United States Patent 7,629,444 (NUCLEOTIDE AND AMINO ACID SEQUENCES FROM XENORHABDUS BOVIENII STRAIN XS85831 AND USES THEREOF) - sequence listing, part 2

SEQ ID NO: 3639 - DNA, 657 bp, Xenorhabdus bovienii
  Coding sequence Name=Xb4151_4152.C440.gene18.dna; Position on contig =10877..11533bp; Strand=+
atgagccggtttcgtcatgcgctgaaaaaccgtgaccagcatatcctgaccctgcggcttgcctgcggggtgctggtactggtcttgctgatcacgctcacgggctggatggcctcaccgcgcaatcttactatccataatccgccggacttacgcagcggcagcacccgcccgtggtgggaagtccctgcgccgagtgtctacagttttgccttttatcttttccagcaactgaatgcctggccgaaaaacggggcacaggactacccggccaaaattgcggccttatcgtcttatctgaccctcgcctgtcaggattttttgcaggcggatgctaaaacccgggccgacagtggtgaactgctcgaccgggtgcgggtggtgtatgaaattcccggccggggctacggggcgaaaagtgtaacggtgcgtaaccgggataactgggtggtgcggctggatttggtggccgatgagtattatcacgccgagccggtcaaacgggcgctggtgcgctatcccctgaaagtggtgcgctgggagggcgatgcggagcgtaatccttttgggctggcactggattgttacgacgggatgccacagcgactggaagcgatgccgcaacctttggaagagaaaaagggggtgttccaatga

SEQ ID NO: 3640 - DNA, 837 bp, Xenorhabdus bovienii
  Coding sequence Name=Xb4151_4152.C440.gene19.dna; Position on contig =11530..12366bp; Strand=+
atgaaaagacatccatcttgcttttctgcctgtttttggccgggactggtcagccttttgttgttcagcctaggggcaaaggctgatgaactgatgaaatgggaacgcattccgttaccggtgacgctgaaagtgtgtcaggagcgaattatttttgctgaccggaatgtccgtgttggtttgtccccgtcactcagcgataaattgcgggtgcagagcgcaggcggcgcggtttacctgaaagccagtcatgccttttcgccaacccgcctgcaattgcaggacagtgaaaacggcgaaattatcttactggatatcaccgctaccaaaacggggtcaacggaacccgtccgcattctttatccggatgaaaaaagttctgccccaaaagagggtgcacagcttcagagaaaatcagtaccttcggctcccgtgcctgtggtattaacccgctatgccgcgcagcagctgtatgccccgctgcgtaccgttgagccagttacgggtatccatccggtcagtctgcatttacccgtatccatcacgacactctatccttcagaaccgattgcggtttccccgctggctggctggggcgtgcaaaattacgcggtggtagccctgaaactgcgtaatacggtcaaacgcaacatcacgctcgacccacgggccttgcaggggaaatttgtctcggcgacgttccagcatcgctggctgggtgaagccgggacaccggaagacacgacggtgctgtatcttgtgacgacaggacagccggagaacgcttttctgcctgagccgatagcggtgaagccgggaggccgcgatgcaggttaa

SEQ ID NO: 3641 - DNA, 1431 bp, Xenorhabdus bovienii
  Coding sequence Name=Xb4151_4152.C440.gene20.dna; Position on contig =12356..13786bp; Strand=+
atgcaggttaaatccaacagtctggtgaaaattctggtgccggtggtgctgatggttggcggatttatcggcatcaaaagttgcagttcaaccgacactgccccgcccgctacgccgcaaaataatgccctggccaccctgtcaccggaggagctacaggcgctgggtgtcggcggtgatacgccggaagataccttgcgtacgctggtgggaacactcaataaagtgcggtcagagcagcaacgcttaggtcagcagaatgccgatatcctgaaagaaaatgaccagttaaaaaatcagcgtcaggatgtcgccggtcagatagacgcggcggtggcagctatccggcaggacgatgaacagcgccggcgtgaattacaggatgaacagcagggattgctggcacagattgatttactgacggaacgcttaaattcagcgcctttgtctgcgccggacagtccgataccgcctgggtcgggaagtattccgtattctgccaatgcaggcacagggcagaatgaacttatctggatagcacccgccgatgaaaagcccgcagacatacaaacccccggcagtggaaaagccacggcacaattcccgacctcatttttaagtgaacagtcagccgccgggcaaaataagccccaaagcccatcacttcaaaacccatcaaaggaagaaaatgaaaagccggtctataccctgcctgaaaatgccacgttagtcggtagtcaggccatgacggcgttattaggtcgggtgccagttaatggcacagtcaccgacccctatccgttcaaaatccttatcggcaaagataacctgacggccaacggcattgaactgccggaggtggaaggggcggtggtatccggctctgccagtggtgactggacgctttcctgtgtgcgcggtcaggttaattccatcacggttgtttttcaggatggcacggtgcgtaccctgccgggcagcgggcaaaacaacaataccagcgcgaacggcatcggctggctgtccgatgaaaacggcattccctgtatcagcggtgagcgcaaatccaacgccgccacctatctgccgaccctgtttgcgctctcggccatgaattcggctggcgatgccctgagtgaaagtcagcgtactgctcagaccagcggcacaggcggtatcaccacggcgttaacgggcaatgccggacaggccgcattaggcaaagcgatgtcaggtggcatgaatgacctgagcgaatggctcagacagcgctacagccagacatttgatgcggtttacgtcccgcccggtgcccggttagtggtgcatatcacacaacgcctggcaattgattacgaagtgaaaggacgtaaggtgcgctacggcgtgagtgagaccgccgaacgtgataatcaggaagcattagattaa

SEQ ID NO: 3642 - DNA, 357 bp, Xenorhabdus bovienii
  Coding sequence Name=Xb4151_4152.C440.gene21.dna; Position on contig =13786..14142bp; Strand=+
atggaaaagatcccttctcagtggatattcagtgcgggttccccgtattgcctgcaagtgccggtgacgtcactggctgaacccacacgggtgcagctttactggcgtgcggtgcgtaaaaaagagtgtcggttgtatctctcaaccgacagagaatgtcagccgttgagtgacggtgattttactgtcttccgcctgacggaaacccagtggcaggcagtggtggacggtaaaatcagcatggcgcctgaacagtgggtgcctttgccttttaccttatcagagctggcggtacacccggaatttgccacgtttaccgtccttggcaccccggaggccgccgtatgcggaaaataa

SEQ ID NO: 3643 - DNA, 402 bp, Xenorhabdus bovienii
  Coding sequence Name=Xb4151_4152.C440.gene22.dna; Position on contig =14130..14531bp; Strand=+
atgcggaaaataaaatattattggctgttggggttggcagggctattagtcggatgtaccacttcgaaagacgccttactccctgccggaaagcagacagtactggcaatgtggcaggggaataaggcaggtcatgccaccgaatcggcaagggaaacactgcgccgttctttaactgtatctgaacggctcagggctctggaagaaccttatcattacagccgttcagccgcgcaggaaatcagccagcagtttccccgcttacccaatcccgatatggtgatgtatatcttcccccatctggttgccggcaacacgccgataccgggctacagcacggtatttccgttttacagccaagtacagtatgccctgccgggtgaacgcacggaggcactgtaa

SEQ ID NO: 3644 - DNA, 2766 bp, Xenorhabdus bovienii
  Coding sequence Name=Xb4151_4152.C440.gene23.dna; Position on contig =14531..17296bp; Strand=+
atggaaaaactcaaggcactgaaccgccccggcaagctgcgtgaagcggatgaagccgccatttatcaggccaatccttctattattgattacctgccctgggtggaatatctggaaaaagaacaatgcctgctgctggatgacgggatttccgttggcgcggtctatcagattgaatccattgccaccgaaggccgtcccgctgagcggttgactgaaatccgggatcaactggaagatgcgatccaggacagtctggaagaagatgatatttcgccgtgggtggtgcagtttttttgtcaggatgacgatgatcctgctgactatctcaacaccttgcggggctatgtgaaaccctgggcacagggaacactgtttactgacgcctttctgacggaatcagagtatcacctgaacagcattgcccggcctgacgggatatttcaggacagcttaatcaccgggcaaccgtggcggggccagcaacgccagacccgtatggtggtttaccggtggcttccgcccacgcgaaaatcccgccatgacagccaaactttatcggctgttgccgcccttaatcaggtttgcgagcggctggtctcatcactggcttctgccggtgtgattgcccgccgacaacatggcgggcagatccaccgttggttgctgcgtcattttaatccggcgccggactgggggatggcaaaagccgatttttaccgtaccgtcagttatgaagcccctatacaatcggatctccccgtcagtaatgactttgccgaaagcctgtggttcaccccgccggtgtctgatcccgacgcgggcgtctggtggtttgacgggttaccgcataaagcggtgctggttgagcgtctgcgccgtccgccggaaccggggacactgacaggcgaagtgaaacggggcgacaatatcaatgccctgatggacatgatgccggcagggacggtggtttcgctgaccattgtggcgcaggcacaggacaggctggaagaggattttacccggctgacgaaaaatgcggtgggagaaaatactgaatcgctgcgcgtccggcaggatgtgcaggaagtgaaagaacttctggggcggcggcataaattgtaccgcagtgcgctggcctttctggtgaggggcaaggatctggatgatataaaccaccgggtgcatcaattatcctccaccctgctgacagccggattacagcccgtccggccggaattcagtgtgtcaccgctgaatgcctacttacgggcactgccgatgtgctttaacccgcagaaagacaaaaaacacgggtacagccgcctgacctgggtacagcatctggccgggttattgccggtgacaggccgttcgaccggcaccgggcatccggggttcagtttttttaaccggggcggcgctccattgaccttcgatccgatgaacaaacaggatcgcacccagaatgcccacttattgctgtttggcccgacaggcgcaggcaaatccgccaccctgtgtgccgcgcttatccagttaatggcgatacaccgaccgcgcttgtttattgtcgaagccggtaacagttttggcctgctggccgattactacgaaagcctggggctgaccgtcaataaaatcggcatcaggccgggctgtggggtcagtctggccctgtttgccgatgcccatcagctgttgcaactgagtccccggcaattgcgcattaatgaagccgatatccccgataccgatgaacaacaagaagatgagggggatgaacagcgcgatatcctgggcgaaatggaaattgccgcccgactgatgatcaccggtggtgagaaaagagaagaagaacgcctgacccgctctgatcgcggtttaattcgtgaggccattatgatggcggcgcagaccagctttaacgagaaacgccagatggtggcctcggatttacagaatgccctttatgccatcgcccgtaatcaccggcaggatgaacacggccagccgttaatcaccgctcaccgacgggcacgggcagatgaaatggccagcgccatgtcgatgtttacgcaggggttcgagggtgaactgtttaaccgtcccggtacgccgtggccggaagtggatgtcaccctgattgatttgggcacactggcacgggagaactactcggcgcaaatggcactggcgatggtctcgctgattaacaaagtcaataacctggctgaacgggatcaatatcaggatcgcgaactgcaactggtgattgatgaagggcatatcaccaccaccaatccactgttatcaccctatatgactaaagtggtcaaaatgtggcgtaaactgggggcctggctgtggctcgccacccaaaacctggcggattaccccgatactgctgaaaagatgctgaatatggctgaatggtggctgtgtctgaccatgccacccgatgaggtggagcaaatcgcccgctttaagaagctgaccgaagagcagaaagcggtgctgctctctgccagtaaattaccccgttgttataccgaaggcgtggtgctggcaaagaaaatcgaagccttattccgggttgtacccccgagcctgtatctggcgctgggcatgacagaaaaagaagaaaaagccgaacggcgggcattgatgcgggaacatcagtgcagtgaactggaagccgctgttttggtggccagaaaaatggatatcgcacggggattaaaggttgattccggttctgtatga

SEQ ID NO: 3645 - DNA, 99 bp, Xenorhabdus bovienii
  Coding sequence Name=Xb4151_4152.C440.gene24.dna; Position on contig =17330..17428bp; Strand=+
atgtatctaatgccttcatttttcactaccttgtttagggaacctctaaaaactctcaatacaaaaaataaggtcaatgttgcactcatcaataaatga

SEQ ID NO: 3646 - DNA, 192 bp, Xenorhabdus bovienii
  Coding sequence Name=Xb4151_4152.C440.gene25.dna; Position on contig =17425..17616bp; Strand=+
atgaccttattgtgtatgactttttcttgctttttcaggggaaaaaataaactcatcgctttttcatcacataccgaaattaaaaggcatgaaggccggattttccaaaataaaccaaacgttgcaaatcataacaagtggccttcagaatcatcgcaaaattggctcgcagccggcctaccgttcggatga

SEQ ID NO: 3647 - DNA, 291 bp, Xenorhabdus bovienii
  Coding sequence Name=Xb4151_4152.C440.gene26.dna; Position on contig =17638..17928bp; Strand=+
atgaaccaaagatatgttctacccgtgcccgggttttcgctattttcttatttcgttttttctgacaggctgataatggtttctttcgtaacgcttttctctgaatatgaacacgatagccctgttccttcagtgcgtgttcacgcatctggctggcataccctttatccgcataaatgtcccggcttgtatttgaccgttccaaaacggcttcaaaaaactggctatcatatgcggaggcggttcctgtcgcgatgttgcgaatcactttatattttgtatcgacattaa

SEQ ID NO: 3648 - DNA, 306 bp, Xenorhabdus bovienii
  Coding sequence Name=Xb4151_4152.C440.gene27.dna; Position on contig =17902..18207bp; Strand=-
ttggtatttcgaaaaacggatgggcaggaaggggccagggcattgtttgaagaagcgaagcatcagctttcggcacagggattcattcctcgaggtggccaactcattgatgccacgttgattccggttcctaagcaacacaataagaaagaagagaatgaacaaattcgtcagggtaaaacccctgataactggacgaaaaaaaacgatgccagaaagataccgcggcaacctggacgaaaaagcacggtaaaagttattttggctataaacttaccattaatgtcgatacaaaatataaagtga

SEQ ID NO: 3649 - DNA, 381 bp, Xenorhabdus bovienii
  Coding sequence Name=Xb4151_4152.C440.gene28.dna; Position on contig =18165..18545bp; Strand=+
atgccctggccccttcctgcccatccgtttttcgaaataccaaatcgtgttacggtctggaatattaatgacatcggtcaagcgacaaaaacgttgccagctcattcggtcaagcagttgatattccatcttttcatcagaaagattatggaaatgtttcaggataatgatgcgaaccatcacctcagtcgggaatggcgggcgtccgcctttgggagaaataatccgtggcgcgacacggtctacgtgtgtcagccagtgccgagaaatcaacatatttatcaagaacaagcagcggatcacctaattcatcgatttttcgacggtgatattcggatgccagcttgtctttttttaaagcagaacgaggcggtatcatga

SEQ ID NO: 3650 - DNA, 465 bp, Xenorhabdus bovienii
  Coding sequence Name=Xb4151_4152.C440.gene29.dna; Position on contig =18564..19028bp; Strand=+
atgtgctgtgtctacattttactcaattttgtggctgtgaaaagtttttggaggttccctgtagttgccaagttcaacatattaaatacacaacctgaatttgaagatagccatgggcgtaccgtcagacgacgcggatgggttctaccgctgacaccagaaacaaaacacttaggctcctggccagatattcaggctcttctggtcacttcttattttcgttattatttaagttgttgtcaggattctcctgcctttcagttagcaggcattcggaaacattgggctattgaaaatagcttacactggggactggatgtcacttttcgggaagatgattcacggatgagagagcagatcgccacaagaatatttgcccaattacgtaaaatggcgctcaatatcgttaaacgggataccaacagtaagttgagtttgagtgcccgaaggaaatcagccgggtga

SEQ ID NO: 3651 - DNA, 144 bp, Xenorhabdus bovienii
  Coding sequence Name=Xb4151_4152.C440.gene30.dna; Position on contig =19236..19379bp; Strand=-
atggaaatttcattttttattattttaataactatttatgatagttacccatataaaataaaattttctaataattatttaagtatcttcagagggttctgtcgcattaaggtgaggtcaggtaatatggttctgttgcattaa

SEQ ID NO: 3652 - DNA, 114 bp, Xenorhabdus bovienii
  Coding sequence Name=Xb4151_4152.C440.gene31.dna; Position on contig =19565..19678bp; Strand=-
atgccggcctacgccctgagcctgcgcaatctcgaggaaatgagggcggagcggggaattgaggttaatcacgataccgtattaattatactatttaatgaacgtgagggataa

SEQ ID NO: 3653 - DNA, 795 bp, Xenorhabdus bovienii
  Coding sequence Name=Xb4151_4152.C440.gene32.dna; Position on contig =19910..20704bp; Strand=+
atgcgttcagctccatcttcggactctttatctgccagggaaaaacaagccaatttacctaaatttaatccggccacgtttgataagtacgcagaactctatgaaagaatgacttcttggccttatcgtcaggaattagagcttccaacgttagcaaaattacttggagatctctccagtttaaatgttctggatttcgggtgtgggcctggcgtaatttcacgttggctgaatgagcggggcgcaaaacgcattgtcggctatgatatttccgaaggcatgcttaattatgcccgccggcgtgaggaaaaagaccagcgcggaattcactatatttcaaagattaatgaagattataacgtatatttcgatatagtccttgctgtttatgtgatgccttatgcggctaactacgcggacttaatggcgatgagccaaaccatggtcagggtattaaaaccaggggggcgcctgctcacactccctatccaccctgatttcaattcagatcccgaatattatcgcccctttggctttcgtctgattgaagagcagccgcgcacggacggtagcgcccttcggcttcatatctgccagccaccttacgatatcaatatacaggcctactattggtcgcgtccgacactggaaaatacgctacaacaggtcggttttcagacggtaaactggaaatcgttgaatgtgccggtcaataccctgatcccgaatctttcatcctacgttcaatgcccgcatgccgccattcttgaatgtatcaggggggatgcatgttaa

SEQ ID NO: 3654 - DNA, 1164 bp, Xenorhabdus bovienii
  Coding sequence Name=Xb4151_4152.C440.gene33.dna; Position on contig =20680..21843bp; Strand=+
atgtatcaggggggatgcatgttaatcaatgttggccagtccgccttctcccctttagtttccgacattgagtatatcgaccggcatgagtgggatgcgttggtttccgataatgacttttttcacagtcacggctggttaggtggactggattacgccttgggcaagggagacgtctttacactgtacggcaatgcgggattgttaggcggttgcgcactctggggtggcgaagatcagtccgggctgttctatctgccagactacttccccggattggacggtccttggcaataccccttcttgtggggcggagcccgccgttccacgcacaatgaaatcccctgcgtgcaggggagctgccggggtgaaacattgtcgaccatggctgaaatgcttgcccagttggccgggacccggggatattacgcaacgattatgccttttatgccgctgcatcaggccctcgaggttgcccgttactatccccatgctcgggtattgatgcattcaggggaagcgaccctatcggtaccggccggggggcttgattcgcaattacaacaattatgctcccaccacagggtaagagccaacgcggaactggctgcctttgcccgcttaggaaaccgggtggaatggtgccgactggacgattatctactggaggcggcggcagaacttattgctaataaccggggaaaatacggtagccatcaaggtattgactggatgcagcgcatatttgatggacaaaaaaaatcctcagtcatcaacaccgcggtggctgctgtagccaaacgcgatgagcagatcctgggggtaaccatcttctaccgttttggtgaaacccttcatgcccgttattacggttcgaattatcagatagacgataacgacttccgttatttcgtgctgaactattactcctcattagattacgcggcgaaaaacgggatccgtgaatgccggctgtccatctccgcccttagagccaaaacgcggcgtggtgcaaaaatagagccgctcgccgcgctgttgctgttcgaaaatgccgtccctctatcaataagtgaatgtgaagactataaccgccttttttaccaacattaccaacaacaattcggcacacacctgacccacgactgggcgttgcttgattga

SEQ ID NO: 3655 - DNA, 345 bp, Xenorhabdus bovienii
  Coding sequence Name=Xb4151_4152.C440.gene34.dna; Position on contig =21855..22199bp; Strand=+
atgctgcatctgatgtatttactgaaaccgacacaaaaagcccatttggatatgaccgcattttggcattgggtggaaaaacgtgacgaatggttctaccgtacactagaaatgactggagaacgccgttggtatgtccgcactattggtgataacgtccattgtctggaacattacgttacatttgccgacgaagccgcgtggggacagtaccgcagggcggtgtcaaaactctgcaaagatcccgaatgggaaaaaatccgcaccgagcaatctctgtggtgggaaatccttgattcaagtttgttgaacgacgcaccttttatcgtcaatcccaggagataa

SEQ ID NO: 3656 - DNA, 549 bp, Xenorhabdus bovienii
  Coding sequence Name=Xb4151_4152.C440.gene35.dna; Position on contig =22201..22749bp; Strand=+
atgaatctaatacaacgcagcctttatttgctcaacaacgcgcgctttttcacccttgccagtcggcacgctgacaatatgccctgggctgctacggtcaattatgtgccattatttgaaccgttgcggctggtgtggtattcgatgaggatcgccagacattccgaaaatattttctaccatgcagaggtcagcggttcgctgttttgtcatgatatgcaggcaactgcaccgccagggctggacggtgcacagtttaccggctgtgcacgggaaataccccagtgcgaatgcgaatgtatccatcaggattattaccgactcaattttcccgaagcacgggaacgtgcccgctggcagttgccgctgcacgagttttatggtgatggtgcgcgacgcttttatgaactccgtatcaatgactggtggctgctggatattgatggctggctgaaaaccaaagaagacaggcgggttcccgtccctcttgcccaattgattgtaccaaaacaggataatgagtctatcttacccagcgttacccaatga

SEQ ID NO: 3657 - DNA, 192 bp, Xenorhabdus bovienii
  Coding sequence Name=Xb4151_4152.C440.gene36.dna; Position on contig =23045..23236bp; Strand=-
ttggcgaatgggaaatggctctgtctgttctttaatgaacccacaccttacagcagttctttcgcaaagaaggcactcgccttttttaagatcgccttttccattttcaattgtttgttttctttacgaagcagcaacaactcctgtcgctcatctgagattaaagaaccgggtttagatttctcaacatag

SEQ ID NO: 3658 - DNA, 207 bp, Xenorhabdus bovienii
  Coding sequence Name=Xb4151_4152.C440.gene37.dna; Position on contig =23381..23587bp; Strand=+
atgctggcggaaaaattacgcaaagaaggccttactctcagtgattatcgcacccgaaagttaatgaaacagttcggattatacgtcaggcagcgtaaaaactatcgggctccgcgcaaaggtaaagcaatatcaacagcctgtaatctactcaaccggaactttaatccgctggcgccgaatgaagtttggacgggagagatataa

SEQ ID NO: 3659 - DNA, 165 bp, Xenorhabdus bovienii
  Coding sequence Name=Xb4151_4152.C440.gene38.dna; Position on contig =23528..23692bp; Strand=-
gtgtcgtatctgtctccgttgacatatcccatcccactatccggtgagaagacaaatccatcactatcgccagatgtaactaaccctcaggggtctttaaatagattatatctctcccgtccaaacttcattcggcgccagcggattaaagttccggttgagtag

SEQ ID NO: 3660 - DNA, 240 bp, Xenorhabdus bovienii
  Coding sequence Name=Xb4151_4152.C440.gene39.dna; Position on contig =23818..24057bp; Strand=+
atgagaacggatcagggggatgtcggggtctgttgggataacgccgttattgaacgtttttttggcagtttaaaacacgattggctattcaaaacacataatgaaaacccgtcggagatgaaaaaagatgtcctggattatctgcattattacaatttaacacgcttacacacggccaataattatttaacgcccgtggaatatgaaatgaccttcaaaaaagtatccggtttttcttga

SEQ ID NO: 3661 - DNA, 474 bp, Xenorhabdus bovienii
  Coding sequence Name=Xb4151_4152.C440.gene40.dna; Position on contig =24303..24776bp; Strand=+
atgagagaccatcaatcaaatcgaggaaaaaagaaactctaccgtcgggtaaatacaacaacacatcatgtttatcatcatggtggtgaataccgatgggaacgtaccaaacaaaaattgatcagggaagatatgccgcacttccttcccatgaaaagtaaacacagacggggcttggattatacaccgttgtttatgtttctattgagtaaagttggtgaacaatgggatgtgatctatagtgaagccattcagagattagatcgggtagatcctgtattttggatagtcgctctacatgaaaatgatcaacgggattatattcgctgcggtgaatcaagttattataacgggctgtttgtcgataaatccggttttttaagaaaggtcaatccccacttatccgcaaaggatattcctgttctgtgtcaatgttgtactcatacctttaatggggttcagataagccgctaa

SEQ ID NO: 3662 - DNA, 3258 bp, Xenorhabdus bovienii
  Coding sequence Name=Xb4151_4152.C440.gene41.dna; Position on contig =24873..28130bp; Strand=+
atgccagtgcaccccaaaagtcatttttttctgctcagtaaagcaaagtcctttgttaccagcctattgtgcctgtcacttagtcttaatggttatgcagattcagaacctaacaatcggaacgatactacaatccagcttgcggagatcacctcccaatgggggcaactgacccgctcacactcgtccggtgaagccgcaaaaacactggcagctcagcagttctcgtccgcagtgacatcaacactgactccgtggcttaaccaatacggcaatgcccgctttaccttacctttcgacagccgtttttcgttaaaaggcatttcatttgattggttgttaccctggtataacgttacttctagcacggccttcagccagttcggggtaaaaaccgatcacagacagacgacaacctcggtgggtttcggttatcgctatctaaccgataactggttatggggtgctaatgcgttctgggatgcactatggccggagcagtatcaccgttacggtatcgggacagaagcctggcatgataacgtcaaactctctgccaacctttaccagcgcttatccggctggaaaacatcccggcaagtcagcgattatgatgcacgccccgccaatggctgggatatccgggtagaaggcggattacctgcgttgccgcactggggcgggcaggtgatgtttgaacaatactacggacagcaagtgggtttattcggtgacaacaaacgtcagcacaatccttacagcctgacggccgggctgacatacacgccagtgccgttagttacattgggcgcggatgtccggcagggaaaacaggatcaccgggataaccgttttacgctggcactcaattatcagctgggcgtcccgctggcacaacagctcgatcccaacgcagtcgcgccgttacgcagcctgacattcagacggacagattttgtcaaccggaatcataatatggtgctggactaccgcaagcagacactgataacactggattttcccgctcagcttaaaggcgatgcaggcaaaatcatcacttttacgccacgaattacctccaaatatctgctggcgcgtttagaactccgggctgatgaattacagcaagccggcggcagaattgttcatcagacgcctgataaaatcatgctgcttttgccgaaagccatcgataaagtgatccggctttccggcattgccattgataaacatggcaatcgttcccggccatcggaaaccaccctttttatccagccgacggaaatccatgtgcaggttaccgcaaaccgggcgcaggcaagggcggacggtcaggacagtgtgatgtataccgtgatggtgaaagatcgtgacggtaagcctgttcccgatcaaacggtgagctggtcaagtgacaaaggcaaactttcacaaaccacacagaaaactgatgcacaggggctggcggcagtgttgctgagcagtcatcatcacggggagcatagcgtacaggtctcggttggtgataatgtcactgtggctttgccggtgcacttcagcgcggtattgaagcctgttatcaccacagacaaaacgcaggccagagcggatggtaaagatgccgtgacgtttaccgttaccgtaaaggatgctgctggtatccccgttcctcaccagtccgttaagtggcaaaccagccggggcaaattcctgaccttgccgtcaacaaccaataagcacgggcaggccactgccgcattagtcagtttgccctccggtatcgcagaggtgtcggtgatggcgggtgaagagacgttcacggcttcaccggttgaatttttacccgcactcacccacacgttgacctgtgacaaaagtacggccattgccgatggacaggacagtgcgctttgcacaattgacgtgcgtgatgcggctgaccagccgatggtggggagggaaatcgtgtggtcaacagatcatggccagattggcgatgaacaggttatcaccgacagcaggggaaaagcccgggcacgggttatcagccggaaagccggtgtcgcccgtgtccgcgctgacatgtcaggtaccatcatcacggcgggcggggtcacgtttgagcgtcagttgaaatccgttatcatcgcggataaaacccacgccaacggaaacgggcaggaggctatcgtattgactgcgattgttgaagatatactggggttaccggttgaaaatcaggccgtcatctggcacacggataatggcatcctgtcatcagcagagacccgaaccgactcacagggattgacacaaattcagctgaccagcaccgttgccggtgcgcaccgggtatggatccaggttgatgataagacggtgaccgccccgacgctctggtttgatgatgtgctgacatccaccctgcgtgcagataaaacccgcatgattgccaatggtcaggatagcgtcatattgaccgtgacggtgaaaaacctgaccggacaacccgccgtcggtatccctgtctggtggcgctcggacaacggtcactttacagacgctcagattgaaaccgatgaaaacggtgaagcccgtgcgacactgcgcagccagaaggcaggtacagcttcagtaacaaccattattgatgaccaggaagttatctcgccaacggtggaatttatcccgctattacgtattgccgataccgttgccgttgacagtcagggcggtaatgccaaccagaaagcctttggcacccgggggccttcagttttctggcggggcgcgaaatttcgcattatcatcgccgataatacaggccgggtgaactggcagagtgattctccggcggtcacagtatccggtgatacggtggtcgtacagcaacgccctgacggcgtgagactgacaggtaccgatgaagcagagcagcaggtggtactgaccttaacaagcgatacctggttcgagcgttcaggcataacgaaagatttttattttaatgcaacgcaaatttgccaatcactcggcagccagattgcgcccaaatatgcacttgaacggctttatgaagaatggggaaatttttatcactatgagggctgggtgagggagttttatgtggtctccacggattatctttctgccagttccggttcaatggatgcgcagacaaaatgggcattctgggcagaatcggatagctggatgcgtaatgcctggcatcggctggcgtttgcgtgtggaagctaa

SEQ ID NO: 3663 - DNA, 120 bp, Xenorhabdus bovienii
  Coding sequence Name=Xb4151_4152.C440.gene42.dna; Position on contig =28093..28212bp; Strand=+
atgcctggcatcggctggcgtttgcgtgtggaagctaaggcggttctgtgtttacgtgattttgccaaattgatccatgatgttgctcctttcttttgtcaaagaatagactccgtttga

SEQ ID NO: 3664 - DNA, 123 bp, Xenorhabdus bovienii
  Coding sequence Name=Xb4151_4152.C440.gene43.dna; Position on contig =28217..28339bp; Strand=+
atggcagagtctatttggcaggtggaatatgcaatgtcattggtttggtctttctatagcaacaggccaaaccagaagataaatattcttctgacgctttatcacatgagtttctcatcctga

SEQ ID NO: 3665 - DNA, 792 bp, Xenorhabdus bovienii
  Coding sequence Name=Xb4151_4152.C440.gene44.dna; Position on contig =28318..29109bp; Strand=-
atgagaaactcaatccaaaacgaaatcacctttccggaaggctggtttcttttcattaatggcgaaatccccttctattgcgatcatgggtgtactgtcgccgattttgctgctgcgagaaacctgatcggttataacaaaaaaaacgggatttacttcaaatttgcctatgaatcctccgaaatcagagggtatgaacccccgccgggaacctatgttctgaccatcagaaaatacaattacacccacaactccggttattttggccgctgtgtttatgcggaagtgaaacaaacccagtgtccggaagaatttaaaaatatcatgacggatatgctgaacatgtcggcggaacagttcacgtttgaagaagtaaaacgaccgaaaccacagggaaaatgcacacctcagttacaacagtgcattaatgatttttttaccggagtcaagcaagatcgcacagatgaaattatggctttaatcaggtctcccatggatgaaaacgaagaggaaaatattctttatcttcgtaaactgtactacggacactatgaaagcccatatcagagagatgatttagttaaaagtgaaatacataaaacagtggtatcggagatctacaactactttgaatcgctcgataaaactagaaaacttgagaatggccgggatctttttccctttctttttagcccaaaaaaatatgatatcagcaccattgtgcctaaaaatgtgagtttatgcgaagtttttatgaatatgatccatattcaggatgagaaactcatgtga

SEQ ID NO: 3666 - DNA, 279 bp, Xenorhabdus bovienii; identical to SEQ ID NO: 890
  Coding sequence Name=Xb4151_4152.C440.gene45.dna; Position on contig =29372..29650bp; Strand=-

SEQ ID NO: 3667 - DNA, 291 bp, Xenorhabdus bovienii; identical to SEQ ID NO: 155
  Coding sequence Name=Xb4151_4152.C440.gene46.dna; Position on contig =29642..29932bp; Strand=+

SEQ ID NO: 3668 - DNA, 93 bp, Xenorhabdus bovienii
  Coding sequence Name=Xb4151_4152.C440.gene47.dna; Position on contig =29956..30048bp; Strand=+
atgaccaaaaaaactcactctcttgacctagcatatacctcaagtagaaagagtaagatgatatgtttaggagccttatgtgatgacaattag

SEQ ID NO: 3669 - DNA, 660 bp, Xenorhabdus bovienii
  Coding sequence Name=Xb4151_4152.C440.gene48.dna; Position on contig =30119..30778bp; Strand=-
atgaattattatgtactaatgaatgattacaagtcttctttaattccacgatatcttcatgctcttgttgatacaaagaagcaagtgaacgaaaactgggattatgaaggttcagattactctttcccttattacatgaaagaattagagtgtccgaatagtttgtttttattatgcaataggaatgtgggcgctctaaatttcaattattattttcatggttccggacatattgcatccaataaatttattgattttttcaatgaattaaaaacctgcgagattatatctaaaaatttgatagccacatcaattaaagatggaagtgtaattagggatgatttgaattatctctattttataggcaatgacgattttttggatttaaacaactctgaattagaagaagatcgttctggttctttgatgcctcataaattaattattaacaaccctagtaatattgatgtatttacaatacgtagtaccttacttgctgattttttgattttttctgaatctgccgtagagaaatttttaaaaatgaaaataagtggagtaaaaatagtaccacttgatgaggcttttaaaaactattgtttagattatggatatgatattggaagcagtagaaaaagagtgaaaaggaaattaccataa

SEQ ID NO: 3670 - DNA, 273 bp, Xenorhabdus bovienii
  Coding sequence Name=Xb4151_4152.C440.gene49.dna; Position on contig =30778..31050bp; Strand=-
atgaactctgtggaaaatggtattcatatccccggcagtaaaaaagcaatgcaggatgatgttggtaaggggatgaaagtattccatagcagtaatcacaatacatattctggtgaggtaagacagagtatagaagaaattaaacgccgacatgacgccggtaaccttagtgaccgtcaagcaagagacgagataagaaaactccagatgaagatgaaaaataagatttggtcaggtgatgttccctctaatccatgtaagagactaaattaa

SEQ ID NO: 3671 - DNA, 291 bp, Xenorhabdus bovienii; identical to SEQ ID NO: 155
  Coding sequence Name=Xb4151_4152.C440.gene50.dna; Position on contig =31114..31404bp; Strand=-

SEQ ID NO: 3672 - DNA, 279 bp, Xenorhabdus bovienii; identical to SEQ ID NO: 890
  Coding sequence Name=Xb4151_4152.C440.gene51.dna; Position on contig =31396..31674bp; Strand=+

SEQ ID NO: 3673 - DNA, 189 bp, Xenorhabdus bovienii
  Coding sequence Name=Xb4151_4152.C440.gene52.dna; Position on contig =31861..32049bp; Strand=+
atgacccccaaaggctgccaaagaacctttcaactcaactatcgttacaacggtcataaaccgggtatgaaagaaaaaattgtggatatggcaatgaatggctctggcgtgagagacacaggccgtgtattaggtctcggtatcaatacagtgatgcggacattaaaaaactctcgccaaaacaagtaa

SEQ ID NO: 3674 - DNA, 984 bp, Xenorhabdus bovienii
  Coding sequence Name=Xb4151_4152.C440.gene53.dna; Position on contig =32357..33340bp; Strand=+
atggtaaaacacatcgagttttccacgtcaggcgaccctgaggtgatacaatattgcgaatttacccctaccgcccctgctcctgatgaagtacaggttcagaataaagctattgggattaattatattgatacctatatgcgtagtggactatatccaacagcaaatctgcccagtggcctcggaaccgaagccgcaggtattgtgaccaagattggctctggcgtgacatccattaaagtcggtgatcgtgtggcttatgctcaagctacccttggtgcttacagcgaagtacataatgtgcttgaaagcaaattagttgtactaccggacgcaatctcattcgaacaggctgctgcatctcttttaaaaggtttaaccgtttattatctgttctataaaacacataaaattcaagcgggagaaacttttctgttccatgcagcagcgggtggtgtcggattaattgcctgccagtgggcaaaagcattgagcgcaaaattgatcgggactgttggctccgatgaaaaagcagcccttgccaaagcatcgggggcatggcaaaccatcaattacaaccgtgagaatattgtcgagcgcgtcaccgaaatcactggcggagaaaaagtgggggtagtctatgattccgtcggtaaggcgacatggctcaattcgctggattgcctgaaacgacaaggtttgatggtcagtttcggtaatgcttctggaccagtgactgggatagatttaggcattctcaatcagaaaggttctctgtttgtcacccgtcctgcaattaatggttatatcactacccgtgaagaactgaatgaagccagcaaggcgctgtttgatttgattgccagtggcaaaatcaatgtcgatgtggcagagaaccagaagtttccattaagtgaagctgcaaaggcgcatcgcacactagaaagccgcgtcacccacggctccagccttctgattccttaa

SEQ ID NO: 3675 - DNA, 1038 bp, Xenorhabdus bovienii
  Coding sequence Name=Xb4151_4152.C440.gene54.dna; Position on contig =33368..34405bp; Strand=-
atgcacgaaaatacacatatacaaaaacatagtgaattcactgccatatcaacgagtgctggtaaattcaagtcttctcgtttctccgttgcccccatgttagattggactgatcgtcattgccgttacttccatcgtctgttgagtaaggaagctttgctttacactgagatggtgacaacgggtgccattattcatggtaaagggaattacctaacgtataacgaggaggagcatccgctggcattgcagttgggcggcagtgaaccccaggcgttggcgcagtgtgctaagatcgcgcaggagcgaggttacgatgaaatcaatttgaacgttggttgtccttctgatcgggtgcaaaatggccgctttggtgcttgcttgatgggggaagccaaattggtggcagacggcattaaggctatgcaggatgttgtggatattcctgtcacggttaaaacccgtatcggcattgatgaacaggacagttacgaattcttgtgtgatttcattgatacagtcgtgaaaaacagtgattgcgataattttattatccatgcacgtaaggcttggctatcgggtctgagtccaaaggaaaaccgtgaaattccaccattggattatccacgggtttaccaattgaaaaaagatttcccacaattaactctttccattaacggtggcattaaatcactcgaagaagcaaagcagcacttacagtatgtggatggcgtgatgattggacgggaagcctaccaaaatccctctattctggcgcatgttgatcgtgagttgtttaatgaaacggcattggtggtgaacaccattaatgcgattaaggcgctttatccttatatcgaacgggaattgtcaaaaggcacctatctggggcacatcacccgccatatcttgggaatttttcagggaattcccggtgcgcgtcagtggcgccgccacttgagtgagaatgcccataaggccggtgctgatattatggtggtggaaaaagcactggagatggtgactgagcggatgtga

SEQ ID NO: 3676 - DNA, 1110 bp, Xenorhabdus bovienii
  Coding sequence Name=Xb4151_4152.C440.gene55.dna; Position on contig =34493..35602bp; Strand=+
atggcctactatagcatagaaaagcgccctcgcgcagatggcaccacccgctatcgctgcaccgttggcgttaaatctggtggtaaatatatttacagagaaaaccgcacatttgggaagcagtcccacgccaaaacatggggtgctatgcgggttgctgaactggaacaaaacggggttcctacgcaaaacgataccgaagagttgacagttggtgagctgctatataaatacatcaatgacccaaatctaggcgtgaaagcaggaagaactaaaaagtatgtattaaacatgcttctagatagtgatttagcaaaattaaccctaactgaactttcagttagtcacattatcgaatattgcaagcaaaggcattctactggtatcactccctcaaccatcaatcatgatgtcagctatttaacgtcagtattaaaatcagccaagccaatctataacatagattatgtctcaaatcccgcatatgaagcacgccctttgttaattcaaatggggcttataggaaagtctcaacgccgtagcaggaggccagtgcaagatgaaattgacaatctcattgaaggattgcgcaagcgcagtagtcatagagagggaaaaataccctatgaagacattttgaatttctccattcttagctgcatgcgcataggggaggtatgcaaaataagatgggatgatatagatgagaagcaaagatctgtcatagtcagggacaggaaagacccaagaaagaaaacaggtaatcacatgtctgttcctctactgggaaatgcatgggaaatagttcagcggcaaccaaaaacgagtgaatggatatttccctacaattccaaaagtgtaactgtggggtttcagtgcgtccgtaatgctctgggtattcaagatttacgttatcacgatctacgcagggaaggagcaagtcgattatttgaggctggcttttctattgaagaagttgctcaggttactggacaccgatctctcaatgtattgtggcaggtatacacagaactgtacccgcaatcattgcatgataagtttaatagactgatgcagcagaaagagaatgattccacctcgaccatctaa

SEQ ID NO: 3677 - DNA, 171 bp, Xenorhabdus bovienii
  Coding sequence Name=Xb4151_4152.C440.gene56.dna; Position on contig =35580..35750bp; Strand=+
atgattccacctcgaccatctaaagaaaagcgcgagattgtggaactgcgggaaagaagctactgtcactatagggcagaaatctgccctttagcatatggggtatctgcacaaacaaaaggtattgaggaaatcccaataccctcacccgtgagtataaaaccaaagtag

SEQ ID NO: 3678 - DNA, 858 bp, Xenorhabdus bovienii
  Coding sequence Name=Xb4151_4152.C440.gene57.dna; Position on contig =36086..36943bp; Strand=+
atgcaagataaaaagcctgatgtgcctgtctcagaagatagcaatctcgttattgttacaacaccggaatatgtcaaagattcaatcaaagaagccattgcagcacacgccacaagccgtaaccatccttatgcaactcaggcagaaccgggatttgtcactttaaataatgaagtcaatagcgatagtgagttaaccgtcgcaacctctaaagcagtaaaaacggcatatgacctcgccaatacagccaatcagaataccaagagtgcaaacgagagcgctgataacgcaaatgataatgccaatactcgcttagcaaaagaccagaacggagccgatattcctaataaggaagaatttgttaaaaacctcggattagagccaaggatggaaggattggctttacctgttggcgtccccgttccttggccaacagagagcccacctgaaggctggttgatatgcaacggtgattcatttgataaagtaagatatccaaaacttgctattgcttatccatctggaaaattacctgatttaagatctgagtttattcgcggtgcagatgcaggacgtggaattgatccaactattaatgtgttatccgcaaagcccagccaaatccaatcacacacacatgattatcgtgaccgatattatagcgagaacagtggctctattgatggtgctacaaactgggagtggcaacctgatgggtataacaattccctaggttcaggtagaacggataatgacaataacacatttctgtattataacggcacgaccagcagcactggtggaactgaaacacaccctcgctatatcgcatttttatacatagtaagagccgcttaa

SEQ ID NO: 3679 - DNA, 192 bp, Xenorhabdus bovienii
  Coding sequence Name=Xb4151_4152.C440.gene58.dna; Position on contig =36948..37139bp; Strand=+
atgcatatacaactcataccaacccgcaccttcctgcgggtttattgccatgcttcggcttttcatctcaaatcccacaccaagcccacccaccagtttaccgcccacaatttccccaatccacccaactacccgctaatctcccctattggctatttattgacggctgacgtgacgccgtactcctgctga

SEQ ID NO: 3680 - DNA, 1500 bp, Xenorhabdus bovienii
  Coding sequence Name=Xb4151_4152.C440.gene59.dna; Position on contig =37100..38599bp; Strand=-
atgatctactcagacggcacaacaaatatcgtgtcaggctcggctattgtccggggaacgggcacccaatggaaatccaatattaacggcattgccgcaggccagattatctccattcaatccggtaatacggtgattcagaatgtcatccggtcggtgaattcagacacggaactggtgctggcctttgcaccctcggtcaaccttgataatgcaaactatgttatctcaaccaccgttcccgatacggtttccgatggtgtccggcatatatgcgccattaacgcctatatcatcttgttcctgcaaaacatggaccggtggatgagtgaaagcggcaaggtcgaagtggagatgccgaacgggcagaaagtcacgctggactccatccgggcattgcagacggcggtggaagggaaactggttaaggagcagaacggggcagatattccgaataagccggagtttgtgaaaaacctgggtttagcgggaacgttgaaagtgggggatttcggtgtgggcgcaacgccatcaacagcgaagacctttacggatgcaaatacgttggctgaggctggctggtatgcaggagggggcagtagtgcaaaaaacttctggaacgaatacgcccccattatggccatgactcgtggtggcggtatggataacacaggaatgatcgcacaaattcaggtggatgatacagggttggctagtcgttatcggagtggtaatcagtggacaaaatggaaatcatatgtttccgcaaccagtgaatatttatctgggtttaacaaaatcaaaacaataggattttttaacagcaatgccaattcatctgtttcatggacagattcgtatacacagatagcagtatctttattcagtgatgatgaattcaatatcattattggtggcgatttaggctccgtccccctgtattataggcgaagacgctatggcaaatgggatgataaaattgagtttattacgaccaaaaacacgacctttgacggtagcggttatctcaagaaagcctcccccatcatccaaatctaccccgatggcacctttaccactaacgacgaatccgaaggggcgacagtcaccagactcggcctcggtcactacaaactatccggcatccttggctataactcagacggtgcatggggtgttcatggcggtatcagcgttccccgtgacgtcaatggcaatgagttagtgtatgttgatgataaagtgctgccggatggggctattgaaatcaaagtcacacacagacagaacgcgcatatgcctgcccgattacagaacaggcgcatgaagtcagtggatgagccggcttattacacggatgatgaaccctgtgatttaccagccggcacccgattagacgtccgcgtccagatgccggaggattctatctggaaccagaaacaggtattggcatctgatcctcagcaggagtacggcgtcacgtcagccgtcaataaatag

SEQ ID NO: 3681 - DNA, 663 bp, Xenorhabdus bovienii
  Coding sequence Name=Xb4151_4152.C440.gene60.dna; Position on contig =38650..39312bp; Strand=-
atggattggggtgcatttttaacaacgggtaacggtgttccgtggtggacacccaaaacgacccccctttcttttgtgagaaaagaatcggtctggactgacagatacgtgaagcggatagaaacgggtatcagcacgaaacaaccctgcatggcgtttatgtgtgctcacaccagcaatgtctggtatgcaccttatggggtcatgttcgggggcggttcggaatggggtattgagataacccggggcgagagtggcactgagacttcgatcttgtgtgagatttatctgttcactctggtttatccccagcctgtcccggattggggaattgctgtctgggacgaagcaggaaaatgtgtcattaccagcgatacaaggcctttgagtatcgaaggggaactcagttcccacagcagcaaagaaactgtggtgcaagggaaaaaaggcatattaatgcagaaaacgggttggatactgtccaaatatgatacgcccgatgatacacgaacccgggataacgaaacttcattttccactgcgtttgatggacacaatacccggctaatggcgcgcgtggcagacggtgagacgaactggattatcagtgaacgaacatggaacctgaccagcccttatattgattgcacgctctacgattaa

SEQ ID NO: 3682 - DNA, 345 bp, Xenorhabdus bovienii
  Coding sequence Name=Xb4151_4152.C440.gene61.dna; Position on contig =39297..39641bp; Strand=+
atgcaccccaatccatatatcacctcacgcagtgtagtaagcaatcagccatccctcaacggcgtcgtcgttgccatccgaaatgatgatttgattatcctttaccaaaaattgacgttttttatctacctggtatccccggtcagtacaaagaaagacataagaaagccgcaatccttcattcatcggctcccgggggacagtgagcgcacctgtcgtctgcccgctctccagcttcataaagccagcataaagaaaggggcgaatgccggtattacgctgccgcccctgttcatcccagaccccaaacccgtaatcactcatcgtcgaaattgtcctatatag

SEQ ID NO: 3683 - DNA, 3186 bp, Xenorhabdus bovienii
  Coding sequence Name=Xb4151_4152.C440.gene62.dna; Position on contig =39617..42802bp; Strand=-
atggctaatcatcttattcagggcagtaagggcggcggtgaaagtccacgcactccggtcgagtcgccggattcgttacaatcgacctcttacgccaaaatcttactggcactcggtgaaggggagtttgcagggggtctggacggcaccaatatctttgtggataacacgccgattattggtcctgatggtcaggcaaactttacaggattaaaatgggaatttcgccccggtacgccccatcaggattacattaaggggatgcctgccgtagagaatgatattacggttggcacggagttagttgagtcatgggtgcgatctgtgaccaatacccaattgtcggcggttcgcatccggcttttgtgggggccattacaggaacagaaagaagacaatggggatacggtcggctatgtcattgactacgcgatagatgtggcgaccgatggcggggcgtatcaggaagttttgaagacagctgccgatggtaagacgacaaccaaatacccaaggtcacaccgcattgatttaccgaaagcgatgacgggttggatggttcgcattcgtcgcctgacccccaaacagaccagcgtccgcatatttgacacgatggtggtagaggcgatcaccgaggtgattgacgccaaactgagctaccccgaaaccgccttactctttgttcagtttgatgccaaacagttccgcaacattccccagatatcctgtgagccgaagatgcgcattatccgcgttccggccaactatgaccctgagagccgccattattccggtgtctgggacgggtcatttaaatgggcatggacagataatccggcgtgggtactgtatgacctgatgattaatgaccggttcagtatcggcgcacgggtgaaagctgaaaacctcgcgctggcaaaatgggatttgtaccgtatcgcccagtattgtgatcagcctgtgcctgatggtaagggcggtcaggagccgagatttacctgcaatgtgtatatccagtcacaagaggacgcatggacagttttgcgtgacattgccggtatctttcggggcatgaccttctgggcaaacaacaacatgaatgcgctggccgatatgccgcgcgatatggattatatctatacccgtgccaatgtccgtgacggtaagtttacctatgccagtgccagcgagaaaactcattactctaccgcaatggtgagctggtcagatccacagaacggctatcaggatgccatagaacccgtcttcgaaaaccgcctgatacgccgattcggggttaaacaggccgatatcaccgcgattggctgtacccgccagagtgaggcgatacggcgcgggaaatgggtactgcacaccaatgaatatgaccggatggtgtcgtttgcggtgggattggatggaaagctccccttgcccggctatattatcggggtggcggatgaaatgttttccggccgtgtgctgggtggccgtatcagtgcggtggacgggcgcaatattaccctcgacagggtatcgtctgcgaaggtcggtgagcggttaatcctgaacctgccgtctggcaaagcggaagggcgcacgattcaggctgtcaatgggcagacaatcacagtaaccacggaatactccgagctacccgccactgaaaatgtctgggcgattgatgcctcggatttggctgtccagcaattcagggtgaccggcattaaagagggtgaggacggcgtgtcattcgatatcaccgccattgagcataaccctgataaatatgaccatatcgacaccggcacccgaatagacgtgcgccccatttccgttattccgcccggagttcagccgccgccgaaaaatgtcggtatcagcagttattcggtggtcaatcaggggattgccatcacgacactgagagtcacttgggatgcagccgagagtgcgatcgcgtatgaagctgaatggcgacgggataatggcaactggatatccgcaccccgcacctcgacgcagggctttgaagtgcccaatatctacgccggacgctatcaggcgagagtacgggcgatcaatgccgctgagatatccagtctctgggcgaatgcaccggaaacccgtttaaaaggcaaggagggcaaccctccggcaccgctggggttcagaacaaccccgatcatcttcggtatccagattgactggggttttgcgccccagaccgacgacacactgaaaactgaaatccagtacagcaggacgaatgacggtgagggtttactgttgctggccgatattccctatccccagcgaatgcacacgatgcaggggctggcggcaggcgttgcattttatttccgtgcgcgtctggtggataaatccggcaatcaatccccgtggacggcgttcattcgtggggagtcgtcttcggatacgaactggatcattgatgcagccggtaaggaatttctttccaacaaagcaggacaacggttgcagtctcaaatggactttaactccgaagccatcatggagaacgccgcattgacaggggcagttgttcagcgacagttgcaagtaaacggcaatatgcgagccgaaatactggaagtcaaaaccacgcaggtgaccgaccgggaagcctttgcggagaagatggaaaaggtgcaggccgatgtcggggagaatgcggcggctgtaaagacaaaggcgacagtggtctttgatattgacggtaacggctatgccctcaaagagattgaagccggggtgaagtacaaaggccagctctataaagccgggatggtgataggggctgaggtgaagaatggcgaagtgcataccaatatcggctttaacgctaacaacttcgtctggttcaatccggccagcggcaagatggaaccctttatggcggctaagaacgggcagctttttattcggcaggcgtttattgatcaggccttaatgcgggaggctatcctgtctgatgccatcagatctaaaaattacgtgcagtatcaggcgggctttttgattaatgcggcgaccggcgcttttgaatttaacgacatgcgggttcgggcgggattgcgttgggcaaacggggcgatagcctgctatgaccccagcggacgggttcgggcggccatgggctatataggacaatttcgacgatga

SEQ ID NO: 3684 - DNA, 576 bp, Xenorhabdus bovienii
  Coding sequence Name=Xb4151_4152.C440.gene63.dna; Position on contig =42854..43429bp; Strand=-
atgaatacactacgaacaatacggctttctggcgtgctgataccccaattcggacgagagtataagctggcagtctcatcccccatagaggctatcagggcgctgtctgtcattattgacggcttcgaaaagtttctgttaaccgctaaagagcgcgggctgacttttgccgtattcatcggaaaacgcaatatcagccgtgatgaactggaattatccggtgagggcgacattcggattgtaccggtgatcattggcagcaaaaaggcgggtatcttccagactattctcggtgcagtgatggtggtggccggggtatttgcatgggcaacgccgtatggggttccgctcgtgatgtccggggtctccatgatgctggggggcgtagtccagatgttatcaccgatgccgggcggactggctcgacgggaagatcccgacaataaacccagttatgcgtttggtgggccagtcaactccatcgcacagggaaatccggttcccattgggtacggcagacgcagaataggcggtgccattatctcggcgggtatctatgccgaagatcagcaatag

SEQ ID NO: 3685 - DNA, 462 bp, Xenorhabdus bovienii
  Coding sequence Name=Xb4151_4152.C440.gene64.dna; Position on contig =43488..43949bp; Strand=-
atgtacagtcattacgatccgggactttcacttgcaggaattttgtttatattagtaattagtgcattaataggattcactatcagtttttttataatgcggtatgcaaccagagccaatgaattactggatatccagaaaaaaatactacaagaattaaaagtacaaaatgaattgttatctggtgataaaggaaactcagatattagttcattttatttgaatgaattaaaaaaattacaatctagtgatgtggtgtccaaaagtgggtacgttaatcattcaaatgttgagaagatggcaaagctatataagaaattcatggaagaaattgaaactaaaaatttatctatattttcggctaggaaagcgtttcaatccgagattaacaggttatcgtctgaattaaatgaaaatcagagaatgtcttttctgaatgtttataaagaaaggctaaaatag

SEQ ID NO: 3686 - DNA, 702 bp, Xenorhabdus bovienii
  Coding sequence Name=Xb4151_4152.C440.gene65.dna; Position on contig =44019..44720bp; Strand=-
atgcgcccacatattactcaagctatcatggatcatgccaaagcagaatatccaaaagaatgctgtggtctggtgattcaaaatagtcgcaaacagcactatatccgttgccgtaataccgcaccgtctccgacagagcagttcagtatgcacccggaagattacgctgaggctgaggatgccggcactattatagccattgtccacagtcaccccgatgccacgacacaacccagccagttagatattgcccaatgtgacctgtcacaagtgccgtggattattgtctcatggccggagggtgatattcgtaccattatgccgactgaggggattaagcccttgctgggtcgcccgttcgtccatggtatctgggattgttacgccattgtccgtgattggtatcggctggaacgcaatattgaactccctgattttgagcgctcaaatggctggtgggagcgtggcgaaaacttgtatatgaagaactatgtttcagcaggcttcatcgaatgcagtggtgacttgcagatgggtgatgtgatcatcatgcaggtacaggccaacgaacctaaccacgccggagtgtatatcggtgatgggctgatgatccaccatatgtatgggcagcttagcaaccgagtgtcttacagtggatattggcaagagagaacggtcatcattttacgttatataaaatga

SEQ ID NO: 3687 - DNA, 348 bp, Xenorhabdus bovienii
  Coding sequence Name=Xb4151_4152.C440.gene66.dna; Position on contig =44786..45133bp; Strand=-
atgataaccaatctaacttattgcggatgggataatggtatgaaatatcgttcactttttgtttttgcggtgttgttattttcatcttcatatgcgatggctcagaaagagtattggtatgaaggatgccccaagtattcagaaaagggattgagtgaattaattcaaagaacaaaaactaccccagttaaatctgccagtgaattacagcaatacagcaaaggtgaagtagaggtatatctcaaaaaagcgaaatgtgatatgcacaatttggagaagtacgcaaaacaattagaaaaaaaactgaaagaaaatgaagacatacagaaatctcagactcgctcttag

SEQ ID NO: 3688 - DNA, 741 bp, Xenorhabdus bovienii
  Coding sequence Name=Xb4151_4152.C440.gene67.dna; Position on contig =45157..45897bp; Strand=-
atgacaatcaattcagatctccagcgccttgagccggggaataaagtcctgttattttcggtcgatggctcagcctttggtgggccagaactgtattttcacaatcaccctattccctacacagaagatgaactggaaagcgctgatcagttaccgatgaaatctatctggtggcaagggcaggagtataagccgtggcctgtcaaaattgaaggattgggggttagtagtgatggcagtgccgcctcacccacactcagtgtggccaatctcgatagtactatcagcgccatgtgtctggcgtatcagaatatggcgcaggcgcgtgtcaccatccgtatgacctttgcgcattatctggatgcccgtaattttgccgatggcaacccagaagccgatcctacacaggaaaaaatagacgtctactatattgacagtaagacgcatgaaaacaatacagagattcattttgccttgtcttccccggctgatctgcaagggatacgaataccgacccgtcagattcatggtctgtgtacatggtgtatgcgcgggttatatcgcaaatccccctgtaactataccggtgatcggtattttgatgaggacgggaacccaaccgatgatccatcacgagatgcctgctctggattattgtcaacaggatgcgagctgcgcttcgggaaaggcaatcagcttccgtttggtggcttccccggttcagcgttgttaaggcggtga

SEQ ID NO: 3689 - DNA, 333 bp, Xenorhabdus bovienii
  Coding sequence Name=Xb4151_4152.C440.gene68.dna; Position on contig =45909..46241bp; Strand=-
atgataaaaacattcgattttcccgcacgagtgggtgccgctggcgagtttgaacccgtggtacgttccgttcagttcggtgatgggtataagcaaacatcaggcgatgggatcaactcacagcgggagagttggccgctgtcatttgtgggtgtcctgtcagaaatagcgcccattatggattttctgcgggagcatcagggctggcgctcgttcaagtggcgtaacccgctatctgagttgggactgtatcaggccggaaaattcaatatacaggccagtggggcttatttcacgttatccgtcacgttcacccgcgtttatcatccgtag

SEQ ID NO: 3690 - DNA, 3309 bp, Xenorhabdus bovienii
  Coding sequence Name=Xb4151_4152.C440.gene69.dna; Position on contig =46238..49546bp; Strand=-
atggcaaatttatcgacgttaaccgttggcctgctggtcaatgccgtctcgttcaggtcgcagattacggaggcctatcgtcacgccggacgggaatcggaaaaattttccggtaaggcgaagtctgacgcgaagaaggccgagtcggcttaccactcgctgggcaagtcgattaaatccgtaggcggtcagttggcgctgctgtccggggtgggcttttcgctggggtctattatcaatacgacccgtaaatacggacaggcgctctctgatctgtccgccattacgggggcgacgggggcgcagttgaagacactggatgacgccgcgcagcagttaggcagaaccacggaatttggggcaacccgtattgccaccgcgctgaaactgatggcctccgccaagccggaactgctgaaaagcaccgaggcattggtacaggcgacggaaaagtcggtgatattggcgcaggcgtcaggtatcgaattaccggaagcgaccaaggcactggctttatcattgaaccagtttggcgcctccgcagagcaggctgaccgttatatcaacgtgttggcagcgggggctaaatacggctcatccgaaatcaatgaaaccgcgcaggccattaaaaacggcggcacaatggcggcacaggcctcagtcagttttgaagagctgaatgccgtcattcagatactggccgccggggggatcaaaggcgcagaggcgggtacggctatccgtaacgtcatactggcgctggagaaatccacggataaaaaactcaagccgtctgtggtgggactgggggcggcactggatcacctgaaaagcaagaagctgtccacggcagaggcggccaaattgttcgggcgcgccaatgtcagcgccgcgtcaaaattagtcgtgggaagaggcaagctggaggagctaaaacagtcactgaccgggacgcaggtcgcgtatgaacaggcctcaacccgcgccaataacctcagtgccgatctggatgttttaagcagcgcctttgaagggctggcggttaaggtagggagcagtgcagatggccccttgcgctcgggcattcagggggcaacgagtgccatcaatggcctgtcagaaaacttcaatatggtggctaccgttgccctgcataccctgatccctgttatggcgactaaactgaccgcggggttacgggaaaatgtcagcgcatggaaagcgacggaaaaagccacccgtgacgccgctaaacagcaggcagaaaccgctaagcgcacgattgaatccgcgagggcagaacgtgagcgagccgcccagcaaagccaatggatggccacgcaaagtgtgatcaataagcagaatggcgtttatgttaattatcaaaaggattatatcgccaatagccgtaaaatcagggaatcaatcattacggaaacctcggcaaaaaagcaactggcggaggctaaccgtaaattatcctattcgacccgcctcatgtcgggcgctgcggcgggagccagcggggcactgtccctactgggcggctcattcggtgccgcgatactggcaggctctgccctgtatggtctgtataaccacagcgtccaaacgagagaggggctgaggcaattaaaagacaccacgattgaaactgttgaagagctgcaaaggctttccaaggttaaggttcagctaaagattgatgactggaaggaaaaactagagaaactacagggcgagaaaaaacagttagaaagtaagatgggggggtattctaatatcaaaattaatctcgccaagtctcatgaaaagaatgcatttggtcgtctttttaaccgaagctctaaaactctccttaaaggaagaaatgaaacactgagcaagctggaagatacttatgcgtcaataaagcaaatgcaagaagcaataaagaatggagagcaaaccttttctgtaggaaaatttgacgtaccgcctccctctccccctaaacccgaaggcggtaacaacaacccatggacaggagaaggagcgggcggcaatgataaaggcgataaaaaagggaaacaggttcttaatcaatatcagcaattgcgcaaggaaattgagcaagcccatacaaccagcttagagcgcattattctcagtgagcgagaaattcaggggaaactcattgaggtcggtaagtcgggtctggtttcccaaaatgaattgttacgcctaaaaaacctcaatgccgaaaaccaccagaagcaacgtatagagctggctgagaaatacgccccggcaaaagccctgacccgtcaggaaaaagaagccagtcaggaactcaaggccatttatgatgcccggttactgaccgagcaggaatacctgtcagccagtaaaacgttgtaccagacttcggttaaagaaaagctggcggaacaggctaaagggctggcggctccccgccttgatatggtcggggaagttgatcctgtcattcaactacaaaaccagctcacacagcaaaccgcgctgtacgatgcctattatcgcaatgggcttatcagcagagagcgccatgaggcactggtggctgcggctacgaataagtccaaggaatcgcagtttgcggcttccaaagagctttatgcttctcagggtgactttcaggcaatgcaaatgaacctgctggatgtggtagaacagcggacagggaacgccttaaccgggatgctgatgggcacaaagtccttctctgaatccatgaaagaactgtcggcatcactggcacaatccatcattcaggatctggttcgtattgcgatgcaggcactgatcaccaaggcggtctcggggtttttcgggggcacgggtggcggtgaaacaacactggcgaacggtcaggctgtgccgatgctgcccaagaatatcaaagcttttgctaaagggggtgttctttcctccccaagtctcagtgcttacagtgggcaggttgtgagtaatcccacattatttaaatttgcccatggcgcggggttgatgggggaggcgggaccggaggctattctgccattaaaacggggacctgatggtgctctcggtgttcgtgcagcaggcggcacgggtaatcaaacgaccatcaaggttgatatcgtagtgcatccagagaagaacagtgaagtgaaaacaaccagcggatttgaatcagcgggtcaggatattgcgaaatttgtcgatcagcgattcaaatcattactgcataaaagtttaggtcagggcggtgatttaaatgtggccatcaaaggaggcagaagatga

SEQ ID NO: 3691 - DNA, 96 bp, Xenorhabdus bovienii
  Coding sequence Name=Xb4151_4152.C440.gene70.dna; Position on contig =49566..49661bp; Strand=+
atgaccgcctcacactgcgcctgttcggtatcgcggggaactgggacggaaacaggcagggcttcacccgggcggggtcggtttttcagccggtaa

SEQ ID NO: 3692 - DNA, 348 bp, Xenorhabdus bovienii
  Coding sequence Name=Xb4151_4152.C440.gene71.dna; Position on contig =49774..50121bp; Strand=-
atgaaaaacctgaaagccgccctgttagccccgcgcgcccatgtgaaagcggtggagattttcggtaccgccgtcaaccttcgccgtatgaccgctaccgaattgatggatttggaagacgccgtggaaaaactcagtgaggccggcaatggccgtgaagcctcccgactgaatgtccagattgtgctggattgcctggtggatgacaaaggtaagccgatcccggccggggatttaccgacagccgaagaactgatggatacccacgataacgccaccattattgcggcgattaatctggtgaaacggcattccatcggtacgctggaggacgccgaaaaaaactaa

SEQ ID NO: 3693 - DNA, 468 bp, Xenorhabdus bovienii
  Coding sequence Name=Xb4151_4152.C440.gene72.dna; Position on contig =50118..50585bp; Strand=-
atggcaacatcatcacccgaatatgccgtcctgcctgcggggacgattgtgaaattcggcaagcccggcgataccgttgatcagatgaaattcctgattaactgtaaggcgctgggcgcaacgggtctttccggcggttttatcgactgcaccacgctgatggacaccaacaaacaatttatttccgacatgccggaaggccccgagaaatcattaggtttcattgatgatcctgaaaacgtcgattttacggcgttcctgaatgcagcccagcgccgcgaaaccgtccagttttacatcggcctgccgaacaagcgcacggcgaccatgattctggcgctctccggctgggagatgaatgacatcaacgcccccgccagtgaagtgattcaaatcacggtcaagggcaaacaaaacaacctcgtctggggtatcgccacaaccctcaccaaaggaagtgaatcatga

SEQ ID NO: 3694 - DNA, 420 bp, Xenorhabdus bovienii
  Coding sequence Name=Xb4151_4152.C440.gene73.dna; Position on contig =50607..51026bp; Strand=-
atgcggaggtgcccgatgattagcacgcatctttccggccttgaagaactggggcgcaagttacaggcactggaaaccgacctccagacccaaattctgcgtaaagccgggaaagccgcgatggaaatcgtgaaagaagacatggtcgcccatgccgggtatgacaaaaaggccaaagggccgcatctgcgggacagcattcagatccgttcagccaagtccaagaagtacaagggcggggtaatgatcactgtaggccccgccaacgctcaccggatgaaagcattagcgcaggaaatggggacgattaaacaagtccctaaaccgtttatacgccctgctctggactacaaccagtccgccgttttaaaggtgctcgcggcagaaatccgcgctgccctgtccgtttacagtcaataa

SEQ ID NO: 3695 - DNA, 528 bp, Xenorhabdus bovienii
  Coding sequence Name=Xb4151_4152.C440.gene74.dna; Position on contig =50827..51354bp; Strand=+
atgctgtcccgcagatgcggccctttggcctttttgtcatacccggcatgggcgaccatgtcttctttcacgatttccatcgcggctttcccggctttacgcagaatttgggtctggaggtcggtttccagtgcctgtaacttgcgccccagttcttcaaggccggaaagatgcgtgctaatcatcgggcacctccgcataagtgataataaagtcacgggtgatacggtaacgtttctgattttcggtcagctcttccatcgcctgatgcagtgtcccgcgtgtcaccgcctgcaccggataattcccgatatgaccatgccggacggattcccatgcgaaacggattttttgctcaatctctgcggctttcgggtaattattcagggtaatgatcccgatctgaaagcgggcttcgaccaatcgcgtggccgccagtccggtattgaatttcgggtcactgatacgctggtaagtgatcccctccctcactgtggacgggagtatcagcggataaacgggcaatag

SEQ ID NO: 3696 - DNA, 327 bp, Xenorhabdus bovienii
  Coding sequence Name=Xb4151_4152.C440.gene75.dna; Position on contig =51383..51709bp; Strand=-
atgaaggcgggttcactgcgccatcgtattaagctatttcgccccgttgtgacacgggatgattatgggacggaaaccgtgacatccgagtatgccagcgaaacgtgggcacgggcggaggcgatgtccaaccgcaaaatccgtaccgccgatcagcaacaagtgattgaggttcagcagttcacagtcaggccgagagcagatattgacaccaactggctggttgagcatcaggggcggctctttaccgtgcgtacggttgaccgtaaccggcaagaccgcgccattatcaccacggaggccgatgtgcgtcatgatagagcgtga

SEQ ID NO: 3697 - DNA, 303 bp, Xenorhabdus bovienii
  Coding sequence Name=Xb4151_4152.C440.gene76.dna; Position on contig =51719..52021bp; Strand=-
atgccttttcccaccgtggaaaaactcaaacagcaatgccgtatcgacagccaccatgacgcggaagatagtctgctgaacacttacgcccgtgcggccatcaaacgggcagaaaattacctgaaccgccgtctttatgacgacgttgtgccggacacggatcccgacgggctgctggcctccgaggatgtggaactggcgattatgctgacggtggggtactggtatgaaaaccgggaggcgcagaccttacccgcaggtttcaagtccttgctggagccttaccgttatattcccttgtag

SEQ ID NO: 3698 - DNA, 207 bp, Xenorhabdus bovienii; identical to SEQ ID NO: 1041
  Coding sequence Name=Xb4151_4152.C440.gene77.dna; Position on contig =52107..52313bp; Strand=+

SEQ ID NO: 3699 - DNA, 1041 bp, Xenorhabdus bovienii; identical to SEQ ID NO: 1291
  Coding sequence Name=Xb4151_4152.C440.gene78.dna; Position on contig =52339..53379bp; Strand=-

SEQ ID NO: 3700 - DNA, 183 bp, Xenorhabdus bovienii
  Coding sequence Name=Xb4151_4152.C440.gene79.dna; Position on contig =53302..53484bp; Strand=+
atgtttgccgagatcaataccaataagcgtaacgttttgcatgatggtcttctcctgaaagaaacaccctgccagcataccgctcacagggtggtggggaccatctcattaaccgcccgaaactatttatccatggtgaaattaggctgtattcgactcttttacaagcggttatataattaa

SEQ ID NO: 3701 - DNA, 429 bp, Xenorhabdus bovienii
  Coding sequence Name=Xb4151_4152.C440.gene80.dna; Position on contig =53548..53976bp; Strand=-
atgaaaatcaaaggagcttattgcttgttttttattttatcaatgggcggtagccaagcgttggcactggattttagctacaaaagtgaaatgcctgctgataacaaaccttcagaggagtacctgaaaaaaagagcggggttagaatccaaatcctggaatgttgatacgctgacacaggataacgtgctggcggagaaacgagaggaagagatggggcagtacaacaaaaaattcgagaataaaaatggaatcggactttcttatgattgggagagtaagcacctaaaatcccttcaacatatgcaacaaacgagtcatttctccaatcgccgctgttaccgagctactcgacagaaattggaaaaagactttggaaatggctactcttattcagatattgctgatacttgtggttcttttcactaa

SEQ ID NO: 3702 - DNA, 789 bp, Xenorhabdus bovienii
  Coding sequence Name=Xb4151_4152.C440.gene81.dna; Position on contig =54147..54935bp; Strand=+
atgcattcataccctatttatcatgtcgatgctttcacggaaaaatccttttctggcaaccctgccgctgttgttttgctggataaatggctgacagatgaagcgttgattgccattgccgcagaaattaatctttcagagaccgcctttctggtaggaaatcaattacgttggtttacacctaaagttgaagtgaatttatgtgggcatgggacgctggcaaccgctttcgtcctcatcgaacaccaatcttgccaagataacccgattacgttcacaagcctttccggtgagcttcgtgtatctcatcaagagggtattttcacattggattttgccgctgctgattgtcacgaagaaaaaacgctcgtttctattatgcaggacgctctggggcaaaatatcaacgaagtgttcgcctcacatgatcgctatatttgcgtgatggactctgctgatcaagttctcaatactcaacctgacttcaataaaatcgctgctcttcccttagctgggcttaccattaccgctcccggtgaatcacctgttgattttgtttcacgttattttgctccagcaaaaggtgtcaacgaagatcctgtgacgggttcaacccactgtgttctcacgccattctggggaaaaaggctcaataaatcaacactccatgcacggcaactctccgaacgaggaggcgatatattatgtaaaacagacggcaatcgtgtttatttgactggaaaagcaaaactcttttcccatggacaaatattgcttgaagaccagtga

SEQ ID NO: 3703 - DNA, 117 bp, Xenorhabdus bovienii
  Coding sequence Name=Xb4151_4152.C440.gene82.dna; Position on contig =55349..55465bp; Strand=+
ttgctaaacttgaatggtcaccagagcttcaagctcgtccgggaaataaggagcaggtcagcggattatatcgaggcccgcagtatgagatgcaatctaccttcaatgtcacaataa

SEQ ID NO: 3704 - DNA, 93 bp, Xenorhabdus bovienii
  Coding sequence Name=Xb4151_4152.C440.gene83.dna; Position on contig =55438..55530bp; Strand=+
atgcaatctaccttcaatgtcacaataacttttgtcttgcaaacgggatgcgttcatatagtgaccatttcattagccacccgcgttaactaa

SEQ ID NO: 3705 - DNA, 186 bp, Xenorhabdus bovienii
  Coding sequence Name=Xb4151_4152.C440.gene84.dna; Position on contig =55675..55860bp; Strand=+
atgttatacgtggagagtattatgaaaaaatatattctttcttgtctgctggcaggcgttacgcttttatcttcaatgcagtcttatgctctggcttgtaatttttttcccccagatagtcaagcatggaaagcttgcacggaagtctgcaaactggtgtttagcccctcaatttgtttaaaataa

SEQ ID NO: 3706 - DNA, 108 bp, Xenorhabdus bovienii
  Coding sequence Name=Xb4151_4152.C440.gene85.dna; Position on contig =55848..55955bp; Strand=+
ttgtttaaaataacatcaaataggacggttcattcctgccgtcctactcatgtctcaccaacaccaccccctaacatactcctgcaaccccagtatcatttgctctga

SEQ ID NO: 3707 - DNA, 207 bp, Xenorhabdus bovienii
  Coding sequence Name=Xb4151_4152.C440.gene86.dna; Position on contig =56002..56208bp; Strand=-
atgaaagccaaagcgttatctctttgggataggttaatgttaagacggcgatttttgatagaaacggtcatcgaccaactcaaaaatatttctcagatagagcattcaaaacatcgcagtcagctcggttttttgctggaaattgcggcgggtctaattgcttatacattccaacctaaaaaaaccgagcttgaatttacgggataa

SEQ ID NO: 3708 - DNA, 1143 bp, Xenorhabdus bovienii
  Coding sequence Name=Xb4151_4152.C440.gene87.dna; Position on contig =56298..57440bp; Strand=-
atgattatttccgcttcaacggattatcggacagcagcacaggccaaattaccgccttttctgtttcactatattgatggcggagcttatgcagagcatacccttaaacgtaataccgaagatttatctaacattgagttgcgccagcgtgtattgaaaaatatgtctgaactgaacctggaaacccgtttatttggggaaaaaatggcaatgcccgtggcgttagctcctgtgggtttgtccggtatgtatgcacgtcgtggtgaagtgcaggcagcacgggctgcggccaaaaaaggaattccatttactttatctactgtatcggtatgcccgattgaagaagtggcttcagctattgaccgtccaatatggtttcagctttatgtactgaaagatcgtggttttatgcacaatgtactggagagggcgcaggcggcgggagttaaaaatctggtgtttaccgttgatatgccaattcctggagcgcgctatcgtgatgcacactctggcatgagtggcccgaatgcttccatgagacaaattttgcaagcgataactcatcctcaatgggcatgggatgtgggactaatgggcaaaccgcatgacctcggcaatatttccgcataccgtggtataccaaccaagttgaaagattacattggctggttgggaaataattttgatccgtcaatatcctggaaagacttggaatggatccgcgatttctggaaagggccaatgattcttaaaggtattcttgatccagaagatgccaaagatgctgtgcgttttggtgctgatgggattgtagtttccaatcatgggggacgccagcttgatggtgttttatcaacggcgcgtgctttgcctgcgattgcagatgctgtcaagaatgacatcaccattctgactgattctggtatccgtactggattagatgtggtgagaatgcttgctttgggggcggatagtgtcttgttggggcgcgcttttgtttatgcactggcagcagcaggggaagccggtgtttccaatctgctggatctgattgataaagagatgcgagtagcaatgacattgacaggtgcgaagtcaatcgcagagattaattcaaatctgttggtaggcaagcaaggttaa

SEQ ID NO: 3709 - DNA, 120 bp, Xenorhabdus bovienii
  Coding sequence Name=Xb4151_4152.C440.gene88.dna; Position on contig =57451..57570bp; Strand=-
atgttctgtgaaacaggatcacgggttttcaagcccttcattgcattgtttggtgcattagtgatggtaaacatcatgatgctgggcggagaaaatgcacaaataagttctcaacattaa

SEQ ID NO: 3710 - DNA, 144 bp, Xenorhabdus bovienii
  Coding sequence Name=Xb4151_4152.C440.gene89.dna; Position on contig =57780..57923bp; Strand=-
gtgttttgtaatctcgtgttttacgaggacgattatttaatcggtttgccacaaggttatcaaggcgatgatgccaaccttgttattaattgtgatcctgataactacccgtattcaccaattaggggatcaaggggctattga

SEQ ID NO: 3711 - DNA, 192 bp, Xenorhabdus bovienii
  Coding sequence Name=Xb4151_4152.C440.gene90.dna; Position on contig =58102..58293bp; Strand=-
atgtttatatggttgccggggctagcaggtggtgatcgcccgttagggtgcatagataatggcgattttgatggatttagtagtcgcttaatgtggcgagagagaggagagttgaagggatatctctattatcctgagaaagaatcacggtgcggtgattattttaaatttgatatcacgttaaataaatga

SEQ ID NO: 3712 - DNA, 666 bp, Xenorhabdus bovienii
  Coding sequence Name=Xb4151_4152.C440.gene91.dna; Position on contig =58638..59303bp; Strand=-
atgggaagggatagacaattttattcccattcagtgggaatgttactcactaggataacgtcaatgacacaacaaatgataagtagtagcgacctattttttggcaaaaagattattattgtgcatggatatagtgcctcaccttcatcacattggttcccttggttaaaagaagtgcttactgagcaaggtgcggaggttatggtgcctgcaatgcctgagtcattggcaccgatacctgaaatgtgggctaagatgttgactgatgtaataccaaaggcagatgatgatacaatttttattggtcatagcctcggttgtgtcacgttattacggcatttagaagcgataagttctacggctgaccgaattggagggtatattttggtttctgggtttgattctccgctggagagtttgccaaaattaaatatttttacagccgaaccattgagctatgcattcttgcgtgaagtgacggaacatcgtatttcaatcatttcttccaacgattatattgtttctccgcaatcttctcatgctctggctaattcattgcaaaccaaaatcattaatgtcgataatgctgggcactttcttgatagagagggttttactcgtctcttacctgtctatgatgctttaaaaaccatcgtttcaggatga

SEQ ID NO: 3713 - DNA, 357 bp, Xenorhabdus bovienii
  Coding sequence Name=Xb4151_4152.C440.gene92.dna; Position on contig =59351..59707bp; Strand=-
atgacccgtttatttaatgattctgcaacactggaaaaaattatcaatgctaaaaacccaggtgcagcaaaagcgtatgggcgcgaagtttgtgggtttaaccaatcgatttgggatgatcatcaattggcaatcgtgattgaaggtaatctggcaaaattttctcaaaataacgctttggcagagtttttattgaatacggcagataaaatactggtcgaagcgagtcctgttgatcgtatttggggtatcgggctggcagaagattttgccaatattgagaatccgttgacgtggaatggtttgaatttattaggattttctttgatggctgtacgtgaggaattaaaaatataa

SEQ ID NO: 3714 - DNA, 291 bp, Xenorhabdus bovienii; identical to SEQ ID NO: 155
  Coding sequence Name=Xb4151_4152.C440.gene93.dna; Position on contig =59731..60021bp; Strand=-

SEQ ID NO: 3715 - DNA, 279 bp, Xenorhabdus bovienii; identical to SEQ ID NO: 890
  Coding sequence Name=Xb4151_4152.C440.gene94.dna; Position on contig =60013..60291bp; Strand=+

SEQ ID NO: 3716 - DNA, 222 bp, Xenorhabdus bovienii
  Coding sequence Name=Xb4151_4152.C440.gene95.dna; Position on contig =60681..60902bp; Strand=-
gtggcatttttgtatttctactccggtatctgccaatttaaaaattaccttcttcaaagctccgcaaaataccgcctcacaatttcccctccaatctctatcgaagccgccactgccggcggcggggtaatattggaaagcacaccgaaccagaaaacgaaaatatggtactgttataaccatgaaatacagaattcaatgcggcattctcaggcagcataa

SEQ ID NO: 3717 - DNA, 210 bp, Xenorhabdus bovienii
  Coding sequence Name=Xb4151_4152.C440.gene96.dna; Position on contig =61057..61266bp; Strand=+
atgacgttacacgtggagagtaatatgaaaaaatatattctttcttgcctactggcaagcgctactcttttagcttcaatgcagacttatgctcattctcccagtgaccctgtatgctttcaaacacctacaggggagcattgcataatgccctttgttccaccacaacccgtaattccagttcccccctatattccaccggcaaattag

SEQ ID NO: 3718 - DNA, 240 bp, Xenorhabdus bovienii
  Coding sequence Name=Xb4151_4152.C440.gene97.dna; Position on contig =61170..61409bp; Strand=+
atgctttcaaacacctacaggggagcattgcataatgccctttgttccaccacaacccgtaattccagttcccccctatattccaccggcaaattagccaaattgaatatactaataaaactgagtaggacggagcattcctgccgtcctctcatagctcaccgacactgcgtcctaacacactcctgcaaacccagtatcatttgctctgcggtggcaatgtgttttctgctctcatga

SEQ ID NO: 3719 - DNA, 216 bp, Xenorhabdus bovienii
  Coding sequence Name=Xb4151_4152.C440.gene98.dna; Position on contig =61369..61584bp; Strand=-
gtgacaatccgttgccggctggatgatgacgatccacggtgcgcttatgctggcgaaaggccttatccagcaacggtatccaatcaatcatcatcctcacagtcgctattcaggatgtattacctggcattgcagttagaggcgggtatgggtgagatagaagagcgagccaagatcatgagagcagaaaacacattgccaccgcagagcaaatga

SEQ ID NO: 3720 - DNA, 570 bp, Xenorhabdus bovienii
  Coding sequence Name=Xb4151_4152.C440.gene99.dna; Position on contig =61673..62242bp; Strand=-
atgaaaatgaaatatttcgattatgcaacgttaccgagaacgcaatggtcaggcgggacaggtgaaacaagggatattgtctgctggccggtttctgatgatttcgcctggcgagcctgtttcacgtcaatttatgaaagtgaggtattagggcaatttcctgatattgaacgctccattgtcttattgaagggaaaggggatcagattgaccagtccgggttttcttgagcacgaactggtgaaaaaaatgacacccttccatttttctggtgatattcacgggcatgctgaattgttggatggctctgtccagtgttttaatatcatgacgcgtcgctcttgctgggcttccgaaatttcggtgatatcccatgaacatcttttaccgacatcgcacagtggtgtcctttatgtcttaaaaggtcgttgggaaatgacgggcgccaactgtgttcagcttgcttttggtcaaggggcttggtggttgccggatatacgggaaggtacaattaagccactggtgacggatagccagttgttgtgggttgatttacgcccgattgggtga

SEQ ID NO: 3721 - DNA, 213 bp, Xenorhabdus bovienii
  Coding sequence Name=Xb4151_4152.C440.gene100.dna; Position on contig= 62173..62385bp; Strand=+
ttgtttcacctgtcccgcctgaccattgcgttctcggtaacgttgcataatcgaaatatttcattttcatgccacctcctaaccactcttaagccctgtgtatactcccgaaagacggttaacgtcgaattgtcaacaccaacattcgcaaataattctgcttacgacaacataaatgtgattgattacccgcattcccttagtagcgtatga

SEQ ID NO: 3722 - DNA, 1422 bp, Xenorhabdus bovienii
  Coding sequence Name=Xb4151_4152.C440.gene101.dna; Position on contig= 62358..63779bp; Strand=-
atgacacgttacgaacagttggctggtgcgatccgccagcaaatagaggatgatatttggcaggtgggcgacaaattgccatcactgagggaatcagtgaaatcatcaggattaagcttaatgacggtgctacaagcctatcaattgctggaaagtcagggttggatcgtggctcgtccgcaatcgggctattatgtggccacccggttaacgcaatttgcggcagcgaaaggcggaaaaggcctgcatttaagcgaaagtgtggagatcagcgcctctatttttgatgtgttgcaggcgtgcaaagatcccaaaatcgtgccttttggctcggcatttcctgatccttccttactgaatgagccaaagttatccaaaatactggcctcagttgcccgtcgctttgtccctcacagctctttggagaacttgccgcccggcaatgagaagttgcggcgtaatatctcccgtcgttatgccgcacacggaattcatgttcctcctgaggagatagtgatcactgcgggggcaatggaatcattaagttttagcttacaatccgtgacctcaccgggagattgggtagtgattgaatcgcccgctttttatggtgcgttgcaggccatagaacgcctgcgcctgaaagctatcgcgattaaaaccgatccgcggacaggtattgatttggatgcactggaagagatcgtgcagaaatacccgataaaagcctgctggttgatgtctcgtttccaaaatccattgtgcaacacgatgccatccgaaaataaacagcggctggtggagattctgaatagtagtcatattgctctgattgaagatgatgtttatggcgaactgtatttcgatcaagaaccgccgatgccaatcaaagcatgggataaagaaaataatttcatgcactgttcatcattttcaaaatgccttgctcccggatatcgtgtgggctgggttgcagcaggaaagcacgcaggaaaaattcagcaattgcagatgatgagcacggtttcagccagcgcaccaacacaattggcggttgcggaatatctggctcacgggggatatgataatcatctgcgacggttgcggcgtcagttggaacagcggcaaagccaggttttacgggctatcagcgaatattttcctgattcggtgaaagtgaacagtgcacgtggcggttatttcctgtggctggagtttgaaccgcctttcaatgctaaccggctgtatcaattggcgctgactaaagggatcagtatcgctccgggcagcatgttctctactagtgctcagtttgatcacgcctttcgcctgaatacgtcatttgtatggaatgacgtacaggcttcagcaatgaaaactttagcaggcttgtgtcatacgctactaagggaatgcgggtaa

SEQ ID NO: 3723 - DNA, 267 bp, Xenorhabdus bovienii
  Coding sequence Name=Xb4151_4152.C440.gene102.dna; Position on contig= 63674..63940bp; Strand=+
atgatttcactgattccctcagtgatggcaatttgtcgcccacctgccaaatatcatcctctatttgctggcggatcgcaccagccaactgttcgtaacgtgtcatatagcctgaccttaggtaaagctgttataggtaataaacagataattgtcactattataccctatattcctgtgttttacttatccgcaccttctaacttcatcgccccatatgattcaactaaaataagaggtcactatgtttgggttaagtgcccttga

SEQ ID NO: 3724 - DNA, 1338 bp, Xenorhabdus bovienii
  Coding sequence Name=Xb4151_4152.C440.gene103.dna; Position on contig= 63918..65255bp; Strand=+
atgtttgggttaagtgcccttgaactcgcaaggatacagtttgccttcacgatttcttttcacattatttttcctgccattacgataggtctggccagttttctagccttattggaagggctatggctaaagacacgcaatacagactacaaaacgttataccacttctggtcgaaaatttttgcagttaatttcggtatgggagtagtttctggtttagtgatggcctatcaattcggtactaactggagttttttctccgactttgccggcagtattacgggtccgttgctagtctatgaagtgttgaccgcgtttttccttgaagccggatttcttggcgtcatgctgttcggctggagccgggttggcgaaaagttgcattttttcgctacttgcatggttgcccttggtacgattatttccacattctggatcttagcctccaacagttggatgcagacaccgcagggccatgaaatcatcaataatcaaatcgttcctgttgactggtttgccgtgattttcaacccctcctttccttatcgtctattgcacatgggaactgcggcgtttctcgcatcagcgttcttcattgcagcttccgctgcgtggcacctgctgaaaggcaatgattcctccgccatgaagaaaatgctgtcaatggcaatgtggctgattctgatcatcgccccgttacaggccatcattggtgattttcatggcttgaataccctgaaatatcagccagccaaagttgccgcgatggaggggcattgggaaaatcgtcccggcgaagccactccgctgatcctcttcggcattccgaatcaggaagcagaagaaacccgctatgccgtcaaaattccttatcttgccagcctgatcctgacacacagtacggataaacaggttccggcattgaaagaatttgcccccgaagatcgccccaatgtctttatggtgttctggtcatttcgtgtcatggtcgggctgggcatattaatgattgtggcgggcgtttggggattattactgcgctataaaaaacggttatatgaaaacagaacatttctccggtttatattcctgatggcaccttcgggtcttatcgccattctggccggttggtttaccacggagattggccgccagccgtgggttgtatatggcttaatgcgtaccaaagatgcggtatcggcacatggcgagatccacatgagcatcagcctgcttattttcttcgtcgtttatgctgccgtctttggtgtcggttacgcctatatgatgaaactgattcgcaaaggccccaacaaggagttagcaaatgggcattga

SEQ ID NO: 3725 - DNA, 1008 bp, Xenorhabdus bovienii
  Coding sequence Name=Xb4151_4152.C440.gene104.dna; Position on contig= 65245..66252bp; Strand=+
atgggcattgatcttcccctgatttggtttctgatcattatattcagtaccatgatgtacatcgtgatggacggttttgacctcggcatcggcattttatatcccatgatgaaggggcagtcagaccgtgatttaatgatgaattccgttgcgccggtctgggatggcaatgaaacttggctggtgctgggcggcgccgcgctgttcggtgcttttcctttggcttatgcggtgatcttggatgcactggcaatccccctgactatcatgctcttagggctgatattccggggtgtcgcttttgagttccgttttaaagccacaccagaacaccagccaatctgggataaggcgtttatttctggttcaatcatcgccacttttacgcaaggaatggtggttggcgcggtgattgaaggttttccggtcgagaaccgcacctacattggaggggctttcgattggcttgccccattccccttattctgcggttttggtctggttgtcgcttatgcgttgctgggatgtggctggctggtgatgaaaaccgaaggccatctgcaacagcagatgtatcgcattctgcgcccgctgacgctgctgatgctggccgtcatcagtattatcagcctctggactcccattgcacatcaggctattgccgaacgctggttcagcctgcctaatctgttgttcttcatacccgtaccgctgctcgttatagggtcaagctggaagctgctacaagccaatgggaacaccagccattacaccccatttctggcggcattattgctgatatttatgggattcagtggattagggatcagtatctggccaaatgtcatcccgccgatgattaattatcaagaagcagccgccccaccgcaatcactgggctttatgctggtcggcgccctgttcatcatcccaatcatactggtctacaccttttggagttattatgtcttccgaggaaaaatcacccatgaacaaggttatcactga

SEQ ID NO: 3726 - DNA, 183 bp, Xenorhabdus bovienii
  Coding sequence Name=Xb4151_4152.C440.gene105.dna; Position on contig= 66209..66391bp; Strand=+
atgtcttccgaggaaaaatcacccatgaacaaggttatcactgagtccgatcctccccgcccttccctctggaaacggctcggttggctggtcaccatctggcttggcagtgtgctgacactttacgccgtctctgcgctatttcgtgtcttaatgacaacagcgggaatgaaagttaagtga

SEQ ID NO: 3727 - DNA, 1251 bp, Xenorhabdus bovienii
  Coding sequence Name=Xb4151_4152.C440.gene106.dna; Position on contig= 66458..67708bp; Strand=+
atgaaaactttctctgacagtccaatagcagcaacaggctggttatgtggcacagctattaccatcaatttgtctgtgctgctatttcttgggttgaataccccgcttaccttgcccggaaagctgtgggccatctttgatatcctgagtatcctgtgccttttaagcttgctgtataaagccgatatgatttcactccagatggcatcattttgtaaaataaaacaaagaaagatcactgccttgaaacgggataagcaatacctgcgttttcttatctccatccattctcaacttaatcttaatacttcactctctgataattttcatagggtatttttcaggcttaaccaattcattccctttggcgaagtcaggatcacgctttatcatccaccgcgtaaatatcattttgaatatctccgtagcccctttgacgccaatcttccacggatacaaaaatgggatttatatgaccggcatacttttcacggcatgattcaaatcaagattaatcaaactcagattctgtcttcttatgaacgggatctgatccagtctgttactgatgcgctggcaagacacctgtccctgagaaatactgtgcatcagcaaattcagcagggtcttatcaatgaacgggaaaatatttccagagaattacatgacacagtggcacaatcatttctgtttctgaaaattcagattaacagcctgcatgtgcgccacgataaattctcccgacaggccttaatcgccttgcggatcataaaagaggagataactttagccagtcagcaattaagggaaatgctggccacactgcgggcagaaaaaaatcattatgatctgtatgaatccctgcaatccctgataaaagaattcaatcatcggctgggattccagattgaatttcattatcggctcactcaccagattattcccatcgggcaccgccgtcatttggcgcaaattatccgtgaggctttgaataactgttataaacatgctgacgcgagttggatcagtattcgcatctacccgataggcaaaaagattattacggttatcagtgataatggccacggcatccatcaagaacagattaaggctcagtttggtctcgctattatgcgggaacgggtcactctcatttcagggcaaatgaagatcaaaaaacgcaaaaaaggcggcacagaaattgaaattcaagttccgctacaagatgaacagcgtaatttagaaaaataa

SEQ ID NO: 3728 - DNA, 207 bp, Xenorhabdus bovienii
  Coding sequence Name=Xb4151_4152.C440.gene107.dna; Position on contig= 67666..67872bp; Strand=-
gtgcatgacattgttcatgctgaaagtttagtcgaacaatcgtcccctccggactttgtgatagcggacaaagggtacgatagtcaggctttcagaaatcatattaaacaacaaggtgcaacgccgatgattccctaccgaaaaaaagagctgaatagtcgtttttatttttctaaattacgctgttcatcttgtagcggaacttga

SEQ ID NO: 3729 - DNA, 99 bp, Xenorhabdus bovienii
  Coding sequence Name=Xb4151_4152.C440.gene108.dna; Position on contig= 67885..67983bp; Strand=-
atgccgcgaactatgttaacagacctccaatggaataagctatctgcgttaatgcaactggccgtcgataattacggcttgcctgttcattttgaatga

SEQ ID NO: 3730 - DNA, 117 bp, Xenorhabdus bovienii
  Coding sequence Name=Xb4151_4152.C440.gene109.dna; Position on contig= 67946..68062bp; Strand=-
atgttttgtgggggattattagacagcatgatgatttggtataatcactttcgccaaaaaacaaccaaacctgaccatcatgccgcgaactatgttaacagacctccaatggaataa

SEQ ID NO: 3731 - DNA, 1527 bp, Xenorhabdus bovienii
  Coding sequence Name=Xb4151_4152.C440.gene110.dna; Position on contig= 68122..69648bp; Strand=+
atgattaatcgatatctgatcaattcattttgtggctggctattgttctcatgttgttggttctgcttatgggtgatcgcctactattttgttaatgattcagaactggccattttgttttttccttttgccctgcgccttggcattgtattacatacgccaaaacattattggccaaccgtttatggtgcagaatggttgctgactatctgtctggcactgttgatggggcagcctcaatggcttaccgtactgactgccagcatagccagcctccctattgtctgggttgccagccgttattatcgtggcagtcaatggcagcggctcgctgtcatggcaatggtgatcacagcaaccggcctcattaatgtcgtggcagtgagtaaccataatccatctttgatcatcgtgtttttggtcagcttaaccggtggtgccatgctggtgcctacatgctatttagtctggcattatctgttccaaagtatctggttgcctctgacagccaacgtcgtgtcgcgtcaaatccagtttcgccttcatcacgttatgctgtatgccctgctatttgtactgaacattctgttacaaattggttttcccaatgaattacgctactttgcaccgttctgtctggctatccccattattttgttggcctttcgttatggctggcagggtgccttactggggacattactgaacagcatcgtattgattgctgcgcgtagtggtgtttcgaatatggaaatcaccgacttactgttatcgctcttggcacaaaccatcacagggataatgcttggcatggcggttcagcgtcagcgtgatcttaatacacagttaaagcgcgaactctatcgtaaccgtagtcttgcaggccaattagttaaagcggaggaatcggtacggcgcgatattgcgcgagaactgcatgatgaaattggccagaacattactgctatccggacgcaggctaatatcattcagcgggtcgaagtgacacctattggctcgaattgtgccaaaactatcgaatcattatcccttaatgtttatgataccaccaaaaggttactcagttgcctgcgtcccaaaatccttgatgatcttggtctgaaagaggcgatcgaacaattgctgcgggatatggaatttgaaaactgcagcatatcagtggaaatccattgggaagctaattctgccgaggtcattgagcaattgagtgacacaacaaaagtcacgttatatcgtatctgtcaggaagccctgaataatgcattaaaatattctcaagcggatcgcattgagttgcatttttctgtcagggcaatgatccgtttattgattaaagacaacggtattggctgtaaggctgaagataacatgaaaggatttggtttacggggtatgcgggaacgtgtacaggcactcggtggacaattctccattcatagcggaaaacgacagaatgactcgacaagcgctggtacggatttatcgatcattttgcccaaactttaa

SEQ ID NO: 3732 - DNA, 1329 bp, Xenorhabdus bovienii
  Coding sequence Name=Xb4151_4152.C440.gene111.dna; Position on contig= 69658..70986bp; Strand=+
atgacaggtttttctcaatctaaacccatatctcacggcaatctgtccgatgcagaaatccgggatcaataccgttactggcgcttacatattatattgaatctatatgtgggctatgcgctattttattttacccgcaaaagcttcaactatgcgatgcctgccatgatcaccgatcttggtcttgataaaagtgagattggactcatcgggacgttgttttatatcacttatggctgttcgaaatttttttccggcattatttctgatcgctccaacccacgctattttatgggaataggactgattgccacggggatcatcaatatcttgtttgggctgtccagctccattgtcatgtttacctttctttggatattaaatgcctggtttcagggatggggttctccctcatgcgctaagttactcacgacttggtattctcgctcagaacgtggcttctggtggtcggtttggaatacttcacaccatgtgggaagtgcgttgattgcattgatcgtcagtttcttaaccttgcattttagctggcgagaaggatttatcgtgccgggctgtattgggatcctggcaggtatacttttatgttggcgattacgtgataagccggccacgatggggctgccgaccatcggtcagtttcgcaatgatcggttggaaaaggctcaggaaaatcaaggcaaaggcctgacgaccagagaaatcctgagaacctacgttttccgcaacaaatatatctggctgctttcctttagttacgtgctggtatacatcgttcgcaccgtcatcaatgactggggaaacctgtatctgactgagtatcatcattatgatttagtgagtgcaaacgccgtattatcgctctttgaagttgggggatttatgggatcgctggtcgcaggctgggggtcagataaactctttggcggcaatcgtggcccgatgaatctgatattctcgatgggtattttcttgtcagtagcggctttatggttgatgcctgttacggggttggtttttcaatcgcttggcttttttgcaattggattttttgtgtttggcccacaattgctgatcggtatggctgccgcagagtgttcacataaagattctgccggtgctgcgacgggttttgtggggctttttgcttatacaggcgcggccattgcaggctatcctttcgctattatcctggaaaactatcactggtcagggttatttatggccatttccatctgcgccgtcatgatcggtttattattgctgcctttcctgcaagcacagtttcctaaacaaagggcacaaagttaa

SEQ ID NO: 3733 - DNA, 120 bp, Xenorhabdus bovienii
  Coding sequence Name=Xb4151_4152.C440.gene112.dna; Position on contig= 70933..71052bp; Strand=-
ttgaaaaaatcctccactcgattttattcagagaacgagtggaggacgctctcatactttttacgattaactttgtgccctttgtttaggaaactgtgcttgcaggaaaggcagcaataa

SEQ ID NO: 3734 - DNA, 1467 bp, Xenorhabdus bovienii
  Coding sequence Name=Xb4151_4152.C440.gene113.dna; Position on contig= 71068..72534bp; Strand=-
atgagtaaaaccgcatccgtcggtttatgggatcaaccaaaaccctttttcatgatcttttttgttgagctatgggaacgatttggtttctacggcgttcaaggcattttggccatttatttcgttcaacaactgggtttttcagaagaacaatcatttattacctttggtgcgttcaccgctctggtgtatggcctgatttctgtcggtggttatgttggtgaccacatacttggaactaaacgaaccatcgttctgggtgcgattgtcatggcaatcggctattacatgatcggcttgtctatcatgaaaccggaactgattttttatgcattaggcaccgttgcggtcggtaatggtcttttcaaggccaatcccgccagcctgttggctaaatgttatcaaccacaagaccctcgtctggatggggcatttactctgttttatatgtccattaatctcggctctctgttttccctttcccttgccccggtgattgctgagaaatatggttataccgttacttacaatatctgcggtattggcctgattatcgccctgttggtatatatcgcctgccgtcgtatggtacataatatcggctctgcacctgatcatcatcctgttaagcccatcggcctgattgccgttctgataggctctgtggtcatggtgggtgtctgtgcatggttactgcacaatatcaaggttgccaatatcgccttgttcgcgattaccaccatcgtcgtactgattttcttctggcaggcattcaagcagaacagagtcggccgtaataaaatgttcgtggcgtttattctgatgcttcaggctgtggtgtttttcatcctgtataaccagatgccaatgtccctcaacttcttcgccattaacaacgttcatcatcagatccttggttttgatgtcaatcccgtcagctttcaagcatttaacccattctggattattatcgtcagcccaatactagcggtggtttacactaagctgggagcgaaaggtaaagacttctccatgccggcaaaattcactttcggcatgttcctgtgttctctgggtttcctgaccgccgccgcctccggtttgtttgctgacgcccaaggcattacttcaccgtggtttatcgtgctggtttatctgttccagagcgtaggcgaattgatgatcagcgctctggggctggcaatggtggctgcatttgttcccagttatctgaccggcttcattctgggaatgtggttcctgtcacaagcggtggcatcaatgttggcgagtcatgtggcggcactcactgcgacacccgtaggcgtaactgatcctctgcaaactctgccaatttatatgagtgtgttcggtaaaatcggtgttgccactctgattgtcgccattatcatgacctttatggttccgtggttgaaccgtatcatgagagaagaagtgaaagcttaa

SEQ ID NO: 3735 - DNA, 117 bp, Xenorhabdus bovienii
  Coding sequence Name=Xb4151_4152.C440.gene114.dna; Position on contig= 72899..73015bp; Strand=+
atgcaggacttaaagtctgaaaattatccgccagcgggtagtcagttcctgtactttttctggcaaggtggctcgatacggttatatcgttggtggatatcgttgatattgttgtaa

SEQ ID NO: 3736 - DNA, 783 bp, Xenorhabdus bovienii
  Coding sequence Name=Xb4151_4152.C440.gene115.dna; Position on contig= 72980..73762bp; Strand=-
atggaaaaatctccttcatgttttattaaacttaatattgtttctaatcctgatatacgaatattttgtttcccttatgccggaggaagcagtgcaacttttgttccctttgccaaaaaaatcaaatcaaacgctgagtttttagtcatacaaccccccggtaaaggtagcaggatcagagaaaaacctcatgatgacatgagtcgccttgttgaagacatatatatcaatatcaaaagcttacttgataaaccttatctgttttttggtcacagtttaggtagccgagtcgcttttgagctaataagaaaaattgacgccgcatcattacctctccccctcgaatttattgcctcaggcagtaaagggcctcaggttcctgctatcagagaaccattaagtgggttaccggataaagattttatcaatggattacagacgtttggccgggttgataaacaagtcatcgacaatgccgaattattatctctgattttacccgcaataaaggcagattttaaaatttcggaagaatatcattatattggaacaggaactttatcctgtcctttaaccgtgtttggtggaaaaaatgatgccatagttacagagcaagaactctattcttggttagatttatttgaaaaagagaaaaaggtcatcatttttgaaggtactcacttttttattgatgataataatgaacctgttattgatgcagttcaaaatattatcaaatcaaaaaaattacaacaatatcaacgatatccaccaacgatataa

SEQ ID NO: 3737 - DNA, 108 bp, Xenorhabdus bovienii
  Coding sequence Name=Xb4151_4152.C440.gene116.dna; Position on contig= 74264..74371bp; Strand=+
atgaaaaaggccacgccggagcgcagccttgaatttgttatccgtgatctaaacagggtgttctcgttcgatggctcagtccgtatacactacagtggttattggtga

SEQ ID NO: 3738 - DNA, 534 bp, Xenorhabdus bovienii
  Coding sequence Name=Xb4151_4152.C440.gene117.dna; Position on contig= 74362..74895bp; Strand=-
atgggatggtatcgacattattttaacgatatttataaattacccttacaggacgcggtaaaagatagcgtgaagcttgtggtcagtaatgataaacaatatcattattttttggatataccgaaataccagccaggccccagacttaatatttttggacatggagaccccaacagagcttcttttcaaggacactctgtagaacatcctttatctggtactgaaattgccgggtttccttgccgagagaaattacctgatgcacaccctttatcaccaagcgatctggcagaaagtatcaaaccactcattttactctatcacatccgaagtattcggttggttgcgtgctataccggaagaacaggctttgctagggatttatctcaatttacggggttacctgttaaggctccaatacaccatgttgatgtgatggaatttgttactacaggttgttactggataataaaacgacaagaagagtcagaggaagcggaacgaaatttccgttggtttgggtctcaccaataa

SEQ ID NO: 3739 - DNA, 213 bp, Xenorhabdus bovienii
  Coding sequence Name=Xb4151_4152.C440.gene118.dna; Position on contig= 74973..75185bp; Strand=+
atgtctttaaacattataataacaaaaataaaatggttgttttttgcccatcaaagatcctgtgactggtgtagacatgcgttcccccagaaaacaaaaaaaacgcatcgggcgctgagggatccccagaaatcagcgctaataaatcaaaaccatactttggtagattctggcgaggtatttgagtgttttattaagtacaatttcaaataa

SEQ ID NO: 3740 - DNA, 114 bp, Xenorhabdus bovienii
  Coding sequence Name=Xb4151_4152.C440.gene119.dna; Position on contig= 75358..75471bp; Strand=-
atggcatcaaatgaatgctcgttctcatccggtcaagaataccttccaaggtcaaacggtgttcaggtttgtcataaacccatccgcagtgttgcatcaatgcagttagcttaa

SEQ ID NO: 3741 - DNA, 153 bp, Xenorhabdus bovienii
  Coding sequence Name=Xb4151_4152.C440.gene120.dna; Position on contig= 75596..75748bp; Strand=+
atgcggttattgaggtacttattctggcggattttgatggtcttttcctttgatttatcggtattcagcaaggcgagctccccgtggtggggtagggttttacggaaaaaacgcaaacctgactatgacagcgcattggcggcactgaaataa

SEQ ID NO: 3742 - DNA, 1917 bp, Xenorhabdus bovienii
  Coding sequence Name=Xb4151_4152.C440.gene121.dna; Position on contig= 76254..78170bp; Strand=+
atggaaaggatcattatagctcactcctcattaggcgatgaatccctgatatttaagtcattgaaaggaagggaaaaattatcaactatttatagttttgaagtggagcttttcagtgaaaagaaggatcttgacatcaaagagttacgaaacaaacccctgtcaatagagataaaaaattctacaaatatttcagaaaaaccccgctttttaagtggaattatccgtgaagccactatttgtgattattatgaccattactactatttatataaggtgattatccagcctgagttgttcattctcactttaaacaaagatttcagaatctggcagaaaaagacggtgcctgaaattatttcagacgttcttaataaatataaaataaagtttaaaaatgaactcaatgcgaaataccagccattagaatattgcacccaatataaagaaactgatttcgattttttaagtcggttaatggaacgtgaaggaatttattactatttccaacacgataagaatgatcacacgcttatattggctgattccccccaatcccattcagccttaccagagcaggcttctattgaatattatccaagccatttttcaccgaaaaacaaagacaaatattatctatacgactggattgtaagttattcaatcaatcccaagctctataccatgagtgactataacttccttaagccaaatgcacagctaaaagaaactcagcagaatccagatccgacagtgccaaaaacagagctgtttgagtggccagggaattataccgaaaatgcgcaaggacaattttatgtccgagtactacaacaatcctataccgcgcaggatctgtatataaaagcgaaaagcgtagaatccggcattgcgccaggctacaccttcacattatcaaaagccctgcgggatggagacaacggcgactatcttattgtcagtgccaattatgagtttcatgaaaatccctatattctgggagacaatgaggttgatgccgacaacataaataaaattatcactgagttcaccgccatccccgctaaagtcaactggcgtgctcctcgcacaacatcatggcccatagcaggtactgaacgagctaccgttgtcggggcaagcggcaaaaccatttggactgatgaacatggcagagtcaaactcaagtttcactgggacagaagcgatataaaagacgataaaagttcctgttggatacgggtatccaacaattgggcgggatcaaagtttggggtaattcaggtgccaagagtgggggaagaagttatcgtcaatttcattaataacaacccagacgaaccattggttgtggggcgcagtttcaaccaaaacaatatgcctccctgggaattacccgcagaagccaccaaaatggggataatgtcacggagtttagagggcggaaaagataatgccagttatttgttgattgatgatgctcaaggaaaagaatccttcgaaatacatgccgagaaagacatgacagtctcagtggaacacgatcaaaccgtttccattgatggggcatctatcacaaagatcaaaaacaaacaacaaactaccgtgaccaatggcaaggaagtcgaagtcaccagtggtggtattcaatataaaattactgacggatataaagcagatatcacgggtgataaatcagaaaaaatcagcagctcttatcagttagaggttggacgcaattttgctaacaacatcagtggaaattacaacctgaatattacggggaataagaaagagtcagtgacaggaaacgccgaaattaaagcaagcaagttgtccttggcatcgagtaccacaatagatattaacggtgcagcaaagatttccataacggcgggactcattctattgggttaa

SEQ ID NO: 3743 - DNA, 2595 bp, Xenorhabdus bovienii
  Coding sequence Name=Xb4151_4152.C440.gene122.dna; Position on contig= 78205..80799bp; Strand=+
atgaaaattatcaaacctctgcgcttaagtctgctacatcgtccttattactggcggcaacatcactatcttggtgtctccattatggctttaactgatatgggtgcctcccctcgcctgcggcctgagcctgaactttggcaacttgcagaggctgaactgaaaaccactaatagcgttgtcgatctcgccatccctaaatcttccgctgaatttcttgcaacgggctatgcctatactcatcaccagcctgataaaaccacgtgttctgcacgtatccagatagagcaattggataagacacttattgtctctggcgatcgtcattggattggcgataagccatccacgccgcaggcatttgaacagatgcggttggattggagccgtgctttcgggggaaaaaattatgaagaaaatccatatgggatcggctttacgccagaactacaggaaaatggcctcgaaactcatcgattacctaatgtagaagaccaaaacagacaacttttgtcaccgcaggatacccctaatcctgcgagtttttgtcccctcgaatttgggtggccgcgccgtttcacccgtatagggaaaaaatatgacaaagagtggctggaaaatgaattccctggtttttcccgtgatatcgactggcgattgtttaatgctgctccccctgatcaatggtgggaacactatcaggcactaccagaaaacgcagcatggcgtatttggaatatgcatcctgaaaaacctatgcaagaaggcaagctgccaccgtggcaggcgcgttgtttcatcaaacggctgcgtgctgacgaagatattttcgaagagattgccatgcgcaatacgacggtgtggtttttccctcatcgggaacagatgatcctgatttggcatggttacacacgcgttaatgaagatgatgcgactgatgttttacacatgctctccgcaatagaactcaatagcgaagcacactcagaaaatgactatcttcaagtacttaaccagcgtacagagaaagaaaaaggcgcattatatgccctgcgagaaaaagacctgatccctgaaagcattattggcccgtggatagatacagagcaatcggagcatggcagtcctttgagggagaatttgcaaaatcgcgagaaacgcctgcgtgaacaacacaaggagcgcatggcgaaatatggaaaagatatcagcacactaataactccctgtattgaacaacccgctaatcccaaagcggatgaattacctgaatttgtagacaaaatagagcaagaagctgcccaaaaatatattgcagccgagcagcaacgggaaaaaattcgcacaatcgctcaagagcaaggtgttaaggtggagcaggtagcgatgcaaaacacccccagagggccacaaaacttccaccaaatacgggatatcttgtaccaacagcaagaaagtcaaaaacaagttgagccaaaatcaatagaacttaacgataaaaaactgacacagattgaacaatccctgcataaaatgtatctggcctctgcacagacacaaccgccagccctgcgcttgaccggggatctgtcacaaattattcgcaagcaagtccagcgtattatgcgggaagggggcgatttccgtgcaatggattttaccggagcagacttatcaggaatggatctacaaggagccaatttttccggtagtttgctggaaagtgtctgtttcaataacagccaattggatggcgcagatttcagtgaagccatgttagccagagccgagatatgccatgcttccctatatggtgcaaaactggataatgccagtctggcacaggcaaaatgtgaacaaagcgatttttcagcggcaagttttaaagaaacacaattgcaggaaacattgctcaaccattgccgatttaatcatgctatcttcacggatctgtttttacaaagaaccttcatcaaacactgtcgtttccaacactcgcaatggcaaggctgcatttttattgagatgatgctacctgctctaaaatttagctatgccagcttaaataaagtttcctttatcaattgcctgctggagaacgccatttttgatcacgctgtactcgacagttgttcatggatagaaaccgaagcagtggcaatccggtttcgatcagccaaactgctaaactgcgtatttaccatgaaaagtgtgcttaatcatgctgatttcagttatgccacattaacggaatgtaatttacgccagacacctttagttcaagcctctttccactctgccacactgaataacagtgattttagcgaagccaactgccaattggctgatatgcagtatttaaataccacccaaagtatatttatcagaacgaattttaagaatgcattgttgaataatgccaacctgatcggcgcttttatgcagaaatgtactttttgtagcactgacttacgcgaagctaatctgttccgcgctgatatgtcccagtccatcatagacgactccaccttgattcatcatgcctatacacaacgtctcaaaaccttacccaaacgtgatcaggacgtgatatga

SEQ ID NO: 3744 - DNA, 1074 bp, Xenorhabdus bovienii
  Coding sequence Name=Xb4151_4152.C440.gene123.dna; Position on contig= 80796..81869bp; Strand=+
atgagtatgctgacagttaatgagattatagctaagatcaaacagcgagacgtcattgaacaagtcaatttgcaggggatctcgctggttggacaaaacttatcaggaggcaggttctgggctgtagacttttcaaatgccaacttctcccatgccattcttgaagagtcagtctttactgaatgcttgtttgaagaaacggttttcaattccgtcaggtgtgaaaagaccttgtttgaacagtgtaatatgatacgtgctgtgttcaataaggccacactgagcgccagtgtgttcgaccaatgcgtcttaaaaaaaacacagtttaaagtcacaaaacaaaacagtacccagttttcatcctgccaattgcaatatgctgattttattgaaaatgaatttgatcgcgccacctttatcaactcagtattgcattacgcaatattacgcaatagtcacttttttctggtcaccttttttcgtcaggacttaagaaaaacggatttttatgccagtcagttcatgaaaacccttttttttgaatgtgaccaccgtgatcaagattatcgaaaattgcaatttcaggcctgtcaatttacagataatcaacttgatgcagtgaattttaatcaatccaatttgacccattgcaattttaagggaagctctctgcaagacgcccagctttcgaatgtcaatgcaacccaagcgttattcatcaatgccgatttaacgcgtgcatgctgccataacagtctgtttaatggagctatttttattggcgcttgccttgagcgaaccgattttcggcaaagtcagctacaacaagccatcatgcaaaaagtacgggctgtcaacgcacaatttgtgaattgtgatatgacctatgctgatctctcttatgccaacatgaataacagcgactttcgggcagcacattttatgagaacgctttttcatcgtactcaacaagttggagcattattctctgaccgtcagggcatattggaaaatgatcctgaactgtttgctgctgaagagtggagtacacaacaacgtcaacgtaagatttaa

SEQ ID NO: 3745 - DNA, 663 bp, Xenorhabdus bovienii
  Coding sequence Name=Xb4151_4152.C440.gene124.dna; Position on contig= 81884..82546bp; Strand=+
atggtgaaatcttcttacgcgctttcttcatcgactcttgttacggaacaacgatatacagaacaaccacagacgaaacaatccagtccattcccatcgcaacaaattgtcggccaagtcgtcaatatctttcaggacggcaaattaatggttaaaaatcaaaattatgggtggcattgtcgacaagcctccagttgcctattggctcctgcaatgggtgacagggtgctacttgtagaagccgatgaacaactctggatactggcgatattagaacgggcagagcaacaagatccggctgtaatcaaggtatcaggcgatttatccattatggctcaggggaatttgaacctgagcagtaacgggttaaatatcaccgccgaaaatggaaattgccatattaatgaaatgcaatacagtggtggatccttgtctgcctgggtctccgtctcgaagataataggcaatcaatttgaatccgtttggcaaactgtaactcagctgagccatcgtctttttcgccatactacgcaaacagaacaagtgcatgcagggcaattagatatgcaggcagaaaactacatgcgactacatgcccaaaataccgtgataaccgcaaaagcaatcaccaaaatagatgctgaacaggtccacattggatga

SEQ ID NO: 3746 - DNA, 402 bp, Xenorhabdus bovienii
  Coding sequence Name=Xb4151_4152.C440.gene125.dna; Position on contig= 82567..82968bp; Strand=+
atgtttgctaatacccaaggcggtggcatagatctggccatcccagatatctgcctaaccccatgccctctaggtgccccaataccgatggtgtatctcaatattgcacaaggtacgaatggcatttgtgccagcacggtcaatattctctttatgggaagtccagcccataacatggcgacaatgattgccatgacgaatggagataatctgggggtggatttgggcgttgcgtccgggacggtgatgggaccctcccgccatacgcttggagccaatagcgtcttgattaagggatcaccggcaacccggctatcaagccctaccctacagaattcaaccaattcggtaggatcacgtgccgtccccagccagacaaaggtcgatatttcaggggcatga

SEQ ID NO: 3747 - DNA, 630 bp, Xenorhabdus bovienii
  Coding sequence Name=Xb4151_4152.C440.gene126.dna; Position on contig= 83003..83632bp; Strand=+
atggtcaatataaaaaatgccagccacacaactccaccttgcagtgataagacattctcccgcgagataattgggcataaattcgcgaacagatgtcgattaaatttcaagtgtgcaatgatggtaatactgtttcttcacgtactcgtatttaatttaataatatttaacatcttcgtattaacagggtgttcatcatccgagcagaaaaaatcgcccccttatcaattgatttttcgtgccacaaataatgtgaatgactcagctccgctgaaaatacacgttattttgttgaaatcgacttcagagtttatgtctgctgattttttttcactgcaaggtcatgctcaggctgtactgggtaataaattgattaattctgagcaactttttttactgccttttcagcacaaatatttcttgttggaaaaaaacataccagaagccaattctatcggcatttttgctgaatataagcaattggatgggaaaaaatggcgtatcgcattaccggttcccattcctgagcctcccgctttctataaattttggacatcaccgccagacacattagatatatgcattcaagtcaccgccaatggcctaaatttcatcgataaatgcaattaa

SEQ ID NO: 3748 - DNA, 1344 bp, Xenorhabdus bovienii
  Coding sequence Name=Xb4151_4152.C440.gene127.dna; Position on contig= 83659..85002bp; Strand=+
atgagcagatcagaaaaagttatctggacagaaggcatgttcttacgccctcaccactttcaacaggccgaaaactatctggagacttatgtccgcgattggggtatggctcaaaggccatattactggggctttttaacgttaaagttagatcaatcattactcgaacagggcaaggtcatggttgcatcagccagtggaatttttcctgacgggacaccctttaattttaccgaggcgcacgcccctgttccattacaacttgcagaaaatcaaactggagaaaatgtcgtattggcactgccgatctttcgcggaggaagggaagagatcatttttcaggaaagaaaagactctatggcacgttttgtcagcgttgacgccgaggtcaatgattttaatgccatgtcagtcggaagtaccaccgtgcaatttggcagaatgcgcctgcggctgatgttggaatcagatctgactccggaatggacgtcactcagtattgtgcatgttatcagtagaacccgtgataataaattgctccttgattcacgcttcattccgcccttactcaactgccatgcacatccacaacttgtcagttttattaatgatttacagggattactggagcaacgccgccaacagacaagccagtgtttgttacaattggggcaacaaaatagttcggaaatcatgtattttcttttcttgtcattagtcaatcgttatagcggccaagtgagccatacccggaatattcccttactgcatccagaacggttattcagtgaatggctgcaatttgccaccgaactggcaagtttttcccaatcacgaataccagaagataaacttccgatttatgaccatgacaatttgcaagtctgtttcaaccacctcatgtttttattacgccaagggttatccattattctggaagaacacgctctccagttgcctttgactgagtattctcatgggctgaatgtggcgaccttaactgacgccaatatgctaaatacattcagctttgtattggccgtttatgccgatacgccgaaagaaacactcatctcccgttttccggcacagatgaaaattgcccctgttggccgcatacgtgaactggttcagttacagttacccggtatcccgatcagtgcaatgccatccgttcccagacaaattccctggcattccggttgcctctattttgagttagaaaaagagggtgaactctggagccagatggcaaaatccggtggttttgcgttacatctggcaggtgaatttccgggtctgcacatggaattttgggctgttagaaatcagtccaaaagttga

SEQ ID NO: 3749 - DNA, 1212 bp, Xenorhabdus bovienii
  Coding sequence Name=Xb4151_4152.C440.gene128.dna; Position on contig= 85046..86257bp; Strand=+
atgactccaaacactcccaacaggcatacggagctttctggcgacatttgggataatccattagtcactgccgctaaccctctattaaatagcattcctcagatccgccatgataccgagtccccggatccaaccgttctacggcgaaaactgatcgatgaaattcgccactttgaactgaaatgccaatatgccaaattgccttatgaagtcattatcggtgcacgttactgtctgtgcaccacattggatgaagcggcagcactgactccgtggggcgttcgcagtgtctggtccggcagtggattgctggtcacgtttcacaacgaaacgtggggaggggaaaaacttttccagttattagcgacgttatcccaaagtccccaaaaaaatctgttgttgttagaactcattaacttttgtctccagcttgggtttgaagggcgttatcgtgtcatggataatgggcgaacccagttggaaaccttgaaacagcgcctgttccagttaatttattccgttcgtggcaattatccgcctgaattatcaccagcattgcaaaaaatcgtcgcgccaaatagcccctgccaatcttccttccctgtttggtcctttatcgctatgacctgtcttattgcatgtattctgtatatcggactgaattggcagttggataatataaccagcccaatattgacgaaaatatatcaagtcaatttgcccaatatgtccgttgatgatcacgtttcttctttcctgccgccggtcttaaatttacaggatatgctcagacgtgaaagtgctgcgggattattaaatgtaacgaatttagcggatagaagtatcgtcacattaagaggcgatggtttgttcaatacgggttccactcaaattaaaaacaatgaacttcccgtcatcaaacatattgctgagacaataaacaacatcaagggggaaattttagttattggttataccgatgatgttcccattaatagctccggcttctcatccaattatgccttatcactcgccagagccaaatcagtaaaaagggaattcgaaaaatatctggatcaccctgaacgggtaagaacagaaggaagaggagaaagtgatcccctatttccaaacgatacgcccagtcatcgagctaaaaacagacgggttgaaatcgttctgttaatttcccctacacatcagacaacgtga

SEQ ID NO: 3750 - DNA, 3516 bp, Xenorhabdus bovienii
  Coding sequence Name=Xb4151_4152.C440.gene129.dna; Position on contig= 86270..89785bp; Strand=+
atgttgagcgccattgttgctatttttaccagccgattaatgtggagtttcctcggcatcaccgccatctcttccattatctggtttattggtcccatgacttctatcggtaataccatacctcttggatcaagtacggtacgaataattatcattgccatattatattttgtctggctctttatccagttagcgtctcacttatatcaggtttggctgaataaaaaactttctgccccattaaacagaggcaatgacgagggtgaacaagtacgaaattcacaatattcccctttatcagaacacttttctgatgccttacgactactgaaaaatgcctatttttatggttcagagatccaatataagccaaaatggaaaccttttttcgatcgtcgatatcggtatcagttaccttggtatgtcctgattggcccccccaattcagggaaaacaacccttctggcaaattctggtttgcactttccattatccgatcatttcgaaacgctttcctcaaacgagataaaagaaaccgataattgtcactggtggttcaccaatcaggctgtcttactggatacacccggacgatataccactcaggatacacggcacgaacaagatgcccgtgaatggaaatgttttgtcaatttgctgaaaaaatatcgcacacgccagcccctaaatggcgtcattcttaccattagcgtagcggatttattaaacccctcaaagaaagtacgtgatcaacacgcttatttattacgcaggcgattgtcagaattacaggctcagttcaagatccaatttccaatctatgtcatcattaccaagattgatttactgaaaggatttggggcttattttgcccattttgacaaaacacagcgcgatcaaatctggggattcaatttcccgtggaacaaaacaggctgggatctgaaggacatttttgcacagcaatatgggttgttgcagacacgattaaatgcagagctatcccatattttattgcacctgaatgatcttcagcaatgtgctgaaagttacctgtttccgcaagaatttgccgcactgcaacccttaattgctcagcatcttgaaattgcattcgctaaatcagggtttgatattccttattcaccacgtgggctttatttcactagcagcgtacaggaagagcctattcatcaaggatattttctgaaaactctgctggaaacgctctttcaggaagcggggcttgccggtcaaaatcgttggtgggtgtacagaaaccgtctattaaaagggctggggtatattattctggctgcgatcatggggttaatcatcaccttgttttttagcagttatggcaacaataaaaattacctgacagaagttcaaaataaaattttccctattctgagccaaagtgcagcattaaaaaagatcagcaacgacatcgatatttatgccttactgcctattttgaataaagtggcggatttgggaaaaagtaaatatttttctcctgatgctcccccttggtcataccaaatgggcttgtatcatggtgaacagatcaatgatgccagtttgactctgtacacgaaaacattacaaaccttattgctaccgcaagtcgcacggttaataacgtctcaattgcaccaaaccaacagcgataatatatataacacttacaatacgttgaaagcgtatcaaatgttatgtcagccccaacattatgacggtaagttcttacatcgttgggtgatgcaatatttgcaggctcatttaccccccactatttcaccgacacaattacaccaaattgaggggcatctgcgccaattattggaatatcagatcgttactttcccttatgtttgtgataacccactgataaaacaaaaacagattttacttagcaagatcccactagcacaactcgtttatatccatttaaaacaggaactatcggataaccccaatttatcgccagtcggcttaacaacgcttgctggcccagaagccggattggttttctcacgcatcaacggtacaccgattacccttaatatagcggggatgtttactccggcggggtatcaaatggggataggtaacaatctcactaccctcatcgataagttatacagtcaaaatgcatggatactgggccagtatgcagaaatatcaaccccaagagagcttaccctcttagtacgacaattttatctccatgattatcttgaacaatgggataaatttctgttcgacatccgtctaaacaatattgacagcctggagcagcgttctaatatagcccagtttctggcttcaaatgcttctcccatgcgcaatctgctcattaatatcagtaagaatgtcaatctggatgaaaggttaagcgataaccattttgataaaaaaatcggtgagttggtcagccgtaaagcagattcattgacaaaagtcgtacctaatccattcatgtcaggagataacctccccaccccggaacaagaattgagaaaacattttgcccaaattactgcattggcaaacaatccagacggtaaaaataagcaaattccttttgatcatgttctcagtcaacttgccaaattacacgaatatctggattcagtacaaaatgctaccaatataggcatacccgcgccatcggatgaaattatcacccaactccaagccacggcggagcggttgccgatcccattcaagggcatcatttcctcgttggcaatgggggctaacagtgatacacaagccagtaacgtaaagaatctcaataagcagctgaatacagaagtccaaggcttttgtcatcaagcgattgccaaccgctatccgctgacgccgtgggcacttgatgatatcagaccggatgatatggctcggatgtttgcgccacaaacggggatcatggatagctttttccaaaaaaatctggtgggaaaagtcgatacatctcacgaaaactggcgccttatactgggaacggatagcaaagcaaaagcattaccggaaagtcacaagttactcctgccattccaacaagcccagatcattcgagatactttattcagcgacggctcgcgtatcccttcatttcgggtcatcgtccgcaccgtaaatatggataaagagatattgagtatgatactggatgttgatggtcagcaattgcaatatagccacggcccacaagtttcgcagtcactcaattggcctggcccaaacggctccaatcaggctcgtatccaattaaatttagatgatgggacaacagcgagtctcatcacttccggcccgtgggcattaaatcgcttaattgaccatgaacaattcgcggcaggaaaacccgccacaaataatcatacaagccagcgtgtgacatttaatatcagaggccatcatgtctcattggaatttattccaaacagtattctcagcccgtttcaacttcccattttcgtctgtcccaagctgattaattcataa

SEQ ID NO: 3751 - DNA, 204 bp, Xenorhabdus bovienii
  Coding sequence Name=Xb4151_4152.C440.gene130.dna; Position on contig= 89818..90021bp; Strand=+
ttgccgcttgcaaacccatgtgagtgtttatacctctgtgcgggagatataagacgcatcttgaaaggcgacggctatattcaaccatcaatattttcattttcaactatcagaaaaagtaaaccctattatgaacatcgaaaccttactcgaacccgtcagcatcgaatctccttgtggggaaaatctggaatacgatcctga

SEQ ID NO: 3752 - DNA, 1056 bp, Xenorhabdus bovienii
  Coding sequence Name=Xb4151_4152.C440.gene131.dna; Position on contig= 89948..91003bp; Strand=+
atgaacatcgaaaccttactcgaacccgtcagcatcgaatctccttgtggggaaaatctggaatacgatcctgaatttatggcattagagcaatccttgcttggaaaaacggaacagcagtttggtgatatcactattccagcggagacacctgactggatacaggccgaaaaacaagccattagcctactgaggcggaccaaagatctgcgcatcatcatggcactgatacaatcatggttgcaaatgcggggattatgtggctacgcagacggccttaatctgctccagcagacactggaacgttattgggatgaagtttggccgaaattagcgtttgagggggaatatgatccccaatttcgcctcaacatacttgccgctattgaggacgattctcctctttcgttgcaagcgcaatattccactctgttgcggaacacgtcaaaggagttgtcattgctggaggtttgctcattattggatggcacgataaacgaaatcagcggctatactggcgggcgaacccgattacaggaggagttaaagcagcaggccagtagccctgaagttttggccgtgatccgtattcgggatcacctcattgcaatactcgacattattcgtcaggcattctcagaaagttatgtttctgaattgtcttggttattaaaacaattaaataaagtgattgaattttgcccttccctttcaaaaacaaggcatcgcgataaggagacagatcccaaaaatatttttgactcaacaacatgttcggaacagagaacgcctgcatctacatattcaacccatgcggtatctgcttcttggcataccattgaagccagcaaccgtgatgaagcacgcatgttactagaaaaggctaaaaactattttgtcgtcaatgaacccagtcaccctgccccacatatgattgcccgtattcagcggttgattgatcgtgatttcgttgacattatttatgatcttgccccagatggactcaaccagctcgaaatcatttttggtcgctcagacaattttgactcgaattaa

SEQ ID NO: 3753 - DNA, 213 bp, Xenorhabdus bovienii
  Coding sequence Name=Xb4151_4152.C440.gene132.dna; Position on contig= 90945..91157bp; Strand=+
atggactcaaccagctcgaaatcatttttggtcgctcagacaattttgactcgaattaatcgtcgttttttcaacaatctatcaagccatgtgtcgttttatatccatccaacttcaagttgccgcttgcaaacccatgtaagtgtttatatctccccgctacgcggggagatatcacgcatcttgaaaggcgactgctatatatccgattaa

SEQ ID NO: 3754 - DNA, 552 bp, Xenorhabdus bovienii
  Coding sequence Name=Xb4151_4152.C440.gene133.dna; Position on contig= 91194..91745bp; Strand=+
atgaaatccagtggacaaaagtttattgctctaaatcgtcctccgcgcgtacagattgaatatgatgtcgagctttatggttcagaacaaaaaattcaattgccgtttgttatgggggtgatgagcgacttaacaggaaaaacattagaggctctaccggaagtgaatgaccgcaaattcatggaaattgatcttgataattttgatgaacgcatgaaatcaacacagccccgtgttgctttccaggtggacaatacactaacccatgatgggaaactgaatgtcgaattaatttttgaaaaaatggaagattttcagcctgatgtgattgctaaaaaagtggaacccctagctaagttactggaggcgcgaacccaactggcaaacctattatcctatatggatggcaaaagcggcgcagaacaattgatcgccgatatcctgcaaaatcctgctctgctgaaatcactggccgatgcaccaaaacccaccgaaggtgttgctgatactgagagtatcaccgacacagaagaggctgaaaataaggagtaa

SEQ ID NO: 3755 - DNA, 1503 bp, Xenorhabdus bovienii
  Coding sequence Name=Xb4151_4152.C440.gene134.dna; Position on contig= 91749..93251bp; Strand=+
atgagtacgactgaacaagaaactgaatttcagcaagagcagctctcaaaagaatatacccctgatgaactgagtgtattgctgaataaagaatttcgtccacaaagcgaccaggcacgaagcgctgtggaaagtgctgtgactacattggcacaacaggcgctggaaaatacggtcacaatctccggtgatacctaccgaaccattcaagccctgattactgagatcgataaaaaactatcacagcaaattaatcatattttgcatcatgatgagttccaagcgttggaaggggcttggcgagggttgcattatctcgtcaataacacggaaaccgatgaaatgttaaaaatccgtgttatgtgtatttccaaaaaagagttgggcagtacgctaaaacgtttcaaaggtgtgagctgggatcaaagccctgtctttaaaaaaatctatgaagcggaatatggccagtttggcggtgagccttatggttgccttatcggagattattatttcgatcacaccgcacccgatgttgaactcttacgggagatggctcagattagtgccgccgcgcattgtccatttctttcgggcgcctcaccaagtgtgatgcaaatggaatgctggcaagagttatctaatccacgggatctcaccaaagttttccaaaataccgaatatgccccttggcatagtttgcgtgaatcggaagatgttcgttatctgggattaactttaccccgttttctctcccgtctgccctatggtaataaaacaaatcctgtcgataattttaattttgaggaggataccgaaggccctacccacagtaactatacctgggccaatgcagcttatgctatggctgttaatatcaaccgctcatttaaattatatggctggtgtacttctatccatggcgtagaatccggtggtactgtagaaaatttgccttgctatactttcccaaccgatgatggcggggttgatatcaaatgccccaccgaaatcgccattagtgatcgccgtgaggctgaattggctaaaaatggttttattccactcttgcatcgtaaaaataccgatatggccgcctttattggggcacaatcattgcagaaaccgtctgaatattacgaccacgacgccaccgctaatgcaaatctttcagctcgcctaccttatttattcgcctgctgtcgtttcgctcactatttaaaatgtattgtccgcgataaaatcggtacatttcaggaacgtaatgatatggagaactggcttaataactggataatcaattatgttgacggtgatccgaccaactcttctgcaggaaccaaagcacgaaaacccttggctgccgcagaagtacaagtagaagaaatcccaagtaacccaggatattatcacgctaaatttttcctacgcccacattatcaattagaaggattaaccgtttctttacgtctggtatcaagattaccttcattaaaaagcacttag

SEQ ID NO: 3756 - DNA, 504 bp, Xenorhabdus bovienii
  Coding sequence Name=Xb4151_4152.C440.gene135.dna; Position on contig= 93417..93920bp; Strand=+
atgtctgatttcaattccatgtataatactcattctttcgttcaattcgagggcattgagggtgaatcgcaaactaaaggttatgaaaaatggatcggtgtccaatttattagtcgtgccataattaaccctgctaatggcttaaccgatataggaagctggggttcaggtaaaggtattttaagccatttcatgcttcatattaattatgacaaagcaataagcgccttagaaaaatatgctgtcacgggtaaacatattaagacaacaaaaattcatatacttcgcttcattggcgataatgaaccggcaatatgggctaaatatgaacttaccaatacttatatttctgaaatcggcagtggacagccttccgataatgtcatcacggttggcctaaaaatgaaaaaattccaattcaattacacgccagcagattatgaaggtaaaaaacaggctgaaaccacctggacctgggatcttgaaaaaaatgtcatcgaataa

SEQ ID NO: 3757 - DNA, 1554 bp, Xenorhabdus bovienii
  Coding sequence Name=Xb4151_4152.C440.gene136.dna; Position on contig= 94012..95565bp; Strand=+
atgcgattcaccattgttaaaaatattggtacaagccagccgcaacaactgagttatgattttatgccacccggtggcacaattggccgctccccagataataactggattttgcccgatgaagggcaggctatagctcgtttacaggccactgtatctgtttccatcgatggagaatgtcgtatgaccaatcggggggctgcctctgatattttgttaaataccatccccatcgctcccgaccggaggattgaaatacgcgatggtgatacgttaaatatcggtgattaccaaatccaagtcattaatattaaccaaggttcgaataatacgaatagtgtgaacacgccaccattgacaacaattcgcaaagatattcccagtgaaatttgggatggattggagaacacgtttacgcccgatgaaagcatgcctcagactccccaacaagttgctaagacactcaatgacaataatccactcataaaacctcagcggcatcaggaacgtaatccaataaaccctctcgaacagatggaaacaataattgatctggattccttgcaacaccgtgccacggatccaatcacgatgtttaatgcaaacacggatagccagcaggaaaatattctcaatgacagtacgcccagtaccttattgcagcagggcaatcagcgcgataaaccagaaattgatcccctgattctattttccgataaacatcggcgggggattttgcatgatgagccgctaaattgggtaatggagaatgctgaacctttggtcgcacaggctaatacaggctcttctgaccctcaatatggtgccagtgatccccctttccaccgtcataacaatgaacacttggatatcgacccagtgacatatccgcctaatccccatcaacccgatcaggccgaagaaggtgttaaattagagggtcaactcttagccgctttattggagggtatggggcttaatcatctccaaaacctgcaatttgatgggcataccctgtataaactggggaaattacttagccagttatcacaaggcattatagcgttaaatgcgtcacgcacacagttgaaatatgagactgataccggagttgcccagattctggtggatggcaacaatccctttgcactttttccttcgggtcaagcggtgctgatccaaatgattggcgaacatatgccaggatttatgtcagcagaacaggcaacacgagatattttaatcgagttacaagcacatcaattgggtatgattgccggtttacgcactattacggcagagatgttacaacgatttgatcccttagtggttaaacaaaaagcacaagctgccggcagactgcctcgtttggcattatcatcaacgtataaagctgctttatgggactatttcaccaaacattatcagaaaaatatggaaaaaattgaacaggatcacactatatttggtgaacagtttcggcaagcctatgagtcagaaattatccgatataaacactcacaagataaattaaagaacaaagataaaaaataa

SEQ ID NO: 3758 - DNA, 555 bp, Xenorhabdus bovienii
  Coding sequence Name=Xb4151_4152.C440.gene137.dna; Position on contig= 95625..96179bp; Strand=+
atgaaagataatattactttattacatggcggttatcattttcgaaaacctcctgcacgcataactgccagagataggatgcagtcttctttgcttgacaggcttactgacaatgaacctgataagaaaaaagaaaacatgaacaattatttattatcacacagaacctttcggcaaaatgtcctgcgggatttacaatggttactcaacagcattaataaagaacctaatcaagatttttcttgtttccctgaaatacagcgctctgcttataactttggcatagcaccactggcgggtaaaaatatatccgatattgaatggagtgatatccaaaataaaatcattaaagcgatccatatttttgaaccccgtattattcccaatgaactgcaagttaattgcatttccgatattcgttcactgtctctatacaatacattgtccatcgaaataaaaggatttttgtggtgtatcccctggccaatagaatttttgtttcgcagtaacctcgatctagaacacggttatttcaccatgaaagaagccggataa

SEQ ID NO: 3759 - DNA, 1875 bp, Xenorhabdus bovienii
  Coding sequence Name=Xb4151_4152.C440.gene138.dna; Position on contig= 96199..98073bp; Strand=+
atggatagcaaactattggaatactataaccgagagttggtgtacttacgtgaaatgggtaaagagtttgcggaacgctaccccaaaattgccaatcgattaggcatgcatggcattgatatcgccgatccctatgttgaacgcctgatagaagggtttgctttcttgacttcccgcatccagttaaaaatggatgccgaatttcagcatttttcccagcatttactggaaatgctctatcccaattatctggctcccaccccttccatggccattacagaactccaaccagacatgagtaagggagatatcagccacggttttctggtgccacacggctcgattatgcgctgccagtctctggagaacgatggcattaccttgcaatattccacgactcaggatgtcatcttacaaccgctgaaactacaaaaagttgagcttggcaagatccccgccaattttcctctggtgggtttaaaccttcatcactatggtgcagtcagtgcattacgtatccgccttgcctgtaagggaaagctctttctccacgatttggatcttaataaactgaccttttttctttcagggccagatattcaatcccaaaaactgctggaactgataatggagcactcggttgggatggtatgccaaactcagggagcctccccacaatacctgacattgcctgacattgctccacatcatgaaggttttgatgatgagcaagccctcttacccaatgatccccgtaatttcagtggatatcgccaggttcaagaatattttgcctttccggcacgttttcgatttttcagtatttgtggtatgcaacctttgctcaaggagaccaaggaagacgttgaattcgaacttattctgctcttaaacaaaaccgatagccgtttggaaagcctgatcgatatttcctatctggcattgaactgtacacctgtgatcaatttatttcccaaaatgaccgagcgattgacggttgatgaaagtaccaatgaatatcatctggtcgtggataacacccgtccattagattacgaaattttttccgtgcaacgtttactcggtatcgatgcacaacataagcaagagcgtatatttcgtcctttttggtcaactaatagcgatgatcctgataattacggtgcctatttttcactgcgccgggagccacgcatattgtctgaacacgcccatcattatggcacccgcacgagctatatcggcacagaaacatttatctctattgtggatgaacatcactctccgtggcctgatacattaaggtatctgagtgccgatgtgatgtgtactaaccgagatctacccgcaatgttgcggcaaaaagatatcaatagctttgccatgctggactccatcccgatcagtaaaattgagtttattaaaaggccgaccatccctcgccctgctctggctgaaggggctgtatcatggaaattaatcagccagcttcaaattaattacatgaattttatggatcaaaaccaagaagaaggcacccagacgctacgacagctattaagtctctatgccgaccttgctgagccagcagtcgtacgccagattaatggcatacgacactgctcattaaaagaagtctatcgtagagtgcccgatactggccttatcgtctttgcccgtggtgtcagcattaaactcgaagtcgatgagcaggagtttgccggcgccagcccgtggcttttaggcagtgtgctggaaaaattattctcgcgtttggtcaccataaacgcctttactgaaatgacactgtatagccagcaacgtggacaagttggcttctggcctgcccgcatgggcagcaagaagttaatataa

SEQ ID NO: 3760 - DNA, 1077 bp, Xenorhabdus bovienii
  Coding sequence Name=Xb4151_4152.C440.gene139.dna; Position on contig= 98131..99207bp; Strand=+
atgaaaacagatattacggccattcatcgtgtatgccgcttgccagagtatttttggcaacaactcacccaagccccctggcaatttgatctgttccagaccctacgtcgcattgatgcccaagcgggagggtattaccgattagggacagccccattaccacgctatgaacctttgcgcttgggacaaaaagcgtcaatggcattcgcaccttccacaatttccacagtccatcagttaaaaaattcaaaactctacgaagtacttatttacagcttcggattatttggtcccaatggcccattacctctgcacctgactgaatatacctattcacgggaatataattatcaagatcccactttgggtgcctttaccaatctatttcaccatcggctgatactcctgttctatcgagcctgggccaatgcacaacctacctcatcattagatagacctgacaaccagaagttttgtcattatatggcttgcctgatagggatgggattgtcagcccagcagaattccaacccggtcaatcacaatcacattacccgtaactctattaacaatcatgcccattacgcgttgtccggccatctttcccgccagaggcataatgcggaagggttgaaaaaaataatgcttttttatttcaaggttcccgtaaaaattatccaaaatattccacaatggttgcagattgaaacgcaagatcaggcgcgactggcagcaggacgtcatgtgccctgtttaggtaagtccgccattttgggcattgcaatacatgatattcaacataaattccgtattgaactagggccattaactcaggcagagtacgacatgtttctgcctgaacagacgaaatctcaacaagtgcgtgagtgggtttatcaatacttaggtatcgagtacggctgggatattaggctgatacttgataaatcagacatcaccgaaatgcgcctgtcagaaacggggaaattgggactcaatagctggctgggtaaggttaacaaatcaagccattatgatgacttaatctacaaccctaaatcctgcaagacgcattaa

SEQ ID NO: 3761 - DNA, 2634 bp, Xenorhabdus bovienii
  Coding sequence Name=Xb4151_4152.C440.gene140.dna; Position on contig= 99251..101884bp; Strand=+
atgccagaaatcagccgttctgtactctttggtaaactcaatcgtgtactcttcacctcactggaaaatgcgacaactttctgcaaactacgcagtaatccttatgtcgagttagtccattggctgcaccagcttatgcagcaacaagactgtgatttacaatcggttatccgttactttgcattagatgaagccaagctggcaaaagatattattacagcactggatcgcctgccacgtggagccagtgcgatttctgatctttccgaacatattgatagtgccgtagagcgtgcctgggtatatggatcattaaaatttggtgttgacaagatccgtaccgcgcactggctgattggtatgttaaagactttcaatctgtacaataccctgaaagccatttcccgacagtttgaacaagtcaatgcagatacgttaatagataatttcaacgccatctgcggtaatagcagtgaagaaccggagaatgaaccaccctctcatcattcccaaccgacaaaaccacaatcctctgacagtgccctgcggcaatatgggcaaaatctcactgatctggctcgccatggtgatattgatcccgtatcaggacgcgatgaagaaatacgccagattgtcgatatcttgatgcgccgccgccaaaataaccccttactgaccggtgaagctggggtaggaaaaaccgccatcattgaagggctggcattgcggatcgccgcaaatgaggtacctccaccactgcaaaatgtgcaactttggttattggatattgggatgttacaagccggggcgggaatcaagggcgaattcgaatcccgcttgcgcagagtgattgacgaagtgcaatccagcccccttccgatcattttattcattgatgaaatccatacattaatcggtgcaggcgggcaacagggaacgggggatgcggccaatttacttaagcccgtactggcacgtggtcagttacgaacgcttggagcaaccacctggtctgaatacaagaaatatattgaaaaagatccggccctcacccggcgttttcaggtcgtccaaattcatgaacccgatgaagccaaggcacttttgatgctacgcagtctggtctggacgctggaaaaacatcaccgtgttctcctactggatgaggccgttgaagctgccatacggctttcccatcgctatattcccgctcgtcagctacccgataaggctgtagctctattagatacggcatgcgccagagttgccattagccaaaacgctgaaccaccacagttggaaaattgccgacataaaatcgatgccttgaagattgagctagaaattgttgaacgagaagcaaaaatggggataggcgatcagcaacggtcaaataccatcctcaatgcgctatccctattggaagaacaacttattcaattggaaaaccgctggcagcaagaactctccttgattaatagaattattcatctgcaaactcaactttatgccccctcctttcatcaacaacagcataatgatcccaatgccctgcatgaagagctaatagcattgcaacaacaattaaaaacgttacaaggagagatcccccttatctttgcttcggtagacagcaatgttgtttccgccgttgtctcagactggacgggggttcctcttggccgcatggtaaaagacgaaattaatgcggtattgcatttggtggatacactcaaccaacgtattatcgggcagtaccatgctttagagttgatcgcaaaacgggtacgaacttcacgggcaaaattggatgatcccaataaaccggtgggggtgtttatgttatgtggcccttccggtgtcggtaagaccgaaaccgcgctggcattggcggaaacgctatatggtggcgaacagaatcttatcaccattaatatgagtgaatttcaggaagcccatacggtatccaccttaaaaggggcaccaccggggtatgtgggttatggtgaagggggagtattgaccgaagccgtgcgccggcgtccctacagtgtggtcttactggatgaaattgaaaaagcccactctgatgtccatgagattttttttcaagtctttgacaagggttggatggaagatggtgaaggccgccacattgattttcgcaataccattattatcctgacatccaatattggggctgatttggtgagttcgctgtgtttacaacaggctcctcttccagatccagaaaaactgagtaccgcattgcgaaaacccttactgcacgtatttcctgctgccttactcggacgtttgattgtcattccttactatccattgagtgataatgtgatgacaagtattgttcacctgcaattggcaaggatcaaaaaacgtttactggaaaaccatgacattgtagctacatttgatgaacccatgattaaatatatcgttggccgatgtacagaaatcgaatcaggtggccgtatggtagatgctatcctgaccaactccttgctgccgcagatcagccagctcttgctctctgctaacgcgaatggtcagcaatatcatcaattacaagtctctctcggacaaggtgagtttcagttccagttcatggaatga

SEQ ID NO: 3762 - DNA, 123 bp, Xenorhabdus bovienii
  Coding sequence Name=Xb4151_4152.C440.gene141.dna; Position on contig= 101834..101956bp; Strand=-
atggatgacgtgattagggcgatgaccttaaaacatcaacaacccctaataaatattctcttaatcacaagttcattccatgaactggaactgaaactcaccttgtccgagagagacttgtaa

SEQ ID NO: 3763 - DNA, 150 bp, Xenorhabdus bovienii
  Coding sequence Name=Xb4151_4152.C440.gene142.dna; Position on contig= 102004..102153bp; Strand=-
ttggaaattgtgtgccgatattctcccataactccccctacattaaattcagcttttaatatatgtgacagacacaatctgcaaatgcaacgatacgccagaaatagttcatgccaacccaatgtattccggcaggctggcttcacctga

SEQ ID NO: 3764 - DNA, 729 bp, Xenorhabdus bovienii
  Coding sequence Name=Xb4151_4152.C440.gene143.dna; Position on contig= 102125..102853bp; Strand=+
atgggagaatatcggcacacaatttccaatattatagcaatgcctagtgatgtgctgctgcagaaaacggttgaggtgatttttcatcaggagaagcgatttcattattttttagatacaccaaaacataaaccgggagatcggctcaatattataggacacagctctccagtgggcagtccaatattatttgcgggagcatatgtgaatagttttggaatgaatccgcgtgttttttgccaaacaatcaatgcattattgactgatataaaaaatagagggaaaaatatccaatgtgtcagaataatagcttgctactctggagcaaataatcttgctcaaaaattagctaattatatcaatatgccagttaaaggctcattaggaggcacacgagtttatccaacgatgcaatttcattcaatacccaatataaaccgtcattttattgataagacagatataggtggtcactattatttcgaggagagggagagacagttgatgcatgatccctcctatggtttgtataggtggtacaaacctaaatcttcaaatccagatagtgaatttgatgagtttgctagtcaacgagtatcaagacttcagcgttcagattcagacagcgaatttgatacgtttgttagccaacgagtatcaagacttcagcgttcagattcagacagcgaatttgatacgtttgttagccaacgagtcaaaagaaaatag

SEQ ID NO: 3765 - DNA, 696 bp, Xenorhabdus bovienii
  Coding sequence Name=Xb4151_4152.C440.gene144.dna; Position on contig= 102928..103623bp; Strand=-
atgttccttatccgaaaagccttccggtgcctgcattatcccaccgatgttatcgctcagtgtgttcgctggtatctggcctatgcgctgagcctgcgtgacctggagggaatgctagctgagcgggggataaccgtcgatcattccacgctatcccgctgggttcatcatctgatcccgttgagggtcaaacgctatcgacggagcaagcctgctgttgggcgtcggtggcgaatggacgaaacctctatcaaaatcaaagggaaatggagttacctttaccgtgctgcggattcagacggcgatacggtttattttttgttgacagcccatcgagataaggaggccgccttgcgtttctttaaaaaggcgatgcgtcagcatggacaacctgacgtggtgacgatggataaaagtggcgccaataaagccgcagtggacgagttaaatcagggaaaacctaaggataacgacatcattatccggcaaaacaaataccttaataatctgattgaacaggatcaccgcaacatcaaacggcgaacacgtcctatgctgggattcaagaatttcagacgggcccagaccgtgttggccgggattgaatgggtctgtatgttgcgcaaaggacaataccgacaaaaagaagggtgtccgatttcacccgcggcatttttctatcaattagctgagtaa

SEQ ID NO: 3766 - DNA, 312 bp, Xenorhabdus bovienii
  Coding sequence Name=Xb4151_4152.C440.gene145.dna; Position on contig= 103626..103937bp; Strand=+
gtgaatcactcaacaaaaaaacagcatgatacccggacacggcttaatacgacagaaccaactttatttgcaacagtgccgtttgttctcgagaacgtaaactatcagacccccattatcagattgaagtttcccttgattgaggtaatcaccgatatggcggtcaacggtggtctgatggagtcgctatgccttgacgatcatcacagaactccacccttcagaagccagaaggatagcttttattctgtctcgtacttgaccatcgcgagttgtgtcgtgaagacgctcaagtttgattttttgttctga

SEQ ID NO: 3767 - DNA, 144 bp, Xenorhabdus bovienii
  Coding sequence Name=Xb4151_4152.C440.gene146.dna; Position on contig= 103812..103955bp; Strand=-
atgaaaatatttattacatcagaacaaaaaatcaaacttgagcgtcttcacgacacaactcgcgatggtcaagtacgagacagaataaaagctatccttctggcttctgaagggtggagttctgtgatgatcgtcaaggcatag

SEQ ID NO: 3768 - DNA, 222 bp, Xenorhabdus bovienii
  Coding sequence Name=Xb4151_4152.C440.gene147.dna; Position on contig= 104189..104410bp; Strand=+
atgaactcaaatgtctatttactccttaatgcagataataccagatataatgaaatattaaaaagcgcagacatagcctaccctcaacctatcagtaacgattggcctgatcttcctatcgagtttcaaataaatattgatgatgtgattaatttaaatggttatttatatttttttaaaggctcgcaatatgttaaattcggtcatgtattaaatggttag

SEQ ID NO: 3769 - DNA, 279 bp, Xenorhabdus bovienii; identical to SEQ ID NO: 890
  Coding sequence Name=Xb4151_4152.C440.gene148.dna; Position on contig= 104582..104860bp; Strand=-

SEQ ID NO: 3770 - DNA, 291 bp, Xenorhabdus bovienii; identical to SEQ ID NO: 155
  Coding sequence Name=Xb4151_4152.C440.gene149.dna; Position on contig= 104852..105142bp; Strand=+

SEQ ID NO: 3771 - DNA, 1137 bp, Xenorhabdus bovienii
  Coding sequence Name=Xb4151_4152.C440.gene150.dna; Position on contig= 105297..106433bp; Strand=+
atgagaaaagtgaaaattttggttgatgaaaatatgccttacgctgaacaactttttcagcaattaggcgaagtacaggcaatcccggggcgcccagtccctgcgggtgctctggaacaggctgatgcctttatggtgcgttctgtcactaaagttaatgaatccttgttgaaaggcagttctgttaaatttgtgggtactgccactgcggggatggatcatgttgatcagcaatggttgtcgcaggcaggaattggcttctcagccgcgccgggatgcaatgcgattgcggttgttgagtatgtattttctgcactgatgttattggcggaacgggatcaatttcaactcaaagataaaactgtcggcattgtcggtgtgggtaatgtcggggggcgtctggctgatcggctggctgctttgggtgtgaaaaccttactgtgcgaccctcctcgtgtcgatcggggtgatgaaggtgaattctggccgttggaaaaattagtacaggaagcggatattctgactttccatactccgcttaatcaatcaggccgttatcagacttatcatctggccgatgcaggattactttctgcattaccggacaaccgaattttgattaatgccagccgtggtgaagtggttgataatcaagcactactttcagtattgcaaagtggaaaaaaattacgtgttgtgcttgatgtctgggaaccagagcctaacctttcattacccttactggctttggttgatatcggtacaccccatattgcagggtacactctggaaggcaaagcacgtggtacgactcaggtctttgaggcttactgcgaatttctggggcaaccatacagggcggaattgtccgaccttttgcctgaacctgatttcagccatatcaccgtacatggcgaagtgacacaaagcatcctgaagcgcttgatacatttagtgtatgatgtgcgccgtgatgacgcaccactacgtcaggtcgctgaacagaatggcgcttttgaccgattgcgtaaaaactatccagagcgccgggaatggtcttccctgacggtgcattgtgactcagaaagcagcgcccaattactgtctgaaattgggtttaacgccaaagtgatttaa

SEQ ID NO: 3772 - DNA, 1011 bp, Xenorhabdus bovienii
  Coding sequence Name=Xb4151_4152.C440.gene151.dna; Position on contig= 106487..107497bp; Strand=+
atgtcagaaggctggaatattgcgctcttgggtgcaacaggcgcagtaggtgaagcgatattggcgttattacaggagcgccagtttcaggttggtgaactgcatcttcttgccagtgagcaaaatgctgggaaaattcagcgttttaatggtaaaagcatcaccgtttatgatgccgcagaatttgattggtcacaggtgcagcttgcgttttttgctgcgacgaaagaagcaacggcacaatatgttgaaaaggcaacggaagcgggctgtctggtgatcgacagcagcggattgtttgccgcagagccggatgtacctctggtcgtaccgggagttaacccacacgctttggctgaatatcgcaaccgcaacattattgctgtggcggacagctcaacaagccaggttttgacggccattaagccattgatcgatctcgcaggtattgcacgtttaaatctgaccaatttattgccggtttccgtacatggcaaagccgccattaatgaattggcagggcaaagtgcccgtttattgagcggcgttccgccggatgaaagtctttttaacaaacaattagctttcaatctgctgcctttattgcctgatgccgaaggctcagtacgtgaagagcgtcgcattgtcgatcaaattcgcagaatattacaggacgaagggctacctatttcagtcagttgtgttcaatcttcggttttctacggaattgcccagatggtgagtgtggaaacactgcgtccagtcggcacagaagaagcgcgtgaagagcttgaacgttttgcagaaattcaggtctcagaagagggagattatcccactcaggtcacggatgcatccggtagtgacaggttgagtattggctgtctgcgtaataattatggtatgccggagatgctgcaattctggtcggttgccgacaatatccgttttggcggtgcgctgatggcggttgaaatcgcagaaaaactgatgcaggagcaattctactga

SEQ ID NO: 3773 - DNA, 840 bp, Xenorhabdus bovienii
  Coding sequence Name=Xb4151_4152.C440.gene152.dna; Position on contig= 107497..108336bp; Strand=+
atgtctgatgcagagctgagtcagtctgtaccagaggcagaaaaagtgaaaattgcactggggattgaatatgatggcagccgctattatggttggcagcgccagcaagaagtaaaaagtgtgcaggaatgtctggaaaaagctttgtcaaaagtggcagatgaaccgatttcggttttctgtgcaggcagaacggatgcgggggtacatgctactgggcaggtagtgcattttaaaacctcagcacaacgtaaagatgctgcctggacaatgggagtcaatagtcatttgccacccgatatcgcagtgcgctgggtaaaaacggtggatgatgaatttcatgcccgtttcagtgcaacggcacgtcgttatcgatatataatctttaaccatcgctatcgccctgcggtgttagcacagggcgtcacgcattttcactatctactcgatgagagaaaaatgcatgaagcggcgcagagtttactgggagagaatgactttacttctttcagggcagtacagtgccaatctaattcaccgtggcgcaatatgatgcacattaatgtcagtcggcacgggcattatgtggtggtggacattaaagcgaatgcatttgttcatcacatggtacgtaatattgttggcagtttgctggaaattggttgtagtaatcaggatatcggctggatggctgaactactggcactgaaagacagaacaaaagcggcggcaacagccaaagctgagggattatatttagttgcggtggattatcctgagcactttggtttacctgcacccactatggggccgttgtttctagctaatgatttaatctga

SEQ ID NO: 3774 - DNA, 690 bp, Xenorhabdus bovienii
  Coding sequence Name=Xb4151_4152.C440.gene153.dna; Position on contig= 108383..109072bp; Strand=+
atggaatttttaactcattttgttgattttgctaagttcattgtcgattttattttacacattgatgcacatttgaaggaattggtcagtgattatggcaattgggtatatggcatcttattcctgatcatattttgtgaaacgggtctggtggtcacgccatttttgccgggagattcgctgctgtttgtggcaggcgcattatctgcattagattccaatgatctgaatgtgcatattatggtggcgttgatgattacagcggcaattattggtgacgctgtaaactatacaattggtcgtatttttggtgaaaaattatttaccaacccgaattcaaagattttccgccgcagttatttggataaaacccatgagttttatgaaaaacacggtggaaaagcgataattctggcacgatttgtgccgattattagaacatttgcaccgttcgttgcgggaatggggaaaatgtcttaccgccattttgctgcttataatgtaatcggtgcatttatatgggtgctattattcacgtatgccggttatttattcggcgatatgccaatcatacagcagaacctgaaattattgattgttgcaattatctttatttctatcctgccaggcatcattgaaatttggcgtcatcgacgagctgcatccaaaaaagcagtagatggcaagtag

SEQ ID NO: 3775 - DNA, 948 bp, Xenorhabdus bovienii
  Coding sequence Name=Xb4151_4152.C440.gene154.dna; Position on contig= 109187..110134bp; Strand=+
atgagctggattgaaaagattctcaataaaagcaaaatcatgcaaactcgtaaggcaagtatacctgagggagtttggacaaaatgtgatagttgtggtcaggtactttatcgtgctgaattagagcgtaaccttgaagtgtgcccgaagtgtgaccaccacatgcggatttcagcccgtgagcgattgcatacatttctggatcaaggaaccggtatcgaattaggcagtgaactggaacctaaagatcttctgaaattccgtgacactaaaaaatacaaagatcgtttggtagcagcccagaagcagacgcaggaaaaagatgcgctgattgtgatgaaaggctcactgtacgaaatgccagttgtagcaggatcatttgaatttgcctttatgggtggctccatgggctctgtagtcggtgcgcgttttgtccgcgctgtcgaacagtcactggaagacaactgcccactcgtctgttttacttccagtggtggcgcacggatgcaggaagcgctgatgtctctgatgcagatggcaaaaaccagtgccgcgctggcgaaaatgcaagatcgaggtctgccttatatctgtgtcctgactaacccgacgatgggaggagtgacagcaagtctgggaatgctgggtgacatcaacattgctgaacctaaggcattgattgggtttgctggtccccgcgtcattgaacagaccgtgcgtgaaaaactgccggcaggcttccaacgcagtgaatttctgctggaaaaaggcgcaattgacatgattgtacgtcgtccagaaatgcgtgagaaaatagccaatctgctttcgatgttgactcgtcagcctcatcccggcacaaaagtagaaacggtagcggaaatggttgctgaacccgctgaggttgaaactgacataaacatcaatcctaataaagaagatgtctga

SEQ ID NO: 3776 - DNA, 1299 bp, Xenorhabdus bovienii
  Coding sequence Name=Xb4151_4152.C440.gene155.dna; Position on contig= 110127..111425bp; Strand=+
atgtctgatatattgcaaattcctcaagccacgtcgtcactgataacgtggctttcctatcttggaaatctacacgcaaaagccattgatatggggcttgaacgtgtgggagcactcgccgatcagttagatttgctgcatccggcgccgaaagtcatcaccgtgtccggcacgaatggcaaggggacgacttgtcatacccttgaatccattctactggccgctggcctgaaggtcggagtgtacagctccccgcatctggtgcgttataccgaacgggtacgtatacagggtaaagagccggcggaacaggatttctgccgtgtattcgcggacatcgaagctcaacgtggtgatatcacactaacctattttgaatacggtactttggctgcgttacagctttttaaagaagctgatcttgatgtcgtcattctggaagtggggctgggcgggcgtctggatgcgaccaatattgtggattcagatgttgcggcaatcaccagcattgcactcgatcatattgattggctgggtgcggatcgcgaacatattggccgtgaaaaagcaggtattttccgtcaggggcgttttgccgtggtgggggagcctgatatgccacataccatcgctgaagtggctgatgagctgggagcgaaattgtttcgtcgcggtgctgactgggatttctcacaggatgcgaacagttggtactggcgcacaggagatcaacagttcagtgaattacccgtccctaatctgcctctggcgaacgctgcaacagcgatgggagtgatttactgtctgttgcagcagaatgataacgtcagtcaggccattaatgaacaggcgatccgtgaagggttaagtaaggctcagttaccggggcgtttccaaatcgtcagggaaaacccgctggtgattttggatgtggcacataatccccatgcagcaggttatctagtacagaaactggcaaaattgccccgcgcaccagacagtaagatccgtggtgtcgttggcatgctggaagacaaggatatagcgggtacgcttgcttgtcttgcccagcaggttgacgaatggtactgcgcatcattgcatgaattccgtggggcagaagcaaacatattggccgagcaccttggcgatgcccgaacatttgtggaagttgagcaggcatggcatcaggccatggcagaagcctcagtgcaggatatcatcgtggtctgcggctctttccatactgttgctcatgtcatggaggctctggaggaggtgaaggaaggtggcaagtaa

SEQ ID NO: 3777 - DNA, 690 bp, Xenorhabdus bovienii
  Coding sequence Name=Xb4151_4152.C440.gene156.dna; Position on contig= 111415..112104bp; Strand=+
gtggcaagtaaatttcaaaatcgtttagttggaaccctcgttcttgtggcactgggtataattgtgttaccggtgctatttgacggcgataagaaacataatgaaagccagtttgcttccatcccgctggcactcaagcctggtgatgaagaagatatcgatttgattgcacccctgacgcaggatatgccatcgacaccaccggaaggggcggctgaagcgatggcaaagcaagcacaagagctacagccagatatgctgtccagttcgttattgtcagagcctgcgccaatggcaccgccgcctgtggagatcacacaagcgcccaaagcgacggttaaatctgaacccaatcctcagccaaaggtggacgttaaacgggaaacgagggctgaaaccaaacctgaagttaagtctgaaagcaaaaccacgccagtaaaggcaccgcagggagtggcatatgttgttcagcttggtgcattgaagaatgcgggtaaagtggatgagattgtggcgaagctgcgtctttcgggtcatcaggtctatgttattccttcttctccagtacagggagaactaacgcggatttatgtcgggccgaatgcatcaaggcaaacccttgaatccactttgcctgaattgaaagaattgacgggtttgcaagggcaaatcaaaaactacagtccctga

SEQ ID NO: 3778 - DNA, 141 bp, Xenorhabdus bovienii
  Coding sequence Name=Xb4151_4152.C440.gene157.dna; Position on contig= 112092..112232bp; Strand=-
ttgcgtagcagatttttcagtctactgaaaataattcgtaacagattcaaaaacaacaatcgccgcaaaaacctaacctgtaactatcacgacgggaagccagacacttcccgtaagacgccaataagtcagggactgtag

SEQ ID NO: 3779 - DNA, 507 bp, Xenorhabdus bovienii
  Coding sequence Name=Xb4151_4152.C440.gene158.dna; Position on contig= 112297..112803bp; Strand=+
atggtctggattgattatacaattattgccatcattggtttctcggcactggttagcctgatacgcggttttgttcgcgaagcgctctcactggtcacttgggggtgtgctttctttgttgcaagtcacttttatacttatctggcggcttatttcacccgcctggaagatgaactggtgcgtaatggggtagcgattgctatcttatttattgcaacactgattgttggtgcagtcgtaaactatgtgcttggttcacttgttcagcggacaggcctgtcaggtactgatcgggttctggggatctgttttggggcactgcgtggtgtattaattgtttctgcaattttatttattgcagattctttcacgccgctccctaaaagtgaggattggcaacagtcacaactcatcccacagttcagtcaaattatcaggtggttttttgactacctgcaaaacgcgtcgagtttcctaccggagaaatcactctctccgcttggctga

SEQ ID NO: 3780 - DNA, 1533 bp, Xenorhabdus bovienii
  Coding sequence Name=Xb4151_4152.C440.gene159.dna; Position on contig= 112803..114335bp; Strand=+
atgaggaaaaactacatgtgcggtattgtcggtatcgtcggttttacaccggttaaccagtcgatttatgatgcattaacggtgcttcagcaccgtgggcaagatgcagcaggcattgcaactattgatggtaacaatgagttccgtttacgcaaggccaatggtttggtcaaggacgtgtttgagacacggcacatgctgcgtttacagggaacaactgggatcggacacgtccgttacccaacagcgggtagttccagcgcctctgaagcgcagcctttttacgtgaattcgccctttggtatcacactggcgcataacggcaatctgacaaacgcacataagttgaaaaaaatgctgtttgaacatgcacgccgccatgttaataccacatcagattctgaaatcctgctcaatatttttgccaatgaacttacccaattcccggattttccactggagccagatgatatctttgcggcgattgcagagatgcacaaaaaaatccgtggagcttatgcctgtgttgccctgattattggacatggcttggtggctttccgtgatccgaacggtatccggcctttggttctggggaaacgtgtgctggaagatgggcgcaatgaatatatggtcgcatcggaaagcgtggcactggatacattgggttttgaattcctgcgtgatgtggcttctggcgaagcgatctatatcactgaaaaagggcagttatttacccgccagtgtgtagaaaatcctgcattaacgccttgtttattcgagtttgtctattttgcccgtcctgactcctttattgacaaaatatcagtatataacgcgcggttacggatgggccggaaactgggcgaaaaaattgcccgcgaatgggaagatctgcatattgatgtcgtgatccctgttcctgaaacgtcttgtgataccgcactggaaatagcccatattctggataaaccctaccgtcaggggtttgtcaaaaaccgttatgtggggcgcacctttatcatgcccggccagcaggaacgccgcaaatcggttcgtcgtaaactgaatgccaatcgtgctgaattccgtggtaaaaatgtcttgttggtagatgattcaattgtacgtggtacgacctcagagcaaattgtggaattagctcgcgaagctggcgctaagaaggtctattttgcttcggcagcaccggaagttcgcttcccgaatgtctatggtatagatatgcctaatgctaatgaactgattgcccacggtcgagaagttgatgaaattcgccagctcattggtgctgatgcgctgatatatcaggatcttcgcgatcttatcaacgcggtgcgtgaagaaaaccctgatattgaaaaattcgaatgttctgtatttgatggtatctatgttacgaaagatatcgaccagatttacctcgattatctggagaatcttcgtaaagatgatgccatgaaattgcgtgggcagagcgaaattgaggatctggaaatatataatgagggataa

SEQ ID NO: 3781 - DNA, 585 bp, Xenorhabdus bovienii
  Coding sequence Name=Xb4151_4152.C440.gene160.dna; Position on contig= 114384..114968bp; Strand=+
atgaaaaaattgattgtcgggctgacgggagcaagtggcgcgatttatggcgtcagattattgcaggtcttgcagtcggttgagggcattgaaacgcatctggttatcagccagtctgcccggcaaacattggctctggagacggattatacgctgcgggatgtgcaggcactggctgatgtggtgcatgataaccgcgatatcgctgcttctatctcttcagggtcatttaaaaccttagggatggttatcttgccctgctcgataaaaaccctgtcgggtatcgtgcatagttatactgatggcttgatcacccgtgctgctgatgttgttttgaaagaaggacgcaagctggtattgagtgtccgggaaacgcctctgcatttagggcatttgagattaatgactcaggcggctgaaataggggcggtgattatgccgcctgtgccggcattttaccaccgtcccgatcatattcaggacattattgaccagacggtcaaccgagtactcgatcagtttaatatcgagctgccacaagatttattcaaccggtggcagggagcgaaacaaattgaaatttaa

SEQ ID NO: 3782 - DNA, 915 bp, Xenorhabdus bovienii
  Coding sequence Name=Xb4151_4152.C440.gene161.dna; Position on contig= 114965..115879bp; Strand=-
atgcgtatcttaattactgggggtacggggctgattggttatcgattgacttgccaattactttcgctttcccattccatcaccattttgagccgttctccacaaaaggtatattctctgttctccgaacaagttgaatgttgggcaacactgaataataaaaataacctgaatgattttgatgcagtcatcaatcttgctggtgaacccattgcagataagcgctggacatcagcacaaaaaacaaaactctgtcaaagccgctggcaactcactgagaaattaagtcatttgattaatgccagtgaatttccgccttctgtatttatttccggttcagccgttagctattacggtgatcaggggcaagcggtagtctctgaaaatgatcttcctcatgacgagtttgcccatcagctctgtaagcagtgggaaacactggcattacaggcagaaagtgaaaaaacccgagtgtgcctgctgcggacaggaattgtgctggcaagtaacggcggagtgctgaaaaaaatgctgccactatttcgattgggtttaggcggtaaaatgggtgatgggaagcaatatataccttggatccacattgatgatatggtcaatggtatctattacctgctggtatcacctgaactgagcggcccattcaacatgacagccccttatcctgtgcataatgatctgtttagtgcagcactggcgaacgtgctgcatcgccccgctttcattcgcatgcctgcttttgtattaaaaataatcattggagaggctgctatgctggttttaggtggacaacaggctattcccaagcggctggaagaaggaggattcggcttccgctattttgaattagaggaagccttcaaagatttattaaaggaggaagctaattcaccttaa

SEQ ID NO: 3783 - DNA, 621 bp, Xenorhabdus bovienii
  Coding sequence Name=Xb4151_4152.C440.gene162.dna; Position on contig= 116020..116640bp; Strand=-
atgatagacctatattatgctccaacgccaaacggctataaaatatcattgttccttgaagaagccggcctaccttacactatctacccaatcaatatcggcaccggagaacaattcaaacccgaatttctggccatttcgcctaataataaaattccggcaattgttgatcaccaacccgccgatggaggagaacccatttccatctttgagtcaggcgctattctactctatctggcgaataaaaccggtcaactgttaagcaaggatgtacgtgaacgcaatcagcaattgcaatggctattctggcaggttgccggctttggccctatgctcggccaaaatcaccatttcaatcattacgcttctgaagtcgtaccttatgccattaatcgctatatggaagaatcacggcgtttagtcaatgttctgaatacccaactggaaaaaacgccgtatcttggcggaaatgagtacagcatcgccgatatcgctacctatccgtgggctagatgtcatgaacatcaaaaaattaatctgaatgattaccctgcggttgaaaaatggcttaagaaaattgaacaacgccctgcaacacaagccgcatacaacaatggctaa

SEQ ID NO: 3784 - DNA, 126 bp, Xenorhabdus bovienii
  Coding sequence Name=Xb4151_4152.C440.gene163.dna; Position on contig= 116600..116725bp; Strand=-
atgggtggcattttacagacaactcaaatcagtggtaatgtactgaaactatatttaccaatccgttattattaccagaggttatatgatagacctatattatgctccaacgccaaacggctataa

SEQ ID NO: 3785 - DNA, 534 bp, Xenorhabdus bovienii
  Coding sequence Name=Xb4151_4152.C440.gene164.dna; Position on contig= 116846..117379bp; Strand=+
atggtggaagagaaatcagcaggtattgagtggattgatatcgtcaatgaaggcaatgaagtgatcgcgcaggcgactcggcagcagatgcgtagccaaaacttgaggcatcgtgcgacttacattgttgtgcatgatggtatgggcaaaattctggttcagcatcgtacagaaacgaaagatttttaccctggaagattggatgcaacggccggtggcgtggtcatggtgggagaaaacatgcttgattctgcccgccgggaagcagaagaagagctggggatcgcgggtgtgccttttgctgaacatggtatcttctattatgaagaaaaaacctgccggacatggggagggttattcagttgtgtcagccacgggccgtttgcattacaggaagaagaagtctcggctgtttactggttgtcgccagaagaaattactgcccgttgtgatgaatttacgccggattctctgaaagccctgtctttgtggctagcgcgtaacagacagagggaactgcctgaaaatggatga

SEQ ID NO: 3786 - DNA, 384 bp, Xenorhabdus bovienii
  Coding sequence Name=Xb4151_4152.C440.gene165.dna; Position on contig= 118214..118597bp; Strand=+
atgattgcatttaacctcaaaagaggtctaactatgataaattacgctaattctttttggtgtaaagctattaatattgctattgttggtgtaatttactttttcctgatgaatatatcgcgagttgcttcatctattggcgattatctgatcttttttttatttttttcttgcattcaaatttctgttgaaataatttatgataatatcaatagcttttcttcgaaataccttaatcagactctgttaaataatgttatggcactaattgaagttaagggaaattatcgaggtttttatcagttgtggggactgattacctctatgtactggtgtttcattttttataaatactacctatttactccttattatcaaaaataa

SEQ ID NO: 3787 - DNA, 6867 bp, Xenorhabdus bovienii
  Coding sequence Name=Xb4151_4152.C440.gene166.dna; Position on contig= 119103..125969bp; Strand=+
atgctgtttacgggggtgttttattcaatacacgaggaatgtatgtctgagacatattttttgcatgataggaaagttcgtggggatatagcgattgttggtatggccagtcatttcccggatgcaccggatttgtataaattctgggaaaatatcatcggcaaaaaggactcgctgactgatgtctctaccatgttaggagacgaatattggcaaaaagaggatttttacgatcccaacccggcagtggcagataaaacctatggccatcgtgctggctttgtgcctccgattgacttcgatccggtggagttcaaaattccacccgcgattattgactcaattagtacggcgcagttgtttgcactctatgttgctaaacaggccatgctggatgcgggcttggttggacaggagaatagcagggtagaccgtgatcgtatcggcgtcattttaggtggcgcaggaaatggcaacacgtcattttcactggcttcacgccagcaggcaccttacttacgtaaaattatggtcaaatccggcctgtcagaaaaagtggcaaatgacatcatcgaacggatgcatggcatgtaccttgaatggaatgaagacagtttcccggggtttttgggtaacgtcgcttgtggccggattgccagttattttgatctcggtggcacgtcttatatggtagatgctgcctgtgccagtagccttgcggcaattaaggccgctatcggtgaactgcattctggtagttgtgatgccgtgttaacaggtggcgtcaatttggaaaactccattttttcattcctgtgtttcagtaaaacaccggcattgtcaaaaagtaatttgtcccgtcctttcgatcagagtgctgacggtatgatgcttggcgatggcgtgggaatgctggtactgaaacgtctcgaagatgcggaactggatggtgacagaatttatgctgtcatcaagtccattgaagcttccagtgacggcagagccaagagtatttttgcccctcgtctggaaggacaggccaaagccttgaggcgggcttatgccagcgcagggctctcgcccaatgatattcaattggttgaggcgcacggcacgggtacggcatcaggtgatgatacagaactaaaaagcttacacactgtgtttggtgaatatcaggtgcctgcaaaatcggtggcaattggcagcatcaagtctcagatcggccatactcgttgtgcagcgggtgctgcgtctatgatgaaagtcgcgttggcactgcatcataaagtcctccctcccactctcaatgtggataagccgacaaacttgctgaaagcagaaaacagcccgttttatgtcaacagcgaagccaggccatggttgcgttcattcaacagtgcaccgcgtcgtgcggcactgagtgcctttggtttcggtggcaccaatttccatgtcattctcgaagagtatgaaaaacatacacatgggcgttaccggctgaatgaatcaccttgggttatgctgtttaaaggtcataatccggcggaattgcttgcacagtgtgaagaagctctgacccgtttcagtggtaacttgcctgatatcgccatccgccaacatcttgagcagcaggacattgacagcttacagccgcaacaggccagagtgctgtttgtctctcaatccgcagaacagaccgttgaattgttgtcgattgccatcaaacagttgcagcagaatagcactcatggttgggaacatccgcgcgggatctattaccagccccaaggaaaaatgctggatggcaaaattgttgctctgttccccggtcaggggtcgcagtatgtcaacatggcgcgcgatattgccaacgattaccctgaaatgcggcaatcgctggaaacactggatgaagtatccatcagcgaattagggcatgaattatcgccagtggtttatcccgtaccgaccttttcagatgacgagcgccagatacaccaacaacggctgacggacacggctaatgcccagcccgcattgggtgctatcagtgccggttatttcaatattttgaaagggatgggattcgtccctgattttgttgccggacacagctatggtgaagtcacggcactctgggcggcaggggtgttttccgataagaatttccaccgcgtttctcttgccagaggctgggcagcagcatctgccagcgatcaccgtggggcagatactgatgctggcgcaatgctggccgcgtcgctcaactctgcacaacgtgcgcagatcctggaacgctatagcggcattatcattgctaatgacaactctcagcagcaggtggtattcggcggtgcgacacccctgatccaccagctccatgatgagttgaaaaagcgtgatgtgcactgccgtattctgccggtttcagccgctttccataccgcatttatcgagccggcttatcagccttatcgtgaacgtctggcaggaatcaatttccagtcaccgcaatgcagactgttctccagtgcaacagcggaaccgtatggaaattctccacaggcgatccgggaattgttagcggagcaattgatcaagccagtgcaattccgccaaaccattgaagccatttatcaggaggggggtcggttgtttgtcgaagtagggcctaaaggggtcttgggcaaactggtggccgatatcctgaaagataaagaacatgaggttatttccgttaatcccaatgacaaaggggaagatcggttacagtttgcccgtgctcaagctaaattgctggcggtaggtgtcaaactcagagaaataaatcagcacatacggccccaaccgatggcagaagacaaaagcaaacgtctgacgttcagaatgagtgggggtttttacctgtcccaaaaaaataaggcacgacgccaacgtgcgctacgtgatggcgacagcgcgattgtcgaacaatttatcgctgaatctgcacctgtaccgatggctccggttatgcctttgcattcccaaaaagaagtcaacatcaaagaagaacattcaggcaaagaagtcaaaccaacacaagaagtacatccaacacaagaagttgtggtagaaaaagttgaaaataaagtcgaaaaaatcgccgaaaacaaaacaatttctgcccaatttattcaacaaaatatgctgacaatcattcaaagacgagagagcacgatggaacagaacaatcagttgagtgaaaacgtagatgtaaacatgttaaatggactgttgcaggctcaacaggtcatgagccagcttcaccaacaatttcaagctaaccagaaagactatattcaactgctgggaatgttgttggataaacaatataccctgctggaaacctgtaaggatcatcagaacttgccgagcatgttatccagtctgagtcaaagcgttcaattactggacaaaaatcttgagttgtatcattccaaccatgaacactatttcatggctcaacaaagcttgttccagtctggtcaagtgacaccgatgatagcacccacccatcgtacgtcatcgccggtggtggattattctgctctggccaaagtgaccacttcggcgacaatagcgtctgctccagtatcaacgccaattccaactccgattccgacaactgccccagcagtgaaggttgacacggctcctgtacaggccaagcctgtggatccgataaaggaaattgagccagtgcgttcaatgatgccagaaatgcctgtcatgccatcagtggtagaggaagctgttaaaccaatagtgaatgacacacctgtcagtcagcctacacctgtagtgattgagacaaaggcgaaagtccttgatccgaaagtagaaaaacagttccagatcttgtcacaaatcactgaagagaagattgtcaaccaattaatctccatcgtcagtgacagaaccggttacccgcaggatatgatcacgccagaaatggatctggaagctgatttgggtattgactccattaagcggctggaaatctttggtgcaatgtttgacgcgttctctgcgaacgtgggtctttacaatgaggcttctagaaataaagatctggaaaacttcgaagtcgattccttgagtaatatcagcaagatgggcgtgttctttaagcaaatgcttgacgatgtcatgaatgacttgctcggcaacgggggtgatgaagccgtagcagagcaatcaccgccatcagtcgaaacccgtgaacatgaaaacaccaaaagcaacgttgtccctgatagcgggggagcaacaggcaaattacagtctctcgggtttttcacatcaacagtaacttcacctgaggctgacagcgtaaaaaagccattagctgaaccgcaactgattgtaccttctgtggttcagcctgtactaaagaatgaaattgtcttaaatgaagaagagtcttttgccggctcacccgtttcgcgttttgccgtggtgaaacaatccctgcctatgccagatcgtctacagggggtgttttcatcccctaaacgctggctggtcgttgatgaggggacaaccaccgtggatgacgtagtgaacgcactcaggcaacagggacagcaggttgctgtcctaatgctgaagcaaaacccggcggtgatggagagtgaagctgcgttagacgcggctttagcagacattgagcagcaacatggcacgattgagggcgttatttacttgcagacacctaagcagagcgttaaggcgttagctgaggtgttcaatgaacaggattaccgctcagttgaaaccacgttcctactggcaaaacgtctgcaaagaagccttaaccatgatgaacagaaaacgggttattttatggttatcatgcgcggtgatggtgagttactcacctctgggcgggaacacttgtctatcgtttcggctgggctcacagggctgactaagtcgctgaatattgaatggaaaaatgtcttctgccgaacagtcgatattgatgccagagtcaaggacagtgatgcggcgaagatggtggtagaagagcttcaagatagccggacggatatgggggaagtgggacgcggcgtgaatggcgagcgtatgacattggcactgacagaagaaaatgtactgtcagcggcattcgtcaatcaggtcaatgcgggtgatgtgctgattgtgacgggaggtgcccgtggcattaccgcacaatgcgttattgaattggcgaaacagagtcaggccacttttattctgcttgggcgtacggatatcaccgaaccattaccggaatgggcagaaggcaagacgacgcaggatgagcgcaaaactgcggctatggcttatctgaaagcgcagggtattcaactcacacctgttaagattaatgggatgttgagccgcttgacgcatcttgatgaaatcaatggcacattgcaggcaatcagacaggctgggggacgggtcatgtaccttcactgcgatatcactgatctaaagcaggtgaaaatcgcactgaccaaagcacagcagcaacttgggcagataacgggtctgatccatggtgccggcaatctggcggataagcgaattgaaaagaaaacactggcggatttacattcggtctttaatgccaaggtcaaagggctggaaaacctgtgccgcgaattagactttacatccctgcgccatattatgttgttctcatcggtttccggtttcttcggcaatgccgggcaggccgactactcgttggcgaacgaaacactgaataaatttatctacctgcctttcaagggtaaaaacagtcagataatccgttcagtgaactgggggccgtgggatggcggtatggtcagtgatgttctcaaacgggtatatgacgcacagaatatggcgattattccgctcgaagaaggcactcaacgttttgtgcgtgagttccgggatcccggttcactccagatcacgattggcggggcaaactacaaggctgagaagacagttaaggcgttggggatcggagagcaggttgaccgtcaattgagtctcgataagaacccgtttttgtatcaccatgttatcgagggtaaatccgtattgcccatgacggcggcgattgcctggatggcgcggatctgtgaagatcgtttccccggttataaactggaaaccatcactgatttcaaggttctgaaaggtattgtctttgataacacgctggctgaatcttactgtgtggcatgggttccgaatacatttgatgaatcgggtgatgggcggctggcactggatgttgtcattaccagtaaacgaatgaaacattatcaggcgaccttgatcctgagcctgcaaagccgtgaagcgcagcatgaagtagtcggtatcgatctgaacgcagaggttccgcagacgctgccattctatgacggtgtcgggggagagggcatattgttccatggggaatcattccatggtgtccagaaagtcgtccatgttgatgatgataatattacattgaagtgctgtgttatgccggtacagcttgaaatgcaggggcagttctcgacccgtttatttaatttgttcattaacgatattgcttttcagttgcctgcaatatggtttctgcaacgaaatgaaatgtgtttacccaatgcaattgaaaaaatagaacaatatgctgagttgaagtttggtcaggaattctacgcgtcaattgaaatcaagcaccaaatgtcaacggaaataataatagatattattttttatgatgaacaaggctatatttatagtcggtttcataatgcaaaatttaccgtgtttgttgaatag

SEQ ID NO: 3788 - DNA, 4365 bp, Xenorhabdus bovienii
  Coding sequence Name=Xb4151_4152.C440.gene167.dna; Position on contig= 126115..130479bp; Strand=+
atggaaaatattgcaattattgggatggggtgcttatttcccggtgcagatacccttgagaaatattgggataacttgctgcgggaaaaggattgcacaactcccttatctgctctggaactgggcgtagatctggactgttattattctccggttgcaggtaaaccggatacaatcaattatgttaagaatggacatgtccgggattttcattttgacggcaaaggatataacttgccggaagaagaattaaattcgctggataatttatttaaatggactatttattctgctgagcaggcattgaatgatagtggctatcgccaacataaaacagttttagaaaaaaccggattaattctcggtagtattggtatgccgactcattcaaccaaacgattaatgagtcctttttatcaaaaaatattgcaaccttatattcagcaattaatcgggcgacctgattttcattttgattcggtttggccacaagcaaaccattccgatcagaatttaattacgggtggacacaatgccacgattgcagcgctggcactggggttattgggtcctcgttattgtcttgatgctgcctgtgcatcagcactgtatgccatcaaactggggatagattatctcctcagtcataaggctgacatgatgctggttggggcgatttgccatacagaccatatctatatcgatcatggtttcaatatgttgcaggtattccctgcaaaaggggaatccattccttttgatagatcatccaaaggggtgaaagcgggcgagggaagcggcattgttgccatcaaacgctactctgatgcgatacgtgataatgacaagatttatggtgtcattgaatcgttcggtttgtccaacgatgcgggggcgaaacacttattagtgccagatctacaggggcagcgtatcgctctggagcgcgcctatcaggataatccgcagcgtgttgattatgttgaatgtcatgcgaccggtacaaacattggtgatcaagtcgaattatcgacaattgaatccttctttggtgaacgtggaacaatgccattgattggcgccaacaaagctatcaatggccatatgctcaccgcgtcaggtatgggggggttactgaaagtgctgttggctatgcagcataatatgatccctgccaccccgcgtgtcgaacaattggtttcgacacaaaaagggctgctgaacattgatcacgtcgtgcgggaagccaaaccctggcctgtcagcaatggacctaagcgtgccggcattaacgcctttggttttggtggggtcaatgcgcacatggtcattggtgaagatacacctgaacggcgggcagcatgcacacaggcgaagttggagaaccgtcagaaaattgagcgtctgtctatcgtcggtattggtgtgcatatggcgaaaaccgaagatggcaaaacgctggatcagacattgcagcaagggatacaacatttttatcccctgccgaaaacccgctggattggcatagaaaagcgtcacgatgtcttggcaatgcaggggatcagccaaccgcctttaggctcttatattgaaacgtttgaatttgactgcaagcacttcaaattgccgcccaatgtggtaggtgcgcatttaagctgccatatgttcttgttgcccatcgcggaacgtgcctttattgatgcgggttatacgctgaatggcagtaaacgtaatatcgccgtcattgtagcaggaggcgtggactatagctctttgcgctatcaggcacgtaatgaaattagttggcaactcagccagagtttggccagcagaggtattcatctgtcagaagaagataccgtagccttgcaggaaatcgttaaagatggcctgtttcctaaaccttatcctgaaggtattaccggcggtataggtaatattgtagcaagccgtctggcggctcatttgaagttgaatggcccggcgtttacgctctatggagaagaaaattccccgttcaaggcactggaattggctcagttcatgttgagcagacagcatgttgatgccgtcatgattgccagcagcagtttcggtggcagtctggaaaatgtgctgtgggatcatcaatccaatcacggtaaccaaatcgttggcgatgcgggtggtgtgattattcttaagcgtgaacaggatgctattcgtgataatacgcctgtttatgctgtactggatgggctcagcatcacctatatgcctgatcactctattgatttcaaaggaaacgaagacgcgattctggcggcagcgagatccggattagaagcagcaggttgcacagccgatcagattgattacattgaactgtatgcaggtggaaaaccaggcgaaatcgccgctgaaatgtcggcattaggtcgggtttatgcttcacaaaacaggcaactgaccgccactatcggcaccgttaaggccaactacggacatttgtttatgaccacgggcctgcttggaatcatcaaatctgcgttacagcttacacagcgatacttaccggcactgccagattatccgcagcatcaggaattggcgcattatgcagaagggaaattccaactgccggctcatacccaatcctggcctgcaccggcaacaggtccccgccgtgcagcaattagtcatttgggtattgaccgggcttacagtcatgtgatcttaagtgaaccacaaagcggaaagcgcgctcgcccaacgagtcgtccagagtcaaatcaggcaggcttaaaagttctatcgtataccgcaagagaaaaaaccgttgaagagttaatcctcaatgaacagacattggcgcgttttgcgtcactggctacggctgcacatgtcaatatggcggtgaccccggcagatgccgaaacaaaagtggtatatcccgaagtatcaaccctgacgatgccattgccgatggaacttaatcacttcatacgcaatgcccatactcaactgcattacctgcaattggagcagacgtattatcagttgcttaaacagcatctggcggagctgcccttaattcagtctacaaccacagaatctgcattggttgcaccgacgaaaaagagagtgacaacctcacccgtcgttttcgacgagcagcaagttctggaattgacagacggcagtgtagaaaaagttttgggtgctgattatgccgaagtcgatagctatccgatacgtacgcgtatgccatcacctcctttcatgtttgtttcgcgcattacggcactttctgccgtcaagggcaagttagaaccctgctatatcgaatgggaatacgacgtgcctgaagatgcgtggtatgccgtaaatggccgtgtgccatcgttcgtcgcgctggaatcgtcccatgcgatgatcgtggcgtttacggtgattggttgtgacctgatgttcaaaggacagcgctgttaccgtgcggtggactgcaataccacgatttacagcgagatgccgaaaacgggagatgtgttgcgtggccgcgtcaatatcacctctgttgtgcgggtaggcggcttgattctagtcgcttatgaatatctttgttatgtggaggaacgtctggtattccggctggtggccaactccggtttctttggccgcaaagaaattgagaacgcaggtaactttgataccagcgcttatttcgccaaaggcaaaaatggcattccagcaaaaccctttacaccgttgctgcactgtgatcggacaacattcaatgagcaggatatcactaacgtcatgaatggtgatctcgctgcctgtttcgggtcgcagtatcaatataaccgggaaggcaaattatgcgtcccggatacccgcatgttaagtcggatcttgaatgtcgatacagcgggtggcgcattcggtctggggcagattgtggcggaattagatatcgatcccgcacattgggcattcaaagctcacttcaagaacgatccggtgatgccggggactttactggtagaaggctctgaacaattgatgaagttctatctgttctatctcggactgaactcacagcctgatctggaagtgcatacgctgactgaacatacatccggtgccaaattccgtggtgaagtgaaatgcgaacgggatgtggtgcagttccggctgacctgtaaagccattgatgccctctattctgatgacaagctggagtctattactttgtttttcattgcggagacgctctatcgcggcaatgtagttggcgtgagtgacaacatgggcgtgagatacgagcgacgccagccacaccagatcatggcggcagaactgaaacaggaagctttaaaatga

SEQ ID NO: 3789 - DNA, 3081 bp, Xenorhabdus bovienii
  Coding sequence Name=Xb4151_4152.C440.gene168.dna; Position on contig= 130476..133556bp; Strand=+
atgagtcagcgcttatctgtgaatcaatcgaaccatcaactgacagcgttaccgctaacgatagggatctcccacttgcaggcgttgtcgactgaactgcgtgtcgtaaaggtgggtgaatcaatatcactgttattgccagatgacataatagcagaacagacgaccctgcttggtcgcctgccagcagtgacggcaggcagtttgggggatgcaggtttcatggcggattacggcgtgaattacgcctattacgcgggtgcgatggcaaatggcatccactctgaagaaatggttattgcgctgggaaaacagcgcattcttgggatatttggttcaggtggcctgcgtattccacggattgctgaggcgattgcccgtatccggcaggcattacccgaaggcccatttggtgtcaacctgctgcataacccgggtaatcctgagtgggaaatggcctgtgtacgtctgtgcatagaaaatcaggtgcgggtgattgaagcctcggcttacatcaaccttagttcggcgctggtctattaccgcgccagtggtctggtacaacaagctgacggcactatcttgcgtcatcatcgtctgattgccaaagtttcccgtcgcgaagtcgctcagaacttcctgcggccagcgccggaaaagattttgcaaaaattactggcagaggagcttatcacacctgagcaggcagaactggctcgccaaataccgatggcagatgatatcacggtagaaggggattcagggggtcatactgatcagggcgtgctcgcctgcatttttcgttcagtcgtccagttacgggatgaaattgcagacgaaactcagcatgactatcaggtgcggattggtgcggcgggcggtctgggaacacctcatgccattctggccgcttttgctctgggcgcggcttatgttgtcactggctcgatcaatcaggcttgtgtggaagccggcacatcccgcgcggtgaaaaaaatgctggggcaggctcacattaatgatgttgccactgcaccctcagcggacatgtttgaactgggagcaaaagtacaggtactgaaacagggcagtatgtatgcagtgcgagcacagaaattatacaatctgtataagcagcacgacagtctggacaccctgcctgtacaggaaatcgctctgctggaaaaacagatattccacaaaccactgacggaaatctggcaggaaactattgcctatttccagagtattcaccaactggacatcattgccaaagcggaaaaacagccgaagacaaagatggcgttggtgttccaatggtatctcggccagtcatcccgctgggcgatcacgggtgatccagtccgcaatctggattaccagatctggtgtggtgcggcgatgggtgccatgaacgaatggctgcaaggaacgccttttgaagcagtggaaaacaggcatgtcagcgacattgcccaattgctgatgaagggggcggcttatctcactcgcattaccctacttgaattattcaatgttgctgttcctgagcagattaaacggtatctaccgttgcatttctacacgggcggggaaaattccccgccaaatgaatttagtcatgaaccatctaacgacgatcttactgaccacagtcaggttgagaatcgtcatcttaatttaatgtcaattcaaaaatcacaggtgaggggtaaagaacctatggacgcttcaacaaaactggtattggataattcaaaggacttttataaaaaatgttgggagctgatgcctggtggtacgcactacaactttggtgatcctgagcgcccgctggtgatccctttcaaccgtgggcgcaattcccgtgtatgggatttggatggtaatgaacatcttgatctgttctgtaaatttggtgcattactggttggacaccacaatgaggcttataaccaatccctgatcgaatatatgggtaaagtgacttcagttgatacctgcgatctggaagtgggtgtctgcgaaacgttggttaaacatattccctgtgcagaaatggtgcgtttctgcctgagcggaacagaagcagtacagaatgcgttgcgtcttgcccgtgcctttacgggcaaaaatcgctttattcgcttccacggccattaccacggtaacgccgacaatatcatgggctggcgtaaaaagcaggatctcacttaccccgtaccagagcagttcaacggggacctgctggatacactgggacgtgatcccaaaatcatggtagaccaaacgttcatgttgccctggaatgacattgatgttctgacggcgactattgaacgttatcacaatgaaatcggcgctgttctgatggaacctctctgcatcaatggtggcgggattttcccggaagaaggttatctggaaaaaaccaaagcattatgtgaaaaacataacattgtgttgatttttgatgaaatcatcacgggtgttcgtttaggactggggggagcacaaaaaatactgggcgtgacaccacatctggcgaccttcgggaaagctcttggcggcggctccatgccaatctctgctattgtcggtcgtagtgacatcatgaacctgtacacccgtggaaaagtgattcatgcaggcactttcaacggttacccactgggtctggcagcaattcagacgacctttaatttgattgaacaagatcccggctgctatgaccgtatggggaatatcatgcgtcagatctccgacgtgttcgtgaaagcggccaaagcggttgacctgccactcgtggtacagggaatgccaaccgcgctggtttatcactcccagagcatccccgtcagttctacggaaggctacagcgataaagtcaaattctgcgacatcatcattcgtgaaatatccaaacgctatggcattcagttctcaccattgtctcgcatgtactctaacctattgatgtcacaggatgacgtgcgtttcttcgaagagaggatctttgatgcgatggtaaatgctcgcaaagtcattgatatcgcattcaaagaaggaattgatgcatga

SEQ ID NO: 3790 - DNA, 768 bp, Xenorhabdus bovienii
  Coding sequence Name=Xb4151_4152.C440.gene169.dna; Position on contig= 133553..134320bp; Strand=+
atgagccgacaaattgctgtcgtcactggggctgcggggggattcggcacagcgattagcaaggtgttgctggatattggttatctggtggcggcaacggatgtcagcagtcaaaaactggcgctcctgaaggagcgtctcggacaccctgaatcccttgcaacctttgaaatggacgtaactgacttagcctcagtagaacaggcggcgcaacagattgttgaaacattcggtgacaccattacggtgctggtgaacaacgcaggcattattaatcgggcattctgtctttccggccaagggtttagtgagacaaccaaggttataaacgtcaatttgataggtgctttcaacagcacatcaatttttgtccgctacatggcgcgcctgaaatatgggcgcatcatcaacattgcctcggttgcgggcatttggggagcggcaggtagttccgcttatggcgcttcaaaagcaggtctgatctctgcgacagaatcctgggggcgtgaattgggtccactgaatatcagtgtgacagccgttgctccgggggtctgtaaaaccgacatgctggagcagtttgtggaatcaggcccgatggagtcggcgggagaggataaggttgtacgttccattgttccggtcgggcgttggggaacgccagatgacgtggctgaagttgtgggatttttggcgagttgcaaaactaactacctcaattccgcagtgatcccattggatggcggaatgcgtgtcggaacgttatag

SEQ ID NO: 3791 - DNA, 1233 bp, Xenorhabdus bovienii
  Coding sequence Name=Xb4151_4152.C440.gene170.dna; Position on contig= 134413..135645bp; Strand=+
atgttcgaccataataaaaaggacgtcagtagtatcttgcttaccggtgcaactggcgtgatggggggaaggatccttctggaaattctgacgacgacggatattgaggtttactgtctgatacgggcagaaaacagccagcaggcaatggaacgtctgaaaggtatcttgtttgcttatgatcaggaaaaacaaagtgagcacactcatcatcggattattccggtactgggggatgtctctaaaaaaagattggggctgacacaagagctttaccgcgaactggctgacaaagttgaccgggtcattcattgcgctgctaacgttagtcttgtggcgtcttataaaaagattgcgcctgttaacgtgcaggggacacagaatgtcattgatttctgtctccggggcaatgtagcgatgttgcatgcttccagtttcagcatggcaggggatcgcctgtataaggacggttttgtcctgcatgaaacagatctggacgtggggcaacgatttgatgacatggattacgaacgctccaaatttgagtccgaaaaaattattcacagtgccggaaaaaaagggctgaagtgggtgattgtgcgcccgggcaacatttggggagaaagtacaaatgggcgttacccattagcgcatacgaaggtcaagggcatttattacgaaatggttaaggcattagtggaaactggtctgacgttcaatgcacaggacgattttgatatcactcctgtggattacgtggcggaagcctcgctgtatgccattttcaatattgagaaatttaatgggaagacgcttaatctgactaatcctaacccgattacgttcaatgatatcgtctctttcctgcgtgattttggttatcgtattgataccattaacatgaatgattacatggaagcactgtcacaaaaccgtctgtaccgttatgaccagccttatcgctcggtttttaccgatctgctggggctattttattccggcatggaactgaccgaaaaagccaaatattccacacaactgacaactgaattactcagtggcagtggaattcagtgccccctgtcggatagaacgttacttttccattacttcaattacctggtcgaatgtgagtttattgcgccgccacaacagcagggagaaagggctgaaatacgggaagcatctgtacgggggagttatctggaacaactgtttgatgctgatttgtaa

SEQ ID NO: 3792 - DNA, 924 bp, Xenorhabdus bovienii
  Coding sequence Name=Xb4151_4152.C440.gene171.dna; Position on contig= 135645..136568bp; Strand=+
atgaggatatacgaggcgacatggctgcatctggatcctgatcttcttcaagggttgtttataaaacaatctaataaaagacaagtaatgacagaaatatgtattgaatcggagcttgcaatgattgaacaaaatcttaaggtgacgttggttcaaaccgatttggtttgggaaaatgcagaacaaaaccgtgaacatatcgaacagcacatcgatcagatcacaggtagtgatctgattatcttaccggagatgtttaccacgggtttcagcatgaagccacaggccattgctgagacaatgacagggccaagtattcagtggatgaaggcgatggctgccaagaaagattgtgccattgtcggcagcatcattatcacggaaaaccagcgcttttataaccgtctgctgtgggttaatcccgatggctctgtcgctcattatgacaaaaaacatctctttactttcgcccaggaagatcacgaatacaccgcaggcaatgccccgctggtggtgaattttaagggttggaaaatcgctgcctttatctgttatgacctgcgtttccccgtctggtcgcgtaacgtcaatggtcattatgatgcggcgatctacatcgccagctggccggcaagacgttcggctcactggtgctcgcttcttcaggctcgcgccattgaaaaccagagctacattatcggggttaaccgtgttgggcaggatggcaaccaactagactatgacggccacaccatgttgatcgacccactgggtgaaatactgctgcacgaaatgaatcacgaagtggtgaaaactgtgcatctgtcactctcccatgtgcagggtgtcagggaacgtttcccatttctgaaagatgctgatctctttgttttgaacaacgatgtgttaggaaatgatacctaa

SEQ ID NO: 3793 - DNA, 162 bp, Xenorhabdus bovienii
  Coding sequence Name=Xb4151_4152.C440.gene172.dna; Position on contig= 136492..136653bp; Strand=-
atgctgctgctcccagaggaatattcttttcaacgaggtgaaacaggcggcagtagccatcttccttcaacaatgcagagttacgttaggtatcatttcctaacacatcgttgttcaaaacaaagagatcagcatctttcagaaatgggaaacgttccctga

SEQ ID NO: 3794 - DNA, 219 bp, Xenorhabdus bovienii
  Coding sequence Name=Xb4151_4152.C440.gene173.dna; Position on contig= 136660..136878bp; Strand=-
atgcaatgtctgagtcaatctcaactgtttttgctccaggggggctttgggttgaaatgtatgtttttgcatatgcatacgacctccggcaaatttcattgttatccctcttatctttccagttttggctttgtcggctgcaactggaaatctattaggtatggatggagtgagtttgattcagcatcaggacgatgttcccaaacaatacgatcatga

SEQ ID NO: 3795 - DNA, 750 bp, Xenorhabdus bovienii
  Coding sequence Name=Xb4151_4152.C440.gene174.dna; Position on contig= 136780..137529bp; Strand=+
atgaaatttgccggaggtcgtatgcatatgcaaaaacatacatttcaacccaaagcccccctggagcaaaaacagttgagattgactcagacattgcatcaggcgtttgagcagaaggtacagcgctatccacacgccattgtgctgaatactgagaacgggttggggctgacttatgagcagtttaatcagcgagccaatcaactggcgcactatatcctgcaaatcaaacagcagatgggggaaacggacgccttttcacccgttatcggaatctgtctggagcatgatgaagagatgctggtatccattctggcaatcctgaaagcgggactggcttacctgcccattaacagcacccatggagcggaaagaatcggtttttacattgaagatgcgggtgtcaagcttgtcattggcgtcttgcagtatcaatcactatttgatgaaagtaaggtagattacctctgcattgacagcgaaaaagcctttatccagaccatgccattacataacccggatgtgagtattcattctgactcattggcttgtatcgcctacgtatctaagactgccggtgtctcgaaaagcgttgacatatcccataccagcgcgatgcgactgagtgccatgagattgcttcgtgctgagaaacatcatcttgatttgacagaaaataactcgacagaaaatgacatttggacactgcttgacgccagtacttttgaagttcacacgatgggaaaatga

SEQ ID NO: 3796 - DNA, 129 bp, Xenorhabdus bovienii
  Coding sequence Name=Xb4151_4152.C440.gene175.dna; Position on contig= 137504..137632bp; Strand=+
ttgaagttcacacgatgggaaaatgacgttaccaatatttatgtcacactctttagtgagagcacaacttatcaccaaatgagacacagagaattttatgggtattcaacacaacgagaaagtgattga

SEQ ID NO: 3797 - DNA, 945 bp, Xenorhabdus bovienii
  Coding sequence Name=Xb4151_4152.C440.gene176.dna; Position on contig= 137601..138545bp; Strand=+
atgggtattcaacacaacgagaaagtgattgagtttgaacaggtcaagaagcactacaaggactatcaagcgctaaaaggaatttccctggatgtctatcgcggagagttcctgggtctgcttggtccgaatggggcgggtaaaacgacactggtcgaaatactggaagggctgaaaacgccggattcaggctcggttcgggtattaggcaaaacatggcagcaggacgcgccttacctgcgtcagcacctcagcggtgtcttacagcagaccctgtttatcgataagctcagtgtagaagaaacacttaacctgtttggcagcttttatggttgttcacgtaaacgagcgcaggaggtgatggaactggtcgagctggaagaaaaacgcaaaacctatgtagaggggttatccggtggtcagcgtcagcgtctcgcattgggtgtgtccatcatcaatgagccggaaatcctgatcctggacgaacccaccacggggcttgacccgcgcattcgtcatgatacttgggatatcctgcgtaagctcaaccgtgaaaagcactcaactatgatcttaactacccactatatggaggaagctgagtatctctgtgatcgcatttgtatcatgaataagggagaaattatcacacagggcagtatggatgagttgttgaaaaaacactgcgatggcgatctcattgaattccgtacccattttcctgaccgcttgcaggtactgagtcaacatgctcaagtcttaaactatgagtacgatgaaaggaaagataagatctgtatgctgattgaagattccaccagttttgttgctcatctttttgagtttgccaaacaagtcgaggttgacatcattgaactgatggtcaggaagaaaacgctggatgacttgttcatgactttggccgggagaaggttacatgaatag

SEQ ID NO: 3798 - DNA, 1098 bp, Xenorhabdus bovienii
  Coding sequence Name=Xb4151_4152.C440.gene177.dna; Position on contig= 138538..139635bp; Strand=+
atgaatagtgcactgctcaacttgatgaaaactcaattccggcaatatatccgtgagccggaaattttgttctggtcgtttggttttcctctattgctggtctggctactaggggtttcgttctcctctcaggacattcccgaaagagaaatcggcatcgtgctgcctgtggaagccgtagaacagcagcaagtcaaacagtggggagagcagcttactgcgcaggagcacatgatctcaggcattatcaataaaaaagaaatcaagcgtgaaaggctggtcaaagttcggtacaacatcacctactatcctgatcatgagtctgtcgtgcgcgggctgaagcgaggggatatccagatgttcattgaacaggataaagagggaaaacgtgtccattaccttgacccacagaacagcgacgccttactgacctattacctgcttaaccagcaagagggaatagaggttgaaaaaaacctgtttatactggaaacaccgggactgcgctatgtggattttctggtaccgggcttactggcaatggcgattatggagacttgcctgattgcggttggctgggcactggcggaaaagcgcatcacacgggtcactcgtcagatgtgcattaccccgatgcgcaaatccacattcctgctggcgcatatcctttcctgccttttgatcagcattaccgagatattaatcatctacctgtttgcagacctctattttgatgtagaaatacaaggctcgttttacgctttcctgctcttgatgctcacggggaatatttgcttttccggtgtggcagtgctggtggcatcccgcgcccgcaaagcccaaaccgcgaatggattgttggaagtttccattttgattcaggttttgttgtcagggatttttttcagttacaaaaacttcccgcagtggatggcgaatattattgaatacctgccattaaccattctggccgacaatatgcgcaaagtatttattgaaggtggtgatttattgcaggccgtgcccgcagcaatcatcttgagtgtcattgggattgtgacatttgtgttgggtatgaaaatatttcgctggtattga

SEQ ID NO: 3799 - DNA, 1752 bp, Xenorhabdus bovienii
  Coding sequence Name=Xb4151_4152.C440.gene178.dna; Position on contig= 139699..141450bp; Strand=-
atgagtacattattatcaacccaaaatctgtcattccatcacggtcacactccactgttagccgatatttctatctccattaataaaggcgagaaaatcggtctgatcgggtataacggttgtggaaaaagtacgctactgaaattactttcttccaaattatcaccgaatgaaggaaccgtaacactggcaaatcactgcattctggcctacaccgaacagcatttaccggttacattgcacagtatgacgctgattgaggctgtgttggataaactgccggcagaacaacgaattgaggacaattggcgggcggaaattttgttaagtgaaatggggtttcagccggagcaacacagtctggcgatctcagcactcagtggcggtcagcatacgcgcttattactggcgcgggcgcttatcattaacccagatttattattgctggatgagccgagtaaccatctcgatttgccgacaattctctggcttgagcaatttctgacacagtggtgcggcagttttattctagtttctcatgacaatacactgttggatcacttaacgaattgcacctggatattacgcgacggtaatgtgtctctctatcgtcttccgtgctcgcaagcccgtgaagcgcagacagcacaagatctcagtgatgaacaccgccataacgcgcagcaaaaagagattgatcgcatcgcgcacagtgccaaacgtctggctatctggggcaaagtgtacgataacgaagcgctttcccgtaaagccaaacaaatggagaaacacgtcgaccgtttgcaggactgtcaggttgaactggctgttagcagccaatggcggttgaaactgaccggtgatattttgcgtgcagatcgcctgtgtgagttcaatcaactgacggtgatcccggcaccgtcctgcccaccactatataaaacggacaatttatccgtgaaaagcggtgatcgcattgcaattatgggtgcgaacggaaccggaaaatcatctctgttaagaatgattttggcacaatcgcaatctcagactctgacgctgccggatagtcctcttgtactgcatccgcgtgtcaatcttgggtattacgaccagaaactggcacagttgtccgatagtgatacgctgtctgatgccttaaaaccgtttgctgccctgctagacaaacagcggaaaatggcgttgatcagcgcggggtttccgtatttgcgccatcaacaaacagtcgcatcattgagtggtggtgaacgcgccagactgttattcatcggcctgagtttggcgaaatattcattattgatgctggatgaaccaaccaaccatttggatatggatggtaaaaatacgcttcgcgatgaaatccggctgttcgcgggtggattattgctggtcagccatgatcgtgaattgattgagcaaagctgtaaccgttattggtatattgatggtcagcgtttaacggaataccacgatttggatgcggtatatcagaaaatccgtcacgctaatagcaatacacaaacgggcagcgcacccgtatctacgttttctctcgaaccatcatcggaagtgctctctaatgatgacgaaatgaaactggcagagctgatttcactagaggaaaaactggcgacagatttgcaacgcaaggctgcacaccagaaaccgatattacagcagcaatggcgtgagcgagtagcccagttgcgtcgacaattgtcgttggattga

SEQ ID NO: 3800 - DNA, 99 bp, Xenorhabdus bovienii
  Coding sequence Name=Xb4151_4152.C440.gene179.dna; Position on contig= 142112..142210bp; Strand=-
atgattcactgctccttctttcagtccatactaaaatgcgtccaaaagctatcgcttttatctgaacacagcccaagttcaaaatacctaataaaatag

SEQ ID NO: 3801 - DNA, 162 bp, Xenorhabdus bovienii
  Coding sequence Name=Xb4151_4152.C440.gene180.dna; Position on contig= 142569..142730bp; Strand=-
atgagtatctttttccaccctttaagattgcaagctgaatgcatcatctctttgggagttaacaaagtcaatacaatgaaattacaaataatttactttatgatgtttttcacaatttataaaagcagttttatttacaatttatgcatagtttatgcataa

SEQ ID NO: 3802 - DNA, 1212 bp, Xenorhabdus bovienii
  Coding sequence Name=Xb4151_4152.C440.gene181.dna; Position on contig= 142860..144071bp; Strand=+
atgtcaaacacgattcagagaagctggtttgatcagtatatggtcccttgtttttcaccggctcaatttattcctgtccgcgccaaaggttctcgtgtatgggatcaggaagggaaagaatacgttgattttgccggtggtatcgcggtgaactcattgggacatgccaatgatgagttaaagaaagtattaacttctcaaatagaaagtatgtggcatgttggtaatggttatacgaatgaacctgttttgaaactggcaaaaacacttgtcgaaaatacctttgctgataaggtttttttctgtaattcgggtgctgaagcaaatgaagctgcactaaagattgcgagaaaatatgctttagataaatatggcagtcataaaaacgaaatcatttcatttgaaaattccttccacggtagaacattatttacggtgactgtgggcggccaacccaaatactcacaagatttcgcgccattgccgcaacaaattagccatcttccctataacaatattgacgctatcaaagcccacatttcggaaaatacttgcgctgtgattgtggaacctatcattggtgaaggcggtgtcattcctgctgatcctgccttcctgaaagctttgcgggaactgtgtgaccaacatcaggcattgttgatttttgatgaaatccagacaggagttggtcggacagggtatttttatgcttacgaagaaacaggtgttgagccagatatcctgactagcgccaaaggtcttggtggcggttttcctatcggagccatgctggttaaacagcctatagcagacgttttccagccgggttcacacggtacaacattcggcggtaatccgctggcggcggcggttgccaatcaggtagttgctttagttaaccaaccggagtttctggcgggagtacaagagcgtcatcataaatttatcaagcgtatgtcagatttgaaccaacgttatcacgtgttcagtgaattacgtggaaaaggcttgctgctgggagccgaactggagaaaaaatatcagggtaaggctaaaaccctgagcaatatcgctgcggaagaagggttgattgccttgattgccggtccaaatgtgttgcgttttgcccctgcgttaaatatcgaagagcaggacatcaatgacggtttcgcccgtcttgaaaacgccctcaagcgatttgttcaggaataa

SEQ ID NO: 3803 - DNA, 1047 bp, Xenorhabdus bovienii
  Coding sequence Name=Xb4151_4152.C440.gene182.dna; Position on contig= 144092..145138bp; Strand=+
atgatgctatttagatccgttcaacataaagatttaggagatattctcgatctttcgtcccgtgctggcgttggtctgacatcgctgccacataatcaggaatacctgacggcacggatttcacgcagcattgattcatttaacgatgtaaatggacgagcacagcagggattcctatttactctggaagatacggagaagcatcgtgttgttggtgttagtgcactggaagttgcggtagggctggaagacgcattctataatttccgtttacagcggtcggtgcgtgcatcccgtgaactgggcgtttacaacacatttgaaacgcttatggtggggcaggattatacggggtgtagtgagttatgtacgttgttcctcgaccctgattatcaggggggaggtaatggtgttttcctttccagaagccgcttcctgtttatttcggcattcaggcatctctttccaaaatctatttttgcggaaatgcgtggggtggtggatctacagggagaatccccgttttggaatgcccttgggcaacactttttcaatatccctttcgctcaggccgattacttgaccggcattggtataagaacgtttattgcggaattgatgccattccatcccatttatgtacctctactgccggaagatgcgcagaaagccatcggtcaggtgcatgaaaataccgtacccgctcgcgctatcttagaaaaggaaggtttcttctataacgatggggtcgatatttttgatgcaggtgccatcttgcaagcagaaattgataatgtgcgttcgatcaaggcaagtcggcttgcctatgtcaaaaaaagcgaaaaggtctcccgacagagtaatggggtgccgtgtattgtttccaatgtgcactttcaggactttaaggcactgctcctgaatatccctgatccgtttagttatgatgaactgcaactgactcctgcggagatggaagtgctccatgtggatgagggggatgctgtgcgctttatttctcttttttctgagggatcttcacaatga

SEQ ID NO: 3804 - DNA, 1479 bp, Xenorhabdus bovienii
  Coding sequence Name=Xb4151_4152.C440.gene183.dna; Position on contig= 145135..146613bp; Strand=+
atgaatcatcaagcaaattatatcggtagcgggtgggtagcagggcaaggcgaacccgtcatcaaatattcccctcttgatcagcggattttatggcaggcaaacagtgcttctgtcagtcaagtaaatgacgcgtgtcaatctgcccgcagggcgttcccggcatgggcgaaactgacggctgaaaaacgtatagctattattcaggcgtttgctgatttactcacacaggaaaaagaggccattgcccgtgtgatcagcgaagaaaccagtaagcctttgtgggaaacaaggacagaagttcagtctatgattggcaaagttgctatttccattgagggatggcaacagcggactggctattcagaaacgcctatgccagatggcaaggcgatattacagcaccgtccccacggcgtgatggcggttttcggcccttataattttcccggccatttacctaacggccatattgttccggcgttgattgccggtaatacactggtgtttaagccgagtgaactgacccccatgacggcggaaaaaaccgtgcaattatggatcaaagcggggttgcctgcgggtgtgttgaatctggttcaagggggaagggaaactggcggtgcattgctggatagccgtgagattgacggtgtgttgtttaccggcagtgcagcgacagggtttcatttccaccgcgtacttgcgggtcagcctgaaaaaatgctggcgctggaaatgggcggcaacaatgctctgattgtggatgattatgacgatcttgaggccgcggtttacaccatcatccaatctgcgtttatttctgctgggcagcgctgtacctgtgcccgcaggctgttggtaaaacgtggagagaagggggatgctctgattcaacggctacttgataccgcaggtcagattatcccgtctcgctgggatgccgatccccaaccgtttataggcggggtgatctcgttgcccgcagtagaaaatctgctggatgctcagtcacgattacaggcattgggcggcgtttcgctgctgactatgactcaacctgatcctgactcaacgtttatgacacccggcattatcgatctgaccgatgccaaagaggttcctgacgaagaatattttggacctctgttaaccttgaagcgttatgacacttttgaagaagccatctctatcgcaaatgatacgcgctttggtcttgcaacggggttaatttcgccggatgccgctctattcgagcatctgttgcaggaggcgagggcagggattgtgaattggaacaaaccgttgaccggcgcctccagcgctgccccgttcggtggtattggtgcatcgggcaatcatcgtcccagtgcgtactatgccgcagattattgtgcctggccaatggcatctctgacggcagacaagctggttttacctgatgcaccggcgccgggtctggattttttccgttcctga

SEQ ID NO: 3805 - DNA, 1344 bp, Xenorhabdus bovienii
  Coding sequence Name=Xb4151_4152.C440.gene184.dna; Position on contig= 146650..147993bp; Strand=+
atgtcaggaattgaagcaaattttgatggcctggtgggtatgactcaccattacgccgggctgtcaatgggtaatgaagcctcgatgactcatcgggggcaacagtccaatccccgcaaagctgcgcttcagggattgatgaaaatgaagtcgctgtctgatatggggctggttcagggggttctgcccccgcagcagcgccctaaccttcccgcactgcggcagttgggttttactggcagtgatgagcaggtattaagcaaagctgcacaatattcacccttgttgctgtccaatctcagttccgcttcttccatgtggacagcaaatgcagcaacggtttcaccttctgctgacagtgctgatcaacgagtccattttacggtggcgaacctgaataacaaactgcatcgttcattggaaagtacagtcaccgcgcgagtgctggaagccgtctttcctgatcaggcttgtttcgcccatcatgatcctttgcctcaacatggggactggggagatgaaggtgcggcaaaccataatcgtttctgcggcgaatatggtgaagcgggtgtgcagctatttgtgtatggtcgcagtgccttacaggaaggcacggcacctaaactctatccggcaaggcagacattggaagccagtcaggcggtcgctcgtctgcaccaacttgaggccgctcaaacggtatttgcccagcagaatccggtcgctattgatagcggagtgtttcataacgacgtgatcgctgtcagtaaccgcaatgtttttttccatcatcagcaggcctttgtgaatcagcagtccgtattggctgaacttgagaaaaaaatggtgcggcttgggcaaaaattgattgcggttgaagtcccttcatcacaagtgacgcttcaggatgcggttggatcctatctttttaacagtcaattattgagccaacctaatggcgatatgatgttgatcttgccagaagagtgtcgccagaatgtcaatgtctgggcgtatttgcaggctttggttgctggtgccgattcccctattaagaaactccacttttttgatttacgggaaagtatgcgtaatggcggaggccctgcctgcctgcggttacgtgtcgtcttgaaagaacaggagttagcggcggtgaatcaggctgctctgatgacgccggaactgtatcaacgcctgacctcttgggttgaacggtattatcgcgattccctgtataccgcagatttggttgatccccaattgctgaatgaagtctattttgcccttgatgaattgacccagatcctcaagctcggctcgatctatgagtttcagcgttaa

SEQ ID NO: 3806 - DNA, 975 bp, Xenorhabdus bovienii
  Coding sequence Name=Xb4151_4152.C440.gene185.dna; Position on contig= 148006..148980bp; Strand=+
atggatttattgaccttattgtttgaaaagaaactggagaaagttctgcatttcccacctgctttaaaagcctcatggctggcggagggagtattgcaattgctgccacaggagagcaaagcggatacgttgattctctccgtcggtatccacggtaatgaaaccgcgcccgtggagctcctgattcagttagtgtcgcaacttgctctgggaagcctaccgttgcagcacaaccttctgctgattttcggtaatgtacccgccatgcgtgaaaataagcgttatatcgataatgatctcaatcgcatgtttggcggccgccaccagaattttccttcagggaatgaatcccaacgagcgatggagctggaaacggttgttcgccagttctttcgtgagccagcagttagggcatcaacacggcgctggcaccttgatctgcatacggcaattcgcggctcctgccatgaacagtttgctttgctgccgtttcaggctcgtgaatatgcatctgatttcctacagtggctggaggggagcgatattgatgctctggtcttccataacgcagccggcgggacgttcagtcactttaccagtgaacatttcaacgtagagagttgtacgatggaggtgggtaaagcacgtccttttggacagaacgacctgagcagatttaataatattacgcttgcattacgtgatgtcgtggcgggttcgtttttgattaaacgggaaaaaccgacaatgaagcgttaccgtgttatagacgcgattatcaaacaagaggacagttttcggctccatattcctgaggatacgaaaaacttcactgcgctgccggacgggttcgaaattgccagccagccgaatcaattctggaaaattacttctcctgcaaactttattctatttcccaacgctcatgttgccattggtcagcgtgcgggtctattgctggtgcaattaacgtaa

SEQ ID NO: 3807 - DNA, 1425 bp, Xenorhabdus bovienii
  Coding sequence Name=Xb4151_4152.C440.gene186.dna; Position on contig= 149002..150426bp; Strand=+
atgacgaggacggtaaaaacacctgtggagcaatccgcaggtgcgcagaaacttcaccgcggattaggcaaacgtcatgttcaattaattgctattggaggggctattggtacagggttgtttatgggaacgggaaaaaccattgctgtatcaggcacttcaataatcctgacttacctgctgatcggtttttttgctttcatggtcatgcgggcgatgggagaactgttgctcacaaaactggattaccgaacctttgctgattttgtggcggattatctcggtgagaaagccagttattttcttggctggacatactggatgagctgggtagtcagctgtattgcggatgttgtagtgtgcggtggctatatccaatattggtttcctgatgtctcactctggttcacagctctgtcacttttggggctgatatgtttgtgtaacttcttttcggtacagttattcggcgaaactgaattctggttcgctatgatcaaagtcgtggcaatcgtagcactgattatcgtcggtgtcggcatggtgtttgtcggatggacatcgcctaatggcgtgacagcgtctgttcgtcatttgactgatcctgaagtgttcttgccgaacgggatgtttgggtttctggcaggctttcagattgccattttctcttttactggcattgagctggttggcaccgtgactgcggaaactaaagaaccagaaaaagttttaccgaaagccatcaacactattcccatcaggatcatcattttctatgtgctttctattatgtgcattatcgccgtgacttcgtggacgaatatttccccggaagtcagcccgtttgtgacgctgtttgcattggctgggttgcctgcggcggcggcagtgattaattttgtcgctctgacttcggcgatgtcttcggctaatagtggtttatacgcgtgtacccggatgctgtatggcttgtccacagaaaagctggcgcatggtaaattcgcacaactctcagtgagcagtgcggttcctatcttcagtttgatattttctgttatctgcatggcaagcggggtattcctgctgttcattgtccccaacgtgatgaaattatttactattgtctcaacggtggcggctattatggtcatttatagctggggaatgatattgattgcttacctggcttatcgtaaaaaacgtcctgatttgcataaaatttccatctataaaatgcctatgggcataccaatgacatggtgtaccttgatattctttgctttcacagtagtgattatggtgtttgattacgatacccgcgttgcattatatggcacaccgatatggtttgtgatattggaggttttgtggcgtatgcggaaaaatcggaagcagcgtgtaatagaaaaaagagtggtaaattaa

SEQ ID NO: 3808 - DNA, 138 bp, Xenorhabdus bovienii
  Coding sequence Name=Xb4151_4152.C440.gene187.dna; Position on contig= 150544..150681bp; Strand=+
atgatccctttttattaccttaccaataaaaaagatgattattgctataaaaaaataaccccagccaaaaagtatggggttattttatctgtcgcagttatctcatcatgtttctcacaatcagagaaaacgacttag

SEQ ID NO: 3809 - DNA, 2067 bp, Xenorhabdus bovienii
  Coding sequence Name=Xb4151_4152.C440.gene188.dna; Position on contig= 150692..152758bp; Strand=-
atggagcaaaaaggcgttcgcctgagtgttttcaaacctatcgcacaaccacgccatagtggttctcaggatcaaaccacatccatcatccgttctcactccagcatgcacgctgctgaacctctggatatggcgtatgtggaatccctgctgaccaccaataagaaagatgtgttgatggaagaaatcgtggctcgttaccacgcaaacaccaaagatgccgaagtggttctgatcgaaggtctggtgccaactcgcaagcatccatttgcacagtcactgaactatgaaattgccaagacactgaatgcagacatcgtgtttgtcacggcactgggtacccattccccagaacagttaaaagagcagattgaactgagccgtgccgaatacggtggtataaaaaaccagaacatcatcggtgtgattgttaacaaactgaatgcacctgttgatgaacaaggccgtactcgcccagatttatcagaaatcttcgacgaagcctccaaagcgaccgttgcctacatcgatccaaaaaccgtattcaaaaacagcccactacctattctcggttgcattccgtggagtttcgacctgatcgcaacccgtgcaatcgacatggcgaaacacctgaaagcagacatcatcaacgaaggtgccattcagagccgtcgtattaaatcggtgactttctgtgctcgcagcattcctaacatgctggaatacttccgtccgggttctctgctggtcacttctgctgaccgtcctgacgtgctgatcacggcatgtctggccgcaatgaatggtgttgacgtaggtgcagttctgctgaccggcggctacgctattgatgattctatccgtgaactgtgcgaacgtgcattcaacactggcctgccggttttcacagtgaaaaccaacacctggcagacttccctgaacctgcaaagtttcagcctggaagtccctgctgatgatcatgagcgtatcgaaaaactgcaaaactacgttgcacaacacatcagcagcgaatggatcgattctctggctgctacttctgagcgtccaaaccgtctgtctccacctgcattccgttatcaactgaccgaattggcacgtcaggctggcaaacgtatcgttctgccagaaggcgacgaaccacgtacggtcaaagcagcggctatctgtgctgaacgtggcattgcagaatgtatcctgctgggtgatccggaagaaatccgccgtgtcgctgcggctcaaggtgttgagctgggcacgggcattgaactggttaatccagccgctgtgcgcgaacgttacgttccgcgtctggttgaactgcgtaaaagcaaaggcatgaccgaagttgtggcgcgtgagcaactggaagacaacgttgttctgggtacgctgatgctggaacaaggcgaagttgacggtctggtttccggtgcagttcacaccacggcgaacaccattcgtccaccgttgcagttaattaaaacagcaccaaacagctcactggtttcttctgtctttttcatgttactgccagaacaagtactggtttacggcgactgtgcgatcaacccagatccaaccgcagagcaactgtctgaaatcgccatccaatctgcggattcagccaaagcattcggcatcgatcctcgcgttgcgatgatctcctactccacgggtaactctggtgcgggcagcgatgtagagaaagttcgcgaagcgacgcgtctggcacaggaaaaacgtccggacctgatcatcgatggtccattgcagtacgacgcagctatcatggcagacgtagcaaaatccaaggcaccaaactcaccagttgctggtcaggctaccgtgttcatttttccggatctgaacaccggtaacactacttataaagcggtgcaacgttctgcggatctggtttccatcgggccaatgctgcaaggaatgcgcaagccagttaacgatctgtcccgtggcgcattggttgatgacatcgtttatactgttgcactgactgcgattcaggcagctcaacaagaaaacgcgtaa

SEQ ID NO: 3810 - DNA, 144 bp, Xenorhabdus bovienii
  Coding sequence Name=Xb4151_4152.C440.gene189.dna; Position on contig= 152757..152900bp; Strand=+
atggagcgaattacgcctaggctgacactggttaaaccaacgctggtgccagtagggatcaacataattatacgggacacggaaacctctttaacggttgctcgtcagtcaatcaacgtgactcaatgctatataaatagatga

SEQ ID NO: 3811 - DNA, 1203 bp, Xenorhabdus bovienii
  Coding sequence Name=Xb4151_4152.C440.gene190.dna; Position on contig= 152999..154201bp; Strand=-
atgtcaagtaagctggtactggttcttaactgcggtagctcctccctgaaattcgctatcatcaaccctgccaatggtgaagaatatctttccggtctggcagaatgctttggcctgcctgaagcccgtattaaatggaaaatggatggcgcgaaaaacgaagctgctttaggtgccggcgcagcacacagtgaagcactgaactttattgttaatactattttgtctgaaaagccagaactttctgcgcaaatttcagccatcggccatcgtatcgttcacggcggtgaaaaattcacgtcttccgttattatcactgatgaagtgatccaaggtattgaagccgctatcccattcgcaccgttgcacaaccctgctcacctgattggtatcgcagaagcgaaaaaagcattctctcatctggttgagaaaaatatcgccgtatttgacactgcattccaccagactatgccggaagaatcatacctatacgctctgccatacaacttgtacaaagagcatggcatccgtcgttacggcgcacatggcaccagccatttctacgttacccgtgaagccgccaaaatgctgaacaagccagtggaagaactgaacatcatcacctgccatttgggtaacggtggttctgtttctgccattgttaacggccaatgtgttgacacttccatgggtctgactccactggaaggtctggtaatgggaactcgtagtggtgacatcgatcctgctatcgtattccacctgcacgatgcaatgggcatgagcgttgatcagatcaatactctgctgactaaagaatctggtttactgggtctgactgaagtcaccagcgactgccgttatgtagaagataactacgaaaccaaagctgatgctaaacgtgcaatggacgtttactgccaccgtctggcgaaatacattggtgcatacagtgcactgatggaaggccgtctggatgcgattatcttcaccggcggcatcggtgaaaactcctcactggttcgtgaactggcagtgaaaaaaatcgctctgctgggcttcgaatatgatcacgagcgtaaccttgcagctcgcttcggcaaatctggcgttatcactactgataacagccgccctgctctggtgatcccaactaatgaagaattggtgatcgctcaggatgcagcgcgcctgactgcataa

SEQ ID NO: 3812 - DNA, 459 bp, Xenorhabdus bovienii
  Coding sequence Name=Xb4151_4152.C440.gene191.dna; Position on contig= 154463..154921bp; Strand=+
atgatgaatacgacgccacctgtcaaccaaggttggtttaagagagtacaattagggcagcaatatttgaaaacgtggccgctggaaaaacagctcgcgccaattttccctgaaaatcgcattatcaaagcgactcgttttggcattcgtttcatgccgccgctggcgatttttactttgacatggcaaattgcactgggtgggcaattggggccatctgccgcaaccgcgctgtttgcctgtagtttgccgttgcagggattatggtggttgggaaaacgtgcagcaacgcctttaccagaagggctgctgaaatggttttatgaaattcgtgagaaatttgccgaagcgggaattgccatgatgcctgtggaaagcacaccaacttacttctcgctggctgaattgcttaaacgggcattcaagcaactagataacgctttccttgatgatatttga

SEQ ID NO: 3813 - DNA, 675 bp, Xenorhabdus bovienii
  Coding sequence Name=Xb4151_4152.C440.gene192.dna; Position on contig= 155189..155863bp; Strand=+
gtggtactgaaatgcagaggtttcttattcgatctggatggcacgttgattgattcactaccggtagttgagcgtgcatggtgccagtttgcagataaaatggacatcgatagagatgaagtgttgagttttgttcatggtactccggctatgatatcactacgtcattttatgcctgatgcaagtgaagaggagatcaatcgcacttttaagtggattgaaaaaattgaatcagaagatacagaaggggttactgctttacccggtgcgattgcactgattgataaactcaatgcgctggatattccgtgggcgatagtgacttcgtgtacggttccccttgcttctgtccgtcataaagtggcggagttgcctgagcccgctcattgggttactgctgagagtatcaaaaatgggaaaccgaaccctgagccttatctgttgggagccagtatgctggggctgtcgccagaggagtgtgtggtttttgaagatgctgctgctggtattcatgcgggtctggatgctggctgtcaggtggtggttgtccataattcgccgggtattccacgtcgtgatgaacttcatcttgtgctcaataatctggaagacattgaaattagcaaatctggcggttatgtaacaatttatgccttaaatgaggaaaattgttga

SEQ ID NO: 3814 - DNA, 129 bp, Xenorhabdus bovienii
  Coding sequence Name=Xb4151_4152.C440.gene193.dna; Position on contig= 156001..156129bp; Strand=-
atgatcaccaataacgccacaacatccattctgactttattggtggtgaaaagaacaatggctactaataacagggtcaatacccacaacagttcgctattcaatatggcctctatcaacagtatctaa

SEQ ID NO: 3815 - DNA, 1755 bp, Xenorhabdus bovienii
  Coding sequence Name=Xb4151_4152.C440.gene194.dna; Position on contig= 156101..157855bp; Strand=+
atggatgttgtggcgttattggtgatcatcgtatttgtcctgagtggtacgctctccctgaatgaagccactatcggtttcagtgatccgaatgtcttgttgattgctgctctgtttgtcattggcgaggggctggtgaggacaggcgttgcctaccagatgggggattggctggttcgtgttgccggtagcagtgaaaccaaaatgctggctctgctgatgctgtcagttgccgggctgggggctttcatgagttccacgggggttgtggctatctttattcctgttgtcctgagtgtcgccgctagaatgaaaacctctccaggccggctgatgatgccgttgggttttgctggcttgattagtggcatgatgacgctggtcgcaacaccacccaatatggtggtcaatagtgaattggtgcgtgaaggtctgcggggttttgactttttttccattacaccgataggtattttagtgttgctggcgggaattgtttacatgcttgttacccgtcgttggctaggcgtgaaagcacttcagaaaccggacgaacgttaccatcgtacgtttcgtgacttgatccgtgactataaattaacgggtcgtgcccgccgtcttgctgtccgcgaaggctccccattgattggtcatgcactggatgaattgagtctgcgtacccactatggtgccaatgtggttggtattgaacgctggaggaagtttcgtcgggtgatggtagctgccaccggtgaaactgagttacatcagcaggatgtgctgctggtggatatgtccgatagcgatgtggatttgcgagaattttgcagcgagcaacagttagagccgatgatattgcgcggggaatatttttcggaacagtcccgtgatgtgggaatggccgaagtttctgtgatccctgaatcagagctattgggaaaatcgttgcgtgatatgaaatttcgcacacgttatggtctcaacgtggtggggattcgtcgtagcggtaaagccattgttgaaaaattagtcgatgaacctgtacaccttggtgacaccttactggtgattggcgactggaaactgattcgggcattgaaaaccaaaacacctgatttcattgtgttgaacctgcccgttgaagtggaaagtgccgctcctgcagcatcacaggcgcctcatgctctgttttgccttgcccttatggtggcgatgatgctgaccaatgaaattcccaattttgttgctgccttgattgcctgcctgctaatgggaaaatttcgctgtatcgatatggaaagcgcctatcgtgccattcactggccgagcatcattttgattgtcgggatgatgccttttgctctggcactacaaaaaacgggcggtattgatttaattgtcaaaggcttgatggatattgccggcaacatggggccgcgggtgatgctgttgtgcctgtttgtactctgtgcgctgatcgggttgtttatctccaatacagcgactgccgtattgatggcgccgattgctattgctgcggcgaaacagatgtctgtttcacccttgccctttgcgatgattattggtgttgcggcttcggctgcgtttatgacacctgtttcatctcctgttaatacgctgatactggggcctggtggatatcggtttgctgatttcctgaaacttggcgtaccttttacgctgatcgtcatggggattagtgtggcgatgatcccgatactttttccattttga

SEQ ID NO: 3816 - DNA, 723 bp, Xenorhabdus bovienii
  Coding sequence Name=Xb4151_4152.C440.gene195.dna; Position on contig= 157941..158663bp; Strand=-
atgccgcacatatcccccacactctcattcagtacagattccaattgcctttcacaacttattttggctcttaatgggtttacttccgtcctgactccgcccacaattaatcacattgttgtcccgcagcaagaggaaattatgagtcattttttcgcccagttatctcgcctgaagttgatcaatcgctggcctctcatgcgaaatgtacgtacagaaaatgtttcagagcacagtttgcaagtcgcttttgtcgcccacgcactggcggtgatcaaaaaccgtaaattcaacggcagtcttaatgccgaacggatcgccctgctggccatgtaccatgatgccagcgaagtcatcaccggagatctgcccaccccaattaaatattacaatccccaaattgcccacgaatacaaaaaaatagaaaaaatcgcccaacataaattattgactatgctgccttctgaattacaggatgattttcgctctattttggatgatcagcttcacacggacgaagaaactgccattgtcaaacaggccgatgcgttatgtgcttatttgaaatgtctggaggagctatcggctggcaacgctgaattcaatcaggccaaatcacgattggaaaaaacattggccgaacgccacagtgaagagatggattactttctgacagtgtttgtgccaggtttcagtctttcgcttgatgaaatcagcctgtaa

SEQ ID NO: 3817 - DNA, 1215 bp, Xenorhabdus bovienii
  Coding sequence Name=Xb4151_4152.C440.gene196.dna; Position on contig= 158714..159928bp; Strand=-
atgttttccattaataaatccagcaaattagataatgtctgctatgacatccggggtaataccctcaaagaagccaaacgacttgaagaagaaggcaataagatactgaaattaaacattggtaatccggcgccatttggcttcgaagcacccgatgaaattctggtcgatgttattcgcaatcttgcaaccgctcagggatactctgattcgaaagggctgtactccgcgcgcaaagcaatcatgcagcattatcaagccagaaatatgctggatattaccgttgaagatatctttattggtaacggtgtttctgagcttatcgttcaatccatgcaagctctgctcaatactggggatgaaatgttggtacctgcgccggattatcctctctggacagcagcggtatcactttccagcggcaaggctgttcattacctatgtgatgaacaacaaggctggttccctgatttagatgacattcgccgtaaaatcaccccgcgtacccgggggattgtcattattaacccgaacaacccaaccggagcggtatatagcaaagagctgctactggaaatcgtggaaattgcccgtcagcataatttgactattttcgccgatgagatttacgacaaaattctgtacgatgatgcccagcaccattccatcgcggcactggctcccgatctctttaccgttacctttaatggtttgtcaaaaacctatcgcgttgcgggtttccgtcaaggctggatggtactgaatggtccgaaaaaacaggccaaaggctatattgaagggctggagatgctggcatccatgcgtctttgcgccaacgtccctatgcagcacgccattcaaacagctttgggtggctatcagagcatcagcgaatttatttttccgggcggtcgcctttatgaacagcgtaatcgtgcatgggaattgattaatcagatcccaggtgtttcctgcgttaagcccatgggtgctctgtatatgttcccgaaaatagacaccaaacgtttcaacatccatgacgatcaaaaaatggtactggatctgttattacaggaaaaagtgctgctggttcaaggtacagcgttcaattggccagaacctgaccatttccgtattgtcacattgccacatacaactgatctgcaaatagcgattgagaaatttgcccgatttatcggcaattatcgtcaataa

SEQ ID NO: 3818 - DNA, 957 bp, Xenorhabdus bovienii
  Coding sequence Name=Xb4151_4152.C440.gene197.dna; Position on contig= 160741..161697bp; Strand=+
atgataaatgcaaatcgtcagataataaacctcgatctcgatctgctaagaacttttgttgccgttgctgacttaaatacttttgcagccgcagcagcagcagtttgtagaacgcaatcggctgtgagtcagcaaatgcaacgtctggagcatcttgtggggagagaattgtttgctcgccacggacgtaacaagctcctgactgaacatgggcttcaacttcttggttatgcacgccagattttgcgtgccaatgacgatgctactgcatcattgacgtacaatgatgctgacggtgaattaagaataggggcatctgatgatactgttgatacccttcttcctttcctgttaaatcgcattgcttctgtctatccacgcatggctgttgatgtgcgaatcaaacgcactcagtttattgaaagcatgctggataaccatgaaattgatttggcattgaccacagcaaaaattaatcaccatccaaaaacggttctgcgctcctcgcctgtactatggcactgtgcgcctgattttcagttgcagacgaacgaagctataccgttggttgtaatggatgaaaccaacccattccgtcagatcgcgctggatacgctggatacggccggtatttcatggcgtattgcttatgaagcggcttccctatcagctgttcgtgcagctgtgaatgctgaagttggcattactgcccgccctctggaaatgcagaatgcagatctaagaattttgggggaaagtgaagggttgccacgcctgccagaaatacaatttttcttgtatcgaaacagtaacgaacagaatgaatctgtcctgactgtttttgatgcaatagaaaataagaaaacaccttataccgtaactactatcgaatctaatgaaaccgacgagattgatgaatcagttgaaatatcctctgttgaaaatatagacgagtaa

SEQ ID NO: 3819 - DNA, 321 bp, Xenorhabdus bovienii
  Coding sequence Name=Xb4151_4152.C440.gene198.dna; Position on contig= 162115..162435bp; Strand=-
atgggcaaaaactccagtggatgtagacatactcgttgcttactcatcaaaagtggtgtcaagatgtctgcttttttgccggcagtgttgcaccacatcgactcatgggaagggataacaaccaaatatgaaacagtgctaatcaatatcattaatagcttgaatcgtcttggtttttattcctctaaacaatattttgcctgcatggcaaaagcgactacctatttatttacaaacaaaaaaccattaattaacagattgtgcttatatatcgctaaaacgtgtcagtcgagtaaaaagccaccaacacgctataactag

SEQ ID NO: 3820 - DNA, 444 bp, Xenorhabdus bovienii
  Coding sequence Name=Xb4151_4152.C440.gene199.dna; Position on contig= 162406..162849bp; Strand=+
atgtctacatccactggagtttttgcccatcactgggcgtttgcagttttcctgctaggtgcttttggtctgtgtgcgcttatgttattgggtgcgtacttcctggggggcaggtcaaaaggcagagcgaaacacataccttatgaatcgggtatcgattctgtcggcagcgcccgtctccgcctgtcagcgaagttttatctggtcgccatgttctttgtcatcttcgatgttgaagccctttacttatacgcatggtcagtttctattaaagaaagtggctggctgggttttgccgaagcaagtattttcattttggtgttattggcaggcttggtttatctggctcgcatcggagcactgaactggactcctgtacgctcacaacgtcaagtcagtcaacccagtgctgacattcataccaacaacagtcatatgcagtaa

SEQ ID NO: 3821 - DNA, 675 bp, Xenorhabdus bovienii
  Coding sequence Name=Xb4151_4152.C440.gene200.dna; Position on contig= 162866..163540bp; Strand=+
atggattatacgctcacccgcatagaaccgaacggtgagaatgaccgttatcccctgcaaaaacaggaacttgtcaatgatcccctggagcagcacgttcaccgcagtgtctatatgggtaaactggaacatgctttgcatgacatggtgaactggggaagaaagaattccttgtggccttataacttcggactttcctgttgttatgtagaaatggtgacgtcatttaccgccgttcacgatgttgcgcgtttcggcgcagaagtattgcgggcatccccacgtcaggccgacttcatggtgatttcaggaacctgcttcgtcaaaatggcacccgttattcaacgtctgtatgaccagctgcttgagccaaaatgggtaatttccatgggtgcctgtgcaaactccggcggtatgtacgatatttattctgtagttcaaggggtcgataaatttatccctgttgatgtttatatcccgggctgtcctccccgccccgaagcctatatgcaagcactgctgctgttgcaggagtctataggcaaagagcgccgccctctatcatgggttgtcggcgatcagggggtttaccgcgctaatatgcaatcagaaagagaacggaagcgcggtgaacgtattgcagtgaaaaacctgcgtaccccagacgaaatttaa

SEQ ID NO: 3822 - DNA, 1800 bp, Xenorhabdus bovienii
  Coding sequence Name=Xb4151_4152.C440.gene201.dna; Position on contig= 163621..165420bp; Strand=+
atgatgacagatcagatagcgcaagaaagcgcacggcctgcttgggaaactcaggatcactttgatgatccggttgtaagcgagcttaatcgtcaatttggcccagaggccttttccgtccagcctacccgtaccggtatgccggttgtctgggttaggcgagaacaattactggcagtaataacgtttctgaaaaaattgcccaaaccttatgtcatgctgtttgacctgcatggtgtcgatgagcgtcagcgctctcaccgacaggggcttcctgcggcagacttttcggtattttatcacttgatttccattgagcgtaatcgtgacatcatgctgaaagtcgcactcaatgaaaaagacttgaatatcccaaccatcacgtcaatttactctaatgctaattggtatgagcgtgaaacgtgggagatgttcgggattacattcaatggtcatccgaatttgcgtcgcatcctgatgccggatacatgggaaggacacccgctgcgcaaggaatattccgcacgcgctacggaattcgaccctttcatgttgaccaagcagaaagaagatctggaaatggaagcactgactttcaaaccagaagagtggggtatgaaacgcggtaccgaaagtgaggatttcatgttcctcaacctcggccccaatcatccttcagctcacggcgcattccgcattgttcttcagcttgatggcgaagaaatcattgattgtgttcccgatattggctaccaccaccgtggtgcggaaaaaatgggtgaacgtcagtcatggcacagttatatcccttacaccgatcgtgtcgagtatttgggaggatgtgtcaacgaaatgccgtacgtgctggccgttgagaaactggctggcattgatgtgcctgatcgcgtgaaaactatccgcgtcatgttgtctgagttgttccgcattaacagccacctactctatatcagtacatttattcaggacgttggcgcaatgtctccagtgttcttcgcctttacagaccgtcagaaagtgtacgatgtcgtcgaggcgattaccggattccgtatgcatccagcatggttccgtattggcggtgttgctcatgacttgccccgaggctgggataaacttctgcgtgaactgcttgactggatgccaaaacgtttgaattcctatgtcaaggcagcgctgaaaaacagtgttctgaaagggcgttctgtaggcgtagcttcttataactccaagcaggcattggactggggcgtgacaggtgcaggtttgcgtgcaactggtatcggttttgacgtgcgtaaatggcgcccttattccggctatgagaacttcgattttgaagtgccaacaggttataacggtgactgttacgaccgtgtcatgctgaaagtggaagagatccgccagagcatgcgcatccttgagcagtgtctcaagaatatgccagaaggcccgttcaaggcggatcacccactgaccactccaccacccagagagcgtaccctgcaacacatcgaaaccatgatcaaccacttcctgcaagtgtcatggggtccggttatgcctgccaatgaatcattccagatgattgaagcaaccaagggtatcaacagttattacctgaccagtgatggtaacactatgagttaccgtacccgcatccgtacaccgagttttgctcacttgcagcagatcccatcggtgatccgcggcagtctggtttctgacctgatcgtttatctgggcagtatcgattttgttatgtctgatgtggatcgctaa

SEQ ID NO: 3823 - DNA, 546 bp, Xenorhabdus bovienii
  Coding sequence Name=Xb4151_4152.C440.gene202.dna; Position on contig= 165423..165968bp; Strand=+
atgcaaagtgaatttaacgcaaacaagcaagtacgtcttgatgtgattaacgtaacggacgctcagacacagggtgcgtttgtactgagtaccgcagaacgtgatgccatcgagcaggaaaaacaccattacgaagatccgcgtgccgcgtcaattgaggcactgaaaattgtgcagaaacagcgtggttgggtgccggacggcgccatctatgccgttgctgaagttttgggtattcccgccagtgatgtggaaggggtggcgacgttttacagccagatttaccgccagccagtagggcgtcacattattcgctattgcgatagcgttgtgtgtcacatcacaggttatcaggatgttcaggcagcgatagaaatgcacttgaacattcgtccggggcaaactacggaagatgggcgtttcacactgttgccaacctgttgtctggggaactgtgacaaggggcctaccatgatgattgatgaggacactcacagttacgtgaaaccagaagaaattgaaaaactactggagcagtatccatga

SEQ ID NO: 3824 - DNA, 1365 bp, Xenorhabdus bovienii
  Coding sequence Name=Xb4151_4152.C440.gene203.dna; Position on contig= 165965..167329bp; Strand=+
atgacaacgcactcaggagtgaaagaaattatccgcgtagcggaaactcatcccctgacatggcggttgcgtgatgaccaacaacctgtctggctggatgaataccgtagcaagagtggttataaaggagctgaaaaagcactgaagggcatggttcctgatgaagttaccacgctggtgaaagatgctggtttgaaagggcgtggtggagcaggtttttccacgggcttgaagtggagcctgatgccaaaagatgaaagcatgaacattcgctatttgctgtgtaacgcggatgaaatggagccgggaacctacaaagaccgcctgttgatggagcagctgcctcatctgctggtggaagggatgctgatcagcgcatttgcgttgaaagcctaccgcggctacatcttcctgcgtggcgaatatgtcgaggcggcggtacatctgcgcagagcaattgaagaagctaaagcggccggtttgctcggtaaaaatattcttggtagtggttttgattttgaactgtttgttcataccggcgcagggcgttatatctgtggtgaagaaaccgcgttgattaactcccttgaaggacgtcgggcgaatccccgttcaaaacctccatttccggctacgtccggcgtatggggtaaaccaacttgtgtaaacaatgttgaaaccttgtgtaacgtccctgcgatccttgaatatggtaaagagtggtacatcggtctgagcgaaggcaaaagtaaagatgccggcaccaaactgatgggcttttccggtcgggtcaaaaatccgggcgtttgggaactgccttttggcaccactgcccgtgaaattctcgaagattatgcgggtggtatgcgtgacggtctgaaattcaaggcttggcagcccggcggagcgggaaccgatttcctgactgtggatcaccttgatctgccgatggattttgaaaatatcgctaaagcaggcagccgcttgggaactgcactcgcaatggccgttgatcatgagatcaacatcgtttccctgacccgtaaccttgaagagtttttcgcccgtgaatcctgtggctggtgtacgccatgccgtgatggtttgccgtggagcgttaaaatcctccgcgccattgagaacgggaaaggtcagcctggtgatatcgaaactttggaacaactctgccgtttcctcggccccggcaaaactttctgtgcccatgcgcccggcgctatggagcctttgcagagtgctattaaatatttccgtgatgaatttgaagcgggaattgtcaccaaagactacggcaacaccaatctgattgcgggcattcagccaaacctgcttaagcagcgctggtaa

SEQ ID NO: 3825 - DNA, 2736 bp, Xenorhabdus bovienii
  Coding sequence Name=Xb4151_4152.C440.gene204.dna; Position on contig= 167403..170138bp; Strand=+
atgctgactatggctacgatacatgtagacggcaaagaatatgatgtaaacggggctgataacctgttacaagcctgcctctcattggggctggatataccttatttttgctggcatccagcgctgggaagcgttggcgcttgccgccagtgtgcggtgaagcaatatcagaacgcggaagatacgcgtggtcgtctggtgatgtcttgtatgacaccagcgacagaaggcacgtttatctccattgatgatgaagaagcgaagcaatttcgcgcaagtgtcgtggaatggttgatgaccaaccatccccatgactgccctgtctgtgaggaagggggtaactgtcacttgcaggatatgacggtgatgacggggcattcattccgtaaataccgttttaccaaacgtactcaccaaaatcaggaactggggccatttgttgcccatgaaatgaaccgctgcatcgcctgttaccgttgcgttcgctactacaaagattatgcggacggcacagactttggcgtttatggtgctcatgacaacgtttattttggtcgcactgaaagtggtacgctggagagtgaattttccggcaaccttgttgaaatctgcccgacaggggtatttaccgacaagacccattcagagcgttacaaccgtaagtgggatatgcagtttgcaccaagcatctgccaacagtgcagtattggctgtaataccagtcccggtgaacgtcatggtgaagttcgccggattgagaaccgttacaatggcaccgttaaccactactttatgtgtgaccgtggtcgttttggctacggttatgttaaccgtgacgatcgtcctcgtcagccacagcaattgcgtggtgatcagtggatttcactgaatgccgagcaggttatgcagggtggggcggatattttgcgtcaggccaaaaatgctattggtatcggttcgccacgcgccagcattgaaagcaactttgctctgcgtgaactggttggtgaagaaaacttctatagcggcatatccgtggaagaacagaaccgactcgatatgatactggaaattcttcagcaaggcggcgtctatactccatccctgcgtgagatcgaaggttacgatgcagtactgattttgggtgaagatctgacccaaacgggggctcgcatggcactgtctgtacgccaggcggtcaagggcaaggcgcgtgaaatggcggcggctcagaaagtggctgattggcagattgccgcagtgatgaatatcggtcagcacgccaaatatcctttgtttttaaccagcgttgatgatacccgactggatgatattgcagcatggaattaccgtgcaccaactgatgatcaagcccgatttggttttgctgtggcgcatgccctgaacagcattgcacccgccgtcaatgacctgccggatgagctgaaaacgaaggtagaaattgttgcacaggcactgcgtgatgcgaaaaaaccattgattatcagtggtagtaatgctggcagtgatgcattgattcaggcggcggccaatatcgcatgggcattgaaagacaaaggtgcaaatgttgggctttcctttgttgcggcttatgctaatagcctcggtctggcgatgatggaagcacagccgttggatgtcgctttgcagcgtattgccaaaggcgattctgataccgcgattgtagtggaaaatgatctctatcggcatgcggcagccgataagattgacagtgcattaggcagcctgaaaaatctgatcgtcgttgatcatcaacgtactgctatcatggataaggctcacttgattctgtcagctgccagctttgccgaaagtgatggtacgctggtgaatcaggaaggccgtgcccagcgctattttcaggtttatgaaccgtcattctatgacaaatctgtcgttatgctggaaagctggcgctggatgcattccctgtataccacttacgcacaatgccagactgactgggcgcaacttgaccatgtgattgaagcttgtgtcaaagctatgcctcaattcaaaggtatcgttaatgccgctccggattccacattccgtatccgtggtcagaaattggctcgttcacctcatcgttacagtggccgtacggcaatgctggccaatgttagtgtccatgagcagcgccaaccgcaggatatcgacacggcatttgctttctcaatggaagggaacaacagcccgtttgccgaacgtcagcaaatcccatttgcatgggcgcccggctggaactccccgcaggcatggaacaaattccaggcggaagtcggtggcaaactgcgtttcggtgatcctggtatgcgtttgattgaaacgaccgatggtgggttgaactactttgacagcattccggctgcatttgctgcacagaaaaaccaatggtatgtcgcgccttatttccacctgttcggcagtgaagaattgtcacagcgtgcagaagtaatacaggaacgtatgcctgagccgtatgtgatgataaatcatcaggatgctgaacatctgaatgtgaaagaaggttccatgatggaatttgactgtgcgggtcaacaattgcgtctggctgtgcgcttaagcggcaatctggtgcagggtcagattggcctgccgctgggaatgccgggtattccacctgttctggcgggtaaatcagtcaataacttacgggggatggcacaatga

SEQ ID NO: 3826 - DNA, 978 bp, Xenorhabdus bovienii
  Coding sequence Name=Xb4151_4152.C440.gene205.dna; Position on contig= 170135..171112bp; Strand=+
atgagttggtttactcccgatgtgattgaagtcttgattactattctgaaagcggttgtcattctgctggttgttgttgtttgcggggcgttcatgagtttcggtgaacgccgcctgcttgggctattccagaaccgctacgggccaaaccgtgtgggttggggcggttcattgcagctcgtcgctgacatgctcaaaatgttttttaaagaggactgggtaccgcgtttctccgatcgggctattttcactctggctccaatcattgctttctgctcgttactgctggcgtttgctatcgtgccagtcagcccaacgtggatggtggcggatctgaacatcggcattctgttctttatgatgatggcaggtttgtcggtttacgctgtgctgtttgccggttggtcgagcaacaataaatattccctgttgggggcaatgcgcgcatcggcacagacactgagctatgaagttttccttggtcttgctctgatgggtgtcgtagcacaggctggctccttcaacatggtggatatcgtcaattcacaacaacatatgtggaatgtcattccccagttctttggtttcctgacctttgctattgctggtgtggcggtgtgtcaccgtcacccttttgaccagccggaagcagagcaggaattggcggatggttatcacgtcgaatattccggcatgaaattcggtttgttctttgtcggggaatatatcggtatcgtgacggtatctgctttaatcgtcacactgttctttggtggctggcatgggcctttattgccttccttcatctggtttgcgttgaaaacggcatttttcatggtgatgttcattctgatccgtgccgcattgccgcgtccgcgttatgaccaagtgatgtcatttggctggaaagtctgcctgccgttaactttactcaacttgctggcgactgccgcagtaattttatacaacgctcaataa

SEQ ID NO: 3827 - DNA, 543 bp, Xenorhabdus bovienii
  Coding sequence Name=Xb4151_4152.C440.gene206.dna; Position on contig= 171128..171670bp; Strand=+
atgacattgaaagagttagtggttggtttcgccacccaggtacgcagtatttggatgatagggcttcatgccttccataaacgcgaaacaaaaatgtatccggaagagccggtttatttgccaccccgttaccgtgggcgcatcgttctgacgcgtgatcctgacggtgaagagcgttgtgtcgcctgtaacttgtgtgcggcggtgtgtccagtaggatgtatctcactgcaaaaagccgaacataaagatggccgatggtatcctgaatttttccgcatcaacttttcgcgctgcattttctgcggactgtgtgaagaggcttgcccgacgaccgctatccagttgacaccggatttcgaattgggtgaattcaagcgtcaagatctcgtatatgaaaaagaagatctgctgatttcaggaccgggtaaatatcctgattataacttttaccataagacaggcatggcgattgatggcaaagataaaggggaagccgacaatgaagctaaacctatcgatgttaaaagcctgttgccgtaa

SEQ ID NO: 3828 - DNA, 528 bp, Xenorhabdus bovienii
  Coding sequence Name=Xb4151_4152.C440.gene207.dna; Position on contig= 171683..172210bp; Strand=+
atggaatttacattttatgtcgcagggctggttgccatcctcgctacactcagggtgataacgcacactaactcagtacatgcgttgctgtacctgattacttccctgttggcactttcggtcgtgttcttttcactgggcgcatattttgccggcgcactggaaattatcgtttacgcgggtgcgatcatggtgttgtttgtcttcgtcgtgatgatgctcaacctcggtaaatctgttgtcgagcaagaacgggcatggttgcagctccgcgtttggatcggcccggctattctggctgctgtgctgctgattgtgttgatctttgctatcagcagcctgccaacggctgagatcagcggtgaagtggtcagtgccaaagaagtgggaattagcctgttcgggccttatgttctggcagtagaactggcatcactgttactgctggcagggctggtagtggcttatcacattggccgtgaaaatcgtcagggtgaagtgatcagtaatcgtacggaggatcaataa

SEQ ID NO: 3829 - DNA, 303 bp, Xenorhabdus bovienii
  Coding sequence Name=Xb4151_4152.C440.gene208.dna; Position on contig= 172210..172512bp; Strand=+
atgatacctttagaacatggtctgattctggcggctattttgtttgtattgggctttgtttgcctgattgtccgccgcaatctgttatttatgctgatcgggctggaaatcatgatcaatgcttcggctctggcgtttgttgttgccggcagctattggctccagcctgatggtcaggtgatgtacattctggccattactctggcagccgccgaggcgagtataggtctggcactgctactacagttgtaccgtcgtcgccagagtctgaatattgatatagtcagtgagatgcgcggatga

SEQ ID NO: 3830 - DNA, 1851 bp, Xenorhabdus bovienii
  Coding sequence Name=Xb4151_4152.C440.gene209.dna; Position on contig= 172509..174359bp; Strand=+
atgaacctactctatttaacaattctactgccactgctgggttttttactattggcattctctcgtggccgctggtctgaaaatctgtcagctatcattgggagtgcttctgttgggctggcagcattagtcacactctgggccgggatggatttccacgcccagaatggggcagaggggctggtttacagccagacattgtggaactggatggaggcagataacttcaatattccggttaatctggtactggatgggctatctctgaccatgctgagtgtcgtgacgggcgttggtttcctgatccatatttatgcttcatggtacatgcgcggtgaagagggttattcccgtttcttcgcttataccaatttgtttatcgccagtatggtggttttggtactggcagataacatgctgctgatgtacctcggttgggaaggtgttgggctgtgtagttatctgctgatcggtttctactataaaacgcctgccaatggtgcagcggcaatgaaagccttcatcgtaacccgcgtaggtgacgtgttccttgccattgggatgttcatcctttatgaccagcttggcacattgagtttccgcgaattggcggtattggcaccgcagcatatcgaagcaggctctacggcgattacttgggcaaccttgatgattctgggtggtgctgtgggtaaatcggctcagttaccactgcaaacatggttggcagatgcgatggcaggtccgacaccagtttctgccttgatccacgcggccactatggttactgccggggtttacctgattgcccgcagccatgcgttgttcctgatggcgccggatattcttcatctggttggtactattggggctattaccttgctgctggcaggctttgcagcgctggtgcagaccgatatcaaacgtgtgctggcctattccaccatgagtcagattggttatatgtttctggctctgggcgttcaggcgtgggatgccgccatcttccacctgatgactcacgcattcttcaaggcactgttattccttgcttctggctccgtgattctggcttgtcaccacgaacagaatatcttcaaaatgggtggcttgagtaagcgtattccgtttgtttatctctgcttcatcgtaggtggttcggcactgtcagcgctgccacttctgactgctggtttctacagtaaagatgaaattctgtggggcgcactggcgaatggtcatatgaacctgatgctggcagggcttgtcggtgctttgatgacatcactgtataccttccgcatgatctttatcgtgtttcacggtgaagaaaataccaaggctcatccagtcaaagggattacccatactttacctctatcggtactgctggtgctctctacttttgtgggagcgctgattgtgccaccgttggcgggagttctgccggaaagaagtacaacggcagggcatgatgacaaactgacattggagattgtttctggtgtggtcgctgttttcggtatcttgctggcagcagcgttgtacctgggcaaacgtgctgtggttaaggccactgcaaacagtataccggggcgtttcttatccacatggtggttccatgcatggggatttgatgcactatatgactggatattcgtgaaaccattcaaaggtattactcaactattacagaatgatcctttgaactcactgatgaatattcctgccatattgtcacgttggggcaataagggacttagcttaagtgagaacggacaagtccgttggtacgctgcctctttggggttgggtgcagtgctggttttggctctgctgcttttgatttaa

SEQ ID NO: 3831 - DNA, 1521 bp, Xenorhabdus bovienii
  Coding sequence Name=Xb4151_4152.C440.gene210.dna; Position on contig= 174379..175899bp; Strand=+
atgctactaccttggctaattcttctacccttcatcggaggcttgctatgctggcaggcggagcgcttcggcacccgtatgccgcgttggatagcgcttctggcgatgggactgactctgctgctttccctgcaactttggttacagggcggttatacgctgaccaacccacagggcattccacagtggcaatcagaatttctgatcccgtggatacctcgctttggcatctccattcatctggctttggatggtttatcactgctgatggtggtcttgacagcactgttgggtttgatggcaattctctgttcgtggaatgaaaaccagccatatcagggattcttccatctgaacttgctatggatacttggcggtgtgatgggggtcttccttgccatcgacctgttcctgttctttttcttttgggaaatgatgctggtgccgatgtatttcctgatcgctctgtggggacacagaggttcaggcggcaaaacccgtattacggcagcgacgaaattcttcatctatacccaagccagtggtctggtaatgctgatttcgattctggcattagccttcgtttatcacgatgcaacgggagaatggtcattcagctatgaaaaactgctgaatacaccgatgtcagatacagttcaatacttactgatgctgggtttcttcatcgcatttgccgtaaaaatgcccgttgtgcctctgcatggctggttgccggatgctcatagtcaggcaccgactgcaggttcagttgaccttgcggggatcttgttgaaaacagcggcgtatggtctgttgcgttttagtttgcctctgtttccacaagcctctgcggaatttgcgccgattgcgatgtggctgggtgtcattggtatcttctacggtgcgtggatggctttcagccagactgacatcaaacgcctgattgcctataccagtgtttctcacatgggtttcgtacttattgccatctacaccggcagccaactggcttatcagggggcggtcatccagatgattgcacatggtctgtcagccgctggcctgtttatcgtgtgtggacaattatatgaacgtctgcatacccgcgatatgcgcaatatgggcggtttatggggaaaaattcaattgttgcctgcgatctcgctgtttttcgctgtagcgacactgggtatgccgggaaccggtaactttgttggtgaattcatgatcctgttcggtagtttcagcaaattcacccttattactaccgtatccgtgtttggtttagtttttgcatccgtctacgcactgtatttaatgcagaaagcgtattacggcacaccaacaactgataagccactacaacggatggatgtgcgtgaaatctccattttgctactgttagtcgtcttgctggtgattgtgggtgtttatccgcagcctgtccttgatacctcagcggcggcgatgagtaacatccaaaattggtattcagcttcacttttaactacaaggccgtaa

SEQ ID NO: 3832 - DNA, 1458 bp, Xenorhabdus bovienii
  Coding sequence Name=Xb4151_4152.C440.gene211.dna; Position on contig= 175906..177363bp; Strand=+
atgacaataacttctgaacaattgatcgcactgttgccgctattgatcgtcggattgacggtggtggttgtgatgctgtccattgcgtggcgacgcgatcatttgatcaatttcaccttaacggtaattggtctgaatctagccctgctttctctctattttgttggacagcaggagccgatggatgtcacgccactgattcatgtggatagatttgcaatgttttataccagccttgtgttgattgcgagcctcgcaacgaccacatttgcttactcatggctggagaattatcccgataataaagaagaattttacctgttggtgctgattgcagctgtcggaggaattctgctttcttctgctaaccatatggcatcactgtttatcggcattgaattaattactctgccattattcggcttgattggttatgcgtaccgccagaaacgttcactggaagcgagtattaaatatatgctgctgtccgcagcagcatcttcgtttctactattcggtattgcactgttgtacgcagaatcaggtgacttgtcctttgcgtcactgggtagaaacctgagtgacagtcaactgcatgagccgctgatcttggcagggctgggaatgatgctggtgggggtgggtttcaaactttctctcgtacctttccaactttggacacctgacgtttatcaaggcgccccggcacctgtatcgacttttctggcgacggccagcaaagtcgctatttttgcggtgataatgcgtttattcctcgaagcacctgtggctgaaagtgaaacgctgcgcattgtgctgaccgtgatggcaattgcttccattctgtttggtaacttgctggcactgacacaaagtaatatcaagcgtctgctcggttactcatcgattgcgcacttgggttacttgctggtggttttggttgccatccgaagtcacacattggcagaagaaacggcgggtatttatctggcgggttacctgtttgccagcatcggcgcatttggggtggttagtctgatgtccagtccataccgagggccagatgctgactcactgtattcataccgtggcctgttctggcataaaccgatcctgtcggcagtaatgaccatcataatgctgtcactggcaggaataccgttaacattcgggtttatcggtaaattctatgttatcgctacggcggtagaagcaaaattatggtggctgacgggggctgtcgtgctgggcagtgccattggtctttactactatttgcgcgtgatggttagtctgtatctgcctgcaccgaagacactgaatcgcgatacgccaagcaactgggcgttgacttcaggtgggattgttgtgttgatctctgggttgctggtgttgatcctcggcatttggccacaaccagtaattgatatcgttcagcaggcgaaaagcgccatgtag

SEQ ID NO: 3833 - DNA, 162 bp, Xenorhabdus bovienii
  Coding sequence Name=Xb4151_4152.C440.gene212.dna; Position on contig= 177405..177566bp; Strand=+
ttggctgggcctttttttgagacacgaggaaagtatcatgaaatagcatttattacggtagtagcatcagaatggtttctattatgcagcaataagaaatcgtccatgtgtaggttctgtcgtattaagcagtgtccgggtatcatgccgtttttttgttga

SEQ ID NO: 3834 - DNA, 348 bp, Xenorhabdus bovienii
  Coding sequence Name=Xb4151_4152.C440.gene213.dna; Position on contig= 177578..177925bp; Strand=+
atgtcccttatccgaaaagcattcaaacgcctgcactaccctgttaatatcatcgttcagtgtgttcgctggtatctggcctatgcactgagcctgcgtgacctggaggaaatgctagctgagcgggggataaccgtcgatcatttcacgctctcccgctgggttcatcgtctgatcccgttgatggtcaaacgctatcgacggagcaagcctgctgttgggcgtcggtggcaaatggacgaaacctctatcaaaatcaaagggaaatggagttacctttaccgtgctgtggattcagacggcaaggcaatcgcatctaaatttgatgcgctttgcccagtactgtaa

SEQ ID NO: 3835 - DNA, 1122 bp, Xenorhabdus bovienii; identical to SEQ ID NO: 1197
  Coding sequence Name=Xb4151_4152.C440.gene214.dna; Position on contig= 177894..179015bp; Strand=-

SEQ ID NO: 3836 - DNA, 216 bp, Xenorhabdus bovienii
  Coding sequence Name=Xb4151_4152.C440.gene215.dna; Position on contig= 179288..179503bp; Strand=+
atgttgttaataaatattaaccctccatatcatgagtctcaggtcagcatgatggatttgaggatagtggttcctttcactgacatgaaaggttatcactacgataaatctgtcacggagcttttaatgctctacaccggagagaagaaggtagttattcctgatatggtcgtacctaagcttaaacagcgcctgaaggatcaggaaagtaaatag

SEQ ID NO: 3837 - DNA, 1206 bp, Xenorhabdus bovienii
  Coding sequence Name=Xb4151_4152.C440.gene216.dna; Position on contig= 179514..180719bp; Strand=+
atgagagtgggaatttctggtttccaacccgcaaggctgacacagatgagagaggctagagggttatctaaaattagcctgggtaagttagtggagcgttctccatcaacggtgactaaatgggagaacggtaaccattccccggatgcagaaatactgcacagcttaagtcgagtgctgaattgcccagtgggttggtttacaaagcctgttatcaagtatgaaaagaaaccagtattctttcgaacactttcaagcacagcaaaagacttatgtatttctgcagaacgatacatggggtggtttcaagaactatcatttaagatgcaagaatatcttgattatccggatgttgacattcctcatctcgatgtcagggattacagagcaatagatgatcagttaattgaaagaatggcttttgaatgcaggaaagcgtggggattaggtattgccccgatagatgatttgttactcgtaatggaaaatgcaggcgtcgtttgctctcgatttgaacagggtagcactgtcatggatggctattctcaatggaatgacgtagaaaatagaccttacgtaatattagcaagtgacaaagataattattatcgcagtcggtttgatgctgcacatgagttaggtcatattgttttacatcgatatattaataagtttgatcatattaactttaccccgatagaagaacaggcacatatgtttgcatcgtgcttcatgttgccggaagaatctttttctgtggagcttccgccttacccgacattagagaactttttagcgttaaaaagtcgttggggaatgtctgcacaagcgatgatcttgagagcacggaatttggagttaatatcacctttggaatatcaaagattgtataaaagtatttcggccagagggtggagaaaaggagagccgcttgatgagcttagaaaaccagaattggttcgcttattacctcgatgcctgaatttattactggattctggaacatttaataaaaaaacatttcttgaggaatttggtttccctaaaggtgatttggaggatttatgttcagtgcctaaaggttttttgtcagagtcaccgatacttgattttcaatcccgaatacaattaaagaatagtatgaatgtgaatgtatcttctgtacggcaagatacaaatgtcgttaacttattcaatagaaagtaa

SEQ ID NO: 3838 - DNA, 594 bp, Xenorhabdus bovienii
  Coding sequence Name=Xb4151_4152.C440.gene217.dna; Position on contig= 180819..181412bp; Strand=+
atggcgcagcatagttttatcaaaatttccaacgacaccctacggcctgctactccagcgaccagagaatacctgcattcgaaaatcaaatgtagtgatgtgctgcaagctgattttaagaaagtccgtaatcctcgtttccaccgcaaatactttgccctgctgaatctcggttttgaatactgggaaccggttggtggcacgatttccccggaagaaaaagccattgtgcgcggttacgtacaatttctggctcactttgctggtagagaagatgccttacaatccgctgaggatgaataccttgcgggcttatccaaaaaccgtgcccataacatcacggccactaaatactttgatgcctttagacgttggataatagtcgagtccggccactatgacacctacgaaatgccggatggccgcctgtaccgtgaactccgttcagtcagcttcgccaaaatggatgaactggaatttcagtccctctatcaatccacactgaatgtgctgtggaatttcatcttataccgcaacttccctaccaaagacgcagctgaaaatgccgctgctcagttatttgattttgtgtga

SEQ ID NO: 3839 - DNA, 357 bp, Xenorhabdus bovienii
  Coding sequence Name=Xb4151_4152.C440.gene218.dna; Position on contig= 181324..181680bp; Strand=+
atgtgctgtggaatttcatcttataccgcaacttccctaccaaagacgcagctgaaaatgccgctgctcagttatttgattttgtgtgagcaagaagcaagaccaatgaccagaaatgaaaaacagtggctgtcagatgtggcttcgctgggctgtattgcctgcaggaatcaggggatggggatgtctccagcggacattcatcatgtgagaaccggacagggaatggcacaacgcgccgctcacctcagcgttctgccgctttgtcctcgtctcaccgggcatgttatcccacgggttttcatgctgatccgaaaagttggcaggcaacccacgggacagaaattgaattattag

SEQ ID NO: 3840 - DNA, 645 bp, Xenorhabdus bovienii
  Coding sequence Name=Xb4151_4152.C440.gene219.dna; Position on contig= 181449..182093bp; Strand=+
gtggctgtcagatgtggcttcgctgggctgtattgcctgcaggaatcaggggatggggatgtctccagcggacattcatcatgtgagaaccggacagggaatggcacaacgcgccgctcacctcagcgttctgccgctttgtcctcgtctcaccgggcatgttatcccacgggttttcatgctgatccgaaaagttggcaggcaacccacgggacagaaattgaattattagaacaggttaaaagggaagtaggagaggtgcggttaaccaaactcggcctcggccactacaaactatccggcgtccttggctataactcagacggtgcatggggtgttcatggcggtatcagtgttccccgtgacgtcaacggcaatgagttagtgtatgtcgatgataaggtgctgccggatggggctattgaaatcagggtgacgcaccgacagaacgcgcatatgcctgcccggttacagaacaggcgcattaagtcacaggatgagcagacgcactacaccgatgatgaggcctgtgatttgcccgcaggcacccggttagacgtacgtgtccagatgccggaggattctgtttggaatttgaggcagaaggcggtgaatggtgttgaagtgggtaaacaggcagagtaa

SEQ ID NO: 3841 - DNA, 756 bp, Xenorhabdus bovienii
  Coding sequence Name=Xb4151_4152.C440.gene220.dna; Position on contig= 182167..182922bp; Strand=-
atgaaaaaattgatttttttattagctgggattgttttgttgtctgggtgtgctgaattcgaaagggttgatgctttactgactgaaaagaaagctgccactacagacgttcaaaaatttaactatttgatgcaagtttcaaaagggcaaacttacatctatgaacactcatccacagaacccgaaacttttgaaagtattagagatagatactttaaagaggctgggttaacggaagaaccaaaaattgtcaaaaaagatttagtttataaatgctttaataaaaaaacttacccatatgaagattttgagtgtgtatataaattttactcaaaagagatagatatagaaaaatccgtcaatgaggctaatgatagtgcagccagattgcaccaaatcagaatggaagatgcccacaatatagccaaaaccgtaaccgaagaaggtggggcagaattcacagaagtaaatataggtagattctgtcgtgcatcatccagagtggttgcaactgcttatgcaagcgttgtaaatacttatcatatttatgatctcgaagccgataagattatgcttcttggtcttacggataaagcttttgtacgccttaagaaaaaagtgacctcagataagcgaggtattgctatggtgcgtaacaatcctcaagatcaagaaatagtttatgaagcatatgatatgctttgtcacgcaaacccaaaatcatatattctgaattataagaaaatatttcgttga

SEQ ID NO: 3842 - DNA, 225 bp, Xenorhabdus bovienii
  Coding sequence Name=Xb4151_4152.C440.gene221.dna; Position on contig= 182822..183046bp; Strand=+
gtggcagctttcttttcagtcagtaaagcatcaaccctttcgaattcagcacacccagacaacaaaacaatcccagctaataaaaaaatcaattttttcattttaatacctcatttaaactctggttataataacctagtggtattaaaaaacaatatgacaccccaagaggttaaaaagtgggaacttcataaaagtataaaggtgggatttctcaccttttaa

SEQ ID NO: 3843 - DNA, 282 bp, Xenorhabdus bovienii
  Coding sequence Name=Xb4151_4152.C440.gene222.dna; Position on contig= 183273..183554bp; Strand=-
atgaacttcaatactaaagtaagaatatttactccgatatatttggtaattgcatgcgctcttgctctaccagtaattgcgtttatcagtgatatgatcatgggtggtgttgcaattgatttaataaaaaaagaatacactttttacgaattcattctattcagatggtggctatacaccaagcttgcagcaattggtgcagtgctaggctttgtcttttggttcatcgaatacagaaaataccgataccacgatgagttagataaatacttcaagcgctga

SEQ ID NO: 3844 - DNA, 114 bp, Xenorhabdus bovienii
  Coding sequence Name=Xb4151_4152.C440.gene223.dna; Position on contig= 183551..183664bp; Strand=-
atgccaccacggaatgtgatgacatgggagtgttggtggtgcactgttcaagtaatcttaactacctatatagacaatattgatacattaacaataaggtacgaagctttatga

SEQ ID NO: 3845 - DNA, 306 bp, Xenorhabdus bovienii
  Coding sequence Name=Xb4151_4152.C440.gene224.dna; Position on contig= 183621..183926bp; Strand=+
gtgcaccaccaacactcccatgtcatcacattccgtggtggcatttttatttcaactatagaggaaatcaccacggttgccgtaaggtgtgatatcccatcttgggtattgcgaaaatcacaataccttttgtgtgtgcagataccccatatgtcaaagagcaggtttctgccctatagtgacagtagctttctttcccaccgttccacaatctcacgtttttctttaggtgtggttagatcccgatatctcatcaatgtaatcagtgggctggtgggtgggcgtggttttgtgtttgaaatttag

SEQ ID NO: 3846 - DNA, 1740 bp, Xenorhabdus bovienii
  Coding sequence Name=Xb4151_4152.C440.gene225.dna; Position on contig= 184196..185935bp; Strand=-
atggtgactagtcgtcagcattaccgcgaaaaagtttctcagatgatcagctgggggcactggtttgcactgttcaatattatgttcagtcttgtgctgggcagtcgctatttatttgcgtctgactggccgggttcactgtttggtcgcatttatgcgctactcagttggctcggtcatttcagtttcattgtctttgctatttacttacttattttatttccgctgacgtttattgtgatgtcacagcggttattgaggtttctttccgctgcactggccacagcagggctaaccctgctgatattagattcctctatctatattcgctttcacctgcacctgacaccgttggtttgggacttagtcaccaacccagaccaaggtgagctgacaagggaatggcaactgatgttcatctgcataccggctatttttctggtgcagatgctatttggcacatggagttggcaaaaattacgtagcctgaatcgtcaacggtttggtaagccattggcggcggtatttattatagcttttatcgcttcccatttgatgtatatctgggcagatgccaacttctaccgctcaattaccatgcagcgttcaaatttaccactgtcttatccaatgacagcacgcaaattccttgaaaaacacggattactggatcaacaagaataccagcgccgtatgaatcaacaaggaaacccggctgccctatccgttgaatatccactgaatggcttatcctatcaagataacaagcaaggttataatttactgttgctagttgtagatggtctggataacaaagacattaccaacgccatgccgtcccttgagcgctttactcagaacaatatccaatttacacagcacttcagtactggcattcaaaacgatactgcattgtttggattattctatggcatatcatcaggctatctagatggtattcttaatagtagaaaatcctcagcacttcttgatgcactgactcaccagaggtatcaatttggtctgttctcttcggatgggttccaaacacctctttaccgccaggctcttttgaccgattattcattccctgtcccaaccaagaaagatgatagcctaactgtgacaaaatggcgtcagtggctggatcttaatcatggcactaccccgtggttttcatttttgggcattaatggttttacacactcaacgagccaatttgacaaaaaagcacttgataccgaaatcaataatgttttagaaacactaaccaataaaggtatgttggataaaaccatcgtggttattacagccaaacacagtgaattgtccgcgggacactcaccaaaatggcttactggcgataaattcaatcgtgaacaaatacatgtcccactcatcattcactggccgggtacacctgcacaggtcatcaacaagttaaccagtcatcaggatgtcatgactaccctgatgcaacgtttattacatgtcagtaattctccagatgattattcacaaggtgaagacctctttaccgctcagagagataacccatggttaatcacgggtgatgacggctcattgattgtcacaacggctacaaataccatctatctttccaagaacggagaatattatctgtatgatttggatggtaatgaaattcaaggagccaaacctaacctcgctcagttattacaaatactaactgaggttaaacgatttttagcaaactaa

SEQ ID NO: 3847 - DNA, 228 bp, Xenorhabdus bovienii
  Coding sequence Name=Xb4151_4152.C440.gene226.dna; Position on contig= 185965..186192bp; Strand=-
atgccacagtcgtctcgctacagcgatgaaaaagttgaacatttattagctgaattggtaaatgttttcgagaaaaaccatacgcctactgatttatccctgatgatcttgggcaatatggtaacgaatttaatcaatacgagcattgctcctgcacagcgcaggcacatcgcagactcgtttgcacgcgcgttacagtcctcgattaatgaagacaaagcgcattaa

SEQ ID NO: 3848 - DNA, 165 bp, Xenorhabdus bovienii
  Coding sequence Name=Xb4151_4152.C440.gene227.dna; Position on contig= 186269..186433bp; Strand=-
ttgcggttagcggcgtattcaaacaccgttacctttctgctgcaaccaaaaaaccaagtgatggaaaagtgttcacaatgtaatgatccactcctctcatttcaaatggcaaaaatgatgcaacagacttcagaatggcaacaattcacacagtcgggaaattaa

SEQ ID NO: 3849 - DNA, 1008 bp, Xenorhabdus bovienii
  Coding sequence Name=Xb4151_4152.C440.gene228.dna; Position on contig= 186470..187477bp; Strand=+
atgagtctggaaatcacccagatcgcgttacaccgattgattaaacgtgatgaacaaacacttgaagtcattctgcgtgattctttgctgaccaccaatcaggtcgtagaagatatgatggctgaattacatcgtgtgtatagcgcaaaaagcaaagcctatggtttattcaatgatgaaagtgaactggcggaatcactccgtcatcaacgtaagggagatgaagactttctcggttttagccgtgctgcaaccgttcgcttgaaagatgaattgacaaaatatccgtttgcggaaggtggtacggtgctattttgccagtaccgatatctggccgtcgaatatttactgatttcggttctcaatagttgcaacagcatgtctgtcaatgacgagctggatgtgaacactacgcagtatcttgatattcctcatgctgatatcgttgcgagaattgacttgactgagtgggaaactaatcccgaatccagtcgttatctgacttttctgaaaggacgggtagggcgtaaggtttctgacttttttatggattttttggctgctagtgaaggcatgaatgccaaagtgcagaataaggggctattgcaggcggtggacgattattgcgaatcagcccagattgataaaaatgaacgtcaggcttatcgccagcaggtttacagctattgtaatgagcagttacaggccggtgaagagattaaactacaagagttgtcccaagaattgccaccattaggcgagcagaatttccagcaattttcgcaggaacagggatacgcattggaagatagtttcccagcagatcgcggtacattgcgtcaattaacaaaatttgctggcagtggtggtgggttgaccatcaactttgatgcaatgttgttgggagagcgaattttttgggacccagtgacggatactctgacaattaaaggcacaccaccaaacttgcgtgaccaactgcaacgtcgcggtagtggtaatgactaa

SEQ ID NO: 3850 - DNA, 282 bp, Xenorhabdus bovienii
  Coding sequence Name=Xb4151_4152.C440.gene229.dna; Position on contig= 187575..187856bp; Strand=-
atgttaactattaatgcagaagtacgtaaagagcagggcaagggtgcgagccgccgcctgcgtagagctaacaagttcccagctattatctatggtggtaaccaagaaccagtttctatcgaactggatcacgatgcagttatcaaccatgaaagtaaaccagaattctatgaagttctgaatctggttgttgatggtaaagaaactacagttaaagtgcaggcagtacagcgtcatccttttaaacctaagctgacgcacatcgatttcctgcgtgcttaa

SEQ ID NO: 3851 - DNA, 1851 bp, Xenorhabdus bovienii
  Coding sequence Name=Xb4151_4152.C440.gene230.dna; Position on contig= 188019..189869bp; Strand=-
atggaaaacgctttcccgacggcaagaccacagaaaaatgttatcctctctatcaactatcttttatctaatacccatgacagtaacataacaatggcttttactttacgcccttaccaacaagaagcggtagatgctaccatccgccattttcgtcagcacaaagatcctgcggtcattgttttgccaacaggggcgggtaaaagcctcatcatcgcagaattagcaaaactggctcacggccgagttttgatactggcacacgtcaaagaacttgttgcacaaaaccatagcaagtattgtgcctatgacctgcaagcggatattttttctgcgggattgcatcaaaagcagagtgaaagaaaagttgtctttggtagtattcaatccgttgctcgcaatctggactgttttgactatcatttctcactgttaattattgatgaatgccatcgcatcagtgatgatgaaaatagtcagtatcaacaaattatccagcaactcaagaaaaacaatccccagatacgtatcttgggcttaaccgccacgccctaccgtttaggctctggctggatataccaatatcactatcatggcatgatacgtggagatgaacactgtttttttcgtgattgtatttatgaacttccgttacgttatatgattaaacatcactttctggtgcccccagaaagattggatatgcccgtaatgcaatatgatttcagtcaggttcgtaccagccagcagggaattttccatgaagctgacctgaatcgggagataaaacgacaaaaacgcattactcctcacatcatcaggcaaatcatcgaatatgcccaagaccgtagaggagtcatgattttcgctgccacagtggaacatgctaaagagatcttccaattgctgcctgctgaacaggctgcattggtcagcgcagatacgccagcaactgaacgggatctattgatcactgctttcaaggcgcaacaactccaatatatggtcaacgtctccgtactgacaacagggtttgatgcgcctcatgtcgatttaatcgccatattgcgtccaacagagtccgtcagcctctaccaacaaatcatcggacggggattacgtttatctcctgacaaaaaagagtgcttaattctggattacgccggaaatcctcatgatatttattcccccgaagtcggtagtagcaagcccaattctcaaaaccagcctatacaggtattttgccctatctgccagtttgccaataccttctgggggaaatgtacagaggaaggtgaaatcattgagcattttggccgccgttgccaaggatgggaagaagatgaaagcggcaaacggcatcaatgtgattttcgctttcgttttaaatcatgcccacattgcggtgcagaaaatgatatcgcggcacgacgctgtcaccgctgtcaggaagtcctggtcgatcctgatgatatgctgaaagccgcccttaagctcaaaaatgcactcgtactacgttgtggcggtatgcaattaacgtcgggtcatgataataaaggggaatggctgcaaatcacttatcacgatgaagatggtgcgagcgtatcagaacggttccgtttagcaacacccgctcagagaaaagtatttgagcttcactttttgcgccagcaccagcgcgcgccgggtattcctctgcaatggaaaacagctgaggacattgcacaacagcttcctctattacgacatcccgacttcgttgtcgcacgaaaaaaaggccagttctggcaaattcgggaaaagatctttgactatcaagggcggtttcgccgagcagatgatctgtactga

SEQ ID NO: 3852 - DNA, 708 bp, Xenorhabdus bovienii
  Coding sequence Name=Xb4151_4152.C440.gene231.dna; Position on contig= 190046..190753bp; Strand=+
atgcgattggataaatttttatcacagcagttaggtataagtcgtaacgatgtaggtcgtgaactacgggctagtcgggttactgttgatgacgaggtcattaagagcggtgcgtataaattgaagcccgatcatcagatagcctatgaaggttcagtattggaacaattaggtggttcccgctattttatgctgaataaaccacagggatatgtgtgttcgacggatgatccaacaaatccgacaattttgtattttatcgatgaacctgttgcccataaattacattcagcaggtcgtttggatattgataccacaggtttggttttgctgacagatgatgggcaatggtcacatcgtattacatcacccaaacatcattgtgaaaaaacctatcttgttacattggaatatccaatatcagacgataccgagatgaaatttcttgcaggtgtgcagttgaatggcgaaaaaacactgacaaaaccagcgaaattagaaattattgagcctcaccgtgtacgtttgagtatccgtgaaggacgatatcaccaagtgaaacggatgttcgctgcagtgggtaatcatgttgttgagcttcatcgtgaacgagttggtcaaatttatttggactctacattggagccaggagaatatcgagcattgaccaaacatgaaattaacagcatacaggtgccaacaccttaa

SEQ ID NO: 3853 - DNA, 1131 bp, Xenorhabdus bovienii
  Coding sequence Name=Xb4151_4152.C440.gene232.dna; Position on contig= 190857..191987bp; Strand=+
atgttgatgccattggcaattgatatgtatttgccaagtatgccaacgattgccaccaattttggcgtcgatgccggtcgagtacaaatgacgctgagtagttacattttgggttttgccattgggcagatggtttatgggccaatgtcagatagtctgggacgtaagccagtcattgtaggtggtgtaattgtttttgccattgcttctgctgcgtgtgctttgtcacaagatattgatacctttatttctatgcgctttctgcacgggttttctgcagcagcagcaagtgttgtgatcaacgccttgatgcgagatatgttcacgaaagatgaattttcccgcagtatgtcttttgtgacattggtgatgatcattgcgccgttgttggctcccatgttaggtgggttgatgatggtatggttcaattggcatgctattttttggtcaatttcgattgctggagtgataaccgcgtttcttgttgctttctttatccgggaaacattaccgaaagagagaaggcagcgattcaatttaaaaactatttttaaccaatttgctatgttatttcggcagcgtcaggtgctgttttacatcttggcaagtgggttttcttttgcaggcatgttttcttttcttagtgccggtgcatttgtttacattgacttgaacggggtttctgcacaacattttggttactattttgggttgaacattatttttctgttcattatgaccatgattaatagtcaatgtgtccgcaaatatggtgcatcgaaaatgctgcatttcggcgtgtttgtgcaatttgtcatgggtttatggttattatttagcactgtacttgatttagggtttatttctcttgtaatgggtgttgcaatttatatcagtggtatttccatgatcacttctaatgctatggctgttgtgctggacgattatcctcatatggctggaacggttgcgtcactggctggaactattcgtttcagtattgctgcgctggtgggcacaattttatcttcagtatctgcaaaaagcgcatggcctatggtgggctcaatggcattatgcgtaatattggcaatgttacttattatttatgcgaataaggccaaaaaataa

SEQ ID NO: 3854 - DNA, 180 bp, Xenorhabdus bovienii
  Coding sequence Name=Xb4151_4152.C440.gene233.dna; Position on contig= 192082..192261bp; Strand=-
ttgattagcatcatcaaattaacaaatttctacatttgtctgcttattgctcggcatttcctatctatccaaaaatcaatagcttcttttgctatttcaagatcttggggaattacctctaaatgcagctactatcaggacaggataaaaaaatattgggaaaattctatgatttcttaa

SEQ ID NO: 3855 - DNA, 153 bp, Xenorhabdus bovienii
  Coding sequence Name=Xb4151_4152.C440.gene234.dna; Position on contig= 192535..192687bp; Strand=-
atgtactaccgaaagttggatattatccacgtattattcctatcagaaacaacattaatacatctaaccaccagctgtaggctatcgattcgtcaaaaccgaataaccccccaacaaaaagcaaacaaaaaagtaaataaaaagttaaaataa

SEQ ID NO: 3856 - DNA, 345 bp, Xenorhabdus bovienii
  Coding sequence Name=Xb4151_4152.C440.gene235.dna; Position on contig= 192658..193002bp; Strand=+
gtggataatatccaactttcggtagtacatagactgccgcaaagttatcggtggtcatctggcttcgttggtacgaaagttgaaattttaccaacagaagaaacagatatagaaaatagcctgatggggctgaaattgttaagccatgaaggtgaaaatgcttgggttattttgcataatttgaatcaatctattgctgatatgcaaatattgagcgcagtaattgagtgggaaagtgagccatgtttattttttgctaaagaggatgagagtgcagtgatatgtcgactcaagacattaggtgctgcgattgcagaaaacataacggcgttgtacccgctttag

SEQ ID NO: 3857 - DNA, 585 bp, Xenorhabdus bovienii
  Coding sequence Name=Xb4151_4152.C440.gene236.dna; Position on contig= 193076..193660bp; Strand=-
atggtcaagtctcaaccaatactgagatacatattgcggttgatacccgcaattctcgcggcagtggtactaaccgcatgtagttcgccagactcccaaatgcgtagcaaaaaagctgatactcatgcagtaaacagccaaaagcacttcttactgcaagcgtctcaggatgagtttgaaactctagttaaaaatttggatactaaatccaaaatccttaaccaatatgcagactggaaaggtgttgcctatcggcttggtgggagtacaaagcgcggtattgattgctctgcttttgtccaacgtactttccatgatcaattcgatatagatttaccgcgttctacatcagagcagcaaaaaattggtcaaaccgtcagccgttctaaattacgggcaggtgatttagttctgttcaaaacaggcatttacatgcgccatgtcggtatttacatcggcaataaccaatttgtacatgcctcgaccagtaatggagtgatcgtttccaaattaaccgatacctactggactaaacggtactacggcgcaagacgaattctgcgagacgtgaacaaagtctcctga

SEQ ID NO: 3858 - DNA, 153 bp, Xenorhabdus bovienii
  Coding sequence Name=Xb4151_4152.C440.gene237.dna; Position on contig= 193724..193876bp; Strand=-
ttgtatctcgctttttacttatcatttctgtacccttctctgctccctatgattaaaataatgcgctttgtaaagatattaataaaatgtgttggttcgcacactttagggacagaaaatttgttaattcatcatcttctgactacgctttag

SEQ ID NO: 3859 - DNA, 705 bp, Xenorhabdus bovienii
  Coding sequence Name=Xb4151_4152.C440.gene238.dna; Position on contig= 194004..194708bp; Strand=-
atgacccgcagtaatccattatcaatatttatacttaacatgttcggtattgccctatttttctcatggtatttgcctgagaatcacggtttttggtttaacattgatgcagccatttttcatttctttaatgaaaaactgcttccaaattccagatttgcactgtttgtcgccatcgtgaatatcagggcatttgatgttatatcgcttctgtgtatgggcttgctctattacagcgcatttcgcaaacagagctatgcgggtaaacgccgtcttttcatgatagggctggtaatgctagtcactgctgtcattattaaccaaataggccacaaaattcccgtcagccgcccaagcccaacattaacattcgaaaatgttaatcgcgtggacgacatgatcagttggcatacaaaagatgcttccaaagacagtttccctggtgatcatggattaatgctattgatttttagttgttttattcttcgctatgtctctcgcggcgcatttttcattgccctgctcattatgatcacctttaccctcccacgcattatggcaggtgctcattggtttacagatattgctatcggttcattatccctgacattaattggaatgagctgggtattactaacacccttaagtgatattatggcaacatggctggataaaaaattaccgtatattaggcgtactagttaa

SEQ ID NO: 3860 - DNA, 123 bp, Xenorhabdus bovienii
  Coding sequence Name=Xb4151_4152.C440.gene239.dna; Position on contig= 194716..194838bp; Strand=-
atgctgatatctccatgtcttagcaacaacatgccagagcgattactctttgccataaattttgctatagtgctccccccagttaatttgactaccaccaaaatttactttcgttttaaatag

SEQ ID NO: 3861 - DNA, 318 bp, Xenorhabdus bovienii
  Coding sequence Name=Xb4151_4152.C440.gene240.dna; Position on contig= 195180..195497bp; Strand=+
atgcttatgttacgaaaaacgacgacttttttgtttatatctttgtcttatcctgtaatggcgcatgatccgccaccctcaagttctgagtttcttcaatttcatggcgctattgttgagcctccatgtcagtttaattggggtaaaaaacgtactgaagtagcctattggcacaatggcgaacagattaatcaagataaaaaattagaatgtcaaaaagatagttattatccattatcaaagcatattagaatagaaaaaataaggtggatagaagaaaacaaaaagtcagggattgttactatcacttatcactaa

SEQ ID NO: 3862 - DNA, 312 bp, Xenorhabdus bovienii
  Coding sequence Name=Xb4151_4152.C440.gene241.dna; Position on contig= 195780..196091bp; Strand=+
atgcaaaattatcttaagttgttaattagctgtttgttggtttcatggatgtcttatggatatgcgcaatctacaggagggaaaattcagttttcaggttctattgttgacccaggatgtcaagttgtcgtatcgaatactcaggccaatatctcttgctatcggttggggaaaaaccttactgtaaagcaaattatttcaactcagaaaacaaccggcgaggtcatgcttcctggcaatataggtgtttccagtgtgaagtggactgatagccaaaaacgtgtggcgatcattaatgtggattacttctga

SEQ ID NO: 3863 - DNA, 573 bp, Xenorhabdus bovienii
  Coding sequence Name=Xb4151_4152.C440.gene242.dna; Position on contig= 196161..196733bp; Strand=-
atggctaaagccaatgaaattaagcgcggaactgcaatcagtcacaatggcaaactattattagttaaagacatcgatattcaaacacccagtgcgcgtggtgccagcacactgtataagatgcgctttactgatgttagaacgggtcagaaagtggaagaacgtttcaaaggtgatgatatcctcgaaaccatcacattgacccgctgcagcgtcagtttttcctatattgatggtgatgaatatatcttcatggatgatgaagatttcaccccttatcactttaaaaaaaatcaaatcgaagaagaattactgtttattcctgaagaaggtttgccgggaatgcacgttttgacaatggatgggcaattactggctctcgaattaccacaaactgttgatatgatcatcgaagaaaccacgccgagtattaaaggagcatcagcaagtgctcgtacaaaacccgctaaaatgagtacagggctcactattcaggtgcctgaatatctgagttcagacgaaaaaatccgcattcatattgcagaacgtcgttatatgggacgttgtgattaa

SEQ ID NO: 3864 - DNA, 198 bp, Xenorhabdus bovienii
  Coding sequence Name=Xb4151_4152.C440.gene243.dna; Position on contig= 196670..196867bp; Strand=-
ttgatatatccccatgccccagtattttcactggggttttcatatcatttcttgcctaatgtgctgactgcgagtaattttgtcgccacttcaacattcattccattatttccttgtttttacggaaggtatctatggctaaagccaatgaaattaagcgcggaactgcaatcagtcacaatggcaaactattattag

SEQ ID NO: 3865 - DNA, 1245 bp, Xenorhabdus bovienii
  Coding sequence Name=Xb4151_4152.C440.gene244.dna; Position on contig= 196864..198108bp; Strand=-
atgaccattgaggtaacgcaaaatttaaaacgtccctccatacttggaggcacaatgatcattgccggcactgccgtcggtgcaggtatgttttccattcctattgctacttcaggtgtatggtttacaggatcaataattttgctggtatatacttgggcatgtatgtacttctctggcttaatgattctggaagctaatcttaattatccgtctggctctagtttccatactgttactaaagatttactgggtaaaggctggagtacactcaatggcctatctatcgccttcgttttgtatatcctgacctatgcttatgtttcagccggcagctcggttttgtttcataattttacgcatttccttcccctgcctcaatcgggaactgggttgctgttcgcgctgatcgttgcctttattgtctggatgtccaccaaagcagttgatcgcttaagtaccattttgataggcggcatggtaataacatttattatgtcagttggaagcatgtttaccgaagtcaaattaactgtcttatttgatcaagccaatactgaaaccagctatttaccatatactttcatggcgctaccttatttgctggcctcatttggctatcacggaaatatcccaggtctggtgaaatattaccataaggacagtaaagctgttgcactcagcctgttctacggcacattaattgctttggtcatctacattttgtggcagtatgtgattcagggaaatattccccgtgaagccttcaagcagatcatcgccgatgggggtaatatcgctaatttactgcaacagatggataatacgtccaacaatactaccatagcccaactcttaaatgctttctcatatatggcattggcgagttcattcttgggtgtatctctgggtctatttgactatctggctgatttttttggattcgacgacagtggagaaggtcgttttaaaaccgcactggtgacattcattccgccaacggtactggcgttaatctttccaaacggcttcctatatgcgatcggttttgcaggactggcggcaacaatttgggcggtcatcgttccagccctgatggctcgtgctagccgtatgcgctatccaaatgccagctatcaggctcccggcggtagtttcctgattgcctttatcattctgttcggactgataaatgctacagctcatgttctctccctatttgatgtgttacctgcttatcattga

SEQ ID NO: 3866 - DNA, 99 bp, Xenorhabdus bovienii
  Coding sequence Name=Xb4151_4152.C440.gene245.dna; Position on contig= 198236..198334bp; Strand=-
atgccatcaagctatggcaaatggaaaaattctatcttatcgcttaaaacaacccatcttctcaagtgcttttcaggcgggttatttcatataacctga

SEQ ID NO: 3867 - DNA, 525 bp, Xenorhabdus bovienii
  Coding sequence Name=Xb4151_4152.C440.gene246.dna; Position on contig= 198288..198812bp; Strand=-
atgccgagagaagattgcttgtcagatgacgaaaataaaaccactacagataatttaaaatctatcttcatcatcatggataaattccagccggaggaatatacagtgtcagttgttgtcggagttggtgtcatcattattaatgataaaggtgaagtcctgctgggaaaacgcaccagccagcacgcaccctattggtcaatctttggtgggcacgtcgatccaggtgaaacttttgaagaatgtgccatccgagaaattcaggaagaaactggattaacgattcaagatcctaaagtctatggtgtctgcaataatctcgaaacctaccatgaagaaggaaaacatacagtttctgtctgtttattggcacatcaccctggaggtgagccacaactaatggaacctgaaaaatgtgagcagttaatctggtgtgatcctcatcagctaccagaaccccactttgaagccagccgcaatgccatcaagctatggcaaatggaaaaattctatcttatcgcttaa

SEQ ID NO: 3868 - DNA, 939 bp, Xenorhabdus bovienii
  Coding sequence Name=Xb4151_4152.C440.gene247.dna; Position on contig= 198951..199889bp; Strand=+
atgagtcgtcgagttgccacaattaccttaaatccagcttatgatttagttggtttatgcccaaatattaccaagggaactgttaatcgcgtacagaccgcaggattgcatgctgcgggtaaagggaacaatgttgcgaaggtgctgcgtgatttgggcattgatgtcacggtcagcggttttctgggacgagaaaatcaggaaggatttcaaaagttctttggtaaaaacaatatgataagccgatttcatttggtctcaggccgaacgcgtatcaatgtgaaattgacagaaaaatacggtgaagtgacggatttcaatttttcaggtttccatgtgacagcagaagagtggaattattttgtcagtgattctctcgactggctggggcagttcgatatggtggtagtcagtggtagtttgccagagggcgttttaccggaatcatttgcggattggatgctgcaattgaaacaacgttgcccctgtataatttttgacagcagccgggaagcctttgttgctggtctggaggcgtcaccgtggctggtaaaacctaatcgtgatgagttggaaatttgggctggtaagccattgcctgacctagatagcgtgattaatgccgcccatgaattgcgtaatagagggattgcccatgtcgtcatttcattgggagaacaaggggcgttatgggtcaatgcctcaggcgcatggctggcaaaaccaccgtattgtgaaattgtcagtactgttggggctggggactcgatggtaggagggttagtttacggcttattaatgcgtgaaaccagtgaacacactttgcgtctggcaaccgcagtttctgcacttacggtcagccagccgaatgtagggatcaagagccgcacggaacttgcatcaatgatgtcaaagattgagctgacttctttcaggtaa

SEQ ID NO: 3869 - DNA, 843 bp, Xenorhabdus bovienii
  Coding sequence Name=Xb4151_4152.C440.gene248.dna; Position on contig= 199890..200732bp; Strand=-
atgaaatttgttggagcccatgtgagcgctgctggtggtgttgatcaggcggtgatccgagcgcatgagttacaggcaaccgccttcgccttattcacgaaaaatcagcgccaatggcatgccccaccattatcggcagatgtcattgataagttcatagccaattgtgaacgttatggctatggcagccaacaaattcttccccacgacagttacctgatcaaccttggtcatcccgaagcagaagcgctggaaaaatcccgcgccgccttttttgatgaaatgcagcgttgtgaacaactagacattgatttacttaacttccatccaggaagtcatctcaaaaaaatcgatattgataaatgtctcgcccgaattgccgagtctatcaatatcgtgctggacaaaacacagggtgtaaccgctgtcattgaaaacacggccggtcagggaaccaatctaggctttaaatttgaacaacttgcagccattattgaaggtgttgaagataaaaaccgtgttggtgtctgtattgatacctgccatgcttttgcagcaggttatgacttacgcacggaaaaagactgcgaagcaactttcgaggcattcgataaaattgttgggtttaagtacctgcgagctatgcatctcaacgacgccaagagcgaattttccagtcgtgttgatcgccatcatagccttggagaaggcaatattggcaatacaccgttcagctacattatgaaagatgaccgtttcaatggcattccattggttcttgaaacgatcaatccaggcatctgggatcaggaaattgcttggctgaaatcccaacagaattga

SEQ ID NO: 3870 - DNA, 162 bp, Xenorhabdus bovienii
  Coding sequence Name=Xb4151_4152.C440.gene249.dna; Position on contig= 200712..200873bp; Strand=+
atgggctccaacaaatttcatattttttcctcttctaattttgtttcactattatggcattgttcatcctgccaaaaaaatctctgtcaaaaacagagaatacaatttaacgcttgttctcacttaacccaatatccgttggattccttgattgacaactaa

SEQ ID NO: 3871 - DNA, 1089 bp, Xenorhabdus bovienii
  Coding sequence Name=Xb4151_4152.C440.gene250.dna; Position on contig= 200835..201923bp; Strand=-
atgtctgaaagtcaacttggcagaatcgacaggttccagcacaatccagtactgatattaattcccggattcgtactaaccgcagttctgaccgcaatcgctatccatgtaggcaacatgccgtgttttatcaatatgggattaagtgccctgacacttgcaattcttttagggattattgtcggaaatacgctttatcctcttttgaagcccacatgtgataaaggggttcatttcgctaaatactaccttttgcgcgctggtatcatcctttacggctttcgtctaacgtttcaacaaatcgcagatattggtacaacagggttactgattgatgccattatgctttcttccacctttttcattgccttatggcttggacgtacctttttggggttggatagccaaaccgcagtattgattggtgcaggaagcagtatttgtggagccgcagccatcatggcaaccgagccagtggtcaaggcatctgccagtaaagtggccgttgcagtttctaccgtggtaattttcggaacgctcgcaatatttatctatccatggttttaccagctcaatgcccattaccaatggcttcctttctctcaagaaacattcggcatcttctctggttcaacgattcacgaagtcgctcaagtcattgctgttgggcatacattaggcaacaatgccgagaatgcagccgttatcagcaaaatgatccgtgtcatgatgttagctccctttctactactgctctctggttatattagtcggatagaggctaaaaactttggcagtgatcaagatcaaaaaaaatccccagtcagtattccgtggtttgctatatttttcattgctacggcaggactaaactcttttcatttattacctggctcccttatcaaacatattattaccgccgataccatcatgctagcaatggcaatggttgcattaggtttaacgactcatgtcagcgccattcgtcaggctggagttaaaccgattctgctggcattcttcctgtttatctggcttatagctggaggattagttgtcaatcaaggaatccaacggatattgggttaa

SEQ ID NO: 3872 - DNA, 864 bp, Xenorhabdus bovienii
  Coding sequence Name=Xb4151_4152.C440.gene251.dna; Position on contig= 202114..202977bp; Strand=+
atgcgtatcactctgagacaactggaaatttttgcagaagttctgaaaagtggttcaacgacacaggcttctcagcatttagcgttatcacaatctgcggtgagcgcttcactgacggatctcgaagggcaattgggtgtacagctttttgatagagtgggaaagcgattagtgactaatgaacatggccgtttgctgtatcccaaagcattagcattacttgaacaggttggtgaagtagaacagctttttaaactggaattaggagcgctgcggttagcggccagcagcaccattggcaattacatgttacctgaaatgttgtcgaattatcgtcaggactatcctgatacaccattggaattgaatatcagtaatactgaagatgtcataaaggcggttgtcgaatttcgcgtcgatttaggattgattgaaggcttatgtcacaatcctgaattgattactcaaccgtggatggaagatgaattgattatcttctgctcaccgaaaaattcactttcacagcgtgactttactgtggaagatttgattaaagagccttggatactgagagagaaaggttcaggcacaagggaagtgctagatcaccttttattctcgaaaatgcctcgattcaatattgcaatggaattgggaaattcggaagcgattaaacatgcagttcaatatggtatgggtatcagttgcctttcgcgacgggtcgtccaagagcaattgaaaaatggcacattagttgagttggtgatccctgaactgaatctttatcgtacactctatctgatttatcaccgtcagaaacatatgtccaatgcactacaaaaattgttgagctattgtaaataa

SEQ ID NO: 3873 - DNA, 1488 bp, Xenorhabdus bovienii
  Coding sequence Name=Xb4151_4152.C440.gene252.dna; Position on contig= 203146..204633bp; Strand=+
atgtctcaagaacaaagcacactaggggagcagcctccaagaaccctgcgccgtgaattaaaagcgcggcatatggcgatgattgccattggagggtcaattggcacagggttatttgttgcttccggcgcaacaatttcacaggctggtcctggtggagccttactttcctatgcattaattggtctgatggtttatttcctgatgaccagcttgggcgaattggcagcttatatgccagtttcgggttcattttcaacctatggatccaaatatgttgatgaaggttttggcttcgcgttggggtggaactactggtataactgggccgttacgatagctgttgaccttgtggcagcacagttggtcatggggtactggttcaatgatgtgccaggttgggtatggagtgcgttgttccttggcataatttttctgctgaactttatttctgttaaaggttttggtgaagctgaatactggttttccctgattaaagtttctacgattattgtcttcattattgttggcatcttgatgatcatcggtatcatgaaaggggctgaaagtgccggctggcaaaattggcaagtgggtgatgcgccatttgccggtgggtttgctgccatgattggggtagcgatgattgtcggtttctcatttcagggaaccgaactgattggtattacagcaggagaatcaaaagatccggcgaaaaacattccacgagctgtacgcaaagtattttggcggatcctgttattctatgtttttgccattttgattattagtttgatcattccttatactgaccccaacttattgcgtaatggtgtgaaagatatcagtgtcagcccgttcacgctggtatttgaaaatgcggggttgttgtctgcggctgcgatgatgaacgcagtgatattgacggctgtgctttcagcaggaaattcgggtatgtatgcttctactcgcatgttgttcacgttggcgagggaaggtaaggcccccaaaatttttggtcatttatcaaaaggaggcgttccacgtaacgcactttacgcgactaccgtggttgcagggttgtgttttttcagctcaatgttcggcaaccagacagtatatctgtggctattgaatacctcaggtatgacagggtttattgcgtggctagggattgcaatcagccactaccgtttccgtaaaggctatatcgcacaaggacgggacttgaatgagctaccctatcgctcaggttttttccctgtcgggccgatttttgcgtttgtgttgtgtttgatgatcacattgggccagaactatcaggcgtttttgcaagataatatcgattggtacggtgtaactgcgacttacatcggtattccggtattcttgattatctggttcagctacaaactgaaaaagaaaactcggtttgttaaatgtagtgagatggaatttccatcattaaaatttacaggtaatgaataa

SEQ ID NO: 3874 - DNA, 96 bp, Xenorhabdus bovienii
  Coding sequence Name=Xb4151_4152.C440.gene253.dna; Position on contig= 204739..204834bp; Strand=-
atggcgctaacaataaagcaaataagaatacttatcaatgcgattaattcaggatcgctacaatttactgactatattcttcccgtaataccatga

SEQ ID NO: 3875 - DNA, 1101 bp, Xenorhabdus bovienii
  Coding sequence Name=Xb4151_4152.C440.gene254.dna; Position on contig= 204895..205995bp; Strand=+
atgaatatcagtctactggcaagctccgctatgatggcgagttttgcatcttgggctgaaacagtcacggatgttgctgggcgtactgttgaggtgcctgaaaaagtcaatcgtattttgttgggagaagggcgtttattccattcccttgcactattggaaggagacaagcctttagcgcgtatcgttggctggcaaggtgatttccgtaaactggatccacaaacttactctatttataaagctaaattccctgagattgataatattcccctgataggtaacaccagtgctgacagtgtcagttctgaaaaagtgctgacgcttaatcctgatgtcgctattttcggcttatctgggcatgggccaggaaaaaacagtgagctggttaaacagttggaaaaagcaggtattcctgttgtttttgtcgatttccgcaacgaccctttgaaaaacacattaccgagcatccgcatgctgggtaaaatgctgcatcgtgaagagcaagctaacgcttacgctgatttttatgaaaagaatcaaaaattagttaccgatattactgaccaaatagcggaagctcagaaaccttcagtctttattgagttgctagcgggtttcagcggcgattgctgtggtacggcaggtaatggcaatatggggaatttcattgacttggctggaggcaaaaacatagccaaagatgtattgccgtcaccgttggggatgatgaatctggaaaaagtgattgtcgcagatccttatatttatattgcgagtggtgcacaggatccgggtgataaagatgggggtgttcaaatgggtgcccaaacttctgcggatattgcccgcgctggactgaaaactatcactgtacgtaaaggtatcaatactttgaccgcagtgaaagaagggcgtagttacggtatctggcatcattactacaattcaccttataacgttgtggtaactcaggtctttgctaaatggttctaccctgaaaaatttgctgacctagatccacagcaaacattgaaagaacttcataataaattcttggctgttgaaccagcaggcacgtattggatcagtgagaagtaa

SEQ ID NO: 3876 - DNA, 1086 bp, Xenorhabdus bovienii
  Coding sequence Name=Xb4151_4152.C440.gene255.dna; Position on contig= 206016..207101bp; Strand=+
atgagtatcactaccaaacctatgccaatggtaaaacaacaattgagtgagtgcgatgtaaaagcacgctatcgtcatattttgcatcgacgtattacattgatatttaccattattttggtgattggtgcctctttgatattggattttacaatggggccatcaggattatcactgcaagccctttggcagacactaatttcgccggaaagtgttgatgtaggaacgcgggtaatcgtttgggatatccgattaccctatgccttgatggcggtagtcatcggcttgtcgcttgggttggcaggcgctgaaatgcagactgtcctgaataacccactggccagtccatttaccttgggcgtttccaatgccgcctcatttggcgcagcactggccatcgtgcttggcattggcattccgggaataccggatcaatggctcatctctgcaaacgcttttatcttcgctttattggctgctttgatgcttgatagtattacacgctggacaagagtggcaacgtctggcgttgtgttgtttggcattgcgatggtgtttaccttcgaagcgctggtttctatgatgcagtttatcgctacagaagacactttacaggggctggttttttggacgatgggtagccttgcaagggctacatgggaaaagctcggcattatgttgctggtatttctcattattatgcctatctcaatgatgaactcttggaagctgacagcattgcgtttaggtgaagatcgtgcagccagttttggtatcaacatcagtcgtcttcgtctgggaacattgctgcgcatcagtattctaaccgctctggcggtagcgtttgtcgggccgattgcgtttatcgggctgatcgcccctcatattgccagaatgatgttcggtgaggatcaccgtttctacttacctgcgagcgcgttgattggtgcattagtgttatcgatggcgtctattgcatccaaaaacctgatccccggaattatcataccggtgggcatcgtcacatcgctgattggtgttccgttcttcctgagcattattttacgccataagggaagtatatga

SEQ ID NO: 3877 - DNA, 789 bp, Xenorhabdus bovienii
  Coding sequence Name=Xb4151_4152.C440.gene256.dna; Position on contig= 207098..207886bp; Strand=+
atgaatcagggactgaaaatcaaccgactcacggccgggtatcctaagcatccggtgattgaaaatctggatgtcaagtcattgcctcgtggtcaaatcacggtattgctggggcctaatggcagtggaaagtccacacttcttcgttcattggcggggcttaataaagctagaggtgaattgttgctcaatgggcaggatttgatgcagatgaatttcgctcaacgcgctcagggtgtagtttacctgcctcagtcattgccggagggggttcatctccatgtactggaatccgtgattgttgcccagcgagcatcaggtggtgtaagcagcaaacaatgtgaaaatgaagtcatggaactgttacgtcagcttggcattgaacatctagcgctcagctatctggatcaattatcaggtggacagaaacagttagtgggattggctcaatcattaatcaggcagccgacactgttattattggatgagccattaagtgcgctggatttaaattaccagtaccatgtcatggatttagtggcacgtgaaactcgtcgtcgcaatattattacggttgttgttgttcacgatattaatattgcattgcgtcatggtgaccatgtattaatgctgaaaaaaggcgagttaattgccgaaggtacacctgaacaggtgattacaccagatagtctggcgcaggtttatggtgttaaaggccgcattgagcgttgctctcagggagtgcctcaggtattaattgatggtttagtgacggaattggctaattag

SEQ ID NO: 3878 - DNA, 1974 bp, Xenorhabdus bovienii
  Coding sequence Name=Xb4151_4152.C440.gene257.dna; Position on contig= 208039..210012bp; Strand=+
atggctgtttttgtaaaaagaaaaatcgtattgggaattattgccgctatttcatccagcgctgttttagctgccaataatggtgatgacaaaattgttgtaactaccgcagcgggcttccagcaaaagattgaagatgcacccgcttctatttcggtagttagccgtgaacagttagaaacgaaatcttatcgtgatatcacggatgcactgaaagatgtaccaggggtagttgtgactggtggtggtagtagtagtgacatcagtattcgtggtatggcttcaaaatatactatgattctgattgatggtaagcgtgttgatactcgcagtacccgcccaaatagtgatggttctggtatcgaacagggatggttgccaccattagcatcaattgaacgtatcgaagtcgtgcgtgggccgatgtcttctctttatggttctgatgctatgggcggcgtaatcaatattattacccgtaaggtacagaaagagtggcataccagcctgcgtgcagatactactctgaccgaacgtaaaaattcaggtaatagctaccaaaccagcgcttatgctgcggggccattaattgatggtttgttaggattgaaagtcaatggcctgttttctcatcgtaatgaagataagtttattggtggctttagagagcaggaaatgcgtaatggtgcagcaacgttctctttgacacctgatgaacagaatactttcgaatttgaggctgggcgttatgagcaggatcgagactcaaccattggtaaaactcgtgattgccagccaaaatcttgtaaagatgacgtgagccgctataaacgtaataactattcgatttcccataatggcgtttatgacttcggtacaatgacttcttatgttcagagggatgaatcgcataaccctgagcgtgaaatgaaatataacgatacgttatttaataaccaaactacgtttatattagatgatcatacgttaagtgtaggaggacagtatcgctatgaagatttacgagatactggtaataaattaaattcagcaaaagatgttaataaattaacacgttggagttgggcattatttgcggaagatgaatggcaaatgaccaatgattttgctctgacgggtggtgctcgtttaaataaagacgaaaactttggagcacattggacgcctcgtttgtatggtgtatggcacgcagatgaacagtggacgatcaaaggtggtgtttctactggttaccgttcacctgaattgcggcaggttgcccctaattggggacagacaacgggtggtagatcccttaatggaatgattatagggaactcggatcttaagccagagaaaagtgttagtgaagaaattagtgttatttggaataaccaagataactttaacgtcggtgtaacagtctttaatacagattttaaagacaagatcactgaggttggagtgtgtgataaagatactgaaaatccatgtaaaccaacaggtgatattacttatgattttatcaaccagcgtacaaacttggataaagcgaacatccgtggaatagaagccaccctgaattgggatatcgtagaaaacttgtccttagcctcaagttatacttataccgagtcggagcagaaaagcggtaagtataaaggtcaggcattgaataaaatgccaaaacatatggccaactctaccttgaattggcaggtactaccagaaatggctacgtggactcgcattaatttcagaagtaaatcaacaaattatgtatatcgctctggtgtgaagaatggtacaccatcttacactttcgttgatttaggcatgacctataacttgacgaaaaacttgcgtgtattaggtggtatctacaacgtctttgacaagcgcgttactgagaaaacccacgatgcggtactagatggccgtcgttataacatcggcattaattatgatttttaa

SEQ ID NO: 3879 - DNA, 246 bp, Xenorhabdus bovienii
  Coding sequence Name=Xb4151_4152.C440.gene258.dna; Position on contig= 210225..210470bp; Strand=-
atgtttgtattcctcagtgcagcagcccgttcttataatggccgcttatggtcagtatcgatccggaacaaaatccggcctcttggtgttgtaaaaaataactcaaagcaaaaaaataactggtgtatatttacacaccagctattttttagtgcacgcattttgcatttcacacctagaaatagcaagagctatcacactaaaaattcattattttttacaataccggagagcctgatggaatag

SEQ ID NO: 3880 - DNA, 216 bp, Xenorhabdus bovienii
  Coding sequence Name=Xb4151_4152.C440.gene259.dna; Position on contig= 210469..210684bp; Strand=+
atggagcaattattcacttttgcactcgtgccaattggcgcttgctgctgcaacgatgattatggggcatggcccaccgtcagttcgctgtcttctaataactcttctttcttttctgtctatagacagatgcgaagtctacccactaactatcgattaagtagttgcattagtacccagatcgaagttatgggaggtttcgctcatgtcgcataa

SEQ ID NO: 3881 - DNA, 1383 bp, Xenorhabdus bovienii
  Coding sequence Name=Xb4151_4152.C440.gene260.dna; Position on contig= 210674..212056bp; Strand=+
atgtcgcataataccactctcacacttgacactaaccaaaccagtgccagcgatcgtgttcaactaagaagaacactgaccctgtttcaggtggtcatgatggggcttgcctacatgcagccaatgactatctttgacactttcggcattgtttccggattaaccagcggacatgttgcaacatcttatgctctcgcgctgatcgccattttatttacagcattgagttacgggaaattggtaaaacgcttcccatcagcaggatctgcctatacttacgtacaaaaatcaataaatccccatcttgggtttatggtaggttggtcatcattgctggattatctgcttatgccgatgatcaatattctgctggcaaaaatttatcttcaggctcttttcccaggcattgacccatggattttcgtagtcacgttgacaatactgatgacgattttcaacctgagcggcattaatgtagtcgcgaatctcaatggtgttattgtgattgttcaggttgccgttatgttggtactcgtcggtttcttggttcatggtgtctataatggcgaaggcgttggaacattactgagtattcaaccgttcacgtcagatgaagcgaagttgattccaatgatcacaggagcgacgatactctgcttctcattcctcgggtttgatggtatcagttccctgtcagaagaaacacctaatgctggaaaagtgatccctaaggcgatcttcatgactgcattaattggtggagctatctttattgcagtatcttattttttacagctttatttccctgatatttctcgatttaaaaacccagacgcctctcagccagaaattatgctgtatgttgctggtgcgctgttccagtacattattcttatgttctcctgtgttacggtagtggcttcagggatggcagcacatgcaggtgtatcccgtttgctctatgtgatggggcgtgatggtgtactgcctgaaaaagtatttgcttatattcacccaaaatggcgtaccccatcaattaatgtcatattggttgggattgttgctctgtcagcgggttggctggatttggtaacagcaaccgcattgataaacttcggggcgttagtcgcatttacttttgttaatctgtcagtgatttcgcagttctatattcgtgaacagcgtaacagcacactgaaagatacgattcactttttgattctgccggttcttggtgcagcgacagtaggtgtgttgtggatgaatctggagtcaagttcgatgaaattaggtctaatttggggaggaatcggtatgatctatatgttcttcctgacccgtagtttccgtcagccaatgcctcagtttactgaatcagtgtaa

SEQ ID NO: 3882 - DNA, 1710 bp, Xenorhabdus bovienii
  Coding sequence Name=Xb4151_4152.C440.gene261.dna; Position on contig= 212236..213945bp; Strand=+
atgaatgatgctaaaatccctcacaaccagcaacttattgcaattctcactaatattgttggatctccccacattctcactgaatctcgaaaaacagaacgttatcgcaaaggctttcgctctggacagggaaatgcccttgctgttgtatttccggcttcattattagagcaatggaaagtgttcaaagcctgcgttttagccgacaaaattattttaatgcaggcagctaataccggattgacggaaggttccacacccaacggtgatgattatgaccgcgatattgttattatcagtacactgcggatggataaaattcaggttcttacatcagtcaatcaggtcattgcatttcctggcagtacattgtggcatttggaaaaagtcttgaaaccgttaggtcgtgagcctcattctgttattggttcttcctgcattggtgcgtcagttgttggagggatctgcaataactctggcggctctttggtacagcggggtccagcctatacagaaatggcgttgtatggacgtgtgaatgagaagggacaagctgaactgattaatcatttgggtatatggttaggagatacgccagaagatattctgacttgcctggaagaacagcgctatcgagctgaggatattcagctggatgaccgagttgcttctgatcatgagtatgcacagcgtgttcgagatatcaatgcagagaccccatcacgttttaatgccgatgagcgtcggttgtttgaagcttctggttgtgctggtaaattagttgtttttgctgtccgtttggatacttttcctgcacagtcgacttctcaagttttctatatcggcaccaaccaacctgaagtattgacagaattacgccggcatatattggctaatttccagcatttaccgattgctggcgaatatatgcatcgggatatttttgatatcgctgaagtgtatggcaaagacacctttgtcatgattgataaacttggtacggataaaatgccaatgtttttcagcctgaaaggacgtatggatgccatgtttggcaaaattccttttttgccatcacacctgacagatcgcgtaatacagggcttgaaccgtttattaccttcacatctgcccacacgtttgaaagagtaccgaaatcgcttcgaacatcacttgatgttgaaaatgtctggtgaaggcataaaagaagctagtgagtggttggaaagctactttaaacaggcagagggagaatttttcgcctgtacgccagaagagggtacaaaggcatttttacaccgtttcgcagcggcaggagcggccattcggtatcaagctattcatagcaatgaagttgaggatattttagcattggatattgccctgcgccgcaatgaccacgaatggtttgagcatctaccgccagaaattgatggagcattggtgcatcgtctgtattacggacattttatgtgccacgtattccatcaggattacattgttaaaaaaggcatagatgttcatgcgctgaaagtaaaaatgctgaagatcctgaaccaacgaggagcggaatatcctgctgaacataacgttggtcatttatatcaggctaaaccgcagcttaaacagttttatcagatgactgatcccactaatactttgaatccgggtattggcaaaacctccaagctgaaaaattggggaagataa

SEQ ID NO: 3883 - DNA, 108 bp, Xenorhabdus bovienii
  Coding sequence Name=Xb4151_4152.C440.gene262.dna; Position on contig= 213998..214105bp; Strand=-
atgcagttcagctggctggctaacggccccgcatcatactggcttatttcagaaaaagaaaaagacaaaattctctgttttgtcttttttatcctcattccagcataa

SEQ ID NO: 3884 - DNA, 1428 bp, Xenorhabdus bovienii
  Coding sequence Name=Xb4151_4152.C440.gene263.dna; Position on contig= 214083..215510bp; Strand=-
ttgagtaacgataaaacccccactttctatgttcatgattatgaaaccttcggcaagcaccctgccttagaccgccctgcccagtttgcgggaattcgcaccgacagtgattttaatatcatcgaagatcctttggtggtgtactgtttgcctgctgacgattacctgcccgatcctgaagctgtgatgattacggggattacaccacagttagcattaaaaaaaggggtcaatgaagctgaatttgcccgccagatccatgaagcattcagcaagcccaatacctgtattatcgggtataacaatattcgttttgatgacgaagtcagccgaaatatcttttatcgcaatttttacgatccttatgcctatagctggcaaaaaggtaattcccgctgggatctgcttgatgtattacgtgcctgctatgccctacgcccagaaggcattatctggccagaaaatgaggatggtctgcccagttttaagctagaaaacctgacgaaagccaacggagttgaacatactcaggctcatgatgctatgtccgatgtttatgccactatcgcgatggcaaaacgggtaaaaaaagcccaacctcgcttgtttgattactttttccaattaagaaacaaacagaaggtcagtaaccagattgatattccgcagatgaagccactggtacatgtatcaggaatgttcggaactctgcgcagcaatatcagccttatagcacctttggcatggcacccgacaaatcgcaatgcggtcatcatgtgtgatttagcgggtgatatttccccgttactagaactcagcgcagacgaattgcgcgagcgcttgtatacccgacgtaatgaactacagccaggccaagctccagtacccattaaattgatgcatatcaataaatgcccgattattgctcctgaaaatacactacggacagaagatgcggaacgagtgggattgaatcgcgatcaatgtgcaaaaaatctggctatattgcgcagtaatccgcaaatcagggaaaaagtggttgagctattttctcaaccagaggaattccctgagtccgacaatgtcgataccaagctatatagcggttttttcagtgatgccgataaaactgcgatggaaattatccgggaaactgcacccaaaaacttaccggcactggatttaacatttcaggatccacggattaaaacactcctgttccgttaccgcgccagaaactatccggcaacgctgaattatgatgaacaacagcgctggctatatcatcgccgggagatattgacacaggaaaatatcagccaatatcttgcggccattgaacagctctttgttgaataccaatctgatgaagaaaagtgccgccagttaaaagcactagttgattatgcagttcagctggctggctaa

SEQ ID NO: 3885 - DNA, 198 bp, Xenorhabdus bovienii
  Coding sequence Name=Xb4151_4152.C440.gene264.dna; Position on contig= 215618..215815bp; Strand=-
atgaccaagagtttccgctgccataagaggtttcagttcctatccgaaaagagatttttctccacatgcgaaatgataatcaacaattttcaccctatatcattagagagttcagattgtccaagatatggtttaccatatcttttcgcatcgtttagcctcgtagaaaccaaagatttagtacacaatttgtcataa

SEQ ID NO: 3886 - DNA, 132 bp, Xenorhabdus bovienii
  Coding sequence Name=Xb4151_4152.C440.gene265.dna; Position on contig= 215867..215998bp; Strand=-
atggaatgttggtttatttgcgttgtccatttttacaccttttttaatcagaccgataatttttatgctgactacacaatacaatttcaggtaacgaatagacaagtcagtttcgacaatttattgacatga

SEQ ID NO: 3887 - DNA, 321 bp, Xenorhabdus bovienii
  Coding sequence Name=Xb4151_4152.C440.gene266.dna; Position on contig= 215969..216289bp; Strand=+
atggacaacgcaaataaaccaacattccataatgtactggagtttgtgcgtatatttcgccgcaagaataaattacagcgcgaaatagtagacaacgagaagaaagttcgagataaccaaaagcgtgtattattgctggataacctgagcgattacattaaaccgggaatgtcagttgaagatattcaaggaattatcgctcatatgcgcagtgattatgaagaacgtgttgatgaatatatcatcaaaaatgcagagttgtctaaagagcgtcgtgagctgtctaaaaaacttaaggcaatggatggcggagtaaaataa

SEQ ID NO: 3888 - DNA, 645 bp, Xenorhabdus bovienii
  Coding sequence Name=Xb4151_4152.C440.gene267.dna; Position on contig= 216330..216974bp; Strand=-
atggagaacattccggcgatgaaatcttggctaattttcggtgctggcaaaggcgttggacgccatttagctactatagcactgaaacaacaccgccccgtaacggtattaattcgtaatctacaacaagccgtggagctaagtgcaatgggtgctaatgtcatacatggcgatgcctgtgacaaaatgagtatcgaaaaagctattgctcaggctggagaaaaccccattgttttctcaactattggcggaggagacgctgatcaccatggtaatatgtccatcatagatgcattggaacaagctgaagtttcacgcatgctactggttacatccatcggatgtggagatagttggaaaacgttgtcaccacgtgccaaatcattatttgggcaatcaatcagacataaatcgctggcagaaagttacctgcaaaccagcaaattggattttacgatcattcgtcccggtggactcactgataaatcaggtactggacattgccaacgctatcaaggtgaagttcacggtatggtgagcagagaagatgttgcacagcaattggcactggtggctgaagatgaagaaacttattaccagatttacgctttagtcgatccagagttaaaacctcactggggctga

SEQ ID NO: 3889 - DNA, 237 bp, Xenorhabdus bovienii
  Coding sequence Name=Xb4151_4152.C440.gene268.dna; Position on contig= 217006..217242bp; Strand=-
atggcaacgtcctgcttatccgttcgctggaaaaggcggcgcgggtggacattctgcaacaaatatcgcaacatctgcgatgtcaaaaccacagtcattcgaatagtaattggatgttgtaatttccagaaaaatcaaaaagggctcctttgtatggagtccttttttatattaaaaatgataaaaaacctgtctgtctcatttcattcactctccgattccaataaacttagatag

SEQ ID NO: 3890 - DNA, 3186 bp, Xenorhabdus bovienii
  Coding sequence Name=Xb4151_4152.C440.gene269.dna; Position on contig= 217137..220322bp; Strand=-
atgaaaagaatgctaatcaacgcaactcaacaggaagagttgcgtgtcgcccttgttgatgggcaacgtctttatgatttggatattgaaagtcctggacacgagcagaaaaaagcaaatatctataaaggtaaaattacacggattgaacctagtctggaagctgcttttgtcgattatggtgcggagcgtcatggtttcctgcccattaaagaaattgctcgcgaatatttccccagtagttatcatgctcatggccgacctaacattaaggatatccttaaagaaggtcaggaagtcatcgtccaggttgataaagaagaacgaggcaataaaggtgcagccttaacaacttttatcagtctggctggtagctatttagttctgatgccgaataaccccagagcaggtggtatttctcgccgtatcgaaggtgatgaccgtatcgaattaaaagaagcgctctcctctcttgaattacccgaaggcatggggcttattgttcgtactgccggagtaggcaaatccgccgaagctttgcagggagacctgaattttcgcctgaaacactgggaagctatcaagaaagccgcagataatcacccagctccgttcctgatccatcaggaaagtaatgttatcgtacgcgccttccgtgattacctacgcccggatatcggggaaattctgatcgacaatcctaaaattctcgatttggcacgccagcatatcactgcgcttggacgccctgatttcgccagcaaaatcaaactgtacagtggtgaagttcccctgttcagtcactaccagatagaatcacagattgaatcagctttccagcgtgaagttcggctgccttctggtggttcagtagtcatcgatacaactgaagctctgaccgcaatcgatatcaactcatcccgggcaacccgtgggggagatattgaggaaacagcctttaacaccaatctggaagctgcggatgaaattgcacgtcaattgcgcctgcgtgacctcggtggccttatcgttattgatttcattgacatgacacctgtacgccaccagcgtgaggttgaaaaccgtttacgtgatgcggtgcgtcaagatcgtgcccgtattcagattggccgtatttctcgctttggcctactggaaatgtcacgtcagcgtttaagcccatctctgggtgaatccagtcaccacgtctgccctcgctgtagcggtacaggaaccattcgtgacaacgaatcactttctctgtcgattcttcgcctgatcgaagaagaagcactgaaagaaaatacccatcaggttcatgcgattgttcccgttcagattgcgtcctacctgctgaatgaaaaacgtaaggcggtcagcgccattgaacatcgtcaaggtgatgtaggtgttgttatcgtaccaaacgatcagatgcaaactccgcatttctctgttctacgtgttcgtaaaggtgaagaaatttctaccctgagttatctgcttccacaattacatgaggcagaaatgacgaatgctcaggatgatggacaacatgaacgcaagcgtcctgagcaacctgctatttcaacttttgatctgcctgcagaaactgtcgcccctgtggcagcaaaaacaaaagagaaaaaggtagtagtgagcaataatcagcaaatagaacagccaggtctgttcagtcgcttcctctgcgccctgaaaaaaatattcaatggtgaagaagaaaaacaggagcaagaaaagagcaataaatcttctagtaacgataaccgacgttccccagaacgccgcaattcacgtcgtcagaatcaaagacgtgaacgtaacgagaatgacactcgcaataatcataaccgtgagcgcggcgatgaacagcgtaagggtcgtaatgttcagcagaaaaacaacgcgccggataatattgcggtagatatagataatgaagctcgtgaagcacagcagcaacagcgccgtgaacaacgggcggaacgccagcgccgccgtcaagaagaaaaacgtcagcagcaactggaaaccaaggttcaacagacgagtagacctgaaattacagaagaggaagttgaagagcatcaacctgtaatgcctcgtcgtcagcgtcgtcagcttgaacagaaaattcgtatcacagacaatgtgaaggaagaagttgttgttgcctctttacccgttgtaacaaaggcgatcattccggcgattacagaagaagagaagaaagtttctgtaccagccattatcgatacgaatgtagaagcagctaatcagccttcaataccacaaggctcaatcgcgcaaaataatgagcagcaagacaacatcatgcctcgccgttctcgccgctcaccacgccatttacgtgtcagtggtcagcgtcgtcgtcgttatcgtgatgagcgtaacctgactcaatcacctgtaccactggtaatggcagttgcatcgccagagctggcatcaggtaaagtttgggtgcgctaccctgttacacctgtgacacaacctgctgaaccagaagtatctactgtggaagaaacagtaataggggcagagcagaaagagagtgtcatgccgatacctgctgttgctgaatcggtatcggtatcagtttcaactgttgctgatactcaggttgccgagcaaaatgcagttactcatgatgatattaagtctgcgaccaatggtgacccgctcgtagaacccgtgcctgagaaacctgaagtattagtatcggaaaacctggaacccgtcgttaaccatgacacccaatatcagcctgaagccttacatgacatgttagtacatgacacagaagaaacacgtcacacagcagaaccaatcattgtgacgtctatcgctgaacaggaacagcatgaagaacagccaactgtcacaacggaaatatacgctaaggcagaggaagttaaagcggaagagacaaaaattgctgagtctccgattatcgtggaaaaaaatcatcacgcttcttccccaatgacaaaagcaccagcaccagacttagcagcacagcctgtcattatcaacgaatggcaacgtcctgcttatccgttcgctggaaaaggcggcgcgggtggacattctgcaacaaatatcgcaacatctgcgatgtcaaaaccacagtcattcgaatag

SEQ ID NO: 3891 - DNA, 120 bp, Xenorhabdus bovienii
  Coding sequence Name=Xb4151_4152.C440.gene270.dna; Position on contig= 220392..220511bp; Strand=+
atggcctcgtgtcttttacaaagccgtcagcctcacggctatcgtttgtatagaggcgcctatattgtcggcgagtctgaatttcatttaaatacagtactctttattgggacactgtaa

SEQ ID NO: 3892 - DNA, 957 bp, Xenorhabdus bovienii
  Coding sequence Name=Xb4151_4152.C440.gene271.dna; Position on contig= 220878..221834bp; Strand=+
atgaaaacaaataatccaattgtacagtttgtcacgattgacgacgatgaagccggtcagcgaattgacaactttttgctggcgcgcttgaaaggtgtgcctaagagtatgatctatcggatcttgcgcaaaggtgaagttcgagttaacaaaggaagaatcaagcctgagtataaattggcagcggctgatgttatccgtattccgccggtcaggatagcggaaaaacagcagccaccagtatctgccaagctgggtaaagtagtcgctctggcagaatgcatcctttatgaggatgactacatactagtcattaataaaccatcaggtactgcggtgcatggtggaagcggattgagcttcggtgtaatcgaagggcttcgtgcattacgtcccgaagcgcgtttcctcgaactggtgcatcgtctcgaccgcgatacatcgggtgttctgctgattgcgaagaagcgttccgcattgcgtacactgcatgaacagttgcgtttgaaacagatgcagaaagattattttgcgttggtacgagggcaatggcagtcacattgcaaagtggtgcaggcacctttattaaaaaatatcctgcaaagtggtgagcggatagtgaaagtcagcagtgagggcaaaccatcggaaacacgttttaaagttgaagagcggtatgagtttgcgaccttggtgcgcgcaagcccaataacgggacgtacgcaccagatccgtgtgcataccttgcatgctggtcatcctattgcatttgatgaccgctatggtgacagggcgtttgatgcacaactgacagaaacagggcttaaccgattgtttctgcatgctagttcattaaaatttactcacccatccacgggagaaactttgcgtttcgaagctcaaatggatgatgagttacggcaatgtttaacaacattacgacaaaataattattga

SEQ ID NO: 3893 - DNA, 606 bp, Xenorhabdus bovienii
  Coding sequence Name=Xb4151_4152.C440.gene272.dna; Position on contig= 221828..222433bp; Strand=-
atggaaaaaatgatgcttccgattgttttatcatcaacgtcgatataccgccgcctattgttggaaaaaatggggctaccttttgtctgtactactcccaatattgatgaaagcccacaagagaatgaaagccccacacaactggtaatgcgtctgtcacaggcaaaagctaccgcattacaaccgagttattctagccacctgattataggttcagatcaggtttgcgttttaagtggaaaaattacaggtaaaccccacaattttgagaacgctttcgcacaactcaaaaaagccagtgggcagtgtgtcactttttatactggaattacgctatttaacagcaaaacaggaaacactgatacccgctgtgaattatttcatgtccatttcagagatctgacagaacccgaaattatcagctacctaaacaaagaacagccttttaattgtgcaggtagctttaaaagtgaaggtttgggaattacattatttaaaaaactcgatggcagagatcccaatacgctaatcggtctgccattgattactctgacagaaatgctcatccgtcaagggataaacccactgacggtatgttatcaataa

SEQ ID NO: 3894 - DNA, 525 bp, Xenorhabdus bovienii
  Coding sequence Name=Xb4151_4152.C440.gene273.dna; Position on contig= 222567..223091bp; Strand=+
atgcagaaggtaaaattacccctgaccattgatgcgcttcgtgcagctcagaaaagattagactacgaaggtagttattctgctgaacaagcttctcgtctcgcagagtctgtggtcagtgtggatggtgatataaatagctcattatcatttcaaattgataatctgcgtctggcagttgtaaaagggcattccgatgtggatgtcacacttgcctgccaacgttgtggcagtaatttcagccatcatgttcacataacgtattgttttagtccggtcgtcaatgatgagcgggccgaggcattaccggaagagtatgagccaattaacattaatgaatttggcgaaatagatttgctggcaatgattgaagatgaaataattctttctctgccggtagtcccggtacatgattctgaacactgtgaagtgtccgacgcggaaatggtatttggtgtactgcctcctgaagcagaaaaaccaaacccatttgccgcattagccagtttaaagaaaagtacttaa

SEQ ID NO: 3895 - DNA, 171 bp, Xenorhabdus bovienii
  Coding sequence Name=Xb4151_4152.C440.gene274.dna; Position on contig= 223104..223274bp; Strand=+
atggccgtacaacagaataaaccaactcgttctaaacgtggtatgcgtcgttcccatgacgcactgactgcaacacatgtctctgtagacaagacttctggtgaaactcacctgcgtcaccatgtgactgctgacggctactaccgtggccgcaaggtaatcaacaagtaa

SEQ ID NO: 3896 - DNA, 1038 bp, Xenorhabdus bovienii
  Coding sequence Name=Xb4151_4152.C440.gene275.dna; Position on contig= 223303..224340bp; Strand=+
ttggctaatctaaccttagcgttagatgctatgggcggggattttggtcctcgtgttacggtgcctgctgcattgcaggcactggcatctaatccgcaattaaaattattgttggttggagatcccgaaaccatctcccctttgcttgcaaataaaaatgctgagcagcttagtcgtttgcaaattattcctgcggaacacgttgtttctaacgatgcaaaaccttctcaggcgatccgttccagtcatggtacttcgatgcgtattgcactaaatttagttaaaactggtgaagcgcaggcatgtgtcagtgcaggaaatacaggcgtattgatggggctggccaaattgatgctgaaatccatcgagggtattgagcggcctgcattgatgacgatgatccctaatttaaaacagcagaaaactgttatattagatttgggagctaatattaattgtaatagtcgtatgttagtccagtttgccattatgggagcagtaatggcagaggatgttacaggtgtgaaaaatccgcgtgtggcattactcaatatcggagaggaagaatccaaagggctagataatatccgcgaagctgctatgaccttacagaataccccaacaatcaattatataggttatgtagaagggaatgagttactgacgggaaaaaccgatgtactcgtgtgtgacggcttcgcaggtaatgttacgctgaagacgatggaaggtgcgatcagggtgattttatctctggttaaatcaccggatagccagaagaaaaaatcatcgtggttgaggaaaattttcaagaagtggttgttaaaacagatattaaaacgcttcggccacctaaaccctgaccagtataacggcgcaacactattaggattgcgtggtatcgtcataaaaagtcatggtgccgcgaatgaacgtgcgttcaaagctgctatagatcaagcagttcagaccgtacagaatcaggttcctgatagaatcgctgcccggctggatgcagtattacccaagagtgaataa

SEQ ID NO: 3897 - DNA, 954 bp, Xenorhabdus bovienii
  Coding sequence Name=Xb4151_4152.C440.gene276.dna; Position on contig= 224347..225300bp; Strand=+
atgtatacaaaaatcttaggtacaggcagttatttgccttcgcaggtgcgtactaacgcagatttagaaaaaatggtggatacgactgacgagtggattgttactcgtacaggcattcgtgagcgtcgtattgcggctgagggtgaaaccgttgccactatgggattcaatgcagccgaaaaagctattgaaatggctggtatcgataaaacacaaattgatttgattgttgtagcaacaacaacttcatcccatgcgtttccgagtacagcctgccagattcagaattctttaggcattcaaggtatcgctgcctttgatgttgcggcagcttgtgctggatttacttatgcgttaagcattgtcgataaatttatcaagactggtgcggctaaacatgccctggttatcggggcagatattatctcaagagttgtcgatcctgaagatcgcagtacagttgtcctctttggtgatgcagcaggcgcaatggtagtaggggcttcagaagagccgggtatactgtcaacccatctgcatgcggatggtcgttatggcgatttactgtcattacctaatcaggatcgattgaaacggggttcacctgaatacgttacaatggctggcaatgaagtatttaaagttgctgtccgtgagttgaccagtattgttgatgaaacactggaagcaaacaatctggatcattctcagcttgactggttagtgccacatcaagcgaatttacgtatcatttcggcggctgccaagaaattggacatgacgatggataaagtggttgtaacactcgatcgtcatggtaatacttcagcagcatctgttccgacggcatttgatgaagcggtacgtgatggaaggattcaacgcggccagcttgtcttaattgaagcatttggcggtggctttacctggggctcagcgctagtacgtttttaa

SEQ ID NO: 3898 - DNA, 930 bp, Xenorhabdus bovienii
  Coding sequence Name=Xb4151_4152.C440.gene277.dna; Position on contig= 225319..226248bp; Strand=+
atgtctgattttgcaatggtgtttcccggtcaaggttctcagtcacttggtatgttggctgatttagccacagaatttccgctggtggaacagactttcgcagaggcttctgcggtcttgggatacgatttatgggcattagttcagcaggggacagcagaagagctgaataaaacatggaaaacccaacctgtattgctcgcagcttcagttgctatctggcgtatatggcaggaaaagggaggcaagcagccttccatgatggctggccatagccttggcgaatactcggcgctggtttgtgctggtgtgattgaattccagcaggcgattaagctcgtcgaattacgcgggaaattgatgcaggaagctgtaccagaagggcaaggggcgatgtacgctattatcggattggataatgaatccattgcaaaggcatgtaaagagtctgcacagggtcaggttgtttcacctgtgaattttaattcgcctgggcaagtcgttattgcgggtgagaaagaggctgtagagcgtgccggtgctgcttgtaaagcggctggcgcaaaacgtgctctgcctttggctgtcagcgtcccttcacattgtgcactgatgaagtcggcagccgctcagttagctgttgcattgcaatcaattgtgtttaatcagccacagttccctgttgttaataatgtggatgtcaaagtagaagaatctgctgatgggattcgcgatgcactggttcgtcagttgtataatcctgtacgctggacggagtctgttgaatatatagcggcacaaggtactgaacaactgttggaaatggggccaggtaaggtattaaccggtttaacgaaacggattgttgatactttaaatgctgtagcagtaaatgatgtatcatcactcacagttgctctgaataaatga

SEQ ID NO: 3899 - DNA, 735 bp, Xenorhabdus bovienii
  Coding sequence Name=Xb4151_4152.C440.gene278.dna; Position on contig= 226260..226994bp; Strand=+
atgagctttgatggaaaaattgcactggtcactggcgctagccgtggcataggtcgctcgattgcagaattattggttgaacgtggtgctcgtgttatcggcacagcaaccagcgagaatggagccgaagcaattagtgcctaccttggtgataaaggcaaaggttttgtattgaatgtcacagattcagaatccgtagaaaaaacactctcgaatattcgtgctgaatttggtgaaatagacattctggtaaataatgcaggcatcactcgtgataacttgttgatgcgtatgaaagatggagagtggcaagacattattgacaccaatctttcttcgatttttcgtctgtcaaaagcagtaatgcgctctatgatgaaaaaacgttatggacgtattatttccattggatctgttgttggaacaatgggaaatgcagggcaggcgaattacgcggcagcgaaagcaggagtcattggtttcagtaaatcattggctcgtgaagtcgcttctcgtggcatcaccgtcaacgttgttgcacctggttttatcgaaacggatatgactagagcgttgacagacgaccaacgagtaggcattttatctgaaattcctgctagtcgtctcggtgatgcaaaggaaattgccagtgctgtagcgtttcttgcttctgacgaggccgcttacattacgggtgaaacattacatgtcaatggtggcatgtacatgatctaa

SEQ ID NO: 3900 - DNA, 450 bp, Xenorhabdus bovienii
  Coding sequence Name=Xb4151_4152.C441.gene1.dna; Position on contig =37..486bp; Strand=+
atgaccgacaacaataaagcattgaaaaatgctggacttaaagtaacacttccacgcctgaaaattttggaagtgctacaggatccagaatgccatcatgtcagtgcggaagatctctacaaaaaactgattgatatcggtgaagagattggcctcgccactgtctatcgcgtgttgaaccagttcgatgatgccggcattgtcacacgtcacaattttgaaggcggtaaatcggtttttgaactcactcaacagcatcaccatgaccatctgatttgccttgactgcggtaaagtcattgagttcagtgatgagtttattgaagagcgccagaaagatatcgctgaacgttacgggatcaagctgtcaaaccatagtctctacttgtatggtcactgtactgctggtgattgccgcaaagatagcacaatgcatgatgaaaactcatga

SEQ ID NO: 3901 - DNA, 2682 bp, Xenorhabdus bovienii
  Coding sequence Name=Xb4151_4152.C441.gene2.dna; Position on contig =607..3288bp; Strand=-
atgaaaagcgttaaattgcgtaccttggcagcactcatcacgacagttggattaatgggctgtgttcatgcagaaatgacgtcacagcagatagtggattcgcttagtcaattaaaagtgaatttcaaaattaaggataatcaagcaggagcacatggaaccgattgtgccattttaggcgcggacggggcttcctgtaatcgggttcatatcacattagctaatggcaatcaggcgatcgactcttctgactgggcgatctattttcacagtattcgccagatcctgaaagtcgatcatgagcaatacaaaatcacgcatatcacgggtgacttacataagctggagccgacggaaaaattcatcggtatcaaagccaatgaaaaaatcttgttaccgatctttggagaatactggcagatttacagcacagattttatgccacgctggtatgccacttccggtgatgcgatgcctaaaatactggcgaataccgatacggaagatctgagtgcgtttttatctgattttacagatgagcagtggaaacggactacgctggataacaatattctgatgactccggaaactcgttttgtaaaaaaccagcagatggtaaaaatcagcggggataaactgcgtggacaggttattccgacgccaaaaacgctgactatccattcacaagatgtaaacctgtcccgtggtgtgaaactggagttgggcgggttgagcaacgcatcaatcaacgttattcgagaacgttttgcctctcacaatatcaagctaacagataatggctatcggattgcggcacagatcaacgcaaacaaatttacgggcacttggcgagtgcaaggggcttattcgctgaatatcacaactcaaggaacgcaaatcgtcgcatttgatcaatccggtgtgttttatggcctgcaatcattgttatctctgctccctgccaatggtgatcctacaattgccacactgacggcaaaagacgcgcccagattcgattatcgaggcatatttttagatgttgggcgtaacttccacagtaaggaagctgtcttgcgtctgctcgatcaaatgtccagttataaactgaacaaattccatttccacttgagcgatgatgagggctggcgtctggaaatccccggtctgccggagctgactgaagtcgggagcaaacgctgtcatgatctgagtgaaactcaatgtttgttgccgcaattaggatcagggcctgatagcaataatatgggaagtggctattttagtcgtcaggattacattgatatcttgaaatatgccaaagcgcgccagatagaagtgatccccgagattgatacccctgctcacgctcgtgcagcggttgtgtcgatggaagcccgttacaaaaacctgatggcacaggggaaagagcaggaggccaatgaatatcgcctgcttgacccgactgataccacgaatgcgacatcagtacagttctacgatcgccgcagttatttaaatccgtgtatggattcctccaaacggtttgttgacaaaattatcagcgaaatcgctttaatgcacagagaagcggaattaccgttgaaaacatggcattttggtggtgatgaagcgaaaaacattcgtttgggaacggggtatcaggacaaagatggcccaatagaaccgggcaaagggatcatcaacaaaaagatagaagacaaaccgtgggcaaaatctcaggcttgccaaaaaatgatagcgcagggcattgttaaagatgttagtgaacttgacagtcattttgccattgaagtcagcaagatcgtcaatactcacggcattgatacaatgcaggcatggcaggatggcttgaaacatgcgaagtcggcaaaagatttcgccaccaagcatgtggcagtgaatttctgggatacactctattggggaggctatgattctgccaatgattgggcgaataagggctatcgagtggtcgtttccagccctgattatgtctaccttgatatgccgtatgaagttagtccgaaagagcgcggctactattgggcaacacgcttcaacgatgaagcaaaaattttcagttttgcgccgaacaatatgccacaaaatgctgaaacatcggtggatcgcgacggcaaccgcttcaatacccagagcaacaaacattggccgggagcttatgggctatcagggcaatcatggagcgaaaccgtgcgtactgatgatcagatggaatacatgatttacccgcgcttgttgccattggcggaacgtgcatggcatcaggcgagttgggaacagaattaccagcagggcagggaatataagggcggcgtaacacattatgttgatactaatgcgatcaacaatgattggatagattttgccaatttgatgggacaacatgagctggctaaattggacaaagctaacatcgcctatcggttgccagtacctgggggaaggattgtatccggaacgttggaagccaatatcgccttgccggggctagcgatccagtattcgctggatggcggtaaaacatgggcgatttacgatgacaggcagcgtccacatgtcagcaataatgtgaaagtgcgctctgtcagtactgatggtaagcgttttagccgagatgaagaagtaaaaatcacgctctga

SEQ ID NO: 3902 - DNA, 1668 bp, Xenorhabdus bovienii
  Coding sequence Name=Xb4151_4152.C441.gene3.dna; Position on contig =3658..5325bp; Strand=-
atgagtgaggcagatgcccgcccgaccaactttattcgtcagattattgacgaagatctggcaacgggtaaacatacatccgtacatacccgtttcccgcctgaacctaatggctatctgcatatcggccatgcgaagtcgatctgcctgaatttcggcatcgcgcaagactaccaggggcaatgcaacctacgttttgacgatacaaacccagttaaggaagatatcgagtacgttgactccattaaaactgacgtacagtggctgggtttccactggagtggcaatattcgctactcttctgactatttcgatatgctgtatcaatacgccattgaattgatcaataaaggtctggcctatgttgatgaactcagccctgaacagatccgcgaataccgcggaacgctgaaagagccgggtaaaaacagtccttaccgtgatcgcagtgtggaagaaaaccttgccctgtttgaaaaaatgcgtgccggtgaatttgctgaaggtaaagcgtgtctgcgtgccaaaattgatatggcatctccattcatcgtgatgcgtgatccggtgatttatcgcatcaaatttgccgagcatcaccagtccggcaataaatggtgcatctacccgatgtacgattttacccactgtatttccgatgcgctggaagggatcacccattcaatatgtacattggagtttcaggataaccgtcgcctgtatgactgggtactggataacattacgattgactgccatccgcgtcagtacgaattttctcgcctgaatctagaatacacggtgatgtccaagcgtaaactcaaccaattggtgaccgaaaatattgtcaacggttgggatgatccacgtatgccaaccatttccggcctgcgccgtcgtggttatactgctgcggctatccgtgaattctgccgccgcattggtgtcaccaagcaggataacaacgtcgaaatggccgcattggaatcctgtatccgggatgatctgaacgaaaatgcaccacgggcgatggcggttcttgatccggttaaactggtgattgagaatatgccggaaggtgaaatgatcctgacgatgccgaaccatcctaacaagccagaaatgggcagccgcgaagtcccattcagccgtgaggtttatattgatcgtgctgatttccgcgaagaagctaaccgtcagtacaaacgtctggtgctcggcaaagaagtgcgcctgcgtaatgcttatgtgattaaggcagagcatgttgaaaaagatgcggaaggcaatatcactaccatttactgccactatgatgagcagacactgaacaaagatccggctgacggccgcaaagtcaaaggtgtgattcactgggtgagtgcggtacatgccgtgccagcggaattctatttgtatgaccgtttgttcagtgtgccaaacccaggggcggaagatgatttcctatccactatcaattcagaatcgttggtcgtgcgtaaaggttttgtcgagccagggctggtgaatgcacagccagaaagaacttatcagttcgaacgtgaaggttatttctgtgctgatagcggcctctccagtgcagaacatctggtatttaaccgcacagttggcttgcgtgatacttggacaaagatctctcaggaataa

SEQ ID NO: 3903 - DNA, 132 bp, Xenorhabdus bovienii
  Coding sequence Name=Xb4151_4152.C441.gene4.dna; Position on contig =5415..5546bp; Strand=+
atggggttcggagcaaagttaatgcggaaaagcgggaagacaaaccccttcccgcgacaattaagagaaaatcttactttagttcaacattcgttacgtatttttgagcaacaaaataagctgttggtttaa

SEQ ID NO: 3904 - DNA, 1230 bp, Xenorhabdus bovienii
  Coding sequence Name=Xb4151_4152.C441.gene5.dna; Position on contig =5562..6791bp; Strand=-
atgaatttcccacaatggccaagttttacagaaaaaacactgaaagatattcaagaacccctgttatctggtcaagtaaattattggactggaaaaaaaggcatggagtttgaaaataaatttgcgcattggattggcgcagaaatggcaatttcatgtaattccgggacttctgccgtaaatattgctgttggcgcattaaatatcggccccggcgatgaagttatcgtgccttcttacacttttattgcaacttcctttgctgttttacaatgtggcgctattcctgttttttgtgatacgacagaagagcacaccattgatcccactaagatagaagcactgattacaccgcgcacgaaagcaattattgtcgtgcatctttatggtgtcgtatctgatatggacccaatcatggcgattgcccgccagcataacctcaaagtgatcgaagatagcgcacaatgtctcggcggaaaatataaaggaaaatcggctggtacaattggggatatcggtacgtttagcttctgccagtcaaaacattttactacggggggagagggcggcatggtcgtgaccaacaatactgaaataggttgggaatgccgggcttatcgtgatcatgggtttgatgtgagaagaaaatttgatcttctcgctttagaagaagtttcatggcatgtgcataatcgaatcggttacaattaccgtatgactgaaattcaatcgattatcggtctgaacgagttagagcgatttgatgattggaatatgaacaatcgcaagagatatgcgaagatctacgatgaaaaatttgcggatatcgacttgatccacggcctgccattgaataatgaagacagatgcaatgcgtactggttatatcccattgtttttgatcttgccaaactggattgcactgctgaaatcatcctgagtgatttgaaaaagataggtattccggcatttaaaatccagtggcctgaagcctatggtgagaaagtgttcagagatctacgtgggtttggttcagccaatttcccttttcattcgaaagaatacacatcccctgaatctgtcaattaccgtgatgttgtctgtgaaactgcacgttctttattgccgagaaccatcagcttgtatctgcaccctacttgggatgaagaacatattgtttattgtgcggatcaactgatcgccgtattgaacagtcatcgtgtgagttga

SEQ ID NO: 3905 - DNA, 1125 bp, Xenorhabdus bovienii
  Coding sequence Name=Xb4151_4152.C441.gene6.dna; Position on contig =6871..7995bp; Strand=-
atgaataatgttatttctactagaattgttttcttggcagcaggtatgggaattgctgcgtgggctcctcttatacccttggtaaaggctgatttaaatattgatgcaggagagctaggttttttattactttttcttggctttggctcaattgtttcgatgccgattacaggatttcttaccactttatttggttgtcgtaaggttattatatcttcaggaatttttgctattgtttctttaccgcttttaatattggcgcctaatgtcactcaactgggttttatgctttttatatttggtgcatccattggtacagtggatgttgcaatgaatattcaggcggttgaggtcgaaaaaaatacaaatagaaatttaatgtcaggatttcatgggttttttagtctaggggggatctttggtgctgctggtgtatcgatattactttatttgaatttctcagcgcttgcagcatgcttaattatatcttttatattgtctgtgttatttttgttttctttttctggactcattagtcgtcataaaaatcatggggatagcgatagtaaaaaaattgtttttcctcgtggaatcattattgtagcaagtttgctttgttttttaatgggaattattgaaggttctgtaattgactggagtggagtatttttagttagtgagcgtaatattgatatttcattcagtggatttgggtatgctgcctttgcagcagcgatgacaataggacgattcatgggagatcgggttatatcaaaaataggaagggggaaagtattttttgttggtacactcagtatcttcattggatttcttatcgttgttaatgtaggaactctcaatctatctatgattgggtttttctttattgggttgggatcatcaaatattgttccaatcttatgttcaatatctggaacgcaaaaagttatgcttcctagccatgctgtcgcttctattgtcacatttggatattttggaattatgattgggccagctttaataggatttattgcccagagttctggtctggagacagcattttatatattagctattggtgcattaattatggtagcaaatacaaaattgataaagaaacattga

SEQ ID NO: 3906 - DNA, 675 bp, Xenorhabdus bovienii
  Coding sequence Name=Xb4151_4152.C441.gene7.dna; Position on contig =8083..8757bp; Strand=-
atgtgtgtattttattatggaggggtaatggaagttattaatataaaagctattttatttgatatggatggtactttagttaaatcactttcagaagttgaggctatttggtctatatggtgcgaattgaacaatatatccataaaaaaagtgttggatatttgtcatggtgttcgttccagagatgttatttcgtctattgctcctcatttgaatatggaagaacaaatacagctattagatgatttagaaattaaatattctgatactgcaaaggcattgcctggggcaaaagaatttctgatttctttagcggcttgtccgtgggctatagtcacttctgccagccaacgagttgcatatcataggatggcaatttgtggtcttaagataccagacttcataattggttctgatgatgtgctgaatggtaagccctatcctgatccctatcttatggcagcagaacgtttgaatattgcggctgaagattgtttagtttttgaagatgctcatgctggggtacaaagcgcattagcagcagggtgtaaggtcatacagattggtggaaaagaaaaaatgtttgattcagttataggtctaattaatgactggaatgaaattaagattactgagatgggcattaattctttcagagtcaatatgaatttataa

SEQ ID NO: 3907 - DNA, 1050 bp, Xenorhabdus bovienii; identical to SEQ ID NO: 483
  Coding sequence Name=Xb4151_4152.C441.gene8.dna; Position on contig =8938..9987bp; Strand=+

SEQ ID NO: 3908 - DNA, 738 bp, Xenorhabdus bovienii
  Coding sequence Name=Xb4151_4152.C441.gene9.dna; Position on contig =10057..10794bp; Strand=-
atgaaaaagataataatgatttttacgttactatttacttcgattaatgttaatgctcaagtattaaatgagaataatccggataagtacaagaaattcaggctggattatgtggagatggtcgatctggctaacccagaaaggttatcgtatagagttttttatgaagagccttctaccggagaaaacagcaagtggtttgatgctattaagcaaggtgattttgaaaccgtcaaaaaaatggttgagagtggtcaggatattgaagccaaagataccggtagcttaaatcaaaccgcactgggttgggctgcctttattggttatgaagatatagtggattatttaatatcaaagaaagctaatttgtgggcgacagacacaagagatgttcatcataccttaaaatcggcaattttaggtaaaaataccaacatagtgaagaaaatacataacctaatgaaacatgaacttgatttaaatgatcaaactattgaggatgacggcgaaacaccggtaatgatcgcagcaagcaataatagaattgagacagtaaaatacctggttgagcagggtgcgaatctgaatctatttacgataacggatgataaaagtatgtattcttatgatcaaagcgcattaacctatgcctgtgagcgtaatttagaagaaatgcaaaaattactcattaagcacggggcgttaaatcacaaaacacataatccatcatgtaattaa

SEQ ID NO: 3909 - DNA, 252 bp, Xenorhabdus bovienii
  Coding sequence Name=Xb4151_4152.C441.gene10.dna; Position on contig =10979..11230bp; Strand=+
atgacatctacaatggtatttcataatggagtatgtatggcggaatcagtaaaattcataagttcaattttttgtgattatatttttttattttgtttcttttggtgcatttctgttcctgtaggactgatttttacagctatggcatgtgtattcaaaaaagcaacctacagaatttcatgttcaatattggctatattatttttatttccattaatattcacgcttatgtatattgcactatctaaataa

SEQ ID NO: 3910 - DNA, 195 bp, Xenorhabdus bovienii
  Coding sequence Name=Xb4151_4152.C441.gene11.dna; Position on contig =11259..11453bp; Strand=+
atgagggtgttattaccggaacaacagaaaaatattatggcacataacgaatttcttgagagttttattgatgtaaacactcccattgtatttcctgtaaacatgaaaaataaagatgggatgaccgaatgtcagttcccagatgtggtcataatgaaagcatggggattctattattttcagaaaccccattga

SEQ ID NO: 3911 - DNA, 1242 bp, Xenorhabdus bovienii
  Coding sequence Name=Xb4151_4152.C441.gene12.dna; Position on contig =11463..12704bp; Strand=-
atggaacaaaagtggattaatgaatacaatatttggttttatgcactattcggaacggcagtaggtgcaggaactctgtttctccctatacaattaggactatccggaccacttgctatgttggttatgctattgatagcattcccatttacctattatccccacctgggtcttgcacgttatatcattaccagcaattccgattctcccacactactcagtgcaaccaaacaatattatgggatcaggatagctcgtatcatcaactttttttatgcactaactttcctgcttattatttttgtttatgcaatatctatcactaattccgttaacattttgttgcagcaattttggaagattcagtttccacgcacattaatagcgtttatggtagttctagggttacacttaattttcttattgggtaaaaaaattacactgaaattcatgggagtgttagttcttccactcattctttacttgctgacattatctgtgacgcttgtatctcaatgggatagtgcaaacattaaacatcttatcagcaatattcatactgactgggattcagtgagagcactttggttactaatgccagttatggtattctctttcagccacaccccaatcatgtctactttttctaaccactgtaaacgagcctataaaacagatgcggaatatcacattaaacagattgtgaaacccacttatgcgctaatttgcgtagtcattttgttttttgtatttagttgtgttttaacgttatcacctcaggaaatacaggcaaccaaagacaacaatattaccattctcagtgcaatcgcgcagaaagaaggcttgtattggatagcaataacggcaacccctgttgctattattgctatgacaaaatcattcttaggaacttactttggggcattggaaggggtcagaggattagtcggagcattggagagtaagattctccatcataaagaaaataaagtgcgtgataagttgatcggcatggctatcgtttttgtccttactttaatgattactatttggaatcctaatactctgaacgttatcgcaggcatcactggacctatgattgcgcttattttgtttgttttaccatctctatcaacatacttggttgaaccactacgaccctatcgttctttttctaatttgatggttctattagtcggtcttggtagttttggtattgctgtgtttagcctttttagctga

SEQ ID NO: 3912 - DNA, 237 bp, Xenorhabdus bovienii
  Coding sequence Name=Xb4151_4152.C441.gene13.dna; Position on contig =12749..12985bp; Strand=-
atgcagagcagctttgataagctcaatgaaacgtttggcaaaaaactatcgcaacggctggagataacagaagcatcttttgatgcactggataaaagattcaaagcagcttgtgacagactggaaaatgttaacagccgactgcaatatcggtttattgcatggcttgcagtgagtgtggtggcggtggttggcacactgtttttcctgaaaagatttatttttatcctggtttag

SEQ ID NO: 3913 - DNA, 354 bp, Xenorhabdus bovienii
  Coding sequence Name=Xb4151_4152.C441.gene14.dna; Position on contig =13082..13435bp; Strand=-
atgctattcgcagtgactctgaatagtatttccgacgttataaccccaaaaatcccgaacacgaggctgtcagaagcctattccgggcggatcattgcaacccgtaaagcacgtctgatgcagtttcgtgagaactggcagaatatctgcaatccgcattttgaacgtgcactgcgcctgaaacgcatcgtggaagaaatccagaaaacgacaaaggcactgatcatagccggcagtcagactcgtgatgaaaagctacggcaatgcaacaccttcatgcaccggagaatgacagccggacagacttgctgcataaacagtctcgggagatgctggcaacattgtagagcctga

SEQ ID NO: 3914 - DNA, 96 bp, Xenorhabdus bovienii
  Coding sequence Name=Xb4151_4152.C441.gene15.dna; Position on contig =13435..13530bp; Strand=-
atggggtttgaagcgttgatctattcacgtttccacctccgtcgacggagggaagcagctacactgtcacctgatgttttttgtccgcatcaatga

SEQ ID NO: 3915 - DNA, 270 bp, Xenorhabdus bovienii
  Coding sequence Name=Xb4151_4152.C441.gene16.dna; Position on contig =13942..14211bp; Strand=-
atgagtgaaatacttcataaaaataatattaaagcggcttgtcaaattaaatcatcagacaaaaatagtattgattggattaatagtaaaagtgggtattcatttgtaataaaaccattaagttcagcgtcaactgatggtgttaccatttattttcacgaaagggatgtttttgatgcttgtgaagttgttttgaaaaataaaaatatatttggtattgataataaagaaatattggttcaatcttttcttaaaggtgagagtatatag

SEQ ID NO: 3916 - DNA, 246 bp, Xenorhabdus bovienii
  Coding sequence Name=Xb4151_4152.C441.gene17.dna; Position on contig =14430..14675bp; Strand=+
atgctatcttttttgtgttacgaacaaacagaccgcaatccaatagaccggggaaaacaaggcgtaaagcaaagtttgctcacagatggacaggacttgccattagcgattgccgttgcgcccgagaatattcatgatatcagatttgtcataaccaccctggtctgtaaaccgaccagggtggttatgacacccaactccatctggataaagtttataaggcggaatgactgtaaaaagcaatga

SEQ ID NO: 3917 - DNA, 297 bp, Xenorhabdus bovienii
  Coding sequence Name=Xb4151_4152.C441.gene18.dna; Position on contig =14734..15030bp; Strand=+
atgagtaagggaatattggctttagtttcaggtgttgaccaattgttgagcgttattggattattgttaggtggagctaatattattaagcttattaatttttcgataataacgttacatgtggagaataatatgaagaaatatattctttcttgcctgctggcaagcactacgcttttagcttcaatgcagtcttatgctatagcttgtaattttttccccccagatagtcaagaatggaaagcttgcatagaagtctgcaaactgctgcccattagtcccaaaatttgtttataa

SEQ ID NO: 3918 - DNA, 186 bp, Xenorhabdus bovienii
  Coding sequence Name=Xb4151_4152.C441.gene19.dna; Position on contig =15238..15423bp; Strand=+
atgctaaagcttgttaacagccttctgctttcgttcttctttacggcgattgtcatagtaggcatcgttacaacaccggaatatgtcaaagattcaatcaaagaagccattgaagaacacgctgcaagccgcaatcacccatacgcaactcaggtagaaccgggatttgtgacactaaataattag

SEQ ID NO: 3919 - DNA, 456 bp, Xenorhabdus bovienii
  Coding sequence Name=Xb4151_4152.C441.gene20.dna; Position on contig =15520..15975bp; Strand=+
ttggagaaaaatcaaaatggtgaagacattcccgataaaactgagtttgtaaaaaatatcggtttatcgggaacggtggaattagcaagaaattcagtgcagggaaaacaatatatttatgatttaacgtatgccacggcagcttggataaaaattgctgaagtgacaatgggagtacccagcactatcaatattaatctcatcggcggctctgggtacaatgtagggttctttggacaatgtgctatcaccaatatagttttaaggacaggaaataacaatcctcacggagtcaatgcagtgatgtatacaactaatagtggtgcacctactgacttagagtctatcccaataggattatattccagacaattaaactacaagccaaatgaagcatggcttcataattttcaacccgtttttcccaacggaccagaatccgacgaaaacgattaa

SEQ ID NO: 3920 - DNA, 402 bp, Xenorhabdus bovienii
  Coding sequence Name=Xb4151_4152.C441.gene21.dna; Position on contig =15863..16264bp; Strand=-
ttgctcacggatggacagggcttgccattagcgattgccgttgcgcccgctaatattcatgatatcagacttgttatagccaccctggacggtttacagacaggatgccggggttatggaaccaaactccatcgggataaagcttatgaggcggaatggctggaaaaagaattaaaaacccgtggatacgtcccctgcatacaatcaagaaaagaagaacaagatgcgctggccgaacaagaggattttaaagtgaaccgttgggttgttgaaaggacacacagttggcttaatcgttttcgtcggattctggtccgttgggaaaaacgggttgaaaattatgaagccatgcttcatttggcttgtagtttaattgtctggaatataatcctattgggatag

SEQ ID NO: 3921 - DNA, 408 bp, Xenorhabdus bovienii
  Coding sequence Name=Xb4151_4152.C441.gene22.dna; Position on contig =16273..16680bp; Strand=-
atgaataagaaatcaatagcccaatggttcatttctgatgaactctggcagaaaattgaacccttactccctccacataaaacccatcaccctttgggctgccatcgccgccgtgtcgataatcgggccgctatgaatgctatcttttttgtgttacgaaccggatgccagtggaatgccctcaatgccacagggatttgttcttcaagcagtgctcaccgccgttttcaggaatgggtggcgggaggcgtctttgagcgactctggcaaaatggcttactcgccagtgaaaaaataggggctatcgactggggcaaattggcactggatggctgtttgactaaagcgcccctggccggctcaaaaaaacaggccgcaacccaacaaaccggggaaaacaaggcgtaa

SEQ ID NO: 3922 - DNA, 342 bp, Xenorhabdus bovienii
  Coding sequence Name=Xb4151_4152.C441.gene23.dna; Position on contig =16715..17056bp; Strand=-
atgcaaggcttaaaggttaacgcagaatatgtattgcgctattttgagttatatgttttccccaaaattggcaaattacctcatgatgaagtaccgcttcatgtttggctttctttaattgcagatatttcaaagcaagtgccatcaattggtatccgcatattaacatactctaagactgcacataggtgggctgttagacgaggaatgaccaattttacaccgctatcagatgtagaaagaagtgatttaggcggaaaaggtgcggatgatgatattgatcctgaaataggggcgcgggcattaagagtgtatcccaataggagatatttgatattatag

SEQ ID NO: 3923 - DNA, 1050 bp, Xenorhabdus bovienii; identical to SEQ ID NO: 483
  Coding sequence Name=Xb4151_4152.C441.gene24.dna; Position on contig =17307..18356bp; Strand=+

SEQ ID NO: 3924 - DNA, 372 bp, Xenorhabdus bovienii
  Coding sequence Name=Xb4151_4152.C441.gene25.dna; Position on contig =18367..18738bp; Strand=-
atggataaaaaaattatagaaatattgcaatatgagttaaaagcagcaacaggaaaggagtttcatcgaataatgacagaaattagtgtgccattgcatgagaaaactggcatagatgttattagttatggtaattcattgcacaactctgattcatattatctgattcgtgcttttagtgattttgatgaaatgaataatattttgactgctttttatagcagcgatagttggatcaatggccccaaaatagagattatcgagaaaattaataaaagcatgaagtcgataatagcgcttcctaatgtatcgattgatgcattacgtcggagtggatacatagttggtgggaaaaattatatttcagtttag

SEQ ID NO: 3925 - DNA, 114 bp, Xenorhabdus bovienii
  Coding sequence Name=Xb4151_4152.C441.gene26.dna; Position on contig =18768..18881bp; Strand=+
atgacaaatcttgtccatttcccgaaagaaaaaaagcaaattatcttttttattcgtgcattgtcacaaaattatagaaaaccccatcaatatccgatagggttttttatttaa

SEQ ID NO: 3926 - DNA, 414 bp, Xenorhabdus bovienii
  Coding sequence Name=Xb4151_4152.C441.gene27.dna; Position on contig =18885..19298bp; Strand=-
atgaataaaatttgtacgttattattatctgctgtgatgttgtgcagtggttgtgccaccatcattggtgaaaaaaatcaacttattgaagtcaatagccagccttcaggcgccgaattttcaatcaaagatgaaactggcaaagtggttgcacatggaaatacaccccaaaatgtcatgcttgaaaaatcaaatggccattattttggtaaaaagaactatcagataacttttgtgaaagaacattttaaatctttcactttgccgctggtagcaaagcctaacggatggtatatcgggggtaattttgtatttggtggcttgattggctggttgattgtagatcccctcaatggaggtatgtatacgctacacccaaaaatagccaatgccgtattgtctgaagctaaataa

SEQ ID NO: 3927 - DNA, 213 bp, Xenorhabdus bovienii
  Coding sequence Name=Xb4151_4152.C441.gene28.dna; Position on contig =19528..19740bp; Strand=-
atgccagtacggataaagcaattacagataatttacgcattccttacctcaaattattttttaaaattggcaatagagaaaactatatttttacgcttatatcgtcaattattcaggtcacaaaattcattatattacataaagtattcttggtattttcatgattgcatgcaagataggatcgttttatttattaattacatcaataaataa

SEQ ID NO: 3928 - DNA, 675 bp, Xenorhabdus bovienii
  Coding sequence Name=Xb4151_4152.C441.gene29.dna; Position on contig =19701..20375bp; Strand=+
atgcgtaaattatctgtaattgctttatccgtactggcattaactggttgtaaagtcggtttagatacagaagtaaacctcagcgatattcttgctcaagaacacaaaatcgtgcaaggtaacctgaatgttgaagtcacttcttgctcaacttccggcgattcccgtcaagagtctaagagtttgatcgaggcgaaaaaaaagatcccgactatttttaaaaatgccgaatttgtggaatgttatcgaaaagattttgattccttcgctcatttcaccattccgattgatgtcggcagtgcacaagatcctattaatcaacaaaataccgatgtctatatttattcaaataaaaagcagaaaattattgctgaattgaaattaacagatgctctaattggccgtattaacaaagcgaaaaaagatttaagctcaatgaaatttaatttctctgtgaaaatacatagaaccaaagaaccgattaatgtaaaagcccttggtgtatttatgacaagtgataaaggtcaaaccacccccatggtttatgaagactttgaatggtctaagtccaaatatgctacctttaaattatctgatgttgccgtcaattcgttgttagctaagggtaaacatccgttattattagagattgattattttgagaaaaataaataa

SEQ ID NO: 3929 - DNA, 222 bp, Xenorhabdus bovienii
  Coding sequence Name=Xb4151_4152.C441.gene30.dna; Position on contig =20582..20803bp; Strand=+
atgaaaagccgcataataaagcaatactacaccatctatgctttaatagcgggtgtctttgataggatgtttaccgtatcagaaatcagtcatggcggagggtttgatattggctgctcacatgcactcacaagtgagattacgcaattatcggaaatagcaaggcagaaaatcctgcctgctcttccccttaatgtttttccaaaatgcctttggatgtga

SEQ ID NO: 3930 - DNA, 984 bp, Xenorhabdus bovienii
  Coding sequence Name=Xb4151_4152.C441.gene31.dna; Position on contig =20772..21755bp; Strand=-
atgatctcgataaaagcaatccagtctaacgtgtgcagaattaaaaataaggtcattactatgcgaaatacaccacagtcagctgttgttttaacgttatttgcaacatttttttggagctcaaattttcaagtgacaaaatttgcgctagagagcttgcctccgtggacagcctcagttgaacgctttgtttttgctgtcttaccgatttttatttttatggcattaaaaagtggcattcatggcaaagtgctgaggaaaaacctgctggcatttatttgtcttggggcaattggtgtggctggattcaacggagcgttatttgttggccttcaaagctccagtcctatcacggctgcactcatcatggcaacgacacccatttctgccaatatcttggaagccatcatgaatcgtcgttttcctgaacttatccgtgtgttaggaatgggtattagcttactgggtgttgttttggtgatcactaatggtcaattggtgggcggtatggttcatatggcatcgggagatgcaatcattttcgcgggtagtctcggctgggccatttatacggtgggaacccgtaaattcattaccaatgctacgccacttgagataaccagttggacgatgctttttggagtggtgatattagcgatgatcgctttttttgttgaatcaccaatttcttcaatgcgatcaggaacgtttgagagtcatttagcgagcgcttatatggggattgcgggttcatttttagcttatcttttttggaacataggggttgcgcttagaggagcagggaagacagcgatattctttaactttgtgcctatttttgccctgataatacagctaatgatgggaaattcgccaagtttgccacaacttgttggcattatgctgactattgtgggagtgctcttagggcaaggtattatcacggcgtggttcacatccaaaggcattttggaaaaacattaa

SEQ ID NO: 3931 - DNA, 969 bp, Xenorhabdus bovienii
  Coding sequence Name=Xb4151_4152.C441.gene32.dna; Position on contig =21780..22748bp; Strand=+
atgcagacaaaaatagaaatcgattttccaaaaatgaaaaataaaacagcgcaatcattggtttgggatgatatccgtgtatttctggcgatagcacggacaggcacattaagtcgggcggcagatgttctaaaaatcggtattgcaacggtctcacgaaaaattgagcgacttgaaacgaccttcgggatgcctctatttctccgccatcaggctggctatcggctcaccgaagacggaaaagaactgctggaaaaagccaaagcgatggaaatagccgccagctcttttctgcttgaagccgatactcggattgcaatttcagggaaagtccgactcgccaccacagaaacattcgcgagtgacttagtaataccgagtttaccaaccttacagaaaaactatcccgacctcacattggaaatcacaacggatattcataccgtagatctacatcgtcgggatgcggatctggcacttcgtatcgtcaggcctgaacgagggcatgttaccgtccgtcaattgggaaaattaggatttgggctttatggcaacaaagattatttggcaacttgttcacctgacatactgaggggtaaatatgaaaaggcacgttttattggttgggcagagacctactcgtaccttccttcattccgatggactgagaaaaacctcaaaagccgaccgttatctgtggctacaacttcactgaacgcacaattggctgccgtaaaagcggggctggggttggcggtactaccgcatttcattgttcaatatactgaacttaaatgcatttctcatgatttgggaatagatcaatccatctggcttgtgattcaggccgatttggcacactctcccagaatacgtaaagtcgctgattttttagcggaaattgtttttcaaaaccaggggaagctttcaggacaaactggaattaattctgtgatattacctgattaa

SEQ ID NO: 3932 - DNA, 120 bp, Xenorhabdus bovienii
  Coding sequence Name=Xb4151_4152.C441.gene33.dna; Position on contig =22723..22842bp; Strand=-
atgacactgaatgatttatggtgtttaagtaggcagaggaaaagcgttcctttggtcgcttttccttcttccttatatttctggctgattacacttaatcaggtaatatcacagaattaa

SEQ ID NO: 3933 - DNA, 495 bp, Xenorhabdus bovienii
  Coding sequence Name=Xb4151_4152.C441.gene34.dna; Position on contig =22848..23342bp; Strand=-
atggaaattataattagggccgctgagtcagaagatgccgagcactttcaacgaatttttagccaccccgatgtgtatccgaatacattacaacttccatgcccttcgcgtgaaatgtggcgggaacgtattaaggaaaataaaactaggggaactatccattttgttgctgagatagacggtaaggttgtgggtaaggtgagtttatttactctggataatccaagacgcaggcatgtagtaggagttgggattagtgttgatgctgattattctggcaaaggtattggttcaaaaatgatggaattcgcgattgattatgcttttaattggctggctgcggttagaattgagttggaagtttttaccgataatgaaaaagcaatagccctatacaccaaatttggctttgaaaaggaaggtgttttacgtaaggcttccctgagaaatggccaatattgtgatgttatggctatgtctataataaaaaattaa

SEQ ID NO: 3934 - DNA, 408 bp, Xenorhabdus bovienii
  Coding sequence Name=Xb4151_4152.C441.gene35.dna; Position on contig =23485..23892bp; Strand=+
atgcatcaaaaaaattcagctatttttgaattactcaaaaatctcgaaatcagcctgcataaagaaaaaagaaataatatcgattggctaaacactatcttgcatgatgattttctagaaatcgcaaaatcgggttatgtttattctaaaaaagtcgtaatcgatgaattaaccacagaatttaaaatggtcttgccaatattttcgcaggattttaacatcaaatggctggataaaaatattgcactgattacctatcaatcctacgaaataaataaatcaggccatccattcaataaagcgcttcgttcatctatttggcaattatctgtatccggtacatggcaacttaggttccatcagggaacaatcatggcagcccaaccgctcagcaatatcacgctgtag

SEQ ID NO: 3935 - DNA, 1407 bp, Xenorhabdus bovienii
  Coding sequence Name=Xb4151_4152.C441.gene36.dna; Position on contig =23946..25352bp; Strand=-
atggaagaaaaaatacaatctacccacacacctgaaactgaaggctcgcatctacagagaagtctcactaatcgacatatacagcttatagcaattggtggtgctatagggactggtctgtttatgggatcaggcaagaccatctctcttgcggggccatcgatcatctttgtatatatgatcatcggatttatgttgttttttgttatgcgcgcaatgggcgagctattactctccaatctgcactataaatcgttcagtgattttgcggcagacttgctagggccgtgggccggtttttttgtgggttggacttactggttttgctgggtaattactggcgttgctgatgttgtcgcgattacctcttatgtcagttattggacgcctgactttcctgagtgggcaacttcgctattgtgcgttttgatattgctgacattgaatctcgcgacggtaaaattgttcggagagctggaattctggtttgccatgatcaaaatcgttgcgattgttgctctgattgtcataggcggtattttgattggcacccattttcaatctcctgcggggcatactgctgcattatccaacgtctggaatgatggtggtatgttcccgatggggctgagtgggttttttgccggatttcagattgcgatatttgcttttgtcggtattgaattggtgggaaccgccgccgcagaaaccaaagatccgatgaaatccctgccaaaagcaattaatgccattccgatccggattatcacattctatgtgctggctctgattgtgattatgtcagtcacgccctggcgttcggttgttacggataaaagtccgtttgtggggctgtttgtcctgattgggctaccggctgcggccagcattgtgaattttgtagtgctgacttctgcggcatcttcggcaaacagtggggttttttctactagccggatgttatttggtttggcgaaagaaggggatgcaccgaagcagtttagtcgtttatcccgccgttcggttcctgcatcgggattgatctttacctgcttatgcctctcttttggcgtcattctgatttattttattcctgatgtgatgcgggtctttacactggtgacaaccgtttctgctactctgttcatgtttatctggagcatgattttgtgttcctacctggtttatcggaaacgccgccctgcgctgcataaggcatctatttataaaatgccttttggcatcgttatgtcatggctgtgtttggctttctttgcttttgtactggtattactgtccttgcagccagatacccgacaggcattaatcgccacaccagtctggttcattattttagtgatcgggttccagattgtgaaaaaacgcagaactcgcctttatcgctga

SEQ ID NO: 3936 - DNA, 279 bp, Xenorhabdus bovienii
  Coding sequence Name=Xb4151_4152.C441.gene37.dna; Position on contig =25216..25494bp; Strand=+
ttgcctgatcccataaacagaccagtccctatagcaccaccaattgctataagctgtatatgtcgattagtgagacttctctgtagatgcgagccttcagtttcaggtgtgtgggtagattgtattttttcttccataattgtatcccatttattctcacagcatggagctagacttaatcccctcaggctgtgtttaagctatcattgtgacatagacagccaaggaattaacagagggatttcaattgaaaagagagatgctgacatttcaatctag

SEQ ID NO: 3937 - DNA, 345 bp, Xenorhabdus bovienii
  Coding sequence Name=Xb4151_4152.C441.gene38.dna; Position on contig =25564..25908bp; Strand=-
atgctgcatctgatgtatttactgaaaccgacacaaaaagcccatttggatatgaccgcattttggcattgggtggaaaaacgcgacgaatggttctaccgtacactagaaatgactggagaacgccgttggtatgtccgcactattggcgataacgtccattgtctggaacattacgttacattcgccgacgaagccgcgtggggacagtaccgcagtgcggtgtcaaaactctgcaaagatcccgaatgggaaaaaatccgcaccgagcaatctctgtggtgggaaatccttgattcaagtttgttgaacgacgcaccttttatcgtcaatctcaggaaataa

SEQ ID NO: 3938 - DNA, 1164 bp, Xenorhabdus bovienii
  Coding sequence Name=Xb4151_4152.C441.gene39.dna; Position on contig =25920..27083bp; Strand=-
atgtataaggggggatgcatgttaatcaatgttggccagtccgccttctcccctttagtttccgacattgagcatatcgaccggcatgagtgggatgcgttggtttccgataatgacttttttcacagtcacggctggttaggtggactggattacgccttgggcaagggagacgtttttacactgtacggcaatgcgggattgttaggcggttgcgcactctggggtggcgaagatcagtccgggctgttctatctgccagactacttccccggattggacggtccttggcaataccccttcttgtggggcggagcccgccgttccacgcacaatgaaatcccctgcgtgcaggggagctgccggggtgaaacattgtcgaccatggctgaaatgcttgcccagttggccgggacccggggatattacgcaacgattatgccttttatgccgctgcatcaggccctcgaggttgcccgttactatccccatgctcgggtattgatgcattcaggggaagcgaccctatcggtaccggccggggggcttgattcgcaattacaacaattatgctcccaccacagggtaagagccaacgcggaactggctgcttttgcccgcttaggaaaccgggtggaatggtgccgactggacgattatctactggaggcggcggcagaacttattgctaataaccggggaaaatacggtagccatcaaggtattgactggatgcagcgcatatttgatggacaaaaaaaatcctcagtcatcaacaccgcggtggctgctgtagccaaacgcgatgagcagatcctgggggtaaccatcttctaccgttttggtgaaacccttcatgcccgttattacggttcgaattatcagatagacgataacgacttccgttatttcgtgctgaactattactcctcattagattacgcggcgaaaaacgggatccgtgaatgccggctgtccatctccgcccttagagccaaaacgcggcgtggtgcaaaaatagagccgctcgccgcgctgttgctgttcgaaaatgccgtccctctatcaataagtgaatgtgaagactataaccgccttttttaccaacattaccaacaacaattcggcacacacctgacccacgactgggcgctgcttgattga

SEQ ID NO: 3939 - DNA, 795 bp, Xenorhabdus bovienii
  Coding sequence Name=Xb4151_4152.C441.gene40.dna; Position on contig =27059..27853bp; Strand=-
atgcgtttagctccatcttcggactctttatctgtcagggaaaaacaggctaatttacctaaatttaacccggccacgtttgataagtacgcagaactctatgaaagaatgacttcttggccttatcgccaggaattagagcttccaacgttagcaaaattacttggagatctctccagtttaaatgttctggatttcgggtgtgggcctggcgtaatttcacgttggttgaatgaacggggcacaaaacgcattgtcggctatgatatttccgaaggcatgcttagttatgcccgccgacgtgaggaaaaagaccagcgcagaattcactatatttcaaagattaatgaagattataacgtatatttcgatatagtccttgctgtttatgtgatgccttatgcggctaactacgcggacttaatggcgatgagccaaaccatggccagggtattaaaaccaggagggcggctgctcacactccctatccaccctgatttcaattcagatcccgaatattatcgcccctttggctttcgtctgattgaagagcagccgcgcacggacggtagcgcccttcggcttcatatctgccagccaccttacgatatcaatatacaggcctactattggtcgcgtccgacactggaaaatacgctacaacaggtcggttttcagacggtaaactggaaatcgttgaatgtgccggtcaataccctgatcccgaatctttcatcctacgttcaatgcccgcatgccgccattcttgaatgtataaggggggatgcatgttaa

SEQ ID NO: 3940 - DNA, 120 bp, Xenorhabdus bovienii
  Coding sequence Name=Xb4151_4152.C441.gene41.dna; Position on contig =27927..28046bp; Strand=-
atgcgtttcggatcagggacatcgttctggatttgctcaaaaacagaggcgcttatccgatgttccgctaatgcgacagaaccgacagattttactctttccagtccatatttgccttga

SEQ ID NO: 3941 - DNA, 96 bp, Xenorhabdus bovienii
  Coding sequence Name=Xb4151_4152.C441.gene42.dna; Position on contig =28060..28155bp; Strand=-
gtgattaaccttaattccccgctccgtcctcatttcctcgagattgcgcaggctcagagcgtaggacagcattgggccatgatatcgacagagtaa

SEQ ID NO: 3942 - DNA, 189 bp, Xenorhabdus bovienii
  Coding sequence Name=Xb4151_4152.C441.gene43.dna; Position on contig =28084..28272bp; Strand=+
atgctgtcctacgctctgagcctgcgcaatctcgaggaaatgaggacggagcggggaattaaggttaatcacgataccgtattaattatgttatttaatgaatataaggaatgtcatcaggtgatatcattaaatttacttttttcaaagttattttactttcacgaaaacggcgacattccatcataa

SEQ ID NO: 3943 - DNA, 123 bp, Xenorhabdus bovienii
  Coding sequence Name=Xb4151_4152.C441.gene44.dna; Position on contig =28805..28927bp; Strand=-
atgaataaattttttcatctgacgtcgttcacttcggggtatgggtgctatgattggcatcactcagtctattttgggatttttttgatttggcgattaatcagatcgcaaaaaccggactga

SEQ ID NO: 3944 - DNA, 345 bp, Xenorhabdus bovienii
  Coding sequence Name=Xb4151_4152.C441.gene45.dna; Position on contig =28868..29212bp; Strand=+
atgccaatcatagcacccataccccgaagtgaacgacgtcagatgaaaaaatttattcataaaacctgggataaagattatgcacgccgactcatggcactcttaatgttacatgaaggaaaaaccgtttctgccctctccagagcccttcattgttcacgtttttcggttaatcgttggataaattggtttacgttgtatgggctggaaggattaaaaagtttaccgtcaggaagacctgcgatctggaatttagcgccactttttttagtttgctgtcgttcttattacagcactccccgcagtattttggctgcctgcgttcacgttggagtattgagctga

SEQ ID NO: 3945 - DNA, 258 bp, Xenorhabdus bovienii
  Coding sequence Name=Xb4151_4152.C441.gene46.dna; Position on contig =29650..29907bp; Strand=+
ttgaacgttattggattattgttaggtggagctaatattattaagcttattaatctttcgataataacgttacacgtggagagtaatatgaaaaaatatattctttctggcctactggcaggcgctacgcttttagtttcaatgcagtcttatgccctggcctgtaatatattccccccagatagcccagcatggaaagcttgcacggaaatctgcaaactgctaccccttggtattccaattccaatttgtttctaa

SEQ ID NO: 3946 - DNA, 285 bp, Xenorhabdus bovienii
  Coding sequence Name=Xb4151_4152.C441.gene47.dna; Position on contig =29841..30125bp; Strand=+
atggaaagcttgcacggaaatctgcaaactgctaccccttggtattccaattccaatttgtttctaataacatcaagtaggacggttcattcttaccgtcctactcatagttcaccaacacagccccctaacatacttctgcaatcccagtatcatttgttctgggtggtacttgaggcctgtctcatccccaatatatcgccggaagtcactcatagtatgaagcagatagtggcgcatgtatttggtgatcgcagcaggaaaaaaatttactcaacgtattga

SEQ ID NO: 3947 - DNA, 687 bp, Xenorhabdus bovienii
  Coding sequence Name=Xb4151_4152.C441.gene48.dna; Position on contig =30199..30885bp; Strand=-
atgaatgactttaaccttgaagaaagcgttgcgatgattgcggcggtgcttgcagatcgcactcgtacccgtatgttgtttctgatgatggatggtcgcgcttatactgcaacggaattaagtgcggcatctgatgttgcaccttcgacagccagtgttcatttaaatcgattggcagaagggaaactggtgatctgcgttaaacagggacggcatcgttattttaaaattcacagcgaagaagtggctgcattgctggaaagcatgatgcactttgccaatcgcaatcacaggaatatcgccataatttccacaccaaaatcactgcgttttttccgaacctgctatgaccatatggcaggggaaattgcggtaaaaatccataacagtctgcttacgaaccattggatgactcgtgattatcaattgacgcagagggggaacgattttttgctttctattggcgtgtgttgtgatgctgaatcctcgtcaaggcgtaaatttgcctgttcttgccttgattggagtgaacggcattttcatattggcggatttctgggtgcctcgttgtttaagacatttttacagaaaaaatgggcgattagacaattagatagccgtgaattgatattgacggagcaaggaaaaagaatgcttatgcaaaagtttggtgtggatataaattga

SEQ ID NO: 3948 - DNA, 111 bp, Xenorhabdus bovienii
  Coding sequence Name=Xb4151_4152.C441.gene49.dna; Position on contig =30960..31070bp; Strand=+
atgttagctgttatatttgaggtcgaaatcgcagaaaaccaaagtgatcgctattttgataccgcagccacattcatatacaggatcttaagcaataacgcgttattttag

SEQ ID NO: 3949 - DNA, 666 bp, Xenorhabdus bovienii
  Coding sequence Name=Xb4151_4152.C441.gene50.dna; Position on contig =31132..31797bp; Strand=+
atgaagcctgtgacgattatcgctataaaacaccagttaatgcaattcttcagtgacatttctttgcaacatattgccttccaatgtgcgtttatgaaacgcatcagaaatatcgagccccacgtgttgatcctcagccttatcgctgcactgagcacgggtaaaatcacgtctattgcccagttacaccaaaaatttaatggcctgtgcccggataaaaagcaaccagtcagttaccgccccttttataaccagctccgtaaagcggcttttgtcgaatttgtcaaaatattggtcagatttgccatggcgcaatgggtggagaaacaggtctcctcaccccaaaaactcatgaaatttaaacaggttattctccaagatgggagttcgttcaaagtccattctgccctggccgatgtttttccctatcgcttcaggacaacgggggccgcggtggaatgtcacatgacaatgtccttgctgactcagtcaccggtaaaaatgaccgtgaccgcagataccgcccctgagcgggcttacctgcctgtaccggcgatgttacgtgaccaattattattggccgatgccggttatgtcgactttgcgtattttgagcaagtgtcactttccggtggttcgtttattgtcaggggaagcatgatctga

SEQ ID NO: 3950 - DNA, 603 bp, Xenorhabdus bovienii
  Coding sequence Name=Xb4151_4152.C441.gene51.dna; Position on contig =31819..32421bp; Strand=-
atgcagacgatggggctgaaatcgcggataagggctaaaaaatactattcatacaaaagagaaaccggctctgttgcggataatctcttgcaccgtcaatttgaagcagaacagcctaatatgaaatgggtgacagatgtcacagaatttaaccaccggggggaaaagctgtacctgtcacccatgatggatctctttaatagagaaatagttgctttccgaacttcccgtaagccggtctttgatttggttaaaaatatgttatctgatgcaatggaaaagctgaaatcacatgagaaacccctgattcattccgacccgggttggcagtaccagatgattcattatcagaaccaaataacagaaaacgggctcatacaaagcatgtctcgcaaaggtaactgtttagataatgccgctatggagagtttttttggaatattgaaatctgagtgttatcacggagtggaatttagctcaatcgatgagttggaaaagacgataaccgattatatttattactataatcatgacggaatcaaaattaaattgaatggattgagtccggttgagcacagaactcaatccattatggggatataa

SEQ ID NO: 3951 - DNA, 189 bp, Xenorhabdus bovienii
  Coding sequence Name=Xb4151_4152.C441.gene52.dna; Position on contig =32469..32657bp; Strand=+
gtgctaacgttatccgtctgtacccgtaccgacctttatgctgatgataaatatcatagatatggatttttacatcagcatatttatctttttgctgagtctttttctggtggtagtaggatgtactgcgtgatatctctgcaaccttcagtaaagttttcagcgggaaaaattgcctcaattcggtga

SEQ ID NO: 3952 - DNA, 546 bp, Xenorhabdus bovienii
  Coding sequence Name=Xb4151_4152.C441.gene53.dna; Position on contig =32646..33191bp; Strand=-
atgaagaagaaaagatattctcagacattcaagctgaaagtggttctgcactacttatcacacccagattgcggatacagtcgaaccgcatcacttttcggactgcatcgtaatttggtaaacaagtggattgatatttatcgcgttcatggtgagcatggactgaaaaaatcattgaacaggtcttattcttttgaatttaaaaagcatgtcgtactgaccatccaacacgaaggactttcattatctgaagccatgaaacgctttaaactgaaagatacagggatgatatctcgatggttggctttgtacagaaaagggggcattgagctactgaagccccgcaaaaggagcagaaaagcatgtacgcgcaacgctgccacccaatataaaccggagtccacaaaaagcgcaaaatcgccccctgaacttttggatgagttagcttatttacgggcggagaacgcctatctaaaaaagctcaccgccttaattcggaaggaaaaaaacacatatcagcaaaaacaaaaattatcaccgaattga

SEQ ID NO: 3953 - DNA, 597 bp, Xenorhabdus bovienii
  Coding sequence Name=Xb4151_4152.C441.gene54.dna; Position on contig =33268..33864bp; Strand=+
gtggtggcccgcaatggtcaggggaaattattgtccaagctgctcaataagccgctgaaatccatcactcgccgaaccaaccgttccgaagtgctggatctgatttgtcggcgtaatggctatgaatttcgcttaattcgtcgctggtttgccgaagaaaaacgcttttgtctctggttgagcaacttgtccgtgaaagaatttacggctaatgacatcatggatatttatcgttgccgctggcaagtagaactgctgttcaaagagttaaaatcacacacaaactggcatcgatttgccacgagaaaagaaacgttagtcacgggcctcatttggctgagtttgctggctctgttgctcagacgttcgctggccagcagattattccccgccgtttcattgctcaaagcagcccaaaatacggaagtctggctgtggcccataatcgaaaacctactccaacgggcgtggtcggaaacctgtttttggctggaaaaagcccaagcgtatttatgtcagaacgcgttcaaaacaccacaaagaaaatcatgtaagtacaagacattggatgcgtgttttgaaaggcttaatgcttaa

SEQ ID NO: 3954 - DNA, 765 bp, Xenorhabdus bovienii
  Coding sequence Name=Xb4151_4152.C441.gene55.dna; Position on contig =34045..34809bp; Strand=-
atgaacaagtatgaaaacttttgggatattggcccacactcacctttacctgttgaacatacctttcatgcgttcgttcgaggatatggtgggtctgttatttctgatgcattgccgggaaatcctgattttaaaaacgctgattattcatttaaagagaatggcgtatttggtgaattgaaagaagttgagactgaatttcttaatcaaaaaggagcgaaaaaaaaattcggaataatgatggagaaacttcgggaagaatgtccagattgggaatcaactcttaaggaagggaacttctacccagaatggtttaaaagtgaacttataagattattcagaccaggaataacaaggattttaaaaaaagctaacacacagattaaagaaacaaaaaaacacttccatgctcccgaagcttatggggttttattctttgttaatgatggatttactggggttccacctaacttagttcaggatatagcttgtgatgctctgttacattcttattcatcaatagattgctttgtatatatgactttaaacagatatatagagatttctaattcgaatgaaccacagttaatttggtcacctaattatagcaatagagctgaagtttcatttgttgaatttatagataacctaggcagaaaatggtttgattttctagaagaaaaaataggtaatttcacatctcggcatgaaagtgacaatagggatgtgctccacggttctaaagcaattatcttaccaaaataa

SEQ ID NO: 3955 - DNA, 159 bp, Xenorhabdus bovienii
  Coding sequence Name=Xb4151_4152.C441.gene56.dna; Position on contig =34818..34976bp; Strand=-
atgtcttggagacaaaacaagtaccggaagagagattttttaagcgctctattgacaatgaatgcaactatgctgacagagagaatccttatggttgtaatattccattgtgtgctattttaccatgtcatgtgttgtgaaaatgtaactattaggtag

SEQ ID NO: 3956 - DNA, 219 bp, Xenorhabdus bovienii
  Coding sequence Name=Xb4151_4152.C441.gene57.dna; Position on contig =35026..35244bp; Strand=+
atgatgttgatgtcggtagctgatcgtctcaaattgcgactaatacatgtaaataatctttcatcaactcatcgagcgctcgtcatcaatattctgaataactgtaaagtcagtaaatctgtaaataacagagttagggttgactattatttaatctattttataaatattgaaaatttatggggggtcggaaaagcgttacaaacgttacaaaattaa

SEQ ID NO: 3957 - DNA, 315 bp, Xenorhabdus bovienii
  Coding sequence Name=Xb4151_4152.C441.gene58.dna; Position on contig =35655..35969bp; Strand=+
atgacttcattatttgaagtcgtggtgtattggaatatgaacaaacagatttccgcgctccgaacgaggcaacaacgtaccttagaacaaatttttaaaacgccggtatcgtcgggaattaaatggtcagatattgaatcgttaatcaaggcattgggcggtgaaatcaaggaaggtcggggttcgcgttgtaaatttttgctgaatgggagtattgccaattttcatcgcccccatccgtcacccgacacagacaaaggggctgtggcgggattacgggaatggttggaaagtataggagtcacaccatcatga

SEQ ID NO: 3958 - DNA, 357 bp, Xenorhabdus bovienii
  Coding sequence Name=Xb4151_4152.C441.gene59.dna; Position on contig =35966..36322bp; Strand=+
atgagtaagcaaaatacgaatattatggagatcgccggactctcggcggtgattagttatgtccctgaactcggtatgtttcgggggaagtttttagggttatccggttattgtgattttgtggctgacagtattgctgggctgcatgctgaaggacgattgtctttgaatgaatatctagaagactgccgttccgccaatatcgagccttatcagaaacgtgaaaaaacaaaaacgtttactttacgttatcccgaatcgtttggcgaacggttaaatcaggctgcaaccgaacaccatatttcggtcaacgcgttcattttggagacattgggtgagcgcctgagaaacatctaa

SEQ ID NO: 3959 - DNA, 234 bp, Xenorhabdus bovienii
  Coding sequence Name=Xb4151_4152.C441.gene60.dna; Position on contig =36530..36763bp; Strand=-
atggtgattaaacgcgtccatccgcccccattgcgggcgcttgctcccccgcctcgcccgcacacaaaaagggcgtgtttttgtgcagttgtgcatcggcgcggagaccttgcccgcactggccttgggcggggtagttatgccgggaaaaattgtgcaattttacgcaaaattgtgatgcgattttacaggcaaaaaacaccggtatttgacggcagatgctctgtgagataa

SEQ ID NO: 3960 - DNA, 282 bp, Xenorhabdus bovienii
  Coding sequence Name=Xb4151_4152.C441.gene61.dna; Position on contig =36833..37114bp; Strand=-
atgaacggcctgactcggcgtagggtactcgccaatgccaagactgaaattgacactcttcgggctgatgttgccgctggccgtcgcaagttgcgcatcaaagccatctgtcccgtgtctgaaactacttcctcccgcagcatggtcgatgcaaccaccgtcgaactctctggagaaactggatcaactgttctcgatatccgagaagacatcatcaacgaccgggcaaaactgaaatatttgcaggattacgttaatacagagtgtaggaggaataaatga

SEQ ID NO: 3961 - DNA, 240 bp, Xenorhabdus bovienii
  Coding sequence Name=Xb4151_4152.C441.gene62.dna; Position on contig =37256..37495bp; Strand=-
atgaaaatcagcaataaaggactggaattcatccagcaatgggaaggactaaagctgaaagcctaccctgacccggcaacaggtggcatcccgtggacgattggttatggccatacgaaagatgtgaagcccggtcaagtaatcacagagcagcaggccgaagctttcttgcatgatgacctcatacccgcttacgccacactggagcgattggttaagatgctactgactcaaggctag

SEQ ID NO: 3962 - DNA, 981 bp, Xenorhabdus bovienii
  Coding sequence Name=Xb4151_4152.C441.gene63.dna; Position on contig =37510..38490bp; Strand=+
atgcctccccgagtgtttcgtgggaggtctgcgtacgaattcaagcacccagatggtcgcacaatacgtctatgtgctctgatcgtcgataaatccgttgtatggaaccattatgagcagttagtgaacgaagaaaaagccacgtttacttacggatcactggtagatgattttttacattcagcggattttattgagctggcaaaagatacgcagagtgactatcggaagtattcaaaaaaggtcgttccggttttcggcaagatgaacccaaacaacattagacccgatcatatccgaaaatacatggataagagaggattacagagcagaacacaggctaacagggaaaaatcttttatgtcgagggtgttccgctggggatacgaacgcggattggtgaagaaaaacccatgtcagggtgttaaacagtaccgagaaaactcacgggaacgctatatcacagatgcagagtatcaagcgctttatgaagtatcccctactgttattcaggttgcaatggagatcgcttacctttgttgtgcaaggcaaaaagatattttagcactgagtaaatcccaactcatggaagcaggaatttatatcaaacagcacaagacagggaaaagtcagataaagggatggtctgaacgattaaggaaagctatcaagctggctaattctttgccactgaaagaaggcctgcacagcctgtatgtcatccaccaagccaacggtaagatatattccagagatggatttaatagccgctggctcaaagccaaagaaattgccgcacagaaatatcctgaattacgtttcaactttacctttcacgatttgaaagcaaaaggcatctctgatctggaaggaacgctacaagaaaaacaagctatttcaggccacaaagatatcggtcagacagctaggtatgacagaaaaactgaaattgttcccgtggtaggtaatcagaaaaaatga

SEQ ID NO: 3963 - DNA, 99 bp, Xenorhabdus bovienii
  Coding sequence Name=Xb4151_4152.C441.gene64.dna; Position on contig =38704..38802bp; Strand=+
atgccccctaaatattttgttaccttccactgtattaatctatttccttcgtcgttatctgatatccccataatcaatgaagtgaggtcaatacactaa

SEQ ID NO: 3964 - DNA, 246 bp, Xenorhabdus bovienii
  Coding sequence Name=Xb4151_4152.C441.gene65.dna; Position on contig =39482..39727bp; Strand=-
atgcaaaacccaatatctgataatcggactttgtacgtaactgatagttactcgcaaatgacggtgagcgtaaatgatatttacgcacaaaatttgcacaactcaataagaggtgtggacaaaagagtgagtcaaaaacaaggggttaattcgttttgtccagcacataaagtaaccattgggattttcccaaccgttgaaataaagacgaatttacggaagatatgtctcgggtggtcaaagtga

SEQ ID NO: 3965 - DNA, 234 bp, Xenorhabdus bovienii
  Coding sequence Name=Xb4151_4152.C441.gene66.dna; Position on contig =39622..39855bp; Strand=+
ttgagttgtgcaaattttgtgcgtaaatatcatttacgctcaccgtcatttgcgagtaactatcagttacgtacaaagtccgattatcagatattgggttttgcataccgacattatcgtcgctcaaattataagcagatcccagaattcgaggtctgcttaaatatcaatatcttaccaccaaatcccgaattagggctttgctctgccgtcagatttgtcgttagtcattaa

SEQ ID NO: 3966 - DNA, 138 bp, Xenorhabdus bovienii
  Coding sequence Name=Xb4151_4152.C441.gene67.dna; Position on contig =39814..39951bp; Strand=-
atggtgattattttcaactgctcatgtgggattctcacaactgaaaattttttgcagttgatgcttttgtacatacgggattttccctcatgtaacttaatgactaacgacaaatctgacggcagagcaaagccctaa

SEQ ID NO: 3967 - DNA, 1050 bp, Xenorhabdus bovienii; identical to SEQ ID NO: 483
  Coding sequence Name=Xb4151_4152.C441.gene68.dna; Position on contig =40001..41050bp; Strand=+

SEQ ID NO: 3968 - DNA, 171 bp, Xenorhabdus bovienii
  Coding sequence Name=Xb4151_4152.C441.gene69.dna; Position on contig =41075..41245bp; Strand=-
ttgttcgtgaatttggtttttctgttatatgatcgtgagcacctgaggaatccctcaggtgctctgttctacttcttattgagcaaagaaaatcgtataacctgtttttatagagaagacgaaaatatgttatcaagtggaaaaatgttttttaaattatcattaaaatga

SEQ ID NO: 3969 - DNA, 270 bp, Xenorhabdus bovienii
  Coding sequence Name=Xb4151_4152.C441.gene70.dna; Position on contig =41257..41526bp; Strand=-
atgaaaaaagtggaatttgattttgaccgtatccctgacgtagaaaccttctattgcgaatttaaggagagtttcgatattggtgatcattttggtgcaaacttggacgccctgtgggatgcggtaacggggggcattgggttgccggttgagattagttttatccacttttcgtcgcaaaaacgagtgtattttgcggctttagttttactgtttgaagaagccgaagaagaattggaaggggaattgcagtttaacatcgtagggtga

SEQ ID NO: 3970 - DNA, 477 bp, Xenorhabdus bovienii
  Coding sequence Name=Xb4151_4152.C441.gene71.dna; Position on contig =41531..42007bp; Strand=-
atgaaaaagagcatactagcaggtatcttattgattttggcttttgtatctatcacttttgcccaaggctctgagtcggttggcgcagaaaaatcacagcaaaatacagaggtattggagagcgtatcttctgaaccgattggcgttctgactaaaccgaaacgtgttgcgcagtatctccgcgaacataacaatagcagacttcccgattattacctcacgaaggcacaggcacgtaatcttggttgggatgcccgtaaaggcaatttatgccaagtctcgccgaatacggcgattggcggagatcggttttccaatcgtgaaaataagctaccgaaaaaacgtgatcgccagtggtttgaagcggatgtgaattatagctgtgggcaccgaggcagtgatagattgctctattctaatgatggcctgatctatctgacagtggatcattacaacacgtttaaaaaattggagtga

SEQ ID NO: 3971 - DNA, 1446 bp, Xenorhabdus bovienii
  Coding sequence Name=Xb4151_4152.C441.gene72.dna; Position on contig =42052..43497bp; Strand=-
atgagtttaacttttgtcagtgactatttactggctgctaataacctgaatcaccaggatttattttctgtattgggacaattggcagagcgccgtctggattacgccgatctctactttcaatctagctaccacgaagcatggattttggaagaccgcattattaaggatggctcctataatatcgatcaaggtgtaggagttcgagcgatcagtggagaaaaaaccggctttgcctatgcggatcaaatcacgctgaatgccttgcaacaaagtgctcaggcagcacgcagtatcgtacgggaagcgggtaatggtaccgtgcgtacattgggggcggtgacacataaagggctgtacccagcaatagaccccttgcagagtatgagccgggaagaaaaaattgccttgctacaccgggttgatcagattgcgcgtgctgaagatccccgtgtacaggaagtgaatgccagcctgacaggggtttatgaacaaatgctggtcgcggcgactgatggtacgttggccgcagatattcgcccattagtacgtctctctgtcagcgtactggttgaagaagatggcaagcgtgaacatggttccagcggaggaggggcgcgttatggctacgaatacttcctgcaaacggctgacggagaggttctggcagaacagtttgcccgtgaagcggttcgtatggcactggtcaacctttctgctgttgcggctcctgcgggcacaatgcccgtcgtactgggcgctggctggccgggtgttttactgcatgaagcagtgggtcacggtttggaaggcgattttaaccgtcgtggtacttcggtcttctccggccagatcggggagcaagttgcctctgaactgtgtaccgtggtcgatgatggcacgatcgaagggcgtcgtggttcattatctgttgatgatgagggcgtaccggggcagtacaatgtactgattgaaaacggcattctgaaaggttacatgcaggacaagcttaatgcgcgcttgatgggtgtggctccgaccggtaacggtcgccgtgaatcctatgcacacctgccgatgccgcgaatgaccaacacttatatgttggcgggaaaatctacaccggaagaaattatcgccagtgttgatagtggtctgtatgcaccgaatttcggtggtggtcaggtggatatcacttccggaaaatttgtattctcaacatcggaagcttatttgattgaaaacggcaaaattaccaaaccggtgaaaggtgccacactgattggttcaggcattgaagctatgcaaaaaatatcgatggttggtaatgatttggctcttgataagggtgtcggagtgtgtggtaaagaaggacagagtgtaccagtgggtgtcgggcagccaacattgaaactggataatctgaccgtggggggaaccgcttga

SEQ ID NO: 3972 - DNA, 849 bp, Xenorhabdus bovienii
  Coding sequence Name=Xb4151_4152.C441.gene73.dna; Position on contig =43516..44364bp; Strand=-
atgaaaaacgtcaatgttgcacttttacaattatgcagtggtgcgaacatcaaacataatttagcgcaagttgaacagcagattaaacaactgccggatacggtaaaattggttctgaccccggaaaatgcgttactgtttgcagacgctgatacctatcgcaagtatgcagaagaacagggaagtggcccattacagcaggctgtgagtgaaatagcacagcgttatggtgtctggttgctgattggttcaatgccgatgatcagccgggaagatccgactcgcatcacgagcagcagcctgttgtttgatgatcaaggggaaatccgtgcacgctatgacaaaatccacatgtttgatgtcaatatcaacgatgaacatggtgcctacagtgaatcctctgtttatcagcccggggagcacattaccgttgtcgatacgcctgttggccgtttggggatggctatctgctatgatctgcgctttcctggactgtttcaggcactgcgtgaacagggggcggaattgatatctgttcctgctgctttcacccgtctgacaggtaaggcacactgggaacctctcctgagagcacgggcaatcgagaaccagtgcatcattctggcacccgcacaggttggggtgcatggtactcgcagaacatgggggcattcaatggcggtgagtggctggggggaagttatcaagaaaaatcctctgaccgtcagtgcattacagctcaacatccggcgggatagtttgactcacatgcgtgagcagatcaaagtcgcgaaacataatcgattccgtccacaactgacttctttgataaaaaagaatacaaattaa

SEQ ID NO: 3973 - DNA, 3837 bp, Xenorhabdus bovienii
  Coding sequence Name=Xb4151_4152.C441.gene74.dna; Position on contig =44361..48197bp; Strand=-
gtgaggcgactgccggggatattattagcgacagccgcaatagtcgttatcattgtggctttgcttgtcagcgggttacgttttttcctgccacatatcaatgattatcgtcagcaagtggcggaaaaaattgctgccgtgacggatatacctatccatataggttatatcaacggccattgggagtcatttggccccagtttggaaatccgtgatatcagcgccaaaacaaaggatgcgagttttcaggctaaaaaggtaacgctttccctgaatgtctggcgttcgcttttacaatggcgctggcatttccgtgacttgtctttttatcaactggaagtcaattatgttaagcccctgtctagcgggaaaaatgaaaatctactttctgagccagacagcctctcttcctttgttcttgaacaactgaatcattttgatttgtatgacagccgcttgaccttccagacgccatcaggtgaaaaagcacaactgatactgccacaactgacatggctgaataaagacgatcgccatcgagcacagggaagcgtcaatctttcttcgattaatggtcaggaaggcgttgttcaggtgaaatttgacctgaaagatattaatggggttctggataatggggttatttatttacaggctgatgatattgatatgcggttgtggttaagccgttggttaagagataacacagggctggaaagcagccgtttcagtctggcgagctggattaccctgaaagggggaagaattgacagcgggcgtctgcaactgaagcagggagaagccaactggtatgttggtagtgaaaaacaccagcttgcggtcaatgacctcattctgcaaatgtgccggcagggagaaggctggctgtttaatatcccaaatctggcaaatctgaaaaccaatggtcagcagtggccagtaggacgtattgcggcactgtatgtcatgcaggcggacaaataccaaggaaaagatcactggcgtctccgtgctgaaaatattcaacttgaacgtctaaatggaatattgccattattctcttctgtaaccccgaatgttgtcaaaggttggcagcatcggcagctgaaaggaatactcaaccactttgcccttgatattacgcctgaattaccggatagctcaatgggaattgccatcaaatggcaggatgttagctggttacgctggcaggatctgccttctgtcaaccatttcagtggaacgctgagtggcagtaagcagtggggaaatctgaaatttgagctgaaaaacagtaccgttgattatcgtagcttgtttcagacaccattcgacattacgagtagtaaaggtcattttacctggagaaatgaccgtcatgggttgaaagtgtgggggcgggatctggatttacaggccaaatcattatggttcaatggggcttttaactatttgttacccaagaatgagccgcctgtgctggaaatgctcgctggaattcgtgttgatgatgcgggagaggcatggcgttattttcccaggtcactgatgggagcatcattggcggactatttgacccactccctgattaaaggaaagatcgagaatgccactctgctctttcaaggcaatccccacgatttcccgtttaagcagaacaatggccaatttcaggtttgggttcctttgcgccatgcaacctttcaatatcaacctgactggcctgccttgtttgattttgatatcgatctgaatttccaaaataacggattgtggatgcaggtaccgaaagcgaagttgggaaaagtcgatgccactcaactgaccgctgtgatccccgattatggaaaaaataagctcttgattgatggcaaattatcggggagtggtaaaaatatccacgattattttaaacacagcccattggcggagtctatcggcagtacgctggatgagttgcaactcgatggcaaagttgatggtaagctccatctggatattcccttagaggatggcaaagtcaatgcgagtggagaggtcgtattgcaagataccacactgttcatcaagccattggatagcaaaatggaacatgtgagtgggaaatttcgctttgataatggcaaactgcaaagtgatacattatccgctcagtggttgggacatcctctgtccctacggtttaccacgcaggatttaccgaaacattatcaggtggatgtagatctgaatgcgcagtgggctgccgggaaattaccggaagttcccgccgaaattcgccgtcaactatcaggaacgttggattggcaggggaaagtgaacatcgctatacctgcacaaaacacatcttcacacactaaacagcaacaaaatggcgtgaaataccgtgtttcgatcaatgcagatttgtcacatatcaacagtaaattggctgcattggacaccgggttgctacgggaatggcagggtattgatgttcttgctgaggggaacacgaaccaaatgcagattaaaggttcactgggaaaacaatatgcgttcaatacccaatggcaattgggaaaaacgcatgcccgactgcaacgcggtattataaatagcgagggtaatggcatccccatactacccgagaagccgctgctggcgttaaatctgcctgagattgatggcgaaaagtggttgccgctgatagcgccattgatgtctggctcatcagaaaatgatggcctgttatggccgaaaatgttcgaaatttccatgccgtcactgaagattggcggtcagcgctggaatcaactcgtcttcaatattgttcaacaggccgatggcatgaaggtcagcgcgacgggagaaaagctcaaaggtaatctgttgatttaccgtcatgagccgtggcaagcctcaatcgattacctttattatgatccgcaatttcctgaagattcatcggctggctccaatacgttaacgtcagacacctcagaggccaaaaaatacggcttgcgccattggccgtcactgaatgttaagtgtgcagagtgctgggttgccgggctgaaactcggcaaagtatccggaacggtgatgccggaaggtgattcactggttttgacaaatggacgactggagaaccgtgcaggtaaattgacattgtctgggcgctggggggaaaacgatattggaaattatactcaggtcaaagggcaattatcgggacaaagattcgatgagatggcggcttatctggggtttattgtcccaatagtcgatgcgccgtttaaatttgatttcgatctgggttggcgggggactccgtggaatcctgagattaaaacgttaaatggtacactgacgggtgagacgaaaaaaggcgctatagccaaattgggtggtggccgggcggggcaattattaagactgatcagttttgattcattgctgcgtaaattacaattggatttcagtgacacattcagtaatgatttcaactttgattccattcgtggtgacacaacgataaaaaatggcgtcatgtataccgaaaacttccatattgatgggctggcggcggacatcgatgcagaaggtcagacagacttggttcgtcgacaaatcaatatggagttggtgattacaccggaaatctcgacaacggttggtgtggcgacggcttttgcggttaatcctgtggcaggtgctgctgtttttgcagcgacaaaagtgttgggacctctgtggagtaaaatatcggtcattcgctaccggctcacggggagcttcgaacaacctaaaattgatgaagttttacgtcagcttaaggagaataaagggtcatga

SEQ ID NO: 3974 - DNA, 1470 bp, Xenorhabdus bovienii
  Coding sequence Name=Xb4151_4152.C441.gene75.dna; Position on contig =48246..49715bp; Strand=-
atgacagcagagttattagtcaatatcacgccatccgaaacgcgggttgcttatattgatggcggtattttgcaggaaatacatgttgaacgggaagcgagaagaggcattgccggaaatatttacaaaggtcgggtgagccgggttctgcccggaatgcaggcggcttttgttgatatcgggctggagaaagccgcctttcttcatgcttcggatattgtgcctcacaccgaatgtattgcgggtgaagagaagaagaatttccaagtcagagatatagccgagttggttcatcaagggcaggatttgatcgtgcaggtggtgaaagatcccctcggcacaaaaggtgcccgattgacgacagatattaccctgccatcccgttatctggtgtttatgccgggagcctctcatgttggtgtttcacagcggatagagagtgaagaagaacgcgaccgcctgaaatccatcgtgatggattactgtaatgagcatggtgggtttattatccgtacggccgccgaaggtataggagcagaagagctcgtacaggatgccgcatttttgcagcgcctgtggggtaaagtgattgaacgtaagaaacgtaatatcaccaaaaataaagtatacggtgaactggcactggcacagcgtgttctgcgtgattttgcgggcgctccccttaatcgtattcgggttgattcccgtcagacattccttcaattacaggaattcatcgacgaatatattcctgaaatgaacgccaagttggagctttatcagggaaaccagcctatattcgatatttatgatgttgaaaatgaaattcagcgcgcgctggaacgtaaagtagaattaaagtcgggtggttatctgattattgatcaaacggaagccatgacgacaatagatattaatactggcgcttttgtcgggcatcgtaatctggaagaaacgatctttaatactaatattgaagccactcagtcgattgcccgtcagctaaggctgcgtaatttaggtgggatcattatcattgattttatcgatatgggtaatgaagaacaccgtcgccgtgtgctggcttctttagaacaggcattgagcaaagaccgggtgaaaacaaccattaatggtttttcccagcttggtctggtggaaatgacccgcaagcggacacgggaaagtatcgaacatattttatgtgataactgcccgacttgtcagggacgtggcacggtaaaatccgttgaaacggtatgttatgaaattctgcgtgagattgtgcgtgttcatcgcctcattgatgcagatcgttttctggtttatgcctctcctgctgtgagcgaagtcctgaaaggggatgaatctcacgccttggctgaggtggaaatttttgtgggcaaacaggttaaggtacagacagaacaactctacagtcaggagcaatttgacgttgtgatgatgtaa

SEQ ID NO: 3975 - DNA, 588 bp, Xenorhabdus bovienii
  Coding sequence Name=Xb4151_4152.C441.gene76.dna; Position on contig =49712..50299bp; Strand=-
atgaaaaccctttatttagcttctggctcaccaaggcgacgtgagctggtgggaatgttagattttaattttgagattctgacaccacaggtcgaagaaaaatggcaggaaggggaatcaccgcagcaatatgtcagccgactggccagagaaaaagcacaggcgggcgtggcaatagcaccgaatgactttcctgttctgggtgcggatactattgttgtattgaataaccgtattctggaaaaaccgcgtaatccacaacatgctgctgaaatattgagtgctttgtccggacagagtcatcaagttatgacggctgtagctttatcgaacagtcagcacaccctgagtgagatagtcattacagatgtgatattccgccagttatcccaacaggaaatacaggaatatattgcaactggggagccgatggataaagccggcgcttatggcattcagggtaagggcggttgttttgtcagaaaaattaatggcagttaccatgctgttgtcggcttaccactggtggaaacatgtgaattaatcacacgatttttagtattagctgatgggaagcattattcatga

SEQ ID NO: 3976 - DNA, 489 bp, Xenorhabdus bovienii
  Coding sequence Name=Xb4151_4152.C441.gene77.dna; Position on contig =50372..50860bp; Strand=-
atgaatcaatatcgtagtcgagggcgctgggtcatctggttatctttcctgattgcaatcgtattgcagattatgccgtggccggagcagttctatatgttccggcctaccttgctggtgctgtgcttaatttactggctgcttgcgatccctcatcgcgtcagtgtgggtacgggctttgtattgggcatcattactgacttattacaaggcagtgttctcggtgcacatgctttggctttcagcatcattagttttctggtggtgttcaaatttcagttaattcgtaatatggcgctctggcagcaagcactggttgtcgtggcgctttcaacgctgatgaatctctgtatttttctggctcatgctttgataccaaagacgcttttccatccagaagtgttctggaatggcctggtcaatggtattctctggccttggctattcttattaatgcggaaaatccgtcgtcaattttcagttcgttaa

SEQ ID NO: 3977 - DNA, 1035 bp, Xenorhabdus bovienii
  Coding sequence Name=Xb4151_4152.C441.gene78.dna; Position on contig =50857..51891bp; Strand=-
atgaagccgattttcagcagtggatcttctctgcaagtacgactctttttagctgttattattgccattattctggttgtggtagacagccgtttcggtttttttaataaagtccgtagctatatggatacggcagtcagtcctttttattttctggccaatgggccacgccaatttctggatggcatctctgaatctctggctacccgtaagcatcttgagatggagaataataccctacgcaatgagctgcggttacagagcagcaaacttctcttgctggggcaactgaaacatgaaaactcccgtctgcgtgaattactgggatcaccggtgcgtcgtgatgaacacatgatggtatcgcaggtgatttcgggtggcattgatccttatcgagatcagatagtcattgataagggggctaaagatggcgtgtatgaagggcaggctgtcatcagtgatcggggggttgctggtcaagtcatttcagtgagtcatttgagcagtcgggtattgttaatttgtgatccgactcatgggttgcctgttcaggtcatgcgcaatgatctccgtatgattgccgccggagccggatgtacggaagatctgcatctggagccgatggcaagtgataccgacattcgtgttggtgacgtactggtgacatcgggtctgggtgggcgttttcccgaagggtatccggtagcggtggtgtcttccgtcaaaatagacaatcagcgggctcatgtggtcattcgtgcacgcccactggctgaattacgacgcctgcgctatctgctgttgttgtggggatcagataacgatccgtcggaaccgttgccgccttccgcagtacatcgcgcagcaaatgaacgcttgatgcagatgttacctgaggtactgccgaatccacttgaagaaaaaccgcagcttccgacgcaggattcaggtgaaggaaaaaaaggcaatatagaggggaataaaacactgtctgtaacaaagccctcgtcttcagctacaggaaatcgtcaatga

SEQ ID NO: 3978 - DNA, 1044 bp, Xenorhabdus bovienii
  Coding sequence Name=Xb4151_4152.C441.gene79.dna; Position on contig =52000..53043bp; Strand=-
atgttaaagaaatttcgtggcatgttttccaacgatttgtccattgacttgggtactgccaatacccttatttatgtcaagggtcagggaattgtactcgatgaaccttctgtcgttgctatccgtcaggacagagccggttcaccaaaaagtgttgccgctgtagggtcggcagcaaaacaaatgctggggcgtactccgggtaatatcgcagctatccgtccgatgaaggatggggttattgccgatttttatgtcacggaaaaaatgttgcagcattttatcaaacaggttcacaacaacagtttcatgcgcccaagcccacgcgtactggtctgtgtacctgttggggcaactcaggttgaacgtcgtgctattcgtgaatctgcccagagcgcgggggcacgggaagtctttctgattgaagagccaatggcggcagcaattggtgccggtctgcctgtttctgaagcaactggctcaatggttgtggacattggtggtggtacgactgaagttgcagttatttccctcaatggcgttgtttattcctcttctgtccgtatcggcggggatcgctttgatgaagcgattatcaattatgttcgccgcaattatggttccctgattggggaagcaaccgcagaacgtatcaaacatggaattggttctgcttatccaacggatgaagtccatgaaatcgaagtacgtggccgtaaccttgccgaaggtgtaccgcgtggcttcaccctgaattccaatgaaatccttgaagccttacaggaacccctgaccggtatcgtcagcgcagttatggtcgcactggaacagtgtccgccagaactggcttctgatatttcggagcgaggcatggttctgacggggggtggtgcgctgctgcgtaatcttgatcgcctgctgatggaagaaacaggcattcctgtcattgtagctgaagatcctctgacctgtgttgcccggggtggcggcaaggcgttggaaatgatcgacatgcatggtggtgatctgttcagcgaagactga

SEQ ID NO: 3979 - DNA, 141 bp, Xenorhabdus bovienii
  Coding sequence Name=Xb4151_4152.C441.gene80.dna; Position on contig =53103..53243bp; Strand=+
atgaagcagcgacaaggcgcatcactaactacttttactacttcaataaaagtggctacgttattattcatatcagacacacaatattctacgttacttttctctaacggagcagaaaaaaactgcataaaaacgggttaa

SEQ ID NO: 3980 - DNA, 252 bp, Xenorhabdus bovienii
  Coding sequence Name=Xb4151_4152.C441.gene81.dna; Position on contig =53276..53527bp; Strand=+
atgatcaaatgcctcaaaaaccaacattatagtgcatatcgcgatacaactacccccgattttactgcttctatgttgacctgtaatcacttctgcaagttcaaccaaaacgtgttttttctcaacattctgacctccccggatagtgcattgtcaaaaagaacgtcaccatcaacggtaataggtaaaaataaggattattctgagcaaatcaataatgtcattttcctgattgttaccctgtgcatttga

SEQ ID NO: 3981 - DNA, 990 bp, Xenorhabdus bovienii
  Coding sequence Name=Xb4151_4152.C441.gene82.dna; Position on contig =53694..54683bp; Strand=+
atgaaagccttattacttgaacaacacgagacattatcagcctctattcaaaatattgatacctcgcaactgccctctggcgatgtcgttgtagatatccactggtcaacactcaattacaaagatgcccttgctattactgggaaaggcaaaattatccgtcaatttccgatggtgccgggagtcgatttttctggtgttgtccatcattctgaaaatccccgctttcatatcggccaacacgttttgctgacgggctggggcgtaggtgaaaatcactggggcgggctggcagaacaggccagagtttctggtgaatggctgacaccgttgccacagggattaagcgccagacaagccatgatcatcggcacagccggttttaccgccatgttatgtatcatggcgctggagcaaggaggagtgacaccggaaagtggagaaattgctgttactggtgccggtggaggggtcggcagcacagcaattaccctgctgtcacaactgggatattccgtcgtcgccatcagcagcaaaaccgaaaaccaagattatttactttcactgggtgcaaagacgatcctgcctgtcactgattttaatcagccatcgcgttcgctggagaaacagcgctgggccggcgtcattgataccatcggtggcacagtactggcaaccctgctggcacaggtgcattacaacggcaccgtcgctgcttgtggcatggcgagtgacagccaactgtccacgacagtgatgccgtttattctgcgcaatgttcgcttacagggtatttcatcagtcaccgtgcctgccgtaaaacgctctgatatttggcaaaggttacagaaattattacctgacgccttttatcaacaggccaccactgaaatttcattagatcaagtggtcgaatacgccaataaactgataaacaaccaaatgactggcagaacgttggtaaaggtagctgataagaccagtatttag

SEQ ID NO: 3982 - DNA, 462 bp, Xenorhabdus bovienii
  Coding sequence Name=Xb4151_4152.C441.gene83.dna; Position on contig =54823..55284bp; Strand=+
atggcagacaagtttcgcattttactcttgaatggccccaacctgaacctgttgggaacgcgagagccagagacctacggcaagttaacgcttgatgatatcgtcagcaaactgtcaaaagaagctcaccaatcgggagtcgaattatcccatctgcaatccaatgcagaatctgaattgattgagagaattcatacggcgcggggcgataccgattttattctgattaaccctgcggcattcacacataccagcgtggcactacgcgacgcacttctagcggttgatatcccatttattgagattcacctctccaatgtgcatgcccgcgagccattccgccatcactcatatctttctgatattgccgttggcgtgatctgcggattgagtgccgatggttatagtttcgcattacaggcagcggtcaaccgcttgtcaacattcaactcatttacctaa

SEQ ID NO: 3983 - DNA, 453 bp, Xenorhabdus bovienii
  Coding sequence Name=Xb4151_4152.C441.gene84.dna; Position on contig =55303..55755bp; Strand=+
atggatattcgtaaaataaaaaaattgatcgagctggttgaagaatccggcatttctgaactggaaatttctgaaggtgaagaatcagtacgtatcagccgtatagcagcagcccagcacatgccaatgactcagcaatatatttcagcgcctgttcaacagtcagtgcaagccgccacaccagccattcctgctgctgaaaaaccagcggaaattatcggtcataccgtctgctccccaatggtcggcacgttctaccgctcaccaagtccagatgcaaaagctttcatcgaaattggccagcgtgttaatcagggcgataccctgtgcatcgttgaagcaatgaaaatgatgaaccaaatcgaagctgacaaaaccggcgtggttagagcaattctggcacaagacggtcaacctgttgaatttgacgagccactggtcgtcatcgaataa

SEQ ID NO: 3984 - DNA, 1350 bp, Xenorhabdus bovienii
  Coding sequence Name=Xb4151_4152.C441.gene85.dna; Position on contig =55767..57116bp; Strand=+
atgcttgagaaaattgtcattgctaaccgtggtgaaattgcactgcgtatcctgagagcctgtaaagagcttgggatcaaaaccgttgcggtgcactctacggcagatcgtgatctgaaacacgtcttgctggcggatgaaaccgtctgtatcggtcctgcggcatcagcaaaaagttatctgaacattcctgccattatttctgcggcagaaattacctgtgctcaggcaatccatcccggttatggcttcctgtctgaaaacgccgattttgctgaacaagtagaacgttctggttttgttttcattggccctaaagcagaaaccatccgcttgatgggggataaagtctccgccattaacgcgatgaaaacagccggtgttccctgtgttcccggttctgacggctcattagggaatgataccgagaaaaataaagccattgcgaaacgcattggctatccggtgatcatcaaggcatcaggtggtggtggtggtcgcggtatgcgcgttgtacgcagcgacaaagatctggaacaatccatcgctatgacccgtgcagaagccaaggccgctttcaacaatgacatggtatacatggagaaattccttgagaacccacgtcacgttgaaattcaggtactggcagatggtcagggtcatgctctctatctggctgaacgtgactgctccatgcagcgccgtcaccagaaagtggtagaggaagcacctgcaccgggtatttcagcagaattgcgtcgcactatcggcgagcgctgtgccaatgcctgtatcgaaatcggttatcgcggggcaggtacgtttgaattcctgtatgaaaatggtgagttctactttatcgagatgaacacccgtattcaggttgagcaccccgtcacagaaatgattactggcgttgacctgattaaagagcagttgcgcattgcctctggcctgccactgtccatcaaacaggaagatatcgtgatcgaaggtcatgcgatcgaatgccgtatcaatgcagaagatccaaaatccttcctgccaagcccgggcaaaattacccatttccactctccgggcgggttcggcgtgcgctgggaatcccatatctatgcaggatatactgtaccgccttactatgattccatgatcggtaagctgatcacgtacggcgaaacccgtgaagtggcaattgctcgcatgaagaatgcactggccgagttgatcatcgatggcatcaagaccaatatcgatctgcaagtagcgattatgaatgacgagaatttccagaaaggcggaaccaatatccactatctggagaagaaactgggtttgcaggagaagtaa

SEQ ID NO: 3985 - DNA, 5637 bp, Xenorhabdus bovienii
  Coding sequence Name=Xb4151_4152.C441.gene86.dna; Position on contig =57252..62888bp; Strand=-
atgctaaaagaacaaaacaggcagcggacagataaacaacgtcatcggattaagctggtggcttgggtgaatattttttcccaggttgtatttctgatggcgggtacttttactcctgtgctggcggctgccaaaacgcatccggttgcacaggaagatcgttccctcagcaaaccgatgacgaaactggaaggggggggtgaaactgacctcacaaaaccgctctccagtaaagcgttggcggatcgtttgaggcaaatttccgccactgaaccttctgaaaataccactgaacgctggctggcgaatgcagcttcccatgcggcggggatgctgaaaaacaacaatattgtggacagcgctaaacgtcaattacacggtctggccgtcaatgaagccaatcaggctgtgcaaaactggctgcaacgctatggcacgatcaaattgcaggctaatgtggatgatcgtgggcgcttagaaggcagtcagtttgatatgttattaccgctctatgatcgcgaaaaacagatggcctttacccagtttggtctgcgtcgtattgacaaccgtactaccgtcaatgttggtctggggcaacgtcattttcttaataccggcatgtttggctataacgctttcgttgaccatgacattacccgtgatcatactcgtttcggcattggtaccgagtacgcccgtgattttatgaaattcggggcgaatggctatttccgggctagtagctggaaagatggccaaaaaatgaaagattacgaagaacgtccggccaatggttttgatttgcgtgcagaaggttacattcctgcctatccgcaattagggggtaagctgatctatgagcaatattttggtgatgaggttggcctgctgagtgaagaacgtcgacaaaaaaatccgtccgtttttactgtgggtgccagctataccccgatcccgctggtgacattgggcattgaccgtaaacaaagtgcgcagggccacggtgaaactctggttaattttggcctgaactatgtacttgggacgccgtggtcaaaacagattgacccggatgcggtagcctttaaacgtagtttgcaaggtgggcgttatgatttggtcgaacgtaataatcaaatcgtactggaataccggaaaaaagagctgatacgcctgaggatggaaaaacagattagcgggcacggcggacaagtcatgtcgttgaatgttaatgtcagtagtaaatatggactgaaagaaattgtctgggatatggcaaatctggtggctggcggcggcaaactggagaaaccggatacgccagtgcgggggggagagcattatcggctgactttgccaccgttccataacaagggcaacaatacctacatcctgtccgggattgcctatgacaatcagggcaatgcttctgaacgggcggaaacacagatacaggtgatctctttagctatcgatcttaaagactcggggtttgagctgcctcatcaatcaatggcagcagatggaaaaacccaaaccatactccggttgaggctgataggcaacaatggcaaacccgtcactggtgtcgcaggtaatatcacgttcatatctgatctcaatagcctgagaggcgaaggtaaaaaccctatattgggcaccgaagttaaagaagtatcggaagggagcggtatttatgaagttaccgccacggctggcaccaaacctggcgaatggaaaatcattgtcacggtggatgacaagccactgaaacatggtacggaaattcagtttgatgttgccaatgcgccgacaatcagcgatctcatcgtcgcgggggtcatagaacagagtaaaaaactcagtgcgacctaccagtttaatgccaatgggggtaatgatacagaccactccttctttgcctggggagcagaaagcactaccgcagacaaagtaacgtcactagccaaagcgacgggcattgaagaaaccgtaccccctcccaatgaaatccagaatgggattacgtcctcaggtaacgtgaaagaaaaaggtcttgtacctgaatacaccattccacagaccgcagtgggtaaagtactggaactgtcagtactggcttccaacgcaatacaaatttctcacttccccccagaaaccgtcgttctgcgcaaaggaatgcaggggaataagacgacaggcggcaatagcgaaggcggagtcactaacccagatgccgccccggttattaccaaactgacgctgagtggtgatttggaagttggaaaacgcctgacagccacttaccagtttgacggtaatagcggtaatgacactgatgactcaaaatatacgtggcatgataagaatgcactggttactgatgaccagttgaaatctgtacctgccgtcagtaaggatagtaagacgaaaacggggacattaactcgggatctgaaacaagaagatgctggtaaaatgttggcgatttctgttaaaccgattaacggtgaaggcatagcgggtcaactgcgtaccgtggataccagcatgagtgaacaggacggtaataaaacccttactcctccgggagataagccgggtagcatttttgatccggcaggcaagcctgccatcaatgagcttaagctggaaggtattctggagaagggaaaaacactaacggcaaaatacgtctttgagtcgggagcaggtgatataacggataagtcggggtatacatggtgccgcaagcagttgaatggccagcccgatggcacaacctgtcaggccggtattggccccgatagagccggtcaggtcagtgaagtggattatttactggaggctaaagatgtcaaccggatcgtggaattttcgattcgggcagaaaatgctttgggcgtgaaagcggatgatacccggacgatcaacaccagtagcgaaggcggagtcactaacccagatgccgccccggttattaccaaactgacgctgagtggtgatttggcagttggaaaacgcctgacagccacttaccagtttgacggtaatagcggtaatgacactgatgactcaaaatatacgtggcatgataagaatgcactggttactgatgaccagttggaatctgtacctgccgtcagtaaggatagtaagacgaaaacgggaacattaactcgggatctgaaacaagaagatgctggtaaaatgttggcgatttccgttagaccgattaacggtgaaggcatagcgggtcaacttcgtaccgtggataccagcatgagtgaacaggacggtaataaaacccttactcctccgggagataagccgggtagcatttttgatccggcaggcaagcctgccatcaatgagcttaagctggaaggtattctggagaagggaaaaacactaacggcaaaatacgtctttgagtcgggagcaggtgatataacggataagtcggggtatacatggtgccgcaagcagttgaatggccagcccgatggcacaacctgtcaggccggtattggccccgatagagccgctcaggtcagtgaagtggattatttactggaggctaaagatgtcaaccggatcgtggaattttcgattcgggcagaaaatgctttgggcgtgaaagcggatgacacccggacgatcaacaccggtagcgaaggcggagtcactaacccagatgccgccccggttattaccaaacttacgttgagcggtgatttggcagttggaaaacgcctgacagccacttaccagtttgacggtaatagcggtaatgacactgatgactcaaaatatacgtggcatgataagaatgcactggttactgatgaccagttggaatctgtacctgccgtcagtaaggatagtaagacgaaaacgggaacattaactcgggatctgaaacaagaagatgctggtaaaatgttggcgatttctgttaaaccgattaacggtgaaggcatagcgggtcaacttcgtaccgtggataccagcatgagtgaacaggacggtaataaaacccttactcctccgggagataagccgggtagcatttttgatccggcaggcaagcctgccatcaatgagcttaagctggaaggtattctggagaagggaaaaacactaacggcaaaatacgtctttgagtcgggagcaggtgatataacggataagtcggggtatacatggtgccgcaagcagttgaatggccagcccgatggcacaacctgtcaggccggtattggccccgatagagtcggtcaggtcagtgaagtggattatttactggaggctaaagatgtcaaccggatcgtggagtttgtgattcgggcagaaaatgctttgggcgtgaaagcggatgatacccggacgatcaacaccagtatgaagtgggaggaaggaaaccataccggtggcggaaatgatcaaggcagtgttattgatccggacaaagatcctgttattactcatctggcattaattgatccattggtgataggtaaaaaaataacggcgacctattcctttgacgataacaatggttatccggatgatgaatccctttatgcgtggggagtgtatgaacccggagaggatgatccgacaatacaggctatagaaaattccaatgatgccatagacaaaagcggttatatcccggaatctttcggactgaccgatcaacatgcaggtaaaatcattgcattgactgtcaggccaaagaatagcaaagggaatataggaagtattgtccgggcgcagggtacggtactggggatcgcggagaattttgatgtgacatggaatgtgggcactgaggaggatttaagcaatggaaagaaagcgcctaaagtgaagagagaagaacccatcacacttaccgtaaaaaccctgaaaagtggcaatgccataaggggagtgccgattaaggttgaactggggaaagccactggccgagccaagacggagcgggtcgatcctactgtgcagttggaaattaccggcaaaacttacaagagtggtgacacttatatgggttttaccgacaaaaatggtgaattaataatgacggccactgataggaatagtatcggtttaaaaacttccgtgtcgataacggtgaatgaaggtacgggtgctaaaactgagactaaaacacaggatgttatttttactgtgattaccagtcctgatacagatttggccaattattgggggcatatggttgaggagctcccgatcaatgcgggcaaattttcacggccattattgagcaaagaagtacaaaaatactatccaaatctctcaactgggattgttcaggaaaataatgaagattggtcagcatacaattatgaaaattttaaaaatttatgtcaggcgaaaggaaagagagcaccacaaataggtgaattgcaagaattgggaggtttggtacaggataaatatcaatttactcccacatacggttggcccactgtgtcgagccgttcttggtatcgttcagacaccgatgcccccaaccaaggaccacatttgaagtcaagctacgccttggataattttaaaataggtaagaatggaccaagtgatataaatatggtttcttgtatttaa

SEQ ID NO: 3986 - DNA, 243 bp, Xenorhabdus bovienii
  Coding sequence Name=Xb4151_4152.C441.gene87.dna; Position on contig =63631..63873bp; Strand=+
atggacagacgatttgttcaatcccacaaagaagcgcgctgggcagtatccctggcgttggcttatcttgttggttggttactgtgtgcctatttacccagtgatgccatcggcttaactggattaccccgctggtttgaactggcttgcctgctgctcccagccttatttatcatcctctgctggttgatggtgaagtttatattcaaagaagttccattggaggatgataatgcaaactga

SEQ ID NO: 3987 - DNA, 1446 bp, Xenorhabdus bovienii
  Coding sequence Name=Xb4151_4152.C441.gene88.dna; Position on contig =63863..65308bp; Strand=+
atgcaaactgaagtgatcttacctctggtagggtatttggcgttggttttcctgctgtcaatctatgcttaccgtcgccgtcaaacaggcgaatttttgaatgagtattttctcggcaatcgctcaatgggcggttttgtactcgccatgaccatcacggcaacctacatcagcgccagttccttcattggcggccccggtgcagcttataagtacggtatcggctgggttctgctgtccctgatccaattgcccgcgatatggctctccctcggcgtgctggggaaaaaatttgccatcctcgcccgtcgctacaacgccgtcaccttgaacgacatgctgtatgcccgctatcagagccgttttctggtctggtttgccagcctgagcctgctggtcgcctttgtcggggcgatgaccgtacaatttgttggcggtgctcgtttgctggaaacagccgcaggtatcccctacgataccggattgctgatttttggcatttcaatcgcgctttacacggcatttggcgggttcagagccagtgtcctcaacgatgccttacaggggctggtcatgctgctgggaacggtattattgctggcaggtatcatctacaaagccgggggcttgtcagaagctattgccacactgcgcgccattgatcccaatctggtttcaccccacggtgctgataacatccttacagggccatttatgacgtctttctgggtacttgtctgctttggtgttatagggctgccacataccgctgttcgctgtatttcctatcgggacagcaaagctgtccatcgcggtattatcatcggtactatcgtgatggcaatcctgatgttcggtatgcaccttgcgggggctttgggaagagcgattattcctgatctgaccatcccggaccaagtgatcccaactttgatgatcaccgtactgccgcctgtcgctgcgggtatttttctggcggcaccgatggccgcgattatgtcaacaattaatgcccaattgctgcaatcttcggctactatcgtcaaagatctctatttaaatctgttcccccagcaaatcagacaagagaaaaaactttctcgcatttccagctactccactctatttttggggatgctgctgctgctggccgcatggcgcccacctgaaatgcttatttggctgaatttactggcgtttggcgggttgcaagcggtattcctttggccactggtgctggggctatactgggaaaaagctaatgcatatggtgccattggctcaatgctcatcggtgcgactagctatacattgctggccagtttcaatatccagatttttggcttccatccgatagtaccatcgttgttattcagtttactggccttcgggatagggaatatgattggcagccgtaaataccaacagatcgccgcatctcaatag

SEQ ID NO: 3988 - DNA, 906 bp, Xenorhabdus bovienii
  Coding sequence Name=Xb4151_4152.C441.gene89.dna; Position on contig =65338..66243bp; Strand=+
atgattcacagaaagagaatttttatgccttggatacaattaagattaaacaccacgggacaacaggccgaagccctcggtgacgagttgatggaaagcggcgcggtgtcagtaacctttcaggacagccacgatacaccgatttttgagcctctgccgggagaaacccgcttatggggcgataccgatgttatcgggttgtatgatgcagaaatggatatgaaagccgtagtcggccaactggagcaggttccacagcttggcaaagggttccttcataaaatcgagcagttggaagataaagattgggaacgtgaatggatggataacttccatcccatgtgtttcggcaaccgcttgtggatttgcccaagctggcgagaagtgccagaaccggatgccgtcaatgtgatgcttgatccaggtctggcatttggcaccggtactcacccaacgacttccctgtgcctgcaatggctggacggccttgacctgacaggaaaaacggttatcgacttcggctgcggctctggcattttggctatcgccgccctgaaactcggggcaaaacaggccatcggcattgatatcgatccacaggcgattcaggcaagccgggataatgcggaacgcaacggtgtatctgcacaactaacactctatttgtcgaaaaatcagccagcagacctcaagtgtgatatcgtcattgccaatattttggctggcccattgcgtgaactcgcgccgatcattggctcactgcctaaatctggtggattcttgggtttgtctggcgtattggcaagtcaggcagaaggcgttgtccaagcctataacaatgaatttattatcgatccgattgcagaacaggaagagtggtgccgcattactgggattaaaaaataa

SEQ ID NO: 3989 - DNA, 984 bp, Xenorhabdus bovienii
  Coding sequence Name=Xb4151_4152.C441.gene90.dna; Position on contig =66532..67515bp; Strand=+
atgcgtatcggacaataccagttgaaaaactgtcttattgcagctcctatggctggcataacagatcgcccgtttcgatcgctatgctatgacatgggtgcaggaatgacagtatcagaaatgctttcttccaacccacaggtttggaagacagataaatctcggctgcgtatggttcatcgcgacgaatctggagtgcgttctgtacaaattgccggcagtgatcctgatgagatggcggcggcagcgagaatcaacgttgccaatggcgctcagatcattgatatcaatatggggtgcccagctaaaaaagtgaatcgtaagctggcaggctctgcattactgcgttacccggaattggttcaagcaatcctttctgcggtagtcaatgcagttgatgtacctgtcacactgaaaattcgcactggatggtcaccggaagagcgtaactgtgtagaaattgcccaattggctgagcgttgcggtattcaggctcttacaatacatggcaggacgcgatcctgtctgtttaatggtgaggccgagtacgacaacattcggacagttaagcagactgttgccattccaattattgctaatggcgacattactgacccgcttaaagccagagcagtgcttgaatacaccggggctgatgccctgatgataggccgcgctgctcagggaagaccctggatctttcgggaaatccagcattatctggaaacaggagaattgctgccaccgatgcctcttggcgacgtgcagcatttaatgagcgagcatgtacgagaactgcatgacttttacggtcaaggcaaaggagttcgtattgcacgtaagcatgtatcttggtacctcaaggaacatgctcctgatgaccagtttcggcgcacattcaacgccattgaggatgccagcgaacagctggaggcgttggaggcatacttcgaaaatttttgcgtaaataaagaaaagagctga

SEQ ID NO: 3990 - DNA, 297 bp, Xenorhabdus bovienii
  Coding sequence Name=Xb4151_4152.C441.gene91.dna; Position on contig =67523..67819bp; Strand=+
atgttcgaacaacgcgtaaattctgatgtactaaccgttgctactgtaaattcacaagatcaggtaactcaaaaacctctacgtgactcagttaaacaagcactgaagaactattttgctcaactgaacggtcaagatgttaatgacctgtatgagctggtactggctgaagtagaacagccactgttggacatggtgatgcaatacacccgtggcaaccagacccgtgcagccctgatgatgggaatcaaccgtggtactctgcgtaagaaactgaaaaaatacggcatgaactga

SEQ ID NO: 3991 - DNA, 171 bp, Xenorhabdus bovienii
  Coding sequence Name=Xb4151_4152.C441.gene92.dna; Position on contig =68214..68384bp; Strand=-
gtgaagcaggactcactggcaaatgctctcagcagaccgtggccgaaaggcgaatggataattgctaactatctcgaaatacatccctctgaaatctggcctagccgttattttgattcttataccggagaattattagaaaggaaagttcgcgataaatcatcaaaataa

SEQ ID NO: 3992 - DNA, 171 bp, Xenorhabdus bovienii
  Coding sequence Name=Xb4151_4152.C441.gene93.dna; Position on contig =68317..68487bp; Strand=-
atggaaggggtagcaggaatgaataacgttagaaatgactggcatcaagccgatattattgctgcattacgtaagcgtggtacaaccttagcagctgtttctcgtgaagcaggactcactggcaaatgctctcagcagaccgtggccgaaaggcgaatggataattgctaa

SEQ ID NO: 3993 - DNA, 378 bp, Xenorhabdus bovienii
  Coding sequence Name=Xb4151_4152.C441.gene94.dna; Position on contig =68511..68888bp; Strand=-
atggaataccagcagttaggcatgagtaaccaagatgccgaatggctggtctcccgccgttttaccattgatgatatcgcccgcatgttcaatgtcagcccgatctttttgcaagaatattcaaacagcacttacagtaattttagcgaagcgtctcgcgcttttctgactatcaccatgcgcccgtggcttgccaactttgaacaacaaatcaaggccgccttgctgatgactttgccgaagcgggggattcgttatcaggtggaatttgatactgccgacttactgcgtgccaatccgaaagaacgttttcaaagttatgagacggcgattaaatccgacgtcatgacgacacccggtagtgctaatcctgtctga

SEQ ID NO: 3994 - DNA, 390 bp, Xenorhabdus bovienii
  Coding sequence Name=Xb4151_4152.C441.gene95.dna; Position on contig =69254..69643bp; Strand=-
atgaaaaaaatattaattgtttttatttttttactttatggttgtggtaatccaacgccaaaagttttaccaaaatcagagtttcttcctgatgcagtgataaatgaaccatatcaggcatcaattaccatcacaggaggtgcattgaatgaaaaaagcgtttgggtaaaaattcatcctactggctcaggactaacatggaatccaaaagatagttctttcctatggggtggaaaaaaagaaataagaaaagattaccatcatataaatataacaggtaccccaaagaagatagaattgataaaaattgaaatagtagggtttactttaggtacaatgtacgcagggaaagagttcaataaaaattatactataaaagtaagggaataa

SEQ ID NO: 3995 - DNA, 234 bp, Xenorhabdus bovienii
  Coding sequence Name=Xb4151_4152.C441.gene96.dna; Position on contig =69645..69878bp; Strand=-
atgaccgattttggtgacatagaaacatcaggaaaaaatcattggatagtttgggaaggagtagtagaaaactatgagaaagaaaatatcacaaataattcagatctgaatcaatatgtaaatttaaatctgttttcatggggtaaagtggaacatcaaattaaaataaacaaatcattagattatgtactcaaccatatttttggagggttggtttttaacccaatgaaataa

SEQ ID NO: 3996 - DNA, 279 bp, Xenorhabdus bovienii; identical to SEQ ID NO: 890
  Coding sequence Name=Xb4151_4152.C441.gene97.dna; Position on contig =70184..70462bp; Strand=+

SEQ ID NO: 3997 - DNA, 246 bp, Xenorhabdus bovienii
  Coding sequence Name=Xb4151_4152.C441.gene98.dna; Position on contig =70413..70658bp; Strand=-
ttggggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 3998 - DNA, 291 bp, Xenorhabdus bovienii
  Coding sequence Name=Xb4151_4152.C441.gene99.dna; Position on contig =70642..70932bp; Strand=-
atgaccagaatatctgggttagattggctgacattggcaagcctaagagattcagaaaatatgattatgagttatgatgaggttgatgatgaattagctggtattacaatgtggggaaaattgacagaatggtttgaaaaatcagggtatgaaaaagtatttagtaatgtcggcttatcccattctaatatagatgacatagtaactcttagtgattactataacaaaggatatcatgttgttactttgatttcagcaggaatgttatcagattttggggtcatgtattaa

SEQ ID NO: 3999 - DNA, 186 bp, Xenorhabdus bovienii
  Coding sequence Name=Xb4151_4152.C441.gene100.dna; Position on contig= 70945..71130bp; Strand=-
atggccgttgtaacgatagttgagttgaaaggttctttggcaacctttgcaatagtagcgagggaagccagccttacctgttccgtgtttgcgtacaggttctgcttggtcgcaatatcgacaagtcacttctatcgtaacagtcatgatgatatcccattaaaaagtacaagaatatcaaattaa

SEQ ID NO: 4000 - DNA, 282 bp, Xenorhabdus bovienii
  Coding sequence Name=Xb4151_4152.C441.gene101.dna; Position on contig= 71118..71399bp; Strand=-
atgggcgatgatttttttccttttagtatcaaaattataccaaagccaatgacgttgttttttattgcctatcaaagaccactgctcatccaattcacagataagtgtgatatcgtcataagcgatctgtcacgatgttacttgttttggcgagagttttttaatgtccgcatcaccgtattgataccgagacctaatatacggcctgtgtctctcacgccagagccattcattgccatatccacaattttttctttcatacccggtttatggccgttgtaa

SEQ ID NO: 4001 - DNA, 372 bp, Xenorhabdus bovienii
  Coding sequence Name=Xb4151_4152.C441.gene102.dna; Position on contig= 71398..71769bp; Strand=+
atgtctttgacccccgaacagatgcaacctgccgaaaattgctcaacttattggcgccttttaatattcgtttcatcacgaccgataactggggaagttatgccggaaaaatatctggtaggcaaaatttttacccaacgtatagagcggcataatctcaacctgcgaattcatatcaagaggttggcgagaagaagaaccatttgttactcacgttcgatggaaatccacgaaaaactcattggcgcatatattgaaaaacatcattacaaccctttggagtcattaccgaatattggaggggagttaaacagaatattaggggattttgagaccctatttacgattttgtggaatctccatctcatttaa

SEQ ID NO: 4002 - DNA, 174 bp, Xenorhabdus bovienii
  Coding sequence Name=Xb4151_4152.C441.gene103.dna; Position on contig= 71819..71992bp; Strand=-
ttgctagctttaccaaaagaaactgatgtcattgaatccctgaacagtatccgtcatgccatcaagaaacgtcaaagcttcccatcagatgattcagtgaaaaaaggtagtttggctgaccattcagggcgcatccaaaaaagtagacaatactgctcagtggctggcgtataa

SEQ ID NO: 4003 - DNA, 165 bp, Xenorhabdus bovienii
  Coding sequence Name=Xb4151_4152.C441.gene104.dna; Position on contig= 71961..72125bp; Strand=+
atgacatcagtttcttttggtaaagctagcaaattctttgatctctggaaggattgtcgatatacaaagctcttaatacgggttcacaatgatgagtttggaatttttttccagccgcttatcgtctttatgaggaaaattcaggaaagtaaaatcattggatag

SEQ ID NO: 4004 - DNA, 1302 bp, Xenorhabdus bovienii
  Coding sequence Name=Xb4151_4152.C441.gene105.dna; Position on contig= 72412..73713bp; Strand=+
atgagcaaggttactgtttttccgagttttggcctgactggtgaagtttttataccatcatctaaacctcatattcagcgtgcattattactagctttactgaatgaaaatacaacgaaaattgttaatatatcttggaatgtagaaactgaaaatcaaattaatgctctgaaaaaatttggtctagaaatattgcataaagatggaacaacactgttacttcgtggtgtaggtagaaatttatcgtataatggggagatatatgcaggtggttcaggtatgttattcagaatgtgcgcagctttagcatctctcattgataatgaaaaaatagtaataaaatgcaatgaatctttatttaatagagagagtgtgtttgacgaagatttctgtaattatttagatattcatattgaacgtattgaaaatgaaaagattataatcactaagagtgaaactaatataaaaaaaccattgactgttttgaatagcactcagttcattacgtttgctctatttgtcactcctttcagcaaacaaaatatagtccctatagttatggacggcagtaaaatgggctatattgatatgacgataaaatcaatgtcccttctagggagcatggttacatatgaacaaaagcactttaaagtaactaaatatatacctaaagatattgaaataaaaataccctctgatttcacatcattaagctatatagcatcttctatattaagctcaaaaggtgttagtgatgtattgataagaaattattattttaatgacacaataaatgaacgtgatttatttaaattttatcaaagtataggtctaattattaagtatgattcaaattggaataatttgagaatattcaggcagtcgattaggttatgggatggtgaattttcattgaaagagcttccttccgtagccgtaaacataattgctgcttcatctaatttgaaaggaaaaaaaatttttagtggggtaaggggaataaataatcataaaagtcaacgagcatttattgttaatgaaaatataagaacaatgggagggagtagtgttctaatattcgatagagtaggaatgtttgagtcaatatatattgaaggaaaaggaccgttgaatggaggagttgaacttaaaagttacggtgaccatagaatttgtgctgctaatctcatagcatcgctcggtgctgagaaagaatccataatatacgatatagataaattaaatgatggatttcccgattatatcgatacgctgaggaatttaggcgttcatattaaatag

SEQ ID NO: 4005 - DNA, 1338 bp, Xenorhabdus bovienii
  Coding sequence Name=Xb4151_4152.C441.gene106.dna; Position on contig= 73740..75077bp; Strand=+
atgtctaaaagaattgataaagatagtaaatttgttgaggtgatttattcgaaacgtttacagggtacacttaacttaccagcttctaaaagttcctcaactcgagcccttctaacttcttccattacttctggaaaaagtattatcagaaatattgctactggttttaataccatagcgatgaaatctaattgtgagcgattgggggctgttttcaaagaagataaaggtaatttgatagtaaatggaattgacgtgagttctatcaaccagcctttagagttcaatccaggtaactcaggggtagtattgaggttgttgatgggggtagcgggtttcttaccagagacaaaatttataaccgattatcacgcctctcttggatttcgttctcaaacagaaatggttaatgcgctatgtatgttgaatgttcaatgtagagcattgggagaagagcatcgacttcctatcaggattaagtctgatagaaagttaaatgattatacagaggtatcttgtagaaaaagctcacaatttttaagtggattactatatcttggagcagtgatggataatgacttaactataaaggtagtcgacaaaataacagctccatcaatggttcacacaacaattaataaccttaagaaagcgggtattagaatcgaatatgatagtgattttcgtgaattttttgtacatggtcgatgtcgattgcaggcaagtgattttacagtaggttctgatccagctagcactgctgcaatccttgcgctttgtggctccctagaatcagaagttcaattgaatggtttcttcgaagaagaactgggaaatggtgctgtgattcaatatctaatcgatacagggactaatatcgaatttattgggaatgaaacgataataattagagggagtacagaaattcgtcctttagattttgacggttctttggcccctgatgcagttcccgcattagcggctagagcttcattagcctctggtacaagtattttttataacattgagcatatccgttataaagagtctgatcggatatctgattttagaaaagaattatcaaaactaggggtaaaatcagatgaaaaacatgatcaactcattatccatgggaaccccaaaggatataaaggcagggtggttctagatggacattacgatcatggacttattatggggctcacaacaataggccttcattgtagtgagcctgttattataaaagaaccatttcatgtagggcaaacttacccagaatatttttctgaaattcgttccttaggtgcgaaagttaatgagctggctaaattaaaataa

SEQ ID NO: 4006 - DNA, 741 bp, Xenorhabdus bovienii
  Coding sequence Name=Xb4151_4152.C441.gene107.dna; Position on contig= 75105..75845bp; Strand=+
atgtgtggaattgcagcaatttttacgacaaaaaaaattttaattgaacaattggataataagcttttctctatgatagaaaggattaaacatcgaggagatttatctcgttttaatgaacacctagttaaagaatacgttgggcttgccacaaatcgcttggcaattgtcgagagagaaaccgcgactcaacctgtttcagacgaagaaagggatattcatgtcatccttaatgggcaaatattcaattataaaaaaatacgtgaaaaacttatcaaaagaggacacgaatttaaaggatatggagatgcagaggtaatattaaaggcatatattgaatatgatttagaatttgtaaatatgctagatggaatgtttgcatttgtcatatatgataatagaaaatcaaagtttctgatcggtagagatcacgtgggtataaagcctctttactatgcaaaaaagaatgatgtttggtatgtggcatcagaaatgaaatcttttctagcacttgatgttgaagttaagacacttgagcctgggagtctttatgatggtaatgagctttataagtatactcgttatgataaatctatagaaaaaagcaaggattgttatcttgtagcaaaacaaaaagttcgtaagttgatggaagaggcggttgagtctcaagttgacactgatctgccggttgctgttatgtttagtggtggaatagacggtcatgtattaaatggttag

SEQ ID NO: 4007 - DNA, 171 bp, Xenorhabdus bovienii; identical to SEQ ID NO: 3228
  Coding sequence Name=Xb4151_4152.C441.gene108.dna; Position on contig= 75896..76066bp; Strand=+

SEQ ID NO: 4008 - DNA, 279 bp, Xenorhabdus bovienii; identical to SEQ ID NO: 3227
  Coding sequence Name=Xb4151_4152.C441.gene109.dna; Position on contig= 76017..76295bp; Strand=-

SEQ ID NO: 4009 - DNA, 3411 bp, Xenorhabdus bovienii
  Coding sequence Name=Xb4151_4152.C441.gene110.dna; Position on contig= 77017..80427bp; Strand=+
atgcaacattttctcagggcattgcaagagtctggattacaagtttctctttcttcttctgaattagctgaactagaaaataaaaatacagaagcgggaatatctcctctcacacagcagattcacgaaatgctttgcagtgcattgccactgaatatgactatccccaaaacgttatttacaaaagagtctacaacagacgattttccactgacggatattcaatatgcttacctgatcggccgtaatcctggattggaactgggtggacggacgagttgtctgtataccgaatgggatgtcaaatccttagatatcaaggtactgaatgacgcgctcaacatggtgattggataccatcccatgctgcggactgcgttatcttcagatggtcagcaacgggttttatctgaatcattggcctataccatttctattcaggatggcagagcgtggccggcatcagaaaaagataaacaactggctgatattcgtcagaaaatggaaacacagttattacccgtagataaaaccccgtcatttgatatacgtgcaacgatactcagtgatgaaattacccgtttgcacctttattttgatttgatgttcatggatcttcatagcgtcagattggtattacgggactgggggcgggtttatcagggctgcgaattgcctgaattaggtgacgaagcaaattttcataattatatcaaggctgaacgttatctacaggggcaaccacaagggcagtatgataaaacttattgggaacaacagttcgataacttaccgccatcccccgaattgccattgaaaaacgcccctgaattgatttctccaccgatgttcaaacgttacagtcggaaaatagcgacagaaaccttatccgctcttaagaaaaaagcagagcagcaaaaactgacgcttgaaacgttgttgttgggaacttatgcagaagttctccgtcagtggtcaaaacgtcagacttttacgttgaccatcacacagctcggtcgtcgtccctatttttcagcggttgaaaatattgtcgggaacttcctgcaacctacattactggcaatacagggaacagaaaacgatagtttcaatgatcggttagtacagcttcagactgattttctgatgaatcgttggcattcttcctacaatggtgttcaggtcttgagggagctgactcgtcgcagtcatggcagtcgcgcagtttctgcaccggtggtattcagtaatactctgacagcccatttagacgatgttgtcacggatatggactgggctgacacagtacaggtttatagcagtaatcaaacccctcaggtatggctggaaaaccaaatcgttcgcgttgatggcatcgtccagattaactggaatacggttagtgagctgttccccgatggtatggttgaagccatgctggatagttatatggaactcctcatcgtctgcgcagaagacgattctgtgtggggcaaaaccggatcattggtaaaacttcctgcgtccgatagggcagaacgcgccaaggctaatgcaacggatattgatcttgctccccggcttctgcatgaaatggttttgcaggccgcagagaaattccctcactccattgcccttgtgcagggcggaaagtactttacttatgctgaaatggtcaagggtgccagtgaagtcgcaaaatctcttcgtgcgtcagtccagattcatccgaatgatattgtggcggtttctctgccacaaggcccggcattggtgcttggggtattgggaattctcatgtcgggagcagcctatgtcgccattgaccctcaacttcccgcagagcgtcggatgaatttgctcaggcgctgctccgccaaaggcatcgtcactgagagcagcctttctaatgaggatgaatcggctgatttattccggatcaatctggatgagtgccttatgtctgaggcaatggatacagaacagaaggtctctgctcatttatcttccgtacaagcgttggatgatttggcatatgtcatctttacctcgggttcaacgggagaaccgaaaggagttatggcttcccatcgcaatgcggcgaacacggtactggatatcaatcgcaaatttcatgtgacagaaaaggacacggttttatccgttgcgcctgccggatttgacctgtctgtatatgattatttcggcgtgctgggggcaggaggaaaggttgttttttcaacctctgaagcggctaatgatccgaaaatctggtttgagacgctggttaaacatcagattactatctggaacagcgtgcctgctcccgtcaaggttttggtagaccgaaatggtggcgatctggctcagacaccattaaggctgatactgatgagcggtgactggatccctatcgatctgcctgaacgtattcgggaaaatctgcccgatacggcgatcatcagccttggtggcgcaaccgaaggatctatctggtcgatatgttatccaattgaagatattgataaaaattggaaaagcattccttatggcaagccattggcaaaccagagattccatgtcctgaacaattggctttcaccttgccctaactgggtgacaggtgaactctatattgggggagagggcgttactctgggttatctgggtgatctcgaaaaaacggcgcagcgattcattacccatcctgttactggcgagcggttatacaagacgggagatctgggacgctatatggctaacggcctgatagaaattctgggtcgtgaagataatcaggtgaaaatcaatggataccgcattgaattaggtgaaattgaagcctgtctcctgactcacgaaaacgctggtcacgtcgtcatggatgcccccgtccatgccaaaacaggtcagcggcatattgtggcctatgtggttccctctgttgcggatacatcagaagatcctgcccattttcaggagcagttgagggaaattgcccgcaatatactgccgtcctatatggtgccgagctattacgtgttgctggctcatatgccgttaaccagcaacggtaaaattgaccgcaaggcgctgccacttccttgggctgatagcgaagaacacacagcaatcgccgtcgatccggccaatgagatagaaacaaaaattttacaactctggcagtcacagctccagcatgatgacttcgatgtcaccgatggcttcttcgatattgggggggactcactgcatgccgttggtctgcttagcgctctgcgacaggaatttaatatcacgcccgccggcgagcaggacattatcgaagggttgttcatgaactccaacattcaggcattctctcggattatcgagacgattatgcaatctcaagcggtgagtgacctatga

SEQ ID NO: 4010 - DNA, 1650 bp, Xenorhabdus bovienii
  Coding sequence Name=Xb4151_4152.C441.gene111.dna; Position on contig= 80424..82073bp; Strand=+
atgaccaagacatacgattacatcgtggtaggtggcggctctgcggggtgtgtggctgcatcgcgcctgtctgagaacggtacgaaatcggtactgttgcttgaagcgggtcacgcatctgatgttaatgatccggccagcccgctccgggatgcgtcaaggctggtactggaagggtataactgggattacgaagcgaatgtacgcagtgaagatcggttcgccgatctcatttcgccttctcattacctgcaagatgaaaaaaaacaagagcacaaacaccggggaagaaaactgttcaattatcgggtgggaaaggtgcttggtggttcttctgccgttaatggtgccattgccttcaggggatttcccagcgattttgaacagtgggtgaaaatgggttgttctcgctggtcttgggaacaggttctgccgtggtttaaacatctggagaatgacgtcgatcgcacgggtgatgataaccacggttcactggggccaatgtgtttgcgcagaccgcaacatgaggaaatccatcccctcgatatggcttttgcccatgcttgtgagcagtcgggtgttccctatgtggatgatcttaatgccggagagtctcccgccgtagggcctgtacctgccaacgtcatcaatggggctgaaagagtggatgtttatcgctcatatcttgaacctgttcttcatagaaagaacctgcgcgttatgacggatgtgctggtggcacagatcatttttaacggaacggtagcggccggcgtaaaagtgattcaggccggagaagaacagatttatcacgcagagcacatcgttctctgtgcaggcgcaattggttcggcaaccctgttacagcgttcaggtgtcggcgatcccggacatctgcgtgctttgggcattccggtgattgcggagttgcccgccgttggccgaaatttgactgatcacgcttcagttgtgctctggtcattgccgaaaaccggcgtgtgtacaacgggtttaccgtggcggcaaattgctgcccgcatcagcagtggctatgacacaaaagttgatgtgcaaatcgggctgttgaacaatgttgccagtgagacggtgccgggattcaaagatcgtgtcgcttatcccatgctggttggtgcttccgtgatgctgatgcggccacaggctctggggcgtgtttttatcagtaccgccgatcctaccgtgctgccccagattgacctgccactgacccgcaatcctgcggatatcgcccgtcttgtcggtggtgttcgtaaaatatgggaagtcctgcggcatccggaagttgatgcgtttctggatgggattcagttttggtctcattccatgatttacaacgatgaaatcatgaacagtgcgattaagaaccttgttaatccgggctggcatgcgtcaggaactctcagaatgggagctgactctgatcctgactgcgctactcaagaggatggacaagtgtatggcatcacgggagtgaccgtagctgatgcatcgctgtttcccaccattccttcgatgccgaccaatctgacgaccatcatgaccgctgaacggattaccagctttctgatggagcgagaggcagtgatagcacggagggaaaatgaacattaa

SEQ ID NO: 4011 - DNA, 738 bp, Xenorhabdus bovienii
  Coding sequence Name=Xb4151_4152.C441.gene112.dna; Position on contig= 82063..82800bp; Strand=+
atgaacattaattgcagacgggtcatttatgcctttccacatgcaggggcgacaacggccatttatcgtccttggctgaatgctctggcggccacgaaagccgcgatcttgcagcctgtggcaatccccggtcgggggcatctagccaaagagcctgaaatccatgagttagagccgttggttgatcggctggcctcagatatttgggcggattttcagcagaagcaggcgcaggggatcacggagtggattacattcggccacagttttggtggtgtgctcagtgttgcggtgggtcagatactgcacgagcgctacgggcttacccctcagtttggtgtggtgtcctgctcggtgccgcctcaacttcaaccgtatgatgagcggcatgaatggacagatgaacaattgattcagaaaaccagagaagatcagggaacgcctgaggcgattttgaacgaaccggcgctgataaaacccatcatcaggcaattacgcaatgactacctcatacgtagccaatttactcagcttggcaacatgcaggtggattatccactggtgctggtttcagccagtcaggacatacatgtcggtttggcagatatgcaggtctggaaaaatcacacttctcacaagacctcactcatccgtattgaaggggatcactttgccgtctaccggcactgggatgccatcaaacaaatactgctgagtgacagtgaaacgcaacaatag

SEQ ID NO: 4012 - DNA, 1137 bp, Xenorhabdus bovienii
  Coding sequence Name=Xb4151_4152.C441.gene113.dna; Position on contig= 82825..83961bp; Strand=+
atgcgtattgagattgataatttcgacgattaccggaaatcttgtcgtgaatttcttgagagtgagatcgttcctgaacatcaggcttgggaatataatggtctgatggcgcgttctttttgggagagattaggtaaggctggcttgttgggtatcagtgtcagcccagaatacggcggcttgggaaaacatgattaccgttttgccgtgattctgacggaagagcttatcagagctggcgttacagtcccggggatcgtcgcccataacgatattattgccagttacatttttgccctcggcagcggagaacagaaacaaaagtggctgccggaattatgcctcgggaagcgagtcgcagccattgccatgactgaacccggcggtggttctaatacggcagatatcaaaactgtggccaaacggcagggagatcactatctggtcaatggcggcaaaacctatatcaccaatggtatcaatgctgatctgatcgtggtggcggtaaaaacagagcagggtcagcaaggtcaggggatcagcctgctggtgatagaacgggatatggccgggttctccagaggggagccaatgaagaaaattggctggaacggcagcgacacggctgaactgtttttccatgattgcaaagttcctgttaccaatctgattggccgtgaaaatctcggtaactattacttcatgtcggcaatgccacgggaacggctcagtatctcagcggtggcggttgccagcgcagaacatattttacagagtacgctggcttacgtgaaagaaagaaaagcgtttgaccagccgattggctcctttcaatacaaccgttttatccttgcacagttggataccgaagtaaaaattgcccgcatctatcttgataacgccgttgagcaatttagcaagggtctttttagtttggtggatgctgcccgtatcaaatggtggacaacggaactccagatgaaagtcgcggatcgatgcctgcaattatatggcggggcaggttatatgcgtgattctgttgcgggcaaaaactggctcaatagccgcgctcaaactatttatggtggaaccagtgaagttttacaggaaatgatcagtaaatcgatggggctttaa

SEQ ID NO: 4013 - DNA, 117 bp, Xenorhabdus bovienii
  Coding sequence Name=Xb4151_4152.C441.gene114.dna; Position on contig= 83986..84102bp; Strand=+
atgagcaaggcagggcttattcctcactaccgtactttcaggaagtacaagggcaatgtcataccaaaaggacgtttggataaattaagggccattgcttctctggagttgggttaa

SEQ ID NO: 4014 - DNA, 504 bp, Xenorhabdus bovienii
  Coding sequence Name=Xb4151_4152.C441.gene115.dna; Position on contig= 84131..84634bp; Strand=+
atgacgacgtcattcatgtattcatatgagaggtatgttatggcaaatgaaaagccaaccttattcgaatggatggggggcagagaaaaactcatgcaccttatggaagtcttctatgccaaggttgaaaaagacgaactgcttgaacccctgtttaaaaatatgaaagccgatcaccccggccatgttggcatgtggctggaagaagtactcggtggagaaagccgctataccgatgagcgcggtggtttcaaagtcatgctgagtcggcacaggggcagaagcatccaacccgagcaacggacgagatgggtagaattattgatgaagtctgccgatgaaatcggtcttccgtcagatcctgagtttcgttcagcctttgcggcctatatcgaatggggttcacgcagggcagaagccaattcccagccggatgccgcaccatcacgccgcgaaactgtaccaaaatggggctggggggaagcacctccgggaacgccctga

SEQ ID NO: 4015 - DNA, 843 bp, Xenorhabdus bovienii
  Coding sequence Name=Xb4151_4152.C441.gene116.dna; Position on contig= 84670..85512bp; Strand=+
atgctgttggctgtcagtgacttacatgtatcccatgcagcaaatcgggcgatagtcgattcattcagaccatcgacaccggacgattggctcttgttggtgggtgatattgcagaacaggagtcagactttacatgggtcataagtacgctttcccaacggtttgcacaggtaatctggacgccgggaaatcatgaactctggtgcagtcccagagatcctgtgaaattacccggtgtactgcgttatgagcatctggtaaacatctgccgacagcacaatgtgctcactccagaagatgaattccaacgttaccctatgggggatggtacatttgtaaccattgcccccatatttacgctatacgattattcattcagaaatgcgaccgattatacggcagatcaggctatagaacgcgcccgtcgctgcggcatcatcagttccgatgagtttttcctgaaaacctatccctataaaaatattatcgaatggtgtcgggaacgcatccaatataccgaaaaacgtttgaatcacattcaggatggcgaaggtattgtgctcatgagccactttccgattatccgaaaaccgaccgaatctttgcgcaataccgaattttctatttggtgtggcagtgaaaaaactcgccagtgggcatcaagaaaaggggtacacatggtggtatatggtcatttgcacattcccaatatcgaatatattcatggtgttgctcatgtggaagtctctttgggatacccacgggaatggcaggagcgtggcagacatttctgtctggtagagctggatgagtggctggaatatgccagtgaatatcgctaa

SEQ ID NO: 4016 - DNA, 576 bp, Xenorhabdus bovienii
  Coding sequence Name=Xb4151_4152.C441.gene117.dna; Position on contig= 85565..86140bp; Strand=+
atgaaatatgatgaaactaatcaaaaaataaaaccgaggattttaattggagccacgggatcagtcgatattgtcctccttcccagatatctttcggctattaaggcggcgattgactgtacattgacggtattgatgacaaacagcgctatcccctttttgccagcggaaaccattgccctctatgctgatcgggttatcagcggagaaaaaccacaggattggccaaccgataagccttctcgcattgtggctgatcatgatctcatggcggttctgcctgcaacggcaaacacgatggcgagtgctgctcatggtgcgactcccaatcgtttgacaacggtcattctggcttccacgtttccggtactgttctttcccgtaatggggagcgtcatgtgggaaaaaaatgcaacacgtcgcaatatcagacagttaaatgatgatggttatcatgttattgaacctgtttggcatgaaaactttgacgcatcactgcaaaagatggttgggcatccttccctgccggatattgaaactgtgatttcactgctgaagcaatatttgcctaaataa

SEQ ID NO: 4017 - DNA, 108 bp, Xenorhabdus bovienii
  Coding sequence Name=Xb4151_4152.C441.gene118.dna; Position on contig= 86142..86249bp; Strand=-
atgcgaggtcagcagataggtaggaaagaggaagagtacgcagtccatatgttaaataccgtcagaatacctgagtactccccatatatatcccatcgatttcagtaa

SEQ ID NO: 4018 - DNA, 1272 bp, Xenorhabdus bovienii
  Coding sequence Name=Xb4151_4152.C441.gene119.dna; Position on contig= 86416..87687bp; Strand=+
atgtcgcaacattataatcgtgcgttaaataaacaagattacaaaactctgtctttggctgctctgggtggagctttagagttttatgacttcattatatttgtcttttttgccgttgtgctcggcgagctatttttccctgcggacatccctgtgtggctccggcaacttcaaacctttggcattttcgcggcaggttatctcgctcgtcctttaggggggatcatcatggcgcattttggtgatttgattgggcgtaagaaaatgttttcgctcagtattcttctgatggccttaccgacattgatcattggaggattacccacttatgatacgattggcattgctgcccctgttttattattactgatgcgcattatgcagggagcggcaatcggcggagaagtgccgggtgcctgggtatttgtggcggagcatgttccccataaacgcatcggttttgcttgcgggatcctgacagccgggctgaccattggcattttgcttggctcgctggtggccacgatcattacctccatttataccagacaggacgttttggattgggcatggcgtctgccattctttattggtggggcttttggcttgtgtgctatgtatctgcgccgttggttacaggaaacgcccgtcttcagggaaatgcaggaacgtaaggcattggcggacgggctgccactgaaatctgtgatcttgaaccataaacatgccatcatcgtttccatgttgctgacatggctgctctctgcgggcattgttgttgtcattttgatggcaccgacctatatgcagactgttttccatctggagcagtcactcaccctgaaagctaacagtctggcgattatcatgctggcaatcggctgtatattagccggtcatttatgcgataaatggggcgccagtctggttttagtggccggctgcgttctgctcgctgtagcctcatggtttttctaccataatatcagtgatgaaccgggcagattattcagtgcttatgctgtggcgggattctccgttggcgtacttggagcagtgccttttgtcatggttcagagctatccgccggaagtgcggttcagtggaatttcattctcatacaatatgtcttacgccatttttggtgggctgacccctattttcgtcaccctgttacaggtctatacccagtttgcgcccgcttactatattctggttttatctgttgtaggtatactcttggggttacatttgcgcgtcagaaaaaagtga

SEQ ID NO: 4019 - DNA, 573 bp, Xenorhabdus bovienii
  Coding sequence Name=Xb4151_4152.C441.gene120.dna; Position on contig= 87760..88332bp; Strand=-
atgcattctaatcagttggcgaatccaggcccgttgggtttgatgggctttggcatgacaacaattttgttgaatttgcacaatgcaggttttttcccattggcatcggccattttgagcatgggaattttttatggtggtttggctcaggtgctggcgggcattattgaatacaaaaaaggaaatacctttgccgcaaccgcatttacctcttacggtatgttctggctgagtctgatcggtttgttgttcctgccggtaatgggtctggcagatgccaccagccatgaattcttcggtgtttacctcgccttatggggtattttcactctgtttatgttttttggaacgttgaaagctaaccgggtcctgcaatttgtgtttggcagcctgacgctgctgttcgcactgctggcaattagcaatatcacaggcaataccggcctcctgaccttcgcaggttatgaaggtattgtctgcggggcaagtgctttctatctggctatggctgaggttctgaatgaacaatatggccgtactgttctgccgattggcgaagtgaaacacgcctga

SEQ ID NO: 4020 - DNA, 1905 bp, Xenorhabdus bovienii
  Coding sequence Name=Xb4151_4152.C441.gene121.dna; Position on contig= 88682..90586bp; Strand=+
atgggtaaaatcattggtatcgacttgggaactaccaactcttgtgtagcaattatggacggcacaactgctcgtgtgcttgaaaacagcgaaggtgatcgcactacaccttctatcatcgcgtatactcaggatggtgaaactctggttggtcaaccagctaaacgtcaggctgtaactaacccgcaaaacacattattcgccatcaagcgtttgattggccgtcgttttcaggacgaagaagttcagcgtgacgtttctatcatgccatataaaatcattggcgcagacaatggcgacgcatggctggaagttaaagatcagaaaatagctcctcctcagatttctgctgaagttctgaaaaaaatgaagaaaacagcagaagactatctgggtgagccagtgacagaagcggttattaccgttcctgcctacttcaatgatgcacagcgtcaggcaaccaaagatgctggccgtattgcgggtctggaagtcaaacgtatcatcaatgaacctacggcggcagcgctggcctacggtatggacaaagaagtcggtaaccgtactatcgcagtttatgacttaggtggcggtacttttgatatctctatcatcgaaatcgacgaagttgacggtgaaaaaacgtatgaagttttggcaaccaacggtgatacccacttgggtggtgaagacttcgatagccgtttgatcaactatctggttgatgaattcaagaaagagcaaggctttgatctgcgtaacgatccactggcaatgcagcgtctgaaagaagccgcagaaaaagcgaaaatcgagctttcttctgcacagcagacagacgtgaacctgccatacatcactgcggatgcgacgggtcctaagcacatgaacgtcaaagtgactcgtgcaaaactggaatcactggttgaagatttggttaagcgttctatggagccgctgaaagttgccctgaacgacgctggactgtctgtatctgacatccaagacgtgattctggttggtggtcagacccgtatgccaatggtgcagaaaacagttgcagacttcttcggcaaagagccgcgtaaagacgtcaacccagacgaagccgttgcaatgggtgcggctgttcagggtggtgtactgtcaggtgaagtgaaagatgttctgctgctggacgtaacgccactgtctctgggcatcgaaaccatgggcggcgtgatgacggcgctgatcacgaagaacaccactatcccaaccaagcacagccaagtgttctctactgcggaagacaatcagtctgcggtaacgatccatgtattgcagggtgagcgtaagcgttccggtgataacaaatctctgggtcaattcaacttggatggtattcagccagcacctcgtggtatgccacaggtcgaagtgaccttcgacattgatgctgacggtatcttgcatgtttctgcgaaagacaaaaactctggtcgtgagcaaaaaatcaccatcaaggcatcttctggtctgaacgaagaagaaatccagcagatggtacgtgatgcagaagcgaacgcagaagctgaccgtaagtttgaagaattggtgcaaattcgtaaccaagcggatcagctgattcacggtactcgcaagcaagttgaagaagcaggcgacaaattgactgcggatgacaaagcagggatcgagaaagccgtttctgagctggaagttgctgtaaaaggcgaagacaaagctgaaaccgaagcgaagattcaggcactggttgaagcttctaagaaacttctggaaatcgcacagcaacaggctcaggaaggtgctgctgaagcgggcaccgcgaaaaaagatgacgacgttgtagacgctgaattcgaagaagttaaagacaaaaaataa

SEQ ID NO: 4021 - DNA, 1137 bp, Xenorhabdus bovienii
  Coding sequence Name=Xb4151_4152.C441.gene122.dna; Position on contig= 90691..91827bp; Strand=+
atggcaaaaaaagattattatgaggttttgggcatttccaaaaccacagaagagaaagagataaaaaaagcctataagcggctggcaatgaaatatcacccagatcgcaatcagggtgataaagaagcagaaagtaaattcaaagaaattaaagaagcgtatgagatcctgacggatgcacagaagcgcgccgcttatgaccaatatggtcatgctgcctttgaacaaggtggtatgggtggtggagcaggcggtttcggtggcggggctgattttagcgatgtctttggtgacgttttcggggatatcttcggtggtggccgtcgtcagcagcgttctagccgtggctctgacctgcgttacaatatggacttgacactggaagaagcggtccgtggtgtgaccaaagagatccgtattcccactctggaatcctgtgatacctgtcatggcagtggcgcaaaagcgggtaccaacccagaaacctgctcaacctgtcacggtgcagggcaagtgcatatgcgacaaggattctttacggttcagcagccgtgtccgcaatgtcatgggcgtggaaaagttatcaaagagacttgcggaaaatgtcatgggcatggccgtgttgagaaatacaaaaccctgtccgttaaaattccagcaggcgtcgataccggtgatcgcattcgcttgggtggtgaaggtgaagcgggtgaacacggtgcaccagcaggtgatttgtatgttcaggttcaggtcaaggcgcatcatatcttcgagcgtgatggcagcaacctttactgtgaagtaccgattaacttcgcaactgcggcactgggcggtgaaattgaagtcccaacccttgatggccgtgtcagcctgaaaatccctgcggaaactcagacgggtaaattgttccgcatgaaaggcaagggcgtgaaatccgtccgtggcggcgctcagggcgatttactgtgtcgtgtcgtggtagaaacgccggtgaagctgaacgacgaacagaaagacttactgcgcaagctgggtgaatctttgggtggcaagagtggtgaaaccaatagcccacgctccaagagtttcattgacggcgtgaagaagttttttgacgatttgactaagtaa

SEQ ID NO: 4022 - DNA, 984 bp, Xenorhabdus bovienii
  Coding sequence Name=Xb4151_4152.C441.gene123.dna; Position on contig= 92291..93274bp; Strand=-
atggcctataaacaactgaccgaaacagaaagatatcagattttcagcctgaaagaagccggtttttcacaacgggagatttcaaagtcactcaatcgaaacccatcaacgattagccgggaattgagacgaaatcgggaggcaaagaaatatacgcctgaacaagctcagcttaaggccgtagcgcgccgacagtgtgctacaaaagcagtaaaagtgaaaccagagatagaaatgtggatcaaacagttaatttggcaagatttaagtcctgaacaaacagtcggttatctcaaaagggaaaatataatatctttgcatcatgaaacagtttatcgattgatttataaggataaacttaatgatggtaatttatggcaacatcttaggattgcgaaaaaaccgtatcgtaaacgctatggaagttatgagcgcagaggaaaaattaaaaacagagtcagtattgataagcgccccaaacttgttgataaaaagcagcgtattggtgattgggaaggagatactatcgtgggtaaaaatcataaaagtgcattattgacattagttgaacgaaaatcgttatttactatcataattaaacttgaaaataaaacagcagaaggggtcgcaaaagcggcaacaagacatttatcactgataaaacataaaattaaaacaatgacctttgataacggcctcgaatttgccgaacacgaactgatcagtaaaaatttagagacaaaaatttattttgctcacccgtattccccctgggaaagagggataaatgagaacacgaatggattaatcagagattacttcccaaaaggaactgattttaataaggtgtcagagcgggagattaaccttgtggcaaaccgattaaataatcgtcctcgtaaaacacgagattacaaaacaccgaatgagttatttaaaggaataccctctcatttacttcgtccattacggtgttgcgcttaa

SEQ ID NO: 4023 - DNA, 600 bp, Xenorhabdus bovienii
  Coding sequence Name=Xb4151_4152.C441.gene124.dna; Position on contig= 93540..94139bp; Strand=+
atgttagaagattccccaaaagatgcccaaaaagactctactaatccccttaaagatatgccctacgaacaaggtaagttattgaaatcaagatgtatcatgatatctggcgaaattaatcaagcactagccgaaaaggtaacaactcagctattagttttacaagaaataaataatgatccaataaagatttttattaacagtcaaggcgggcatgttgaggctggtgataccattcatgacttgattaaatttataagaccagaagtctttataataggtacaggttgggttgcaagtgctggtattaccatatttcttgccgctaggaaagaaaatcgttattctctccctaatacccgttttatgattcatcaacctttaggtggatatcaaggaaaagcatcagatatagagattgaagctaaggaattcttatttatacgcagccgtataaataaacttatcagtgatgctacaggacaatcgatagaaaaagtagaaaaggacactgataggaattactggatgcgcccacagcaagctattgaatatgggattgtcggccgcataataactaaatgggacgacatccaataa

SEQ ID NO: 4024 - DNA, 285 bp, Xenorhabdus bovienii
  Coding sequence Name=Xb4151_4152.C441.gene125.dna; Position on contig= 94196..94480bp; Strand=-
ttgcgtataggttgtatctttcacccattttatcaaagaaagtccattggaacagaatctttaggggcactgattgatattagttttgaatattttagatgccatcggatttatgcaaaattagatgttttaaatcttggttctaaacgattagttgaaaaactcggaatgcgtcaagaagctcacctattacaaaatgaacgtgttaatggaatttggagtgacatgtatatgtatgcaattctacataatgaatggcaagcaccaaaatttttaaagcgataa

SEQ ID NO: 4025 - DNA, 1050 bp, Xenorhabdus bovienii; identical to SEQ ID NO: 483
  Coding sequence Name=Xb4151_4152.C441.gene126.dna; Position on contig= 94481..95530bp; Strand=-

SEQ ID NO: 4026 - DNA, 159 bp, Xenorhabdus bovienii
  Coding sequence Name=Xb4151_4152.C441.gene127.dna; Position on contig= 95791..95949bp; Strand=+
atgaatagttctataaaatccggtgttcgtcctgatgccttaaaatccggtgttcgccccgatgctttgaaaacaggtgttcgttctgacgctctaaaaacaggtgttcgtcccgacgctttgaaaacaggtgttcgtcctgatgctattattgactaa

SEQ ID NO: 4027 - DNA, 1359 bp, Xenorhabdus bovienii
  Coding sequence Name=Xb4151_4152.C441.gene128.dna; Position on contig= 95933..97291bp; Strand=+
atgctattattgactaaatcaataattagttatgtaagccagcttatagctggcttattgtctatattcaaaacattcacaaacgaaatggataaaaatatgacaattgattttcacaaagaagtttgggaaggatttgatcaaaaaacaaattatggaaagacaccttttcttttccagtcagttcttcctttaaatgaggggttttccaatcatgaaactgttaaagatgcattttataatttatgcagtaaatctaatttactaaaaactgattgccgcttgcgtatctatgatggtgaaaaacgtcgtgatgatcttgtcgaaaaattatcatctgaaaccatattatcggatgaaacgttgacacatttcatgcaacgattaagtggaaaagagcgtttcagtttagtgattaataaccttgagcaatcttgtccaaagctagcagctgatttcggcttatttgcgcaatctttctttgcttataaaggtattcctattggtggaatagaacaagcaactttttgtggcaattattctggtactgcttttggtatacacgaaggttttgaacatgcatttttgtgtcatttaggaccgggtattaagtatttttattgttggtcaagagaactttatttggaaataactggctcacgcgaacccacgttctcagattcagaactatatgataaattaatagaaaaaggaacgctttatatacttaagccgggtgatgccttgtatttaccagcatcagtttatcatgtcggtcgtcaagaagaattttcggtatcaattgcactgccattttatacttatccattgtcgcgttttatggcattaaaaatacttcctgctctcagtgaacaatcgcttccctttgatcaagaaggcatgtcagaattaattaaatttgataataatcaatttgatatagaaccactctcaactcttttaacagaaacaataaataaatggttccaacaagatctaccgaaatacttacactattactggcatcgacttcgtagtaacggaggatgggaactacctacgactataagtgcagatccattaaaggaacccgaacatcaaaatgatttaatcattaatcctgattctcaagtatcattacaggctccatttattgttagttacgagcatggattaaattgttcttctgatgaaattcgcgtatttattgcaacaaaaagtgtaatattacctgccagttctgagactttaaagcttttggatacacttaatactcgacaacccattacaatacattctgaagatgtttatacctcactgaaaatattaataggcacaggtggtttattctgtcattaa

SEQ ID NO: 4028 - DNA, 852 bp, Xenorhabdus bovienii
  Coding sequence Name=Xb4151_4152.C441.gene129.dna; Position on contig= 97309..98160bp; Strand=+
atgtatagaaatttcccagcattagtggatgattatctgaataaaaatatttctactgcaaatttaattaatagtattattagtgaaggaaaagcaaaaattgatggaaatgagctaattgataaacatttagatcctatgattacaattatttataatcaaattaaagatctcataaacccatcaaatcttagtcaggaagaagcaaaattatatattggtgagctttctgtatttgctcgttacaattccactatgttattaagagcagccgataatattcgtggtttttgtcctgagtttgctcaagaattaacacgaaactttttggaagaaggtggagaacgaggaaagttacctgcccactatgttgtttttagcggagcactcattgcggacgtaaattttagagtgaatggctggatgccacggacttcttcaacacgtgctcttatttctttaatcgacatacttacgtggtctcattgcccttcaacggtactgggcatgtattatgcaaccgaagctattgctatcgcggaaactctacttttacaagatattaccaatcgtctaggacaaattactggtcgaggaacaggaaattcattaaaaaaacttgatttttattatcgaatgcacttggatgaaactcatagcgctgcaactgataatgtagcagttgaacgcgggcatcaagaaggtattgctagattcatcagggatgcagatctattccattttcagcaaccccagattgtggatggcttccttcaaatgcttactccttttgttgatcagtgggttgagattcatcatttaacccgaacagatcactgttacagtcattaa

SEQ ID NO: 4029 - DNA, 387 bp, Xenorhabdus bovienii
  Coding sequence Name=Xb4151_4152.C441.gene130.dna; Position on contig= 98178..98564bp; Strand=+
atgaaaaaaattgaattttctggtgggtgtctttgtggtcatatccgatttatagcgacaggtgaggctggtaatcctcatacatgttcttgctctatgtgccagcaacattctggggcattgactctatgttggattgaatttccgaaagccgcagtccactggaatgggccgggtggcgttccctctgtatttcgttcttccgactattctagtcgtgctttttgctcacaatgtggaagttctctaggagcaatagacgatggcccaacagtcggactgctattaggtaattttgatagtaaaaacaaaaaaaaccttcgcccagtttcacattcatttatatcgtcacgcccccgttggtggaaaatcgatactcaatcctaa

SEQ ID NO: 4030 - DNA, 888 bp, Xenorhabdus bovienii
  Coding sequence Name=Xb4151_4152.C441.gene131.dna; Position on contig= 98580..99467bp; Strand=+
atgttgaattctccaatattatataaagcggcgatgattcgccgcatacgcacttttcttgattctcagaaatttattgaaattatgactcccgttatgcgccgttattctggtgatgactctcgtccacgactctcgctacataatggaggttggctaagagagtcttcggcttttgccttacgctacaatcttcaattctatgatcgtatctatgaaataggtcctagtttccggcctgatacagtggatgatacacacctaccagaatttacaatgcttgatttatataaaaaagattctactcttgatgaaatgcttcaacttgcacaatcaataatagaaatattttatcaagggaaaataagtgtattatcgttttctgatcatcttaagcaacggtttttagttgacttttttgaagattgttccgctcccgaaatatttattgattgtttacgagaaatgtattgtgacaaaaaaactcccccgctaaatctaattgatcgctatattattgagaatattgaacctctatcacaacaatgctgtattatcgtaacggattttcctttgctcaccgagatacgagcaaagaaaagaacaggaacaaaaggaatcgtcgagcgtttcgaaattttgattgatgggatcgaaattgttcatggttatactgacgaagatgatgtagagcgttttgaaactcaggctcggaaacgtaacatgtttgggtctgaagatgaggtgatgtgtaccatgatgagaaataaattggtatctccttccagcgctggatttgctattggtatagaaagattatgtcaagttgcattaggagaaaaacaaatatctgcatttgcaacttcgcgtccgttttctcctttttaa

SEQ ID NO: 4031 - DNA, 1602 bp, Xenorhabdus bovienii
  Coding sequence Name=Xb4151_4152.C441.gene132.dna; Position on contig= 99504..101105bp; Strand=+
atggtgacattcaatgaatggtttattatggccttttctatcgcattggttttaatcgttcctgggccaacaaatactttacttttatcagctgggttacagcaagggttaagtaaatctcttattctcgttattgccgaagccataggatatacagtggctattgcaatttggggattttttttgctatctctgacacagacgttgtcttggatataccagtttgtgaagctattgtccgcgatttatatattgtggctagcttttaaattatggatgtatagcttaaaaatagattattttacagataatcagatgaatttaataaatatttccgcccataaaagtacaaatttccttgatgttatggtagccacatttttgaatccaaaagccttattattcgtaagtacttttattccgataagcacttttaaatctatgaatactttttttcctatgcttggtatttttttgttaatcttagtaccaataggtacattatggatatctatcggaagcttaattcattcctataaatacttacgtagatttactgccatttttctgcggatatcatccgtaattctgatactattttcattctcgttaacttattcaggaatagcaaaggctgaaagttcactggttttgtacaattggcaaagttatacaagtccagagatgctccaaaaattcaaaaaagagcataatatcagcattactctattagaatacaaatcaaatgaagaagcattagaaagcattcagcttggaaaaattaatgctgaccttgctgttgtagcggataattttttgcttcactggataaacgccggacttctgcaacctattaatgttcagtcaatgacaaatttcaaaaatattaccccccgatggcgctcatctcctgctgatccgcaacggacttatggtattccttggtcttggggcgttgttggcactgtcgtccatacagatgttcacgatggtgatattaatacatggaaggttgttttagaaccgccaacatcattatttggtactattaatgtgggttcagacatgaatgatcttatttatgcggccattcgctatcatgggggtaaaatatgtgactcaaatcctaaattacttgaaaaagttaagaagaccttacttgaagcaaaaaaacattgggccgcaatggaatatggtagtgtcaatatgatggcttcgggaaaatttaaagcaggtattgactggaatggtgcagcgttgcgtcaacgtagaattaactctcatattcagtttggctttccgcgtgaaggtgtattaatattcagtgataatcttgtcattcttaaaagatcgaaaaattatgaaaatgccagattatttcttaattttattatgcaacctgagaatgccgcattgaattctgcatttcatggctatgacagtaccatagaaggggctgataaatttttaccctcatggatgaaaaatgcacttgaacttaaaattcctgaacatgtattaaaaaattcagatcattcgatcatgtgcccaccttttgttcaaaaaaagtatcttaatatctggcaacagcttttaaaataa

SEQ ID NO: 4032 - DNA, 282 bp, Xenorhabdus bovienii
  Coding sequence Name=Xb4151_4152.C441.gene133.dna; Position on contig= 101379..101660bp; Strand=+
atgagtatttttaactttatcaggaagatagatgacccacgttctgacatcaataaaaaacatgagctaatggatgtgattttcttagccttttctgctgtgttatgtggggcttctggttggaaatcgattcaagaatttggtgagttacaaatcgaatggcttaaagagtgtttgaagccttgcatgtggtcagtgcttatgatgttgaatcgggtgttgccctcggccattgtgccgccgaaagcaaaggtaaggaaggctaggttgccaggcaattga

SEQ ID NO: 4033 - DNA, 447 bp, Xenorhabdus bovienii
  Coding sequence Name=Xb4151_4152.C441.gene134.dna; Position on contig= 101696..102142bp; Strand=+
atggatgccctacattgtcagaaagaaacccttgggttgattaaccaacgaggcggggattttattgttggcctcaaaggcaatcaaaaaaaattctatgagtttgttaaaccgcattttgctgcaccttatgaccacgatgaacgggctgaatttacagagaaaaatagcagtcatggacggaaagaattccgtcatgtcatgcaaatccgtgctgcattacctgagcaacttcagcaacagtggccttcaatacaaagtgtgattgaaatcgtcagtaaacgaagtgtgaaaggtcaaccttcctgccgtgattcacgctggtatgtcagctctctcccgttagatgcggaaattgccgccaaggcaataagaaggcactggtcggtggaaaacaagctgcattgggtattttcgggaagacgctctatcactcaaagaccctga

SEQ ID NO: 4034 - DNA, 819 bp, Xenorhabdus bovienii
  Coding sequence Name=Xb4151_4152.C441.gene135.dna; Position on contig= 102308..103126bp; Strand=-
atggttgctacacatgatgatattcagacccgttatgccaatatttcagttctcgatactggtggaagtgggctgccagtgctcctgatacatggtaattcaagctgtaaagaaatttttcgtcatcaaattgaatatttaaaaggggactatcgggttctggcattggatttacccggccacggtaaatcttctgacgccagcgatccgcgtgaagcatactcaatgcccggttatgcccgcaccatcatggaagtactggataagatggacattgataaagtcgtagtctttggctggtcactcggggggcatattgggttggaaatgctggcactgaatcctaaaatgatcgggctgatgatttgtggcacgccgccagtggccgttgggaaagagaatatagcccgtggtttttgtcagagcaaacagatgagactgaccggtaaagcggaatttactgacgaggatgtcagaaactttgcctgtgagacaaacggcgtcaatgcacctcatgaaccgtttatgatagaagccgtggcaagaacagacgggttagctcggcaatatatgtttgaagcttttatttcccctcaggcgacagatcagaaattattggctgaaaccagtgaagttcctttggctatcgtcaatggtgtcggtgatcctttcattaatcacgattatattaatggattaaattatagaaacctttggcaaggccaggtgtttaacttggccggcgttgatcatgcgccattctgggaagcaccagatatttttaacccgattctggctgaatttttaaaagatctttaa

SEQ ID NO: 4035 - DNA, 138 bp, Xenorhabdus bovienii
  Coding sequence Name=Xb4151_4152.C441.gene136.dna; Position on contig= 103410..103547bp; Strand=-
atgaaattaacagtgagcagatgtgttcaaggtgaagggttagataccacagagatatcagattttaactgggtcattgcccctatagacggggctagaaagtttagtttttttcatataattaccctagaatgttaa

SEQ ID NO: 4036 - DNA, 726 bp, Xenorhabdus bovienii
  Coding sequence Name=Xb4151_4152.C441.gene137.dna; Position on contig= 103577..104302bp; Strand=-
atgacctctagtcgaggtattggagcggctaccgctatactggcagcaaataaaggatattctatatgtttaaattatttaaacgatgaaaagtctgcgtttaaagtccgtgatgagattctaaatctgggtgccaaatgtatcactgtacgtgctgacgtttccaatgagcatcaagtaaaaaaaatgttcgacgacattgatactcagttaggaagtattactcaccttgtcaataatgttgggatcttaaaacaaaaaatgcccttaattgatatggatggggaacgatttcaacaagtactattgaccaatgtaatgagtcatttttattgctcttctgaggcgattaagcgtatgtcgatttctagaggaggctctggaggttcaattgttaacgtttcatcaggtgcatcgaaaagtggctcacctttcgaatacattgattatgctgcgtcgaaaggtgcagttgatacctttactacaggattatctaaagaagtcgccgctgacggcatacgagtcaactgcgttcgtccgggaggcatttacaccgatatccatgctgatggaggcgaaccttctagagttgatcgtattgccaagaatttcccgatgcaaagaggtggaacgcctgaagaggttgcaaatgcgattctttggctacttagtgacgaagcttcattcgtgactggaagctttacagacttatgcggtggtttataa

SEQ ID NO: 4037 - DNA, 279 bp, Xenorhabdus bovienii; identical to SEQ ID NO: 890
  Coding sequence Name=Xb4151_4152.C441.gene138.dna; Position on contig= 104608..104886bp; Strand=+

SEQ ID NO: 4038 - DNA, 270 bp, Xenorhabdus bovienii
  Coding sequence Name=Xb4151_4152.C441.gene139.dna; Position on contig= 104837..105106bp; Strand=-
atgggcgatcacttttcgtcttatcctaggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 4039 - DNA, 135 bp, Xenorhabdus bovienii
  Coding sequence Name=Xb4151_4152.C441.gene140.dna; Position on contig= 105137..105271bp; Strand=+
atgcgcctactggctttgctgactcctttcaatattattatttatatgacggatggttggcaaagttatgaaaaggcgttagcggggaaactgcatgtggccagcaagcgttatacccaacgcatagataaataa

SEQ ID NO: 4040 - DNA, 102 bp, Xenorhabdus bovienii
  Coding sequence Name=Xb4151_4152.C441.gene141.dna; Position on contig= 105362..105463bp; Strand=-
atgaataaggatgatttccctttgttattactagcttttgttaatgagaatcatttgtgttttaatgtcgacgctttagataaagaaaatagatggcattaa

SEQ ID NO: 4041 - DNA, 447 bp, Xenorhabdus bovienii
  Coding sequence Name=Xb4151_4152.C441.gene142.dna; Position on contig= 105790..106236bp; Strand=-
atgcatgaatccctgacaattgcattgcttcaggcacgggaaaccgcaatgggttttttccgtcctattttgaaaagctataacttgactgagcaacaatggcgtattattcgtgtacttgcgagtagccgttcgattgatttccatgatttagcttgtctcacctgcatcttacgcccaagcttgacgggcattctgacacgtatggaacgtgatggacttatcttccgcctgaaaccaatgaatgatcagcgtaagctgtatgtttccctgacaccggctggtcaggagctttacgaacaggccagagagcaggttaatgatggttataaggcgattgaagatgctttttctccagcaaaattggctcagcttttagcgttgctggatgagtttacttccatcggaaacctcgttcaggaagatatagagacagaaaatgagtag

SEQ ID NO: 4042 - DNA, 678 bp, Xenorhabdus bovienii
  Coding sequence Name=Xb4151_4152.C441.gene143.dna; Position on contig= 106624..107301bp; Strand=+
atgaaaggcactgtttttgccgtcgccctcaaccatcgcagtcaactcgatttctggcatgaggcatttgatgagctaccttataaaacgccaccaaaaactccaatttggtttattaaaccccgcaatacggtgattgtctccggtgatattattcctcatcccatcggggaaacggtacaaagcggtgcaacgctggcactgctgattggcaaaaccgcccgtaaagtttctattcaggatgcagaacaatatatcgcgggttatgcattggccaatgaggtcagcctgccagaaacttcgttttatcgtcccgctatcaaagaaaaatgccgggatggattttgtccgataggccagataatcacaacaaaatcagtagattcactcgatatcatcactgaaatcaacggtcaggcagttgatcgctggtcaacccgcgatcttgtgcgttctgcttcggaactcctggcggcattaagtgatttttccacgttaaacgaaggcgatgtcatcctgctcggcaccccccatcagcgtgttactctccaccctaacgacatcgtcacggtcaaagctgaaggttttcctgcgttgaaaaacacagtcgttttggaagacatcacgttgaaaggtagcgatttggaaggaatggcgcaggcgggaggtcagtcatga

SEQ ID NO: 4043 - DNA, 765 bp, Xenorhabdus bovienii
  Coding sequence Name=Xb4151_4152.C441.gene144.dna; Position on contig= 107298..108062bp; Strand=+
atgagacaagccagagtacgttatcagaaccaagaaatgagtgttatcgtcgatgagcaggaaaatatcctgctgtctgatgggtgcgtcgtcagcggacgcgatgttttgtggctccctcctgccaatggcaccctgttcgcattgggactgaattatgccgaccacgccacggagctggaatttaagccaccggaagagccgctgatcttcatcaaagccgccaatagtctaaccggccatcgtcaggtttccgtccggccggacaatgtggaatacatgcattatgaagcggagttggttgttgtgattggcaaacccgcccgcaatgtttccagagaacaggctatgggttatgtcgcgggttataccgtctgtaatgactacgctatccgtgattatctggaaaattattatcgtcccaatctgcgcgtgaaaagccgcgatacgctcaccccgataggcccgtggatcgtggataaaaatgcaatagccgatccccataacctgatattgagcacccgggtcaacggggaattacgtcaacgcggcacaacggcagacctgatctttgatattcctttcctgattgcctacctgagcagttttatgacactacagccgggagacatgattgccacaggaacgccgaaagggctgtcagatgttgtgccgggtgatgaagtgattgtgtccgtcgaaggtgtcgggagcctggtgaatcacattgtcagccagcaagaatatgaggaaaacctgtcatga

SEQ ID NO: 4044 - DNA, 1467 bp, Xenorhabdus bovienii
  Coding sequence Name=Xb4151_4152.C441.gene145.dna; Position on contig= 108059..109525bp; Strand=+
atgaccactattaatcattggatcaacggcaagaacgttgccagtaacacctattttgaaaccaccaatcccgccaccggcgaagtgctggcgcaagtggcatccggtgggcagacagagattgatcaggcggttgcagcggcaaaagacgcttttcccaaatgggcggatacgccaatgaaagaacgtgcccgcctgatgcgccgtttaggggagttgattgaccagaatgtacccgatattgccgcgatggaaaccaaggataccggcctgcccatccaccagacgcaaaatgtgctgatcccgcgcgcttcccataatttcgatttcttcgctgagatttgccagcagatgaacgggcggacttatccggttgatgacaagatgctcaactatacgctgatccagcctgtcggggtttgtgcgctgatttctccgtggaatgtgcctttcatgactgcaacgtggaaagtggcaccgtgtctggcgctgggcaataccgccgtgctgaagatgtctgaactttccccattgaccgccaaccgtctgggcgaactggcgctggaagcgggtattccggctggtgtgctgaatgtggtgcagggatatggcaataccgccggcgatgcgctggtaaaacatcatgatgtgcgggcgatctcgtttacgggaggaaccgcaactggccgccggattatgcaaagtgcgggcctgaaaaaatattcgatggagctgggtggcaaatcccctgttctgatctttgaagatgcggatattgaacgtgcgctggattcagcgctgttcacgattttctccctcaatggcgaacgctgtaccgccggttcccgtattttcattcaagaaagtatctaccccgaattcgttaaacgctttgctgaacgcgccaatcgcctgcgtgtaggcgatccacaagatccgaatactcaggtcggtagcttaatcagtcagtcgcactgggaaaaagtctccggctatattcgtctcggtattgaagaaggagcaacgctgctggccggcggctctgataagcccgccgatctgcctgatcatctgaaaaagggtcattttctgcggccaaccgtgctggcagatgtgaataaccggatgcgcgtggcacaggaagagatcttcggccccgttgcctgtctgctgccttttaaaagtgaagaggacggcctgcgcatggccaatgatgtggaatacggtctggcgtcttatatctggacgcaggatgtcagcaaagttctgcgtctggcacgtagcattgaggccggcatggtgttcgtcaattcccagaatgttcgcgatctacgccagccgttcggcggtgtgaaagcctccggtacaggacgcgaaggcggggaatacagtcttgaagtgtttgccgaagtgaaaaacgtctgtatctcaatgggagatcatcccattcctcgttggggagtgtaa

SEQ ID NO: 4045 - DNA, 891 bp, Xenorhabdus bovienii
  Coding sequence Name=Xb4151_4152.C441.gene146.dna; Position on contig= 109577..110467bp; Strand=+
atgggaaagttagcgttagccgcgaaaattacacatgtaccctcgatgtatttatctgaaatgccgggtaaacatcatggctgccggcagggggcgattgatggtcacaaagagataagccgccgttgccatgaaatgggcgtcgatacgatcatcgtgttcgatacccactggctggtcaacagtgcctatcatatcaactgtgccggacacttttccggcatttataccagtaatgagttaccgcattttattcgcgatatgacttatgaatatgacggcaatcctgaactcggccggatgattgcggaagaagcccgccagatgggggttcgcgctcaatcacatgaaatctccagcctgaaattagaatacggcacactggttcccatgcgttatatgaacagtgaccatcatttcaaagtaatttcgatttcggccttttgtaccgttcatgcctttgaagacagccgcaagctgggtgaagccgtgttgcgggcgattgagaaatatgacggtacggtagcggtactggccagcggctcgatgtcgcacagtttcattgatgatcaacgcgccgaagaaggaatgaacagctacacccgcgagtttgatgagcagatggatcgccgagtggtgcaactttggaaggaaggtcagttcaaggagttctgcaaaatgctgccagagtatgcgcaatattgccgtggtgaaggcaatatgcacgacacagtgatgttgctcggcctgctcggttgggacaaatacgacggtaaggtggaatttctcaccgaattgttcgccagttcaggaacagggcaagtgaacgccgttttcccgctatctgatgatgcggttaatgaacaaaccaccgaaaaaatcagagcctga

SEQ ID NO: 4046 - DNA, 390 bp, Xenorhabdus bovienii
  Coding sequence Name=Xb4151_4152.C441.gene147.dna; Position on contig= 110480..110869bp; Strand=+
atgccacatttttacgctgaatgtaccgaaaatatccgtgaatccgccagattaccggcgctgtttgccaacgtgaatcaggcgctggccgagacggggattttcccgctgggcggcatccgcagccgcgcaatctggctggatacatggcaaatggcagatggcgaacaagattacgcctttgtccacatgacgctgaaaatcggcgcaggacgcagcctcgaggatcgtcaacaggtcggtgaaatgctgtttacgttaatcaaaacacactttgccgatttgatggcacagcgttatcttggactctctttcacaatggaagaacttgatccgatcctgaattataaatcgaataatgtacatcagctgtttaaatcaaaagattag

SEQ ID NO: 4047 - DNA, 1485 bp, Xenorhabdus bovienii
  Coding sequence Name=Xb4151_4152.C441.gene148.dna; Position on contig= 110933..112417bp; Strand=+
atgaccaatcatctagagacattactgctgcgccaacaggcttatatcaatggtcaatgggttgatgcgcataataaaacgacgtttgccgttatcaatcccgccaatggcgaagttattgccaatgtcagtgatatgggttgtgcagagacgcaacaagccattgaagccgcccagactgcccttcccgcatggcgggcattgactgccaagcagcgcagccaaaagcttaagcaatggttccatctaatcatggataaccaaaaatcgttagcggaactgctgagtgccgaacagggaaaaccccatgcggaagcgatgggagaaattgcctatggtgccagttttatcgaatggtttgcggaagaaggtaaacgcatttatggcgaaactatcccatcaccgatgccgggtcgtcgtctcgcgaccatcaaacagccgataggcgttgtagccgcgattacgccgtggaatttccccaatgccatgatcacccgtaaagttggcccggcactggccgcaggttgtacggttgtactgaaacctgccgcagaaactccgctgtctgcgctggcattagcagtactggctgaacaggcgggcattccggcaggtgtcctgaatattgtcaccggtatagatgccaaagcaattggcgaaacactgacttcaagccctatcgtacgcaaactctcttttaccggttctacccgtgttggcaagttactgatggcgcaaagtgccgataccgtcaagaagctttctctcgaactgggcggcaatgcgccttttattgtctttgatgatgcggatcttgatgcagctgtggaaggcgcgatggcgacgaaattccgcaacagcggacagacttgtgtcagtgccaaccggatcctggtacaagaaggcgtttatgatgcgtttgctgaacgtctggttcatgctgtcaaacaacttcgcgtcgggccgactcatagcgattcatcacaacctgtgccacaacaagggccactgattaatcaggcggctgtggaaaaaatacaggcacatatcagcgatgcggtttcccacggcgcgcgtattctggccggcggcaagtcccacaccttgggtgggttattctttgaacccaccgtgctggccgatgtggatgattccatgcgggtcagccatgaagaaaccttcggcccactggcgccgctgatcaaattccgcgatgaagcagaagccattcgcctcgccaatgatacagaatttggcctcgcggcttatttctattcccgcgatattggccggatttaccgggtggcagaagcactggaaagcggcatggtcggcatcaatgaaggtttgatttccaacgaagttgttccattcggaggcataaaacagtctggtctggggcgtgaaggttcacgttacggtatcgaagattatctagaagtgaaatatctctgttttgggggtttgggcactaaaggagcttaa

SEQ ID NO: 4048 - DNA, 813 bp, Xenorhabdus bovienii
  Coding sequence Name=Xb4151_4152.C441.gene149.dna; Position on contig= 112424..113236bp; Strand=+
atgcaacagcagctacagcaagaagtcatatcacaggttgcacgccgtttacatcaggcagaaaaaaaccggcagcagatccggcagatttcactggattacccagaaataacgattgaagacgcctacgccattcagcgtgagtgggttaacttgaaaatcgcggaaggccgggtgctcaaagggcataaaatcggcctgacatcccgagccatgcaagtcagttcacaaattgaggaaccggactatggcgcattactggatgatatgttttttcaggacggcagtgatattccctgcgagcgctttattgtgccgcgcattgaggtagagttggcctttgtgctggcaaaacccctgcgtggcccaaactgtacgctgtttgatgtctataacgccacagattacatcattccggcgctggagttgatcgatgcccgcagtcacaacatcgatcctgagacccagcgcccgcgtaaagtgttcgatacgatctctgataatgccgccaatggcggtgtcattatgggcgggcgccccatcaggccggatgagctggatctgcgctgggtcagcgccctgctctatcgtaatggggtgattgaagaatccggcgtagcggctgcggtgcttaaccatcctgccaatggtgtcgcatggttagccaataaactggctctgcacggtgtccagctcgaagctggtcagatcattcttggcggttcctttacccgcccggtgcctgcccgcaaaggcgatacttttcatgtggattacggcgcaatgggttcaattagctgccattttgtttaa

SEQ ID NO: 4049 - DNA, 807 bp, Xenorhabdus bovienii
  Coding sequence Name=Xb4151_4152.C441.gene150.dna; Position on contig= 113267..114073bp; Strand=+
atggatctgttaaccaatagatttaagcaagccctgaaagcagggcatccacaaatcggtttatggcttggcctgtgcagtggatacagcgcggaaattctggcaggagccgggttcgactggctgctgattgatggcgaacacgcgcccaatcatattccctcaatcctgacccaattgcaggcaattgcaccctatccaagccagccggttgttcgctcaccatggaacgatcaggtgcttattaagcaacttctcgatatcggcgcacagacgttgctggtgccgatgattcagaacgcggagcaagcccgcgaagccgtgcgtgcgacccgctatcctcccgccggcattcggggcgtaggcagtgcactggcaagggcttcccgctggaatcgcattcccgattatctggctcgtgccaatgatgaaatctgtgttttggtacaagtggaaactcgcgaagccctgcgcaatctgccggatattctgaccgtcgaaggtgtcgatggcgtgtttatcggccctgccgatctcagtgcagatatgggctattccggtaaccctcagcaccctgaagtcaaagcagccattgagcaggccatccgtcagatagcggcatcagacaaagccgcagggattttaatgacccatgtcgaaacggcggaacattaccttaatctgggtgcactatttgttgccgtcggggtcgatacaacgttgctgacaacagctgctaactcgctggcagcgcgcttcggcaaaaaacaggagaagataaccccgtcttcattgagcacttattaa

SEQ ID NO: 4050 - DNA, 198 bp, Xenorhabdus bovienii
  Coding sequence Name=Xb4151_4152.C441.gene151.dna; Position on contig= 114070..114267bp; Strand=-
gtgggtaagccggattttctggctcttgtatggcttcaggtgggctgctcattgtcgttaccttttttattatacgatgcgtgtcgcgtttttatggaaactggcatgaaaactgtcactgtattggcagatgctgcgattgacatctgccatgtaggaaaatcgattgtggtgttatcagtaatcagaatgatttaa

SEQ ID NO: 4051 - DNA, 1368 bp, Xenorhabdus bovienii
  Coding sequence Name=Xb4151_4152.C441.gene152.dna; Position on contig= 114216..115583bp; Strand=+
atgagcagcccacctgaagccatacaagagccagaaaatccggcttacccacctcaaaaactcaccgatcggcagcaaaacgtcatcaacaaattgttccgccgcttgatcctgtttttatttgttctatttgtgttttcctttcttgatcgcatcaatatcggctttgccggtctgacgatgggaaaagatctcggcctgtcgtctacgatgtttgggctggctgctacgctgttttacgcgacttacgtgattttcggcattcccagtaatgtgatgctcagtgttgtcggcgcccgtcgctggattgccaccatcatggtgctgtgggggatcgcttctactgccacgatgtttgccaccggcccgacaagcctgtatatcctgcgtatgctggtcggcattgcggaagcgggtttcctgccggggattctggtctacctgacttattggtttcccgcctattatcgcgcccgcgccaatgccctgtttatgatcgcgatgccggtcacaatggcgtttggctcgctggcctccggttatattctggaaatggatggcatctgggatctgcgtggctggcaatggctgtttttgctggaaggcttcccttctgttctgctcggttttgtcgtctggttctatctggatgactcaccggaaaaagctaagtggctgacgcgtgaagataaacagtgtcttcaggagatgatggagcgcgataaactttcgcaagtgcaatccagtcgcccggccagctccaaaaccagcctgtggcgtgaagtttttaccccgattgtcctgatgtatactttcgcttatttttgcctgaccaatactctgagtgccattaatatctggacgccgcaaattatgcagagtttcaatcaggggagcagtcatgtgatgatcggtctgctgactgctattccccaattctgcactatcttaggaatgatttactggagtcgccgctcagaccgtctgcaagaacggaaaatgcacactgccctgccctatctgttcgcggcagcaggctgggttttgacctcactgactgaccacagcatggtgcaactgctggggattatcatggcttccacggggtcatttacggccatggcggtattttggactacgccggatcaatccatcagcctgcgcgcccgtgccattgggatcgccgtcatcaatgccacaggtaatgtgggttctgctgtcagcccgctgttgattggctggctaaaagatcaaacgggcagtttcaactcaggtctctatttcgtcgccggactgctgattatcggggctttgatggtttcatttatcccgatgaagcaaacgcagcgttcaggggataactattga

SEQ ID NO: 4052 - DNA, 897 bp, Xenorhabdus bovienii
  Coding sequence Name=Xb4151_4152.C441.gene153.dna; Position on contig= 115583..116479bp; Strand=+
atgccagcctccaacacacgcaaagtcattattaccaatattgatatcagtaaagactatgatgaaacgcagggatctgacgatgtgcactatcagacttttggtcgcatggccgcgttctttggccgtgatatgcaggcgcatcgtcatgatggtttttttcaacttcactatctggtgaccggacggattgagctgcaactggatgaactacgctattcagtacaggcaccgctgtttatcctgacgcctccttcggttcctcacgctttctttacgcaggaagataccgatggttatgtcctgacggtgcgtcaagcattgattacgccgctgctcaattcgctctaccccacccatcgggaactggttgatattccggccatctgcctttctgtggcagataagcccgatgaattggcgacattcaatcactattgggcgctgatcgggcgtgaatctgccaatcaattcgcaggacgtgaacaatcactggcatttctggcgcaatcactgtttacctttctgctgcgcagcattccccttgatgatcaccgctctggcggggtaagaggagaactaaaactgtttcagcgttttaaccagttgattgaacagcattatcatcagcatcttgctgtaccggaatatgcggaaaaactgggaattaccgaatctcgcctcaaagatatgtgccgaaggtttgccaatcggccacccaaaaaattgatttttgaccgattattacgggaagcaaaacggctgctgctgtttagtgacagcccggtgtttgaaattgcgtatcagctgggatttaaagatccggcttattttacgcgtttttttaatcggttaatgggatgtgcaccaagtgtttggcgggagaggagtgtgtaa

SEQ ID NO: 4053 - DNA, 486 bp, Xenorhabdus bovienii
  Coding sequence Name=Xb4151_4152.C441.gene154.dna; Position on contig= 116545..117030bp; Strand=-
atgtcgttgatacgaaaagccttcaaacggttgcattaccccgttgatatcattctaagtctacgcaatctcgaagagatgatgaccgagcgagggatacgtgttgaccattctcccttataccgttgggttatcaggctcacaccattactgggtaaggcctttcgtcgacataaacgtcccgtggctcgtggctggtgtatgggtgaaacctatatcaaaatcaaaggtcagtggaaatacctgtatcgggcggtgatacctccggtcaacctattgatttttttattgaccgccaaccgagataccgctgccgctttgcgttttttccgtaaagccctacgccactacggggagcctgacatcatcacccttgataagagtggggacaacaccgccgccatcgccttgctgaatactcacaacctgaagataagatattgtcaccgacagagatgttttatcgattggctgaataaagagtaa

SEQ ID NO: 4054 - DNA, 219 bp, Xenorhabdus bovienii
  Coding sequence Name=Xb4151_4152.C441.gene155.dna; Position on contig= 117094..117312bp; Strand=-
atgaatataactgactcaggcatacatatggtgtgtcggttaaaagacggttttaatgaagaagatattattacacattgcaggcaattaaatttaggggcacaaccattatcacgctactgtattcattctttttctgataacgctattctttttggctatgccgcccatatcccaactgaaattaacgaaaatataaaacgactggcgaatttttag

SEQ ID NO: 4055 - DNA, 771 bp, Xenorhabdus bovienii
  Coding sequence Name=Xb4151_4152.C441.gene156.dna; Position on contig= 117414..118184bp; Strand=-
atggcaaagggaaacattatgaaaattaaaactcttgttgcagtagcagtttctgctgtaattctgacaggttgtaagaatattgatcatggaatgctggctagctctggaatgcaattatttcaggcggcgacgctaagtgactctgatgtcaaacagttttctgaccaagcatgtaaggatatggatgcacggaataaaactgcaccggcatccagccaatacactaaacgtctgaacaaaatcgccaaagcattaggtagcgaagttaacggcacaccggttaactataaagtttatctgactgatgatgtgaacgcatgggcaatggctaacggttgtgtacgtgtatacagcggcctgatgaaaatgatgaacgacaatgaagtcgaaggcgttctaggccatgaaatgggtcacgttgcactgggtcactcccgtaaagcaatgcagattgcttatgctacagttgctgcacgtaccgcagctacatcagccggtggtgtagctgcacaactaagcgattctcagtttgcagcactgggtgaaaaactgatcaactcgcagttctcacaacatcaggaaagtcaggctgatgacttctcttatgatctgctgaaaaaacgcaatatcaacactggaggtttagcatccggcttcgagaaactggctaaactgggcagtggtaaatccagcatgtttgattcacatccgccttcacaggagcgtgctcaacatattcgtgatcgtatcacagcagataagaaataa

SEQ ID NO: 4056 - DNA, 105 bp, Xenorhabdus bovienii
  Coding sequence Name=Xb4151_4152.C441.gene157.dna; Position on contig= 118553..118657bp; Strand=+
atgttgaagggagccagtagcgctatcagacgcatcaaggttttctttgttcttgagccaaaaacgggggcgattaccttccgtctgatccggtcatcagcataa

SEQ ID NO: 4057 - DNA, 1314 bp, Xenorhabdus bovienii
  Coding sequence Name=Xb4151_4152.C441.gene158.dna; Position on contig= 118839..120152bp; Strand=-
atgagtcaacaatggacatcccgtctggggcatgtattagcagcaaccggatctgccgttggcattggtgccatctggaaattctcgtatgtttcagcaacaaatggtggcggtgcatttctggttgtatttttattgtttagctttgtgattggattagcgattctgttagctgaaaacatactgggaagcagtacgggtgaagtggccattgatgcgtttaaaaaattacttggtaaacactgggggtgggttggctttataggtatattcagttcatggtgtatctatagcttctacagtgttgtcggtggttggaccataggttacacggtgatggcgagtacaggaaagttgaatattaccgacatttctcaactgacatctattttcaccggtttcatcagcaatccatggtggccgataatcacacatctgacattttcagggctaacctgtttcgtagtattatctggtgtgcaaaaaggtttggaaaagtcagttaaagtcatgatgccactgttattcttgatcatgatagtgttaattattgtcggcatccgtttacctggttcatcagaagggctaaaattattcttatacccagacttcagtagtttgaccggaaaaggtgttttagatgcattagggttagcatttttttcactgtctatcggtttggggatccacattacgtacagctcctatttgcctaataacaaaggcattggtaaatcgagtatctgggttgtaatcctctcctgtttggtctgtatattggctggcctgatgatttttcctgctttgtccgctgctggtttaaaacccaatgcgggacccggattaacatttatgacgatgccaatttatttcgccaatcttccaggtggctcaatcttagcagttactttctttttattattattaatggctgcactaacctcatcaatttcattacttgagcatattgttgcttatgttcaaacgcgttttcagtggtcgcgtcgtaaagcaagcttaatagtcacggcatcgattatgctaatggggatccctgtttccttatcttttggtcctctaagtcacgtcacattaggtggaaaatccatcttcgatatactggattttattacttccaatgttctcatgccattattcgggattatcatttgcctcgtatttggctggtcacgtaaggtcaatgcactaataccggataatatgtcatcgtggaaccgtcagtgtttactgtttatatggagatatgtcgggcctttatgtatcggagtgattttgatccacggacttatttga

SEQ ID NO: 4058 - DNA, 261 bp, Xenorhabdus bovienii
  Coding sequence Name=Xb4151_4152.C441.gene159.dna; Position on contig= 120120..120380bp; Strand=+
atgccccagacgggatgtccattgttgactcatgctaacccccgaatagatacagtatcagcacgtgtacttaggcccaccgccgtaagcaaaaaaccggcagcagcgttcgaaacatgcttacccgcttgcaggccagtcataggcagggaaatgatatttcctgccccgttgaatcgtgcaaaggtcataaagtccaatgcccaaatatttttagatgataaacggtatgtcataataattgttaacttattgttataa

SEQ ID NO: 4059 - DNA, 168 bp, Xenorhabdus bovienii
  Coding sequence Name=Xb4151_4152.C441.gene160.dna; Position on contig= 120457..120624bp; Strand=-
atgatcagctgtaatagagtaatcatcttggactcctcacaaggcgttagtacatgccttttagaacttaaaagtttgactggggggcagttgttggcgattctagctgttattaccactatcattctgtatattatgcgtatcagtgaatatggtacttatcactga

SEQ ID NO: 4060 - DNA, 279 bp, Xenorhabdus bovienii; identical to SEQ ID NO: 890
  Coding sequence Name=Xb4151_4152.C441.gene161.dna; Position on contig= 121366..121644bp; Strand=+

SEQ ID NO: 4061 - DNA, 171 bp, Xenorhabdus bovienii; identical to SEQ ID NO: 2071
  Coding sequence Name=Xb4151_4152.C441.gene162.dna; Position on contig= 121595..121765bp; Strand=-

SEQ ID NO: 4062 - DNA, 111 bp, Xenorhabdus bovienii
  Coding sequence Name=Xb4151_4152.C441.gene163.dna; Position on contig= 121951..122061bp; Strand=-
atgtacttatcgttacatgcccaaaaatggatttcagcttcccctctgctaattatcgcatattcattaggaacaaaattgtcgcaatggaacccaagtttacttgtgtaa

SEQ ID NO: 4063 - DNA, 1290 bp, Xenorhabdus bovienii
  Coding sequence Name=Xb4151_4152.C441.gene164.dna; Position on contig= 122686..123975bp; Strand=-
atgctcgatccaaatatgctgcgtaatgagctagacgcagtcgccgaaaaactggctcgcaggggttatactcttgatgtggagacgctgtgtaaacaagaagagcgtcgtaaagttttacaagttgaaactgaaaccctgcaagcagaacgtaattcccgatcgaaggctattggtgcagcgaaagcccgtggtgaagatattgaaccactgcgtcaggaagtgaatcagttgggagaaaaacttgatttagcgaaagctgaattggaaacattgcaggcagagatccgtgagctcgcattaagaatgcctaatattcccgatgattcttctccttatggaaaagatgacagtgataatcaggaaattagccgctggggtgagccacgccaatatggttttgaagttaaagatcatgtagcactgggtgaattaaccaacggtcttgattttgccgctgcagtaaaattgacgggttcgcgtttcgtggtaatgaaaggtcagattgctcgtctgcaccgtgcactggcacagtttatgctggatctgcataccgaacagcatggttatctggaaacttatgtaccttatctggttaatcatgaaacgctgtatggcactggtcagctgcctaaatttggtgaagatctgttccacaccaacccattggaagaagaaactggcagtaactatgccttgattccaactgcggaagtgccggttaccaaccttgtccgtggtgatattctggatgaaagtgcattgccactgaaaatgacggcgcatacaccttgtttccgctctgaagcgggttcttatggccgtgatactcgtggcctgatccgtatgcaccagtttgataaaattgaattggttcagattgcccatcctgaaaaatcaatggatgctttggaagaactgactggacatgcagaaaaagtattgcagttattaaaattgccttaccgcaagatgttgctatgtacgggtgatatgggcgcaagcgcaagaaaaacttacgatctggaagtttggctgccagcgcagaatacttaccgtgaaatctcatcatgctctaatatgtgggattttcaggctcgtcgtatgcaagcacgtttccgcagcaaagatgacaagaaaacccagttggtgcatacactgaatggttctggtctggctgtgggccgtactctggttgcagtgatggaaaactatcagcaggcagatggccgtatcgaaattccagaagtattgcgtccttatatgaaagggctggagtttattggttag

SEQ ID NO: 4064 - DNA, 1287 bp, Xenorhabdus bovienii
  Coding sequence Name=Xb4151_4152.C441.gene165.dna; Position on contig= 124095..125381bp; Strand=-
atgcggccagtcacattagatcattatatcggtcagcaacatttgctagcggaaggcaaacctttgccacgagcaatccgcgcgggtcatcttcactccatgattttgtggggaccaccgggaacggggaaaacaacgctggctgagattattggccattacgcgcaagctgatatcgagcgtatttctgcggtcacttctggtatcaaagaaattcgagaatccatagaaaaagcgagtcaaaatcgtaatgcaggtcgcaggactatcttatttgttgatgaagtccatcgatttaataaaagccagcaagatgcctttttaccgcatattgaggatggcacgatcacgtttattggtgcgacaaccgaaaatccttcctttgaattaaattcagctttgttgtcacgagcccgtgtctatttattgaaatcactgtcggcagccgaaattgagcaagtgctttttcaggctatgaatgataaagaacgtggtttcggtgggcaaaatattgtgttgcaggacgacacccgtcagatggccgcagaattggttgcgggtgatgctcgtcgttcattaaacttgctcgaaatgatgtcagatatggcggaagccaatgcacagggacaacgagttctgacaccagagttactgaaagaggtcagcggggaacggagtgcgcggtttgataataaaggtgatcggtattacgatttaatctcagcgctgcataaatcaatacgtggttcagcgccggatgctgcgctttattggtacgccagaatcattacagcaggcggtgatccgctttatgttgcccgtcgtttattggctattgcatctgaagatgtgggtaatgctgacccgcgaggcatgcaggtagctattgccgcgtgggattgttttacacgagtaggcgcggcagaaggggaacgggcgattgcacaggccattgtttatctcgcatgcgctccgaaaagcaacgcggtttatatggcattcaaggccgcgatggtggatgcgcaagataagccggattatgacgttcctgaacatttgcgcaatgcgcctaccaaactcatgaaggaaatggggtttggtgaggcataccgctatgcccatgatgaaccgaatgcttatgctgctggtgaagtttatttcccaccagaaatgcgagagacccgctattatcatccgacagccagagggctggaaggtaagatcggtgataaattaaactggctaactgaacaggatcaaaatagccagataaaacgctaccgctaa

SEQ ID NO: 4065 - DNA, 609 bp, Xenorhabdus bovienii
  Coding sequence Name=Xb4151_4152.C441.gene166.dna; Position on contig= 125449..126057bp; Strand=-
atgaaaaaactgatgttgattggttgtctgatgatgggtgtgagtgtgggtactgcatgggctgatgcctcgcaggatctacaaggtcgcttgggtaaggtgaatagctttcacgctagttttatccaaaccgtcactagtagtgatggttcagcgatccaaaacggtgaagggcaactttgggtcaaacgtcctaatttgttcaactggcacatgacagcgcctgatgagagtgtcttggtttctgatggcaaaacattgtggttctataacccctttgttgaacaagtgactgctaattggttaaaagatgctgcaggcaatacaccatttatgttgattgcccgtaatgattctgctgactggaagcaatataacgttgtacaaaatggcaataacttcgagttgacgcccagtaacgccaatggaaatttgaaacatttttcaatcactgtaacgccggaggggactatccagaaatttacagcggttgagcaagatgggcaaaaaagtgcttatcaattaaaagggcagcaaaatacccgcgttgatgaatcaaaattcaaattcaccatgccagagggcgtcacgttggatgatcagcgttag

SEQ ID NO: 4066 - DNA, 117 bp, Xenorhabdus bovienii
  Coding sequence Name=Xb4151_4152.C441.gene167.dna; Position on contig= 126000..126116bp; Strand=+
atgcagtacccacactcacacccatcatcagacaaccaatcaacatcagttttttcatgtgcgagataccttcaattcatatttattatcagcgttaatagccgataccacatttaa

SEQ ID NO: 4067 - DNA, 3336 bp, Xenorhabdus bovienii
  Coding sequence Name=Xb4151_4152.C441.gene168.dna; Position on contig= 126127..129462bp; Strand=-
ttgaaccaggaatatacagaagataaacgtgttaaattaaagaaaataagcagtagccgtcggcttctggaagccattctgttggttattgctatttgtgccgtgtactttatggtggcgcttgtcagtttcaatccctccgatcccagttggtcacaaacgtcatggaatgggcccgtccataatttcggtggcagtgttggagcctggttgtcagatatactattttcggcatttggtattcttgcctatgcagtcccgctatttatgttcttaggttgttggaatgctttccgtcagaaagataggcaagagtatgttgatttctttacgctcgcattacgcatcattggcgctttggcactggtattaacctcatgtggtctggttgctctcaatattgatgatttaaacgattttgctgctggtggtgtcatcggcaacttattcagtaaagcaattctgccgtggtttaatattcttggggcgacattagcgctgctcggtgtctgggctattgggttcacattatttacaggctggtcatggctcacgattgcggaaaaaattggtgcagttattcttgactcactcagttttatggtaaatcgcagtcgcaatgagcctgagtatggagaactggaaaacgaggttactcctgaacatctggccagcgggcaaaatcgtgctgataatgtcaacacaggtgatataggcacgacagcatctgccgctaaagctgtagaagttgacgaggatgacgtgctgttgagtgcgccaacgatggtggaactggttaaaactgattcagtgcctccagctatggatatagcgcaggaggtcggttcacctgaaaaggttcagtctgtgcagcaaaacgaaaacaggccgcaatctattgctcagaaagccattgccttaccggaatcagtacaaactgaatcggatcatgctgaagaagatcaagaacctgttccttatacatttgaactaccagctgattatcaattagatacagaatcagaattcagtaaaactgcacaatcagagttatctatagatagcactgtggcaacaaacatacagccgatagagtcgtttactttttctccgaatgataatctgaaaaatgtggctgctggtgtttctagtgctgctgttgtgatgaaaactcctcagatgaaacagggtattggccctgaaatgccgcggccgaatcccgttagaatacctacccgccgtgaattatatggtgtcaaagtaccgtctcagcgtttgtctgaacatctgcaacgggaagaaaaagagagacaaagcgatcttattgcggaaactgatgaacagcaaatggatgaacagcagcaagacacgttgcggcagcaattccttgaacagcagcgtgaacgctatggttctaattttgaagaagaaacaaaagggcctcgtgaagaaatcgctcagatacataagcaatcagcgacagccgaatttgtagagcatagtgttgatgaaccgtcggaacaggaagaggcattgcgagtggcgtttgaacagcagcagcgtgaacgttatcaaaagatccagcctgtaattccaagtcaggccgaaaagcctgcgtttgattattcttcactggctgatggttttgaaaaatctgaacctgttgagccattacccctgcaatcagagtcatcgattcattcagaacaggaaaaaagaacagtttctgtttcagggccttcccatgaatcgaaaattcagcatactgttgcgcagcaaccgcagcaaccgcagcaatcgagcctgttccatccatttttgatgcgtaatgatcaaccattgccaaagccaacaacaccgatgccttctttagatcttctgacgaaaccacccgcagaagaggagcccgtcgatatgtttgcccttgaacagatttcacgtctgattgaagcgcgcctgaatgattatcgtgtcaaagcggatgttgttgggttctcaccaggtccggttattacacgatttgagttggatttggctccaggggttaaagcttcccgtatttccaacttgtcgcgtgaccttgcccgctcactctctgcggtggcggttcgtatcgtggaagtgattccgggaaaaccttacgtaggtttggaattaccgaataaaaaacgtcatacagtttatctgcgtgaggttttggactgtgaaaaattccgcgataacccatcgccattaactatcgttttggggaaagatatcgcaggtcagccagtagttgctgatttgggtaaaatgcctcacttgctggttgcagggacgacgggatcggggaaatcagtgggggtcaacgcaatgatcctcagcattctatataaagcgaaaccggaagatgtccgctttatcatgatcgatccgaaaatgctcgaattgtcgatttatgaaggtattccgcacttattgacggaagtcgtcactgatatgaaagatgcggcgaatgcactgcgctggtgtgtgaacgaaatggagcgtcgttataagttgatgtcagctttgggcgtgcgtaatctcgccggctataacgataagatcaaacaagcggaaaatatgggacgcccgatccccgatcctttctggaaaccgggtgacagtatggatgtaactcatcctatgctgaaaaaagagccttatatcgttgtcatggttgatgaatttgctgacttgataatgacggtagggaaaaaagtggaagaattgattgcgcgtctggctcagaaagcacgcgcagcaggtattcacttggtgctggcaacacagcgtccctcagttgatatcattacagggctgattaaagccaatatcccgacgcgcatcgcatttaccgtttccagtaaaattgattctcgtaccattcttgaccaaggtggtgcagaatcattacttggcatgggggatatgctttatctggcaccaaactcttccattcctgtacgtgttcatggcgcatttgttcgcgatcaggaagttcatgaagttgtcaacgactggaaagcccgtggtcgtcctcaatatattgataatattatcaagggtggagaagacggtgaaggtggtctgggattagatagcgatgaagaattggatcccctgtttgatcaggcggttcaatttgtgaccgaaaaacgtcgggtttctatttccggtgtacaacgacagttccgcatcgggtataaccgagcagccagaattgtcgaacagatggaagcacagcagattgtcagtactcctggtcacaatggcaatcgtgaagtcttggcgcctccgccgcatgaacattga

SEQ ID NO: 4068 - DNA, 495 bp, Xenorhabdus bovienii
  Coding sequence Name=Xb4151_4152.C441.gene169.dna; Position on contig= 129595..130089bp; Strand=-
atgatagataataagaagcgtccaggaaaagatcttgatcgcatagaccgtaatatccttaacgaattgcagaaagacggccgtatttctaatgtggaattatccaaacgggttggtttatcacctactccttgtctggagcgtgtacgccgattggaacgtcagggctttatttctggttacaccgccttgttgaatcctcattatctggatgcatcgctgctggtatttgtggagattactctgaaccgtggtgcagcagatgtctttgagcagtttaatactgctgtacagaaacttgaagaaatccaagaatgtcacttagtttctggtgattttgactatttactgaaaacacgagtgccagatatgtctgcatatcgtaaattactgggcgaaaccctgctgcgacttccgggcgtcaatgacacccgcacttatgttgtcatggaagaagtgaagcagagtaaccgtttagtcattaaaactcgctaa

SEQ ID NO: 4069 - DNA, 108 bp, Xenorhabdus bovienii
  Coding sequence Name=Xb4151_4152.C441.gene170.dna; Position on contig= 130046..130153bp; Strand=+
atgcgatcaagatcttttcctggacgcttcttattatctatcatcttattgctctctctttatattcctacacccataacattttccctatctctctcaagcagttga

SEQ ID NO: 4070 - DNA, 96 bp, Xenorhabdus bovienii
  Coding sequence Name=Xb4151_4152.C441.gene171.dna; Position on contig= 130662..130757bp; Strand=-
atgataagtttactgtgtttggctgtgctcatgaatacctcatttccattatcgcatattgcggatttggggattgtaggagaaataataagttaa

SEQ ID NO: 4071 - DNA, 960 bp, Xenorhabdus bovienii
  Coding sequence Name=Xb4151_4152.C441.gene172.dna; Position on contig= 130726..131685bp; Strand=+
atgagcacagccaaacacagtaaacttatcattcttggctcaggtcctgctggttataccgccgctgtttatgcagcccgcgctaatttaaaccccgtccttattacaggggttgaaaaaggcggccaattgaccaccacgactgaagttgaaaactggcccggtgatcctgaagggctgacaggtccagatttaatggaacgtatgttccagcacgctgaaaaatttcaaacagaaattatttctgaccatattcagaaagtcgatttcgaaaaaaaaccattccgtctttatggagatgatcaggaatatacctgcgatgctttgatcatcgcgacaggtgcttctgcccgttatctgggtctcccttccgaagacgctttcaaaggtcgtggcgtatctgcctgtgcaacatgtgatggtttcttctatcgtaagcaaaaagttgctgtagttggtggtggcaataccgccgttgaagaagcactatatcttgcgaacattgcagccgaagtccatctcattcaccgccgtgatactttccgttcagaaaagatcctcattgaccgcctgatggagaaagtcaagaatggtaatatcattctgcacaccgatagaactttagatgaggtgctgggcgatgatatgggtgtgactggcattcgtattcacgatacgaaaagtgataatgcagaagagctggatgttactggtgtcttcattgctatcggacacagtccaaacacaggtatctttgaaggacagcttgatctgcaaaacggatatattaaagtccagtccggcctgcatggaaatgccacccagacttctattccgggagtatttgccgccggggatgtcatggatcatgtttatcgccaagccatcacctcagcaggtacaggctgtatggctgcactggatgctgaacgttttcttgatggattggcaactaaataa

SEQ ID NO: 4072 - DNA, 174 bp, Xenorhabdus bovienii
  Coding sequence Name=Xb4151_4152.C441.gene173.dna; Position on contig= 131617..131790bp; Strand=-
atgatacaatgtatcaaaaaggctggtgatactgtttgccagcggccaaaccttatgttccctgttaaaaagcgctaccgaaatagcgccttaaggaaagagggtttatttagttgccaatccatcaagaaaacgttcagcatccagtgcagccatacagcctgtacctgctga

SEQ ID NO: 4073 - DNA, 1770 bp, Xenorhabdus bovienii
  Coding sequence Name=Xb4151_4152.C441.gene174.dna; Position on contig= 131816..133585bp; Strand=+
atggacaaaacaagacaatctgaacttgttcgatggctaagacagcaaagtgcgcctgcccgtcggtggcttcggctatccatgctacttggcctcattagcggattactaatcatctctcaagcttggcttctggcgtcaatccttcaagcactaatcatggataatatcccccgcgaaaatctcatcgttcagtttctgatgctgatcgccgcctttacattgcgggcaattgtcagtgctattcgagagcgtatcggttttatctgtggcaaggttgtacgccaacaaatccgcagtatggttttggataaactggcacaattggggccggtttgggtcaaaggaaaacccgccggaagctgggctacgattatcttggaacaaattgaagatatgcaggatttttattcccgctatctgccccaaatggcgcttgcaacgattatccctctcttaatcctgatgactgtctttcctgtcaactgggctgcagggttaattttactcgtcacagccccattaattcccctttttatgacattggttggattaggggccgctgacgccaatcgacgcaattttgtcgcgctcagtcgtttaagcggcaatttccttgatcgtttacggggtctggaaactctacgcgtgttccatcgcggggaagccgaagttaagcaacttaccgaatcgacagacaatttccgtcacagaacgatggaagtactgcgcatggcatttttatcgtctgctgtgctggagttttttgctgcggtttccattgcggttgttgccgtttattttggtttttcttatttgggagaattacattttggtagttatggtctgggtgtcacgttgtttgcaggcttcctcgctctgatcctcgctcctgaattctttcagccactgcgcgatttgggtacgttttatcatgcaaaagcccaggctgtcggtgccgcagagtcactttttaccctgctcagcagtgagggagaacactctgtattcaacggcgaaagaatgctgccagatacaaaatcagtgactattgaagcaaacgaactggaaatccggtcacacgatggtcatcgtcttgcgggtcccttgagcttcacgattgaccaacatcagcggattgcattggttgggaaaagtggtgcagggaaaagctcactgatcaatctattactcggattcctaccctatcgcggctctttgaaaatcaatggaatcgagctacgtgagctgaatctaaccaaatggcgtgagcaattaagctgggttggacaaaatccacacctgccagaacagacgctgctcgataatatccgtcttggtcaatttgacgcaacacaagaccagattaatgatgttatggaacaggcttatgtcagcgagtttatttatgctcttcctgacggcgtgaatacagtcattggtgacaatgctgcccgtttatctgttggacaagctcaacgcatcgccgtagcacgggcattattgaatccctgtcagttattgttgttggatgagccagcagccagtcttgacgcccatagcgaacaacgtgtgatgatggcattaaatcaggcatctagtcagcaaaccacactgctggtcactcacctgttagaagaaacactggaatatgaccagatttgggtaatggaaaacgggttaatcattgagaaaggccattatcagagtttaagccaatctcaaggggcattttcccgtctgttgtctcatcgcagcgtggagctttaa

SEQ ID NO: 4074 - DNA, 1743 bp, Xenorhabdus bovienii
  Coding sequence Name=Xb4151_4152.C441.gene175.dna; Position on contig= 133588..135330bp; Strand=+
atgcgtatattactcccatttctcgcactctatcgccgccactggtttctcatcagcttaggcatggtattagcgattgtaaccctgttagccagtattggcttgctgacgctttccggctggtttcttgccggtacagccttggcaggattcgcggggttatatacgttcaattatatgctgccagccgctggcgtccgtggtgcagctattttccgtactgctggccgttatggtgaacgactggtcagtcatgatgctacttttcgcgtattagcccatctacgcgtttttgcctttcagaaaattttaccgctttctccgggaggcatcgcccgttttcgtcaaggcgagctgctgaatagaatcgttgcggatgtcgaaacgcttgatcacctctatctgcgagttatctcccctgtcctttcagcgttggttgtgattgttgttctgacttttggcttgagttttcttgatgtcaccctcgcatataccctaggcgggattatgctggggctactgataatattgccttttgggttttatcatgcaggaaagccttatggcagagacatcaccctactacgcggtcaatatcgtacattactcactagcgcgttgcagggacaggcggagttaacagtgtttggcgcactcgggcgttttcgacaatcaatgacagacgttgaatccgattggctgaaatgccaacaacagcaagccaacctgacggggctttctcaagccgttatgattttcgctacaggcataacagtgactctgctactttggctggcagcagcaggtgtaggggaacatagccaacccggagcactgatagctctatttgcgttctgtgctctcgctgctttcgaagctcttggacccgtcacagtagcatttcagcatatgggacaggttatctcatctgcaacccgtgtttctcagttaatgcatcaggagccagaagtcactttccctgctcatgggccacaaacgactgatagcctcaatcttgagataaaaaatattgatttcacctatcctgaacaacctctgccagtattgaagaatatttcactgtccctggcatctggcgagcatatcgcactattggggaaaacagggtgcggtaaatcgacacttttacagttactgagccgtgcatggaatgttgatcacggcgaaattcagctcaatcaacaacctatttcccagtatgatgaaaccacgctgcgatcaatgatgtctatcgttcctcagcggatacatgtcttcagccataccctgcgtgaaaacctcttgctagccaaaccggatgccagcgatgatgagttagtaatcgtactcaaacaagtgggtttagggaacttgctagacaataatgaaaagctaaactgttggatgggtgaaggtgggcgccagctttccggtggggaacaacgccgtttggggattgccagagcgttgttacacaatgcaccattaatgctgctggatgagccgacagaggggctggatgccgatactgaacaacagattctgtctctgttacgccacagttgccagcacaagacactgattgtggttacccatcgattaacaggtttacagcatttggatcgtatctgtgttatggatgagggacgcatcattgagcaaggcaaacatgatgtgttgctggctcagcaggggcgttactatcaattctatcagcgacagagctatcctgagcaggagtaa

SEQ ID NO: 4075 - DNA, 690 bp, Xenorhabdus bovienii
  Coding sequence Name=Xb4151_4152.C441.gene176.dna; Position on contig= 135339..136028bp; Strand=+
atgacgatagctcaactgggtaactcatatgcatttcctcatccaacccatgcgctggctgaaccaaatggtttactagcatttggcggtgatctatgcgcagagcgtttaagggtagcttatcacgaaggtattttcccttggttttcccctgatgagcttcccctatggtggtcacccgacccccgagcggttctaattccgggtgaattacatactggacgtacgctacgtcgttttattcgcaaacttccttaccaaattacggtaaactatgctttcgatcaggtgatatatggttgtgcccaacggcaagaaggcacttggatcgggtctgatgttcagaaaggttatcaggctctacatcaagaaggtctggctcattcaattgaagtctggcatgactgccaacttgtaggtggtttatatgggattaatgtaggtacgctattttgcggagaatcgatgtttagcaaaatggagaatgcatctaagtgtgcttttgtggcattctaccaccactttttacatcatggtggccaattattggattgtcaggtactaaatcaccatacgaaatcattaggcgcaaaaaatattccaaggaaagaatttctccagcatctttacttatgcagagagcaatcattgcaggcaggatgctgggctgctcaaatgctggatttatag

SEQ ID NO: 4076 - DNA, 129 bp, Xenorhabdus bovienii
  Coding sequence Name=Xb4151_4152.C441.gene177.dna; Position on contig= 136010..136138bp; Strand=-
atgccgaaaaaccctcattatgtaaaggaatgtcgtattttaaaccatcattttcctcataatggatatcgacattcccgccgtgaacagcataaatcactagattttgactataaatccagcatttga

SEQ ID NO: 4077 - DNA, 219 bp, Xenorhabdus bovienii
  Coding sequence Name=Xb4151_4152.C441.gene178.dna; Position on contig= 136184..136402bp; Strand=+
atggccaaagaagacaatattgaaatgcaaggtactgtgttagacacactgccaaacaccatgttccgtgtcgaattggaaaatggacacgtcgttactgctcacatttcaggcaaaatgcgtaaaaactatattcgcatcctgactggagacaaggttacagttgagctaaccccatatgacctgagcaaaggccgtatcgtcttccgtagccgctga

SEQ ID NO: 4078 - DNA, 2286 bp, Xenorhabdus bovienii
  Coding sequence Name=Xb4151_4152.C441.gene179.dna; Position on contig= 136514..138799bp; Strand=-
atgctcaatcaagaactggagcttagtctcaacattgcttttgccaaagcaagggataacagacatgaatttatgactgtagagcacctattgctggcgttgttaagcaatacatcagcgcgaggagcactggaggcttgtaaagtcgatctggtgatgttacgccaggaattggaaaattttatcgcacaaacaacccctttgttatcagagaatgatgacagagatacacaacctacgttgagtttccaacgtgtattacagcgtgcagtgtttcatgttcagtcttcggggcgttcagaagtttctgggtcgaatgtcttggttgctattttcagtgaacaggagtcccaggctgcttatttactgcgaaagcatgatgtgagccgtctggatatcgtgaatttcatttcacatggaacgcgcaaagatgagtctgataatgagtctcatcacagtgtcaatccgattcaggaggaacaggtgataaatgaagatcgactggaaaatttcactaccaacctgaatcaattggcacaaaaagggcagattgatccgcttgtcggacgtcagcatgaattggaaagaacggttcaggtattatgccgccgccgtaaaaacaaccctttatttgtgggggagtcaggtgttggcaagaccgccattgctgaggggcttgcatggcgtattgtgcaaaaagatgttcctgaggttattaaggattgcacaatctattcgttggatattggttcattgctggcgggtactaagtatcgaggtgattttgagaagcgcttcaaatctttgttaaaaacgttagagcaagacagcaaaagtattctctttatcgacgaaatccataccattattggtgcaggtgctgcttcgggggggcaggtggatgcggctaacctgattaagccgctgttgtccagtggtcgcattcgggtgattggctcaacgacttatcacgaattcagtaatatttttgagaaagatcgagcgctggctcgccgattccagaagatagacattcttgaaccttcttctgaggaaacggtgcagattatcaatggattgcgtactaaatatgaggcgcaccatgatgttcgttatactgcaaaagccattcgtgctgcggttgagctgtctgtgaaatatattacagatcgccacctgccggataaagccattgatgttattgatgaagcgggagcgagaacaagattggtgccggctagtcgtcgcaaaaaaacgattaacgttgccgacattgaatctgtagtggctcgtattgcccgtattccagaaaaaacggtttcagccagtgacaaagatgtattgagaacactggatgatcgtttgaagatgctggttttcggtcaggataaagcaatcggggtactgacggaagccattaagatgagccgtgccggattggggcaggaacataaaccagtggggtctttcctgtttgcaggacccacgggggtcggtaagacggaagttactctccagctcgctaaaatgcttaatataaaattactgcggtttgatatgtctgaatatatggaacgccataccgtcagtcgtttgattggtgcaccaccaggttatgtgggatacgatcagggcggtttattgacagatgctattatcaaacatccacattcagtgttgttgctggatgagattgagaaggctcatcctgacgtgttcaacttgctgctacaggtcatggataatggcacattgacagataacaatggccgcaaggctgatttccgcaatgtgattctggtgatgacaaccaacgcaggggtacgtgagatacagcgtaagtccattggttttactgagcaggataacagcatagatggaatggaagagatcaaacggatcttcacacctgaattccgtaaccgtctcgatggtatcatctggtttgatgcactttccgctgaagtcattcaactggttgttgataaattcatcgttgaactgcaagcacaactggatgaaaaaggtgtttctctggaagtaagtgcagatgcccgtcagtggttatgtgataaaggctatgacagagcgatgggcgcacgtccaatgactcgggtgattcaggacaatctcaagaaaccattggcgaatgaactgttgtttggttcgttgatacatggaggttcggttaggattaatcttgataaagacaaacgggcactgatatacgatttcaaaagtgcacaaaagtcgagtaaaaagaaatcggaagatgcggtgctataa

SEQ ID NO: 4079 - DNA, 321 bp, Xenorhabdus bovienii
  Coding sequence Name=Xb4151_4152.C441.gene180.dna; Position on contig= 138831..139151bp; Strand=-
atgagtgagttttataacagtttgaaaattgaagaattaattgaagataaaacagagcaaacgttacagccaccatcaatgtataaggtgattcttaacaatgacgactatacccctatggagtttgtggttgacgtattgcgaaagttcttttcttatgatgttgaacgagcaacgcaactcatgctggatatccattaccaaggtaaggcaatttgcgggatttatacggcagaggtggcagaaactaaagctgcgcaagtgaatatgtatgctaaagagcacgagcatccgttactttgctcgctggagaaggtctga

SEQ ID NO: 4080 - DNA, 192 bp, Xenorhabdus bovienii
  Coding sequence Name=Xb4151_4152.C441.gene181.dna; Position on contig= 139232..139423bp; Strand=+
atgaagcactctgcttatcccctctttgatctctggataaagaatccgcctaaaaatcggatatcgttatctatatcaaactttcgctatttgagacagcttgaggttatttctgtgcttgacggcgtaatgaatttcactacagtatattttatgagcaccgccctggctgggcatctgctcatatcctga

SEQ ID NO: 4081 - DNA, 231 bp, Xenorhabdus bovienii
  Coding sequence Name=Xb4151_4152.C441.gene182.dna; Position on contig= 139475..139705bp; Strand=+
atggaaacaggtactgtgaaatggttcaataatgcaaagggctttggatttatttgtccggccagcggaggcgatgacatattcgctcactattcaaccattcagatggatggttataggacgctgaaagctgggcaaaaagtgaacttcagtattcatcaaggccccaaaggcaaccatgccagccttattgttcctctggaagatgactcgaaatcaaaaaaagagtga

SEQ ID NO: 4082 - DNA, 909 bp, Xenorhabdus bovienii
  Coding sequence Name=Xb4151_4152.C441.gene183.dna; Position on contig= 140276..141184bp; Strand=+
atgtattcagggttgctaattgttctcataccattaattctaggctaccttattcgtctgaataataaaacggcgctggccacagttcattacctacttaatatcataatttatgtcattctcttcctgatgggcgtcagactcgccatgctggaaaatctgggcaataatctactctctatcctgctgtatgcgatgacatttttcttatgcatatttgcgactaacttgctggcacttatcctattggataaacgggatccgtggattattcaagtcaataagcaggaaaaatcgccttctcaattacatatggtttttgattccatcaagttatgtggtgcattaatatcaggatttttactcgggctgacaaactggtcattgttgaattttgccgatcatgccagtgaaattgccttgattcttttactgcttctggttggtattcaactgcgcaataacggaatgagtttaaaacaaacgctgttgaatcgccgtggcaccattatcgctctggtcgtcgctataagctccctgttgggtggcattatcgccgcatttttactgggattaccgaccaaaaccggtcttgccatcgcatctgggtatggctggtactctctttctggtattttactctctaacgcttatggctcggtgattggcagtactgcattcttcaatgatctagcccgtgagttggcatcaattctgctcattccgatgctcatcaatcgttatcgctcaacagcgttggggttaaccggagctgcatcaatagactttacattaccaatattacaacgctgtggtggcataagtatcgtaccagcagccattgttcacggttttatattgagcttgatgacgcccgtatttattgcattttttactcaacaggcttag

SEQ ID NO: 4083 - DNA, 162 bp, Xenorhabdus bovienii
  Coding sequence Name=Xb4151_4152.C441.gene184.dna; Position on contig= 141315..141476bp; Strand=+
atgataataacaattttatgcagatattattgcatagttattcttatgagattaatatccctccaacctattaactattcatatttatcgcatgagcattcaattaaaaaacataaattgtttctatggaacgcatcaggccctgttcgatatcaattttga

SEQ ID NO: 4084 - DNA, 729 bp, Xenorhabdus bovienii
  Coding sequence Name=Xb4151_4152.C441.gene185.dna; Position on contig= 141406..142134bp; Strand=+
atgagcattcaattaaaaaacataaattgtttctatggaacgcatcaggccctgttcgatatcaattttgaatgtacatcaggagaaactgtggttctgttgggcccgagtggtgctggcaaaagctctttactgcgagtgcttaatctattggagatgcctcgttctgggcaactaagcgtggcaacacatcagtttgatttcaaacagcagccaggcgccaaggaaatacgaacactgcggcaaaaagttggcatggtttttcaacaatacaacctatggccacacctaactgtgatggataacttgattgaagccccctgccgcgtattaggtctacccagacagcaggctcgggaaaaagcagcaaaactgctggctcgtcttcgtttggatgaattttccaaccgttttccacaacacctgtctggcggacagcaacagcgtgtcgctattgcacgggcattaatgatggaaccccagattctgctgtttgatgaaccaaccgctgcacttgatcctgaaattacatctcaagtcatcaatatcatcaaagaactggcaggaactggtattacccaaattatcgtgacacacgaagtggaacttgcacgtaaggcagcaacacatattgtgtatatggagaaaggccacatcattgaaaaaggtgacgcaagtcattttttaaaacccaaaacagaagcctttgctcattatttgtcacactag

SEQ ID NO: 4085 - DNA, 744 bp, Xenorhabdus bovienii
  Coding sequence Name=Xb4151_4152.C441.gene186.dna; Position on contig= 142224..142967bp; Strand=+
atgaaaaaattattgtttgctgccttattaaccgcaatgactttgtctacatctgcaaccgcagcagaaaaagaaacgctgcgctttgctacagaagcaacctatcctccgtttgaatttattgatgcaaacaataaaattcaagggttcgatgtagatttagcgaatgctatttgcgcgaaaatcaacacagagtgcacattcaccaatcaagctttcgatagcctcattcccagcctgaaattccgccgttttgatgcattgatggcaggcattgatattacgcccgaccgccgtaaacaagttgatttcactcatacctattatgataactctgccgtttttattgccatcaaaggaaaatttactcattctgccgatctgaaaagcaagcaagtgggaatacagaatggtacgacacatcagaaatatttgatggaacagcataaagagatcaaaaccgtaccttatgacagttatcagaatgcgatccttgatctgaaaaatggccgtattgatgctgtattcggtgatactgccgttgccaatgaatggctgaagaagaataaagaattaggctctgtcggcgacaaagttactgacaaagattactttggcattggtttaggaattgcagttcgtaaaggtaatacagctttgctggataagctgaacaaagcactggctgaagtcaaacaagatggtacttataactccatctataaaaaatggtttgaacaataa

SEQ ID NO: 4086 - DNA, 777 bp, Xenorhabdus bovienii
  Coding sequence Name=Xb4151_4152.C441.gene187.dna; Position on contig= 142924..143700bp; Strand=+
atggtacttataactccatctataaaaaatggtttgaacaataacagaatcctaatgagtgaacttcaatctttaattaacgccgctggtattaccatcggccttgctgtttcttctcttgtcattggcttaattctggcaatgctttttgccgcttgggaatcagccggctggaaaccctttgctttcttaggctcttgttgggtcacattgatcagaggattgcctgaaattctggttgtcctctttatctatttcggaagttcacagcttctcataacgctgtcagaaggctttgatgtcaatctcattgtttggcaattcagaatccagatggaaattgacaactttgatgtcagccctttcctttgtggtgttatcgccctttctctactttactccgcatacgcatcacaaacactgcgaggcgcattgaaagcagtcccaatggggcaacgggaagccggacaagcactcgggttaagtcaaagccgtatattttttcgtctgactatgccgcagatgtggcgccatgcattgccagggcttggcaatcagtggttggttctactgaaagatactgctttagtttcactgatcagtgttaatgatctgatgttgcaaacgaaaagtatcgcgactcgcacacaggagccatttacatggtatgtgattgccgccatgatctatctggtgattactctggtgagccaatttattctcaaacggcttgaaatgcgcgccattcattttgaacggagtgcttccgatgtttga

SEQ ID NO: 4087 - DNA, 669 bp, Xenorhabdus bovienii
  Coding sequence Name=Xb4151_4152.C441.gene188.dna; Position on contig= 143693..144361bp; Strand=+
atgtttgagtatataaaggatatcttacctggcctgcaaactagcctaagcttgactgtcaccgcattactggctgcatttatactgtctgtggttctgaccttcattttaacaatgaggttgccgatactatcccaattggtaaaaggctatatcacgttatttaccggaacgccgttactggttcagttcttcttgatttactacggacccggacaatttccctcaataaaagagtacccttggttatggcaactcatgtcagagccgtggctatgtgccatggtgacactggccttgaacagtgcagcctattcaacccaacttttttatggcgccgttagggcaatccctactgggcaatggcaatcctgtcaggctcttggtatgtcaaaaacccattccatgcgcattctgctgccttatgccttcaaacgagcgctttcttcctattccaatgaagttgtcttgattttcaagagtacttctctagccagtacgatcacactgctggatatcatgggatatagccaacttcaattcgggcgtagttatgatgtgactgtatttgttgctgctggggtcatttatctttgcgtaaatgctcttctgacactgctgatgcgcataattgagcgtcgagccttatcatttgagcaacgccattaa

SEQ ID NO: 4088 - DNA, 1134 bp, Xenorhabdus bovienii
  Coding sequence Name=Xb4151_4152.C441.gene189.dna; Position on contig= 144449..145582bp; Strand=-
atgcaatgtgcgcagtataccgcggggcattgtcactcctgccagtggctcaataagtcctattcacaacaattatctgataaacaacaacatttacagcagcttttacgggagacgtcagcaacgtactggctgcctccagtcagcagcctgatcagtggatttcgtaataaggccaagatggtggtaagtggcagtgttgaacgcccacagcttggcatgcttcaccgtgatggcagaacggtggatctttgtgattgtcctttgtatccacaatattttcagctggtatttgaatcgataaaaatatttatcgctaaagctgggttggttccgtataacgttgcacgtaaaaaaggggaattgaaatatattctgctgacagaaagccgtgccagcggtgaaatgatgctgcgttttgtcctgcgctcagaaacaaaactggctcagttggaacatgctttgccgtggttacaggaacaactaccacaattgacggttatttctgccaatattcaaccgactcatatggcgattttggaaggggaaaaagaagtcatttttactgagcataagatgctgaaggaaatcttcaacggaattccgctgtatattcgtccccgtagttttttccagacaaatccagaaattgcttcggcgctttatgcgacggctggtcgttgggtcagagagctgaatatcagcagcatgtgggatctcttttgtggagcaggaggttttgggctgcactgtgcagacaaagaaaccagactgacagggattgagattagtgcagaggccattgcctgtgccaaaaactcggccaaaagtcttggtcttgagcaggttgaatttcaggcattggattctacacattttgcccttgataaagcgcaactccctgaactggtgctggtgaatcctcctcgcaggggaattggtaaggcgttatgcgaatacctcagtcggatggcacctaaatttattctctattcaagttgtaatgctgaaacaatggcaaaagatattgctgcgcttgagcaatatcgaatagaaaaagtgcaattattcgatatgttcccccatacagaacattatgaaacgctggcgttactgatctttgatggaaagtaa

SEQ ID NO: 4089 - DNA, 585 bp, Xenorhabdus bovienii
  Coding sequence Name=Xb4151_4152.C441.gene190.dna; Position on contig= 145607..146191bp; Strand=-
ttgttgctattggcaaggtgtttccttcagatagcatgtacaactttttggtcatatgaggttgattcgatggattctatggttgttccaaatttggtaacattgcgtaactggcttgaacgcctcaaaatttcttattttgagagtgattcaaattcggtcttgcatttgcctcatatgcagaacattgatggcctgtttgatgccaagattgatctgttgggtgacgtagtgctgttttctgctctggcagaagtcaggccaacggcgataattccattggctgcaaacttgagccagattaatgcgagttccctcactgccaaagtgttccttgatattcaggacgaaaacttaccgaagttgatagtttgtcaggcatttcctattgccgctggtatgactttcccgcagttttcccatttcttgcagcaaagtgaggagcagattgccaatgtgatttttgaaattcacagcaataatttcctttatattaataatgatatggaaagcgagatggaagtagaagtggaagatgaggaatcattggcttcgacggaaacatcgacatttaccttgcactaa

SEQ ID NO: 4090 - DNA, 312 bp, Xenorhabdus bovienii
  Coding sequence Name=Xb4151_4152.C441.gene191.dna; Position on contig= 146206..146517bp; Strand=-
atgaagaaaatctcaacaaaagagatgagctcgttgtcagatatgccaaagctggttattttattagaagtattgggaatcggcttgttggttttggcgtatttgtcgataactgatagcataattctatcacctttattaatgacgacagaagcgcacattgctatgatcttattgggtataggttgcttgatacctgcagctatccatattatctggcgtgcagtctataatctttcttttttaggaattgatcataagaaagtagataaaaatcatctgactggttctgatgatgaaaaaacaaaatag

SEQ ID NO: 4091 - DNA, 264 bp, Xenorhabdus bovienii
  Coding sequence Name=Xb4151_4152.C441.gene192.dna; Position on contig= 146713..146976bp; Strand=+
atgtatactgtcatttttggtcgcccaagttgcccatattgcgttcgcgccaaagaattggctgaaaaattaaaagcagagcgcgacgactttgattaccgctatattgatatctgggctgaaggcatcaccaaagacgacttgtcaaaaactgtggggaaacccgttgaaaccgttcctcagattttccttgatgagaaacatatcggcggctttactgattttgaagcttacgctaaagaacatctgaacttgtacaaataa

SEQ ID NO: 4092 - DNA, 117 bp, Xenorhabdus bovienii
  Coding sequence Name=Xb4151_4152.C441.gene193.dna; Position on contig= 146943..147059bp; Strand=-
atgtggatcttagtcaatattatgagcctgccactatccagaagaaagcatcgatatttctggctggatagtgaattttatggttatttgtacaagttcagatgttctttagcgtaa

SEQ ID NO: 4093 - DNA, 858 bp, Xenorhabdus bovienii
  Coding sequence Name=Xb4151_4152.C441.gene194.dna; Position on contig= 147191..148048bp; Strand=+
ttggttaaagactatcgggtttttttatttgtcactgtgttatctacagtacagagggcatctaaatcacctttttttgctatcatcggcatattatttactcacttagcatcaacaatcgttaaatatcatggtgaattaaagcaaaaatcctttactgaatcgcattataaaattactatttttaacaatgacttgataacgctcgtttatcatatttgcgtcaatatcacgcttgtgaggcttactttgctagaacaacttaatcacaatgtgtttacttttatcaatgcaacaccggattcatcacctgcaatgattttactggcgatctttgtagcaaaatatcttgtgtttattttccccataacattagctgtttgctggctttggggagaagaaaaagccatctcacatcaacgtattgttgtcagtaaatcctgtattgcttttgcctttgcaatagcctgttcggatatcatcggaacatttgttccacacgcccggccgtttgtagaaggttttggttataattttctctatcatgcccctacagcctcttttcccagtaatcacggtacagcagtctttaccttcgcgttagcatttaccttctggcatcgtatccggtcaggtttatgcctgatgatcatcgcctgcgtgattgtatgggccagagtctacgtaggggttcattggccaatagatatgatcggcgcatttctagtcagcttgatgggttgtgctttttcgcaaatattctggcgcttatatggtgagtattggcacagtaaactcattcgcctttaccaattctgctgtgcatttttcatccggaaaggatggataaaaaattaa

SEQ ID NO: 4094 - DNA, 1308 bp, Xenorhabdus bovienii
  Coding sequence Name=Xb4151_4152.C441.gene195.dna; Position on contig= 149017..150324bp; Strand=+
atggacacgtctcaatcaggttctatcgcagcctctgctgcttccggcaaaagcgattatactacctggcgtaaatcagacactgtatggatgttggggttatatggcactgccattggtgctggagttctgtttcttcccataaacgccggtattggtggtttaattccactcatcatcatgacactacttgcacttccgatgacattttttgctcaccgtggaatgtgtcgttttgtcttgtccggcaaaaagaatggcgaagatatcaccggcgtggtagaagagcatttcggtaaagtcgcaggtttcctgatcactatcctctacttctttgcaatttatcctatcttactagtttatagtgttgcactgaccaacaccgtaaacagctttattactcaccagttacatatgaacgcaccaccgcgcgcattgctggcactggtactgatccttggtgtgatgagcattattcgcttcggtgagcaatttatcgtcaaagcaatgagcgtactggtcttcccatttgtcgcagttctgatgctgctagcgctgtatttaatcccacactggaataccacaatcttcgataccctgtcactggagaatgcgctgtcttccacaagcggtcatggtttgctgtttactctgtggctggctattcctgtcatggtgttctctttcaatcattctccaatcatctctgcatttgccgtagcaaaacgcgaagagtacggtgaagatgcggagaaaaaatgttcgcgcattctgggttatgctcacatcatgatggtgattaccgtcatgttctttgttttcagttgcgtactgagtctgtcaccggaaaatctggcagaagcaaaagcacagaatattactatcctgtcctatctggccaaccattttagtgcaccaacgattgaatacattgctccgctcattgccttcattgcaattaccaaatcgttcctcggtcactatctgggtgctcgcgaaggtttcaacggtatcgtgaacaaggctcttagcacacaaggcaaaactattcagcataattcactgaatcgtatcactagcctctttatgttagtcagcgcctggatcgtggctactcttaacccgagtatcctagacatcatccaatccctgggtgggccaataattgccatgattttgttcatcatgccaatgtacgctattcacaaagtgccagccatgcgcaaatatgctggtaaaccaagcaatgtctttgtggttgtgacaggattaattgccatttctgcggctgtttactcagtcatgtaa

SEQ ID NO: 4095 - DNA, 117 bp, Xenorhabdus bovienii
  Coding sequence Name=Xb4151_4152.C441.gene196.dna; Position on contig= 150309..150425bp; Strand=-
atgtatagtcttcggataaataggaaaatgccagtcaattgtgaggttggctggcattttttatggggctgttgttatagaaaactgctcctgagccttgattacatgactgagtaa

SEQ ID NO: 4096 - DNA, 1206 bp, Xenorhabdus bovienii
  Coding sequence Name=Xb4151_4152.C441.gene197.dna; Position on contig= 150458..151663bp; Strand=-
atgaaaaaaagacggcaagtacagataatcaaatcttttactgttggcttgggtattttttggttgatgggtgtcaacacatacgcaatggatgaacccgcagcacctgaaattgatgcgaaatcctatatattgatggattacgccagtggaaaaattctggcatcccataatcccgatgaacggctagatccagcgagtctgacaaaggtgatgaccagctatgttgttggtcagtcgattaagtcgggaaagatttctacagaagatcaggtaaccgtaggtaaagatgcttgggcaaccggcaatccggcgcttaaagggtcatccctgatgtttttgaaaccgggtgatcgggtcaaagtcattgatttgaaccgtggcattgtgatccaatctggcaacgatgccagtattgcccttgcggattatgtagcgggcagtcaggatgctttcgttgatttgatgaataaatactctaaaactctggggctggaaaatacccatttcaagactgttcacggtctggatgctgcgggacaatacagcactgctcgtgatatggcgctcttaagtcaggctatgatccgtgatgtgccagaagaatatgctctaaataaagagaaagaattcactttcaataatatccgtcaacctaaccgcaatcgcctgttgtggaatcagaatatgaatgtggatggtgtaaaaaccggacataccagcggggcaggatataaccttgttgcttctgcagcggaagggtcaatgcgtttgatttcagttgtactgggagcgcctagtgatcgaatgcgtttctctgacagtgaaaagatcctgtcatggggattccgtttttatgaagccagtactccgcttaaagccagtgacacactggtgacagaaagagtatggttcggtacgcgttcagaggtggctttaggtgtagaaaaagatacggccgtgacggtgccgcgaggtcaagcgaataacctgaaagccagttttacgctgacccaaacttcacttgaagcgccattggcgaagaatcaagttgtgggcactgtgaatttttcgttgaatgataaggttattgatcaacgtcctttggttgttaaagaagccgtagaagagagtggattttttgggcgtatttgggatttaattgtgaagactgtcagcggctggtttaactcaattttcggatag

SEQ ID NO: 4097 - DNA, 624 bp, Xenorhabdus bovienii
  Coding sequence Name=Xb4151_4152.C441.gene198.dna; Position on contig= 151828..152451bp; Strand=+
atgatgctgacaatctggggccgtaaaagctcatcaaacgtaaaaaaagtcacttggtgtctggaagagttaaacgtgccatatcagcaaattgatgttggtggtaagtttggcaaacttaatactccagaatacctgctcatgaatcccaatgccgtcattccctgtttgcaggaagacgattttatcttatgggaatcaaacacgattgtgcgctatatttcggcaaaattcggcgaaaatagtctttatcctgccaatcttcaagaaagagccaaaattgatcaatggatggattgggtcggctgcaatttcttcccgccaatcaaacaacttatgattaacattgtcagaacaccagaagatcagcgtgacccgaaagtgattgcccagatattaaaagagatagaaaaactgctgaaaattgtcgatgacatgctgggtaagcaaaaatacctttccggtgataaatttggcatggcggatatcgccctcgcgccactggtctatccgtggctaaacatcgagatagagcgtccatctctgccaaatttggaacgctggtatcaattactaaccgaaagaccagcgtttcaaaaaatcgttatgattgaaataagctga

SEQ ID NO: 4098 - DNA, 834 bp, Xenorhabdus bovienii
  Coding sequence Name=Xb4151_4152.C441.gene199.dna; Position on contig= 152455..153288bp; Strand=-
atggtgaaaaaagtttccatcatcggattgggttggctgggaatgccgttagcgcaaattttgcaaggctatggtatgcaagtggtcggtagtaaaacaacagcggatggtgtcgaagcggcacgtatgtgtggtataggttgccatttattgaatctgacccctcagataatctgtgaagcggatgatcttgagcagctgatgtcagtggatgtactggtgctaacactacctgttagcggtattgcggggggtggagaaggatatgtcaaagcggtgcagttaattgtcgatactgcgctttcgcattcggttcctcatattattttcaccagctcaacttcagtttatggctcgtctgtcggccatctgaatgaagatgctccgttatttcctgagacgcgatctgccaaggcgctggttgaattggaaaactggctgcatcgactgccaaatacttctgttgatatcgtgcgtttggcaggtttggtcggcagtggtcgccatgcagggcgtttccttgcggggcggaaagcgattgagggtggagaaaaggtggtcaatctagtccatcaggatgatgttatttctgctattaaacgccttattgagcagcagaaaggagggcatatttataatctgtgtgcgccagaacatccgaaaagagagaaattttatttgcaggccagccgtcagctcgatttgactccgccagagtttctacagtcagaggttcagggaacagcgggtaaagttgttgacggtagccgtatttgtcgggaactaggttttgagtatcaattcccagatcccggcagaatgccaatgagctga

SEQ ID NO: 4099 - DNA, 291 bp, Xenorhabdus bovienii
  Coding sequence Name=Xb4151_4152.C441.gene200.dna; Position on contig= 153557..153847bp; Strand=-
atgggcatattttctgcgaatgcaatcaggcgctgttgctgcaagttgattttgatgccacagcgagccagtagtgcacgagaatcatcactgaggcggccggatttctgcatggctatccgtaagcgtgttttatctagcatgttatgttttaccctatctcaatattcaatatataaatcgtataaattggcaataaaaaaaaccctcggaaaatcttccgagggtttttttatcgtactcatgccaccggaagacttgctaaatgtcttccagcacacaacagcctga

SEQ ID NO: 4100 - DNA, 900 bp, Xenorhabdus bovienii
  Coding sequence Name=Xb4151_4152.C441.gene201.dna; Position on contig= 153705..154604bp; Strand=+
atgctagataaaacacgcttacggatagccatgcagaaatccggccgcctcagtgatgattctcgtgcactactggctcgctgtggcatcaaaatcaacttgcagcaacagcgcctgattgcattcgcagaaaatatgcccatcgacattctgcgtgtccgcgatgatgatattccgggtcttgttatggatggtgttgtcgatttaggcattatcggtgaaaacgtacttgaagaagaacaattaaaccgtcgggcgcaaggggaggatccccgttataacacattgcgccgtcttgattttggtgattgccgtctttcccttgccgctcctttcgactatgactataccggcgtggaatgcctgcaaaactcccgtatcgccacgtcttacccacacttactgaaacgttatttagataaaaaaggcgttcccttcaaatcctgccttctcaacggttcagttgaagtcgctccccgagcaggattggctgatgctatctgtgatttggtctcaacgggcgccacactggaagccaacggtctgcgggaagttgaagtcatctatcgctcaaaagcctgcttgatccaacgcgatggtgagatgccggaagccaaacaacaactcatcgacaagctgatgatccgcatccaaggcgttattcaggcgcgtgaatccaaatatatcatgctacatgctccaagcgacaaactggaagaaattatcgcgttacttccgggtgctgaacgtcccaccattttaccactggcgggggcacagaaccgtctagccatgcatatggtcagcagtgaaaccctattctgggaaacgatggaaaaacttaagtctctgggcgcaagttccattttggttttaccgattgaaaaaatgatggagtaa

SEQ ID NO: 4101 - DNA, 1317 bp, Xenorhabdus bovienii
  Coding sequence Name=Xb4151_4152.C441.gene202.dna; Position on contig= 154610..155926bp; Strand=+
atgagtatcaattttaagaccgttatccgctggcaggaatgcccaccagaacagcaaaaagcgttgctgacacgccctgctgtcgtcgcttcagaaaatatttcccgcacggtaaaacagattctggaaacggtcaaagccaacggcgatgaagcattgcaggaattcagccaacgcttcgacaaaacaacaatcgatactatcccgctttctacaagtgaagttaacgcagccgccagccgcctgacaccagaaatcaaacaggctatgcagcaggccatgaataacattcgcctgttccatgaagcccaaaaacccgctgtgattgaggttgaaaccctgccgggtgttcgctgccagcaagtcacacgcccaatcgattctgtggggttatatattcccggaggttctgcgcctctgccttccactgtattaatgctgggaatacccgctggcatcgcagagtgccgtaacgttattctgtgctccccacccccgattgccgatgaaattctctatgccgcacagctctgcgggattaacgaaatatttcaggttggcggcgcacaagccatcgcagcaatggcttttggcacagaatccgttcctaaagtggacaagatttttggcccgggtaatgcatgggtaacagaggctaaacggcaagtgagtcagcgcttcgacggtgcagccatagatatgccagcaggtccatcagaagtactggtaatagcggacagtggagccaatcccgcatttacggcagcagatctgctttcacaagcagagcatggccctgattctcaagtcgtgctggtcacacctgacgaaatttttgccgagcaggtgatccgtgaaatcgaaacccaacttacggccctgccacgccagcaaatcgcgattcaggctctgcaatccagccggattatcgtcactgacaatctgacccaatgtgtagcgatcagcaatcaatacggccctgaacacttaattatccaaacccgtcagcctgagcagcttgtggaaaaaatcaccagcgcaggttcggttttcctcggagactggtcgccagaatccgcaggagactatgcttcaggcaccaatcacgtcttgccgacctatggttatacttcaacctattccagcctcggtctggcagatttcctgaaacgaatgacggttcagcaaattacaccgcaaggattaagaagcctcgctccaatcatcgaaacactggcgcaggcagaacaactcaccgcgcacaaaaatgccgtcacattacgcatagctgccctgaataactcagatgttgaataa

SEQ ID NO: 4102 - DNA, 1110 bp, Xenorhabdus bovienii
  Coding sequence Name=Xb4151_4152.C441.gene203.dna; Position on contig= 155942..157051bp; Strand=+
atgatgagtactgtttttaatgtcaattcactggcaagagaaaatgtccgcaaattagtcccttatatgtctgcccgccgtttaggtggcaaaggtgacatctggttaaatgctaatgaatatcccatcgcacctgattttcagttcagcgaaaaaacgctcaaccgctaccccgaatgccagcctgcctccgtaatccagcgctatgcagattatgctggtctgcaaccgaatcaagtccttgtcagccgtggcgccgacgaatccattgaactattgatccgcgttttctgtgagccgggaaaagacgccgtactgttctgccctcccacttatggcatgtacagtgtcagtgcagaaacctttggtgtagagcagaaaaagatccccacccgtgctgactggcagccggacattaccgccatcgaaaataatctggatcgcgtcaaactgatttatatctgtagccccaacaatcccacgggtaatctgattgctcctgcggcgctgcgccagatccttgaactagctcgtaaccgtgccattgttgccattgacgaagcctatatcgaattctgtccgcaacatactaccacccgctggctgcgagactatccgcacttggtgattttgcgaaccctctcgaaagctttcgcactggcaggactacgctgtggatttacgctggcttctcccgatattatcgcgctaatgttgaaagtgattgctccttatccacttgctatacctgtggcagacatcgctgcgcaggcactgacaggagcaggcattcatataatgaaagatcgtgtagaggaagtggtcaagaaccggacttatctccagcagacattgaatgaactggcaatggtcgaaaaagtgtttccgagcgaagccaactatcttttagtgaaatttaccgatgcggaaatcgtattcagggcattgtgggaacaagggatcattttgcgtgatcagcgaaaacaagcgggactaaataattgcctgcgtatcaccattggtagccgaaatgagtgtaaacagttggtcaatgccatcgctgctcttggtagccaaactcaaccactaaaggaagctgaaaatccatga

SEQ ID NO: 4103 - DNA, 1068 bp, Xenorhabdus bovienii
  Coding sequence Name=Xb4151_4152.C441.gene204.dna; Position on contig= 157048..158115bp; Strand=+
atgagccagaaactgctttttattgaccgtgatggaacgttaatcacagaacctccgaccgattaccaagtcgatcgccttgataaattggcctttgaagctggtgtgatccctgccctgttatccctgcaaaaagcgggttacaaactggtcatgatcaccaatcaggatggattggggactgatagcttcccccagaccgattttgagccaccacacgcactgatgatgcaaattttcacttcgcaaggcattcagtttgaagaagttatgatctgtcctcacaaacccgaagacaattgcaactgccgcaaacccaagctcgggttggtggaaaaatatctaacagaaggcatggtagatatgaaaaacagttacgttatcggggatcgggaaaccgacttacaattggctgaaaacatgggaattaaaggaattctctatcaagcccaatcacttggttggtcaacgatttgtgagcaactgacccacaaagatcgtcatgccagcgttgaacgtaaaaccagagaaactggtatcaatatcgatatctggctggatcgcgaaggtagaagcgaaatcaatactggcgtgggtttctttgatcacatgctggatcagattgccacccacggcggtttccgcatgaatatacaggttaagggcgatctctgtattgatgatcaccacaccgttgaagatactggattggccttaggtgaagctctgaagcaagcattgggcgataaacgcggcattgcccgttttggcttcacattaccgatggatgaatgcctcgcccgctgtgctctggatatttccggtcggccccatctcgaatacaaagcagagtttaaacatcagcgtgttggagatttaagtactgagatgatcgaacactttttccgttcactttcttatacgatgggatgcaccttacacctgaaaaccaaaggtaagaatgatcatcatcgggcagaaagcctgttcaaagtctttggtcggacattgcggcaggccattcgcatagaaggtgatgttctgcccagttctaagggcgtactataa

SEQ ID NO: 4104 - DNA, 609 bp, Xenorhabdus bovienii
  Coding sequence Name=Xb4151_4152.C441.gene205.dna; Position on contig= 158125..158733bp; Strand=+
atgatggaagttgttattttggatacaggctgtgccaatcttgcctctgttacttatgccatccgccggttgggttatgatcccatcgtcagtctggatgcggatattgtgcgatcagccgataaactgtttctgccgggagtagggacagcaatggccgcaatggatcaactccagcaacggcaactgatcccactgattatttcactcactcaacccgtactgggtatttgcctcggcatgcagcttctggcggcaatcagtgaagaaagcaatagtgaaacaaacgataatgtctccttgctggcattaattgatgcccccgtcaaaaaaatggcgaccgccggcctgccattaccccacatgggttggaatcaagtaaaagcgcaggccggacatcccctgttttgccatattgaagacaatgcccatttttattttgttcatagttacgctctgcctgtcggtgaatacaccattgcccaaacggaatatggcaattccttcagcagtgccattgcaaaagacaatttttttggtgtgcagtttcaccctgaacgctctggcacagcaggttcacaactactgaaaaactttttggagatgtaa

SEQ ID NO: 4105 - DNA, 738 bp, Xenorhabdus bovienii
  Coding sequence Name=Xb4151_4152.C441.gene206.dna; Position on contig= 158738..159475bp; Strand=+
atgattatcgccgcattagatttaattgatggcaatgtggtgcgtttgcatcaaggggattacaaccagcaacggacttatggcaattcacctttgtcctacctgcaacaatatgaaaaagaaggcgctaagttgctgcacctcgtagatctcaccggcgcgaaagatcccaccaagcgccagatgatcttgctgcgtgaattgctggctggcgtttctgttccagtgcaagtgggcggtggaatccgttcggaaaacgatatcaaatcactccttgaggccggagctagtcgggttgtgattggttcaaccgcgatcacacagccggaattagtcaagcaatggtttcagcgttatggtgcagaatcaattgtactggcactcgatatccgcatcagtacagatggcgctaaacaaatcgccatcagtggctggcaggaaaacagtaataccactcttgagcagattgttgagcaatatctccccgttgggctgaaacatgttttatgtaccgatatttcccgtgacggcacactaaacggctctaatatcgcactctatcaggagatcagtcagcactatccacagattcaatttcaggcatcgggcgggatcggcaacctcgctgatatttctctcttaccgacgactggcgttgcgggcgttatcgtcggacgggcattacttgaaggaaaattcacactgacggaggctatccaatgttggcaaaacgcataa

SEQ ID NO: 4106 - DNA, 777 bp, Xenorhabdus bovienii
  Coding sequence Name=Xb4151_4152.C441.gene207.dna; Position on contig= 159457..160233bp; Strand=+
atgttggcaaaacgcataattccttgccttgatgttcgtgatgggcaagtggtcaagggagtacaattccgtaaccacgaaatcatcggtgatatcgttccacttgcacagcgctatgcccaagagggagctgatgaactcgttttttacgacatcaccgcttcttcagatggtcgtgtggtagataaaagctgggtggcgaaagtcgccgaagtgatcgatattccattctgcgtcgcaggaggtatcaaaactaccgaagaagctggccagattttatcatttggtgccgataaaatttcgattaactcccctgctctggctgatccttcattaatcagtcggttggccgatcgttatggcgttcaatgtgtagtaatcggcattgatacgtggtttgatgaaaatagcaacagctatcgggtctatcaatttactggtgatgaaaaacgcacaactgcaacacaatggcaaacacgggattgggtcagggaagtacagcaacgtggcgcgggtgaaatcgtcctgaacatgatgaatcaggatggtgtccgcaatggctatgatcttacccaactgaaattggttcgggatatctgctccgtccctttggtcgcttccggcggtgcgggtacgccagaacattttttggatgcatttaaactggctaatgttgacggtgccttggctgcctccgtatttcacaaacagatcatcaatatcggtgagctcaagcaatatcttgctacacagggtgtcgaggttagaacatgttaa

SEQ ID NO: 4107 - DNA, 621 bp, Xenorhabdus bovienii
  Coding sequence Name=Xb4151_4152.C441.gene208.dna; Position on contig= 160227..160847bp; Strand=+
atgttaacagcacagcaaatcgaaaaactggattggaaaaaagtggataatctcatgcccgttatcgtccagcacgctgtatccggtgtggtgctaatgatgggttacatgaataaagaggcacttaatgccacactggattccggtaaagtcacctttttttcccgcaccaaacagcggttatggacaaagggcgaaagttccggccacttcctgaatctggttgatatctatcccgattgtgacaacgataccctgctcgccctcgtcaatccgattggctcaacctgccatacaggaaccgagagctgttttgcaccagcgcaaactgaatggggcttcctctaccaactcgaacaactactggcaagccggaaaaatgccccaccggctagctcttatactgcccgtctgtatgccagcggcacaaagcggattgcccaaaaggtcggtgaggaaggcatagaaaccgcactggcagctacagttaatgatcgggaagaactgaccagcgaagctgctgatttgatttaccatctgctggttttattacaagatcaagatttggatctcagttgtatcatccgccaattgcagaaaaggcatacagccaaagaataa

SEQ ID NO: 4108 - DNA, 144 bp, Xenorhabdus bovienii
  Coding sequence Name=Xb4151_4152.C441.gene209.dna; Position on contig= 161020..161163bp; Strand=-
ttggaaaatgccatctggtttgccaaagagacaggaaccaccgtattgattgaagccacatcgaatcaagtcaatcagcccggctgtgtgcggtcgctgaacatagctggcaggaacacggtggcgaagtgcctgtctacgtga

SEQ ID NO: 4109 - DNA, 147 bp, Xenorhabdus bovienii
  Coding sequence Name=Xb4151_4152.C441.gene210.dna; Position on contig= 161115..161261bp; Strand=-
ttggagatacaacgcaatcgctattacaacttatccatcgccataaatccggcgaggcaggtggcgtttactctgtctgttcggcacacctctgagtattggaaaatgccatctggtttgccaaagagacaggaaccaccgtattga

SEQ ID NO: 4110 - DNA, 174 bp, Xenorhabdus bovienii
  Coding sequence Name=Xb4151_4152.C441.gene211.dna; Position on contig= 161277..161450bp; Strand=-
atgcttgtggttttaccaacccgattcaggcatcacacgaagagattgtggctatttttaaagcggcaatgtaactcgatgaatattgccatttatatggcaatattcaagaaagaaatcactttctcaaacacagagctagacccgctacttgaagacgctcagtttttttaa

SEQ ID NO: 4111 - DNA, 1152 bp, Xenorhabdus bovienii
  Coding sequence Name=Xb4151_4152.C441.gene212.dna; Position on contig= 161377..162528bp; Strand=-
atggcagtatcaactttctttatcccgccagtgaataaaatcggtatgggatgcatgactgaagccattgaattaatgaaaaattatggctacagacaggctttgattgtcactgaccgagtgttaaacgagattggtgttgttggagaggttcagaatttactggctgaagcagggataaagagtgcgatttatgatgggacgaatccaaatccgaccactattaatgttgaagaagggctaaccatcctgcgccagcatgattgtgattgcattatttctttgggaggcggttcaccgcatgactgtgcaaaagggatcgcgctggtggcggctaacggtggggatatccgtgactacgaaggcgttgatcgttctgttaaacctcaattgccattgattgccattaacaccacagcgggtaccgcctctgaaatgacgcgtttctgtatcattacagatgttgatcgtcatatcaaaatggctattgtggataaaaatgtgacgcctattttgtcagtcaatgattcggcattgatggccggtatgccggaaggactcactgctgcaaccggcatggatgcgctgactcatgccattgaagcctacgtttctacggcagccaatcctatcactgatgcctgtgcgttgaaagcagtgacgatgattagcgactatttgcgccgtgccgttgcaaatggcaatgatatggaagcgcgtgagaatatggcttatgcacagtttttggcaggtatggcattcaataatgcctctttgggttacgttcatgccatggcacatcagttaggtggtttttatgatttgccgcatggtgtttgcaatgcagtattgctgccacacgtacaaaaattcaatgcaaaagtatctgcatctcgcctgaaagagattgctgctgtaatgggagctgatattgccaacttgaacgatcggcagggtgcagaagcctgtatccaagaaatcagcaaattagcaaaagatgtcaatattccggcggggttgtccgaattaagtgtcaaaattgaagacttgccaatgttggcaagcaatgcgttaaaagatgcttgtggttttaccaacccgattcaggcatcacacgaagagattgtggctatttttaaagcggcaatgtaa

SEQ ID NO: 4112 - DNA, 123 bp, Xenorhabdus bovienii
  Coding sequence Name=Xb4151_4152.C441.gene213.dna; Position on contig= 162473..162595bp; Strand=+
atgcatcccataccgattttattcactggcgggataaagaaagttgatactgccattcggaactccttaggtttcactgaagtatttcaaatcttgatgcaaaaaaggtgggttacaatgtga

SEQ ID NO: 4113 - DNA, 159 bp, Xenorhabdus bovienii
  Coding sequence Name=Xb4151_4152.C441.gene214.dna; Position on contig= 162743..162901bp; Strand=+
atgttaattagatcatatggcgattattatatgaataatatttctacattgataatagttgtatttttgattatcagctttgtgctaattgttagcctcgatccagaggtagcacacttcattgaaaaatttgctgaaaggctgatacaaaaaagttga

SEQ ID NO: 4114 - DNA, 1407 bp, Xenorhabdus bovienii
  Coding sequence Name=Xb4151_4152.C441.gene215.dna; Position on contig= 163024..164430bp; Strand=-
atgtccaaacaacagatcggtgttgtcggtatggcggttatggggcgtaatctggcgttgaatatagaaagccgtggttactctgtatccattttcaaccgctccagcgataaaactgatgaagttattgctgaaaatccagggaaaaaattagttccaagttattccattgaagagtttgtcggttcactggaaaagccacgtcgtattctgttgatggtcaaggcaggtgaagctacggataaaaccattgcatcgctgacgccacatttggataagggtgacattctgatcgatggtggcaatacctattttcaggatactattcgccgcaaccgtgagttgtctgctcagggttttaactttatcggtacaggtgtttccggtggggaagaaggtgcattgaaaggcccgtcaatcatgccgggcggtcagaaagaggcttatgagctggttgcgcctattctgaaagagattgctgccaaagttgatggtgagccttgtgttacttatatcggtgcagacggagcaggccattatgtgaagatggttcacaatggtattgaatatggcgatatgcaactgattgcagaagcgtattctctgctgaaacactccttgaatctgagtaaccaggaactggcggatgtgttcagtgactggaaccaaggtgaactgagcagctatttgatcgaaattaccgctgatatcttccgtaagaaagatgaagaaggtcaatatctggttgatgtcattctggatgaagctgccaataaaggtacgggtaaatggactagccaaagttctctggatctgggtgttccagtaacactaattaccgaatccgtatttgctcgttacatttcctctctgaaagatcagcgtgttgctgcctctaaagttctgtcagggccagaagcccagccattcaatggtgacaaggcagaatttattgagaaagttcgccgtgccttgtatttgggtaaaatcgtttcttacgctcaaggcttccagcagttgaaagcgtcttcggatgattacaactgggatctgaattatggcgaaattgctaagatcttccgtgcaggttgtatcattcgtgcgcagttcctgcaaaaaatcacaaatgcatacaatgagaacgcggctatcgccaacctgctgttagcaccttacttcaagcaagttgcggatgagtatcagcaagccctgcgcgatgtggtttcttatggtgtccagaatggtattccaacgccaacattctctgcggctatttcatattacgacagctatcgttcagcggttttgcctgcaaacctgattcaggctcagcgcgattatttcggtgcgcatacctataagcggactgataaagaaggcgtgttccacactgaatggttagattaa

SEQ ID NO: 4115 - DNA, 117 bp, Xenorhabdus bovienii
  Coding sequence Name=Xb4151_4152.C441.gene216.dna; Position on contig= 164469..164585bp; Strand=+
atgcctaactcaacactatgtcaatcaaataatgtcatatacaacaaaattacagtgggcaatttgttaatgagatcacatgttaactcaggaataggcttcaggggtagttattga

SEQ ID NO: 4116 - DNA, 1581 bp, Xenorhabdus bovienii
  Coding sequence Name=Xb4151_4152.C441.gene217.dna; Position on contig= 164725..166305bp; Strand=+
atggaatggatcgctgatcctacgatatgggccggtttggccacacttatcgttttagaaattgttctcggaattgacaacttaatatttattgccattctggcagacaaacttcctgaaaaacagagagacaaagctcgcctgacaggtctgacctgtgctctggtcatgagattgctcctgttattcagcctttcttggcttatttcactgacaactccattactaactttatggaatcatcctttcagcgcccgcgatttaattatgctgatagggggaatattcttgctgttcaaggctacaatggagttaaatgagcggttggaaggtaaaatgctacataacaaccaacagcgcaaaggtgcaaatttttgggctgttgttgtgcagattatcgttttggatgccgtcttctcgctggattctgtcattactgctgtgggtatggtcaatcacattggcaccatgatggctgctgtcatcattgccatgattctgatgatatgggccagcaagccgctgacgaaatttgttaatgctcatccgaccattgttatcctgtgtctcagcttcctgctgatgatcggtttcagtctggtggctgaaggctttggctatgttattccgaaaggctatctctatgccgccatcggcttctcgatcatgatcgaagcactgaaccagttttcccaattcaatcgccgtcggttcctgagtgcttcccgctccttgcgcgaaagaaccgcagaggctgtacttcacattttaaatggcaaacgtgaaaacgccgatctggacaatcatgcttccaatctgatcgcggatcatgaagatcataaagccgtctttgaaccgcaggaacgccatatgatcgcccgtgttctcagcatggcgcaacgtacagtcagcagtatcatgacctcccgccacgatgtggtttacctcgatatccatgcaccaactggaaaattgacaacgttactggaaaagcaaccgcatacacgaattgtagtaacggatgagcaagccagtgacgaaccactcggcgtagtgcatgttattgatatcctcaatcaacaactgactcataagtcatttgatttacggaaactggtgcaacagcctctgatcttccctgaatcactctccctgcttcaggcgctggagcagttccgtcaggcacagacgcacttcgcctttgttgttgatgaattcggttccgttgaaggtgtggtcacagtgactgacgtgatggaaaccattacaggcaatctgccggcaggcggtggagagatcgacgcccgccatgatattcaggtaacggaagagggatactggatcgccaatggatttatgccactggatgacctggtgctctatgttccattgctattggatggaaagcgcgagtaccagacactggctggcttgttgatggaagacctacagcgtgttccacaacaaggtgagcagttacagatcggcgaatatctgtttgaaccgctcgaagtaatcagccaccgcatcaataaagtgaaaatcacatccctgaaaacggaagaaaaaatagaagcataa

SEQ ID NO: 4117 - DNA, 261 bp, Xenorhabdus bovienii
  Coding sequence Name=Xb4151_4152.C441.gene218.dna; Position on contig= 166541..166801bp; Strand=-
atgcaaaatattttgtactcatataaaaccctcattttatcaacaataaatagacgtattgctaacccagccacaggaaattttgttaaaaagttcccgggcaatatgaaggcggtggtgacttctccgcccatgagtaaatcatcaaacctgctcattaacactggagagcacatcttgtgcgtgaatttcctgtcgtggagtgtggtcagtgtcaaaactacctaccacgacacacatccccccgtgatatctgtttga

SEQ ID NO: 4118 - DNA, 3228 bp, Xenorhabdus bovienii
  Coding sequence Name=Xb4151_4152.C441.gene219.dna; Position on contig= 166780..170007bp; Strand=+
atgagtacaaaatattttgcattactgacacatgcaggcactagtaaactggaaaatgctgcgacatcgggtacaaaacttgagattacccatatggccgttggtgatggcggtggcagcttacccatcccaaacgtcacccaatccaaactgattaatgaaaagcatcgcgctgaaattgatgtactgaccattgaccccaaaaaacccaacctgattatcgccgaacaggtgcttcctgagggtcaaggtgactggtggatccgcgaaatcggtctgtttgacaaggatggaacgctggttgccgtcggaaactgtgcagatctctacaaacctcaattgcaggaacagaccgttagcatggcgctacccgtcagcaactcagattggactggctgggtaaacgagctattttctggtctggcaacacgcaattacgtgagagaaaaaattaaagatcatgccgaaagccgcaatcacccagatgcaacattgaaagaaaagggtcttgtcactttgagtaacgcggtagatagtgacaatgaaactcatgctgcaacatcaaaagcggtaagaacaacccatgctctggctgaaactgccaataagaatgcaacctccgcaattcaaagcgctgacagtaaagtgcccttgacccgcaaggtaaatggcaaagaactgttaacagacattgaactgaccgcacttgatgtaaatgcctacaacagagcggaaaccgacgagcttatcggcatagttaaaaaacagactgataccgctaaccaaaatgcgactgctgccctccaaagtgctgacagcaaagtccccttaacccgcaaagtaaataacaaagagctgctaactgacattgatctgaacgcggcggatgtcggtacttataataagtcggaaattgatgctcatatcaataaagttgagcaattggctgataccgccaataaaaatgcgacttccgctattcaaaacgctgacaacaaagtgccattaacccgcaaggtaaatggcaaagaactattaacagatattgaactaaacgcgactgatatcggtacctataacaaggtggaaatcaatgagcatatcagcaaagttgagaagctagctgaaaccgccaaccagaatgccacgaccgcgattcagaatgccgacagcaaagtgccattaacccgtaaagtcaatggcaaagagctgtcagccgatattcaactgaatgcggcggatatcggtgcctataccaaagtagaaactgacgatcatatcaataacgttaaaactcaggtcggtaatgtcaataagctggctgaaaccgccaaccataacgccaccaccgcgatccaaagtgccgacaacaaagtgccgttaacccgtaaagttaatgacaaagagctgtcagccgatattaaactgagcgcggctgatgtcaatgcctatagtcaaaaagaaactgacgaccgtatcagtgacgtcaagactcaggttggtaatgtcaataagctggctgaaaccgccaaccataacgccaccaccgcgatccaaagtgctgacaacaaagtgccgttaacccgtaaagttaatgacaaagagctgtcagccgatattaaactgagcgcggctgatgtcaatgcctatagtcaaaaagaaactgacgaccgtatcagtgacgtcaagactcaggttggtaatgtcaataagctggctgaaaccgccaaccataacgccaccaccgcgatccaaagtgctgacaacaaagtgccgttaacccgtaaagttaatgacaaagagctgtcagccgatattaaactggacgcggcagatgttggtgcctacaacaaagtagaaactgacacacatattaataacgtcaaagttctggctgaaaccgccaaccagaatgccacgaccgcgactcagaatgccgacagcaaagtgccgttaatccgtaaagtcaatggcaaagagctgttaactgacattgagctgagtgcggctgatatcggtacctataacagaactgaaatcgatgatcgtatcaacaaagttgacaaactggctgaaaccgccaatcaaaatgccacttctgccattcaaagtgccggcagcaaagtgccactcattcgcaaagttaatggcaaggaactgtcaaccgatattcaactgattgcggatgatgttggtgcctataacaagaaggaaaccgatgatcgtatcaacatagttgataaactcgctgatactgccaataagaatgctatttctgccattcaaaatgttgacagcaaagtgccattaaatcgcaaagtaaacggcagagaactgtcaacagatattgaactgaccgcgactgatatcgatgtctataacaaagcagatgtcaacattcttttcgaggatgctaaagaactggcaaataatgcaaataacaacgcggataacaaagtaccattaactcgcacagtaaatggtaaatccttgttaacagacattaaactgcaagcatctgacctcaatgtctatagcaaaggagaggttgatagtcgcatcgacgatgttaaggaactggcaaatagcgcaaataataatgcggatagccgagtgccgttaactcgtacagtgaatggcaaggcgctgttatcggacattaaacttatagcatctgatgtaagcgcttatactaaagcggaaactgatctccgtatcagtaaagttgaagacttggctaagagcgccaataataacgccagcggccgactggagaaaggccaaaacggggcggatatcccagacaagaaagcgtttgtaaaaaatcttggcctgtccgatctcattgggttaggtatagaatcccgtcgagtcggaacagatgtcaccataatcaagcttggtgatatcatcaagatcaacggactcgcagtagctagtgaaccgattggtgaagttaattcattcgttatcggtggggttacatactatacccactactacaaaatacagctaccaatcagcttgccaaacggcataatttcatgccatgcaagtattgtcgggagtaattttgataatcaacaaccgggttaccttgctgatgtaaaaacacagcggaataatccaaatggagtaggagtgtcgaaagatacattgacaatatctgtcacaacgccgcaggttggctgggttcctcacttcgattatcaggttatagggtattaa

SEQ ID NO: 4119 - DNA, 1860 bp, Xenorhabdus bovienii
  Coding sequence Name=Xb4151_4152.C441.gene220.dna; Position on contig= 170209..172068bp; Strand=-
atgaaaagattgttgacgacactcgttattttgttagtagtcattgttgctggtttagctgcgttagttgtgctgattaatccgaatgattttcgtagctacatagtcgaacaggtacaaaagaagagtggttatcatctcgtgttacaggatgatttgcgctggcatatctggccaaaactgagcattctgactgggcagatatcactaacggcatctgatgctgaaatacctgcggtggtggcagagaacatgcgtttggatgtcgaattactgccgctgttatcccaccagtttgtagtcaaagaagtgatgctgaaaggtgcagttttgcgatttatgccggacagccagccgcagaaacaggctgaagccccgattgcgccgaaaagtgatatccaatatccggtggcagggggtcaaggttggaaactggatattgccagaatcaaggtagcggatagcttactggtctggcaaactgatactgattcccaattaaatatccgtgatatcaattttctgatggagcggaaggatcaggatcacgtgaatcttgaattcagcagcaagatcaataaaaaccagcaggaactggcattcgaattcaatacttccgttgatatttctgattatccgcagcgcttggcggctgatgtcagttcgctcaaatatcaactgaagggagtcggagtaccgtctgagggcatcaaagggacaggcagtgttagcttagcgtaccaatcatctccttcatccatttcgctacaaaaactggcattaacggtaaatgaaagcgaacttaacggcaatattgctgttaaattgcaaaataagccgcaatacaccatcaacctgagttcgccaaaactgaatttagataatcttctgggatgggatgcattaccgcaaaatgatttgcaggcaaggcatgattatcgaattgaaaacagtttattgaaaccggtgattgcgacgtctgtttcaccattatcaaattatgatctgagtttactgaaagcgtttgaggccaatctttcgtttgtggcggataaggttatttatcagggcatggatattgataattttgtcttgaaagctgtcaatgatgatggaatggcagaaatcttgaaattgagcggcgatgtatttggtgggcattttgcgctccccacgacgattgatgccacggttaacccagctaaattacatactaaaccgctcttacaaaatatagagctgaaaccactgttgacggctctggctctgccacccgtattcagtgggcaacttgaactggatggtgatcttctgggggaaggctatgatgaatatgctatcacccattactggcagggtgatctgaatattggcttggaaaatgcgcgtttggagggattgaacattcctcagcttattcagcagtctttttcgagggcgactgaccaagttaatcagccagagagtactgatgattttacagaagcaaaaaatatgtctgtcagagcgcaattgaatcaaggtgagctcaaggttgataacctttctgcgatatcgggaatgttaaatatcacagggcagggcaaggcgaatttgctgaaacaaaacacagatatgtcgttgtgggtgcaattgacaggcggctggggaaaacaaaacgaatttgtgcgtaatctacagaaattaaaagtgcccctgcgggtttatggtaattgggataacctgcaatataagctcgatgttgaagcattgctgagtgatgaattacagaaaaaagccaaacaatccatcagaaattggattgaacagaatagtcgtgctgaagatcgtaaggaatttgagaatttattgaataaatga

SEQ ID NO: 4120 - DNA, 582 bp, Xenorhabdus bovienii
  Coding sequence Name=Xb4151_4152.C441.gene221.dna; Position on contig= 172118..172699bp; Strand=-
atgcgactctgtgaccgtgacattattaaatggattgatgaaggtaaattggtaattaccccgcgtccccctgttgaacgtataaatggggcaactgctgatgtgtgccttgggaatcagtttcgcgtttttcgtggtcatactgctgcctacattgatttgagtggccccaaagcggaggtcaatgcagcacttgatcgtgtcatgagcgatgaaatcgttttgccggagggagaagttttcttcctccatcccggcgaacttgcattggcggtaacgctggaatcggtcacactacccgataatctggttggctggctggatgggcgttcatctctagcgcgtctcggcctgatggtacatgtcactgcccatcggattgatccaggctggcatggtcaaattgttttggaattttataactcaggcaaattacctttggcgttgcgcccaggcatggtgattggggcgctgagctttgaacccctttcgggttcagctgaccgtccttacaaccgacgtcaggatgccaagtataaaaatcagcagggcgctgtaggcagccgaattagtgaggactaa

SEQ ID NO: 4121 - DNA, 642 bp, Xenorhabdus bovienii
  Coding sequence Name=Xb4151_4152.C441.gene222.dna; Position on contig= 172748..173389bp; Strand=-
atggctgatgaagcacataagtgtacaatcgtaggtattgcaggtgcctctgcctcaggcaaaagtcttattgccagtacactttatagagaattacgggctcaggttggtgatcacaatatcggtgttattccagaagattgctattataaagaccaaacaaacactcctctggaagaacgttataaagttaattacgatcatccaagttcaatggatcacagtttactgttcgaacatatccaagcattgaaagccggaaaatccattgaattgcctcaatatgactatgttgctcatacccgcaaaaccgaatccatccattttgaaccgaaacgcgtcatcatccttgaaggtatcctactattaacggataagcgtttgcgtcaggagatggatttctctatttttgtagatacaccattggatatctgcctgatgcgccgcattaaacgtgatgtgaatgagcgtggacgtacattggattctgtcatcgaacagtataaaaaaaccgttcgtccaatgtttctgcaatttattgagccatcaaaacaatatgccgatattattgttccccgtggtgggaagaaccgcgtggctatcgacatattgaaagccaagattggccaattttacgaataa

SEQ ID NO: 4122 - DNA, 186 bp, Xenorhabdus bovienii
  Coding sequence Name=Xb4151_4152.C441.gene223.dna; Position on contig= 173617..173802bp; Strand=-
gtgacattgccgccaatatctctgctcagatgtactggcagggagagaaaattcctacggaaatttctttccgcgcagtttgagttaagcaatttcgtgtcgatacgcgacggaacgttgttgattagcaacagtcactgtgactttgttggtattgtcgctatctggtctgtgatcggttcatga

SEQ ID NO: 4123 - DNA, 1113 bp, Xenorhabdus bovienii
  Coding sequence Name=Xb4151_4152.C441.gene224.dna; Position on contig= 173720..174832bp; Strand=-
atgaactcacaatcccccgagcagaccagtcctgacctgctgaaagaacacgttgtgaaaatactggcaacgttcaagcatccgactttagagcgagacttgatagccctgaaagcattgcatcattgcgccatgcttgatggggtactgcatattgaattaatgatgccgttcgtctggaagcgggcttttgcaaaactgaaggaagaaacgactcaatctttgcaaacggctactggagcaaaatctgttgactggcggcttacctatgatatctgtaccttgcgccgcgctaataatctgccgggtgtcaacggtgtccgcaatattctggcggtcagctcagggaaaggtggagtggggaaatccagcacggcggtgaatctggcactggcgctggcgcaggaaggggcaaaggtgggtattctggatgcggatatttatggtccgtccgtgcccaatatgcttggcacagctcaagagcgcccaacttcacctgacggccagcacatggcgccgattatggtgcacggcatggcgacgaattccatcggctatcttgtcacagatgacaacgcgatggtttggcgcgggccaatggcgagcaaggctctgatgcagatgttacaggatacactgtggccggatctggattacctggtcatcgatatgccgccgggaacaggggatattcagttaacgctgtcccagaatattccggtgactggcgcgctggttattacaacgccgcaggatattgctctgatcgatgcgataaaaggcatcgcgatgttccaaaaagttaatgtgccagtattgggtattattgaaaacatgagcatccacatatgcagcaactgtggccatcaggagccgatttttggtacgggtggtgcagagaaactggcggaaaaataccattgtcaattgttggggcagattccgttgcatatctcactgcgtgaagatcttgatcgcggcgaaccaacggtcattagccagcctgacagtgaattggcagatatttaccgtgacattgccgccaatatctctgctcagatgtactggcagggagagaaaattcctacggaaatttctttccgcgcagtttga

SEQ ID NO: 4124 - DNA, 132 bp, Xenorhabdus bovienii
  Coding sequence Name=Xb4151_4152.C441.gene225.dna; Position on contig= 174964..175095bp; Strand=+
ttgcgttaccctagcgacaatgcccttgatcaggtaacatcaaaaacccttttcaatatatggaagtcagatcctaaccatgtctcaagtcgcgaacaaattattggtgacctgtgcgttaccttatgctaa

SEQ ID NO: 4125 - DNA, 2028 bp, Xenorhabdus bovienii
  Coding sequence Name=Xb4151_4152.C441.gene226.dna; Position on contig= 175043..177070bp; Strand=+
atgtctcaagtcgcgaacaaattattggtgacctgtgcgttaccttatgctaacggtccaattcatctcggtcatatcctagaacacattcaggctgatatttgggttcgttatcatcgaatgcgcggcaaagaggttcactttatctgcgctgatgatgcccacggcacaccaattatgctgaaagcccagcagagtgggatctcgccagaagaaatgattgccaaagtgagcctagagcatcagcaggattttgccggctttgccatcagctacgataactaccactctacacacagcgaagaaaataaagaacttgcgtcccaaatttatctgaaactgaaaaagaacggttacatcaagagccggaagatttctcaactgtacgatccagaaaaaggcatgttcctgccagaccgtttcgtcaaaggtgcctgcccgaaatgtaaggccgaagatcagtatggcgataactgcgaagtctgcggaaccacttacagcccaacggaattgattaatccccgctcggcagtatccggcgcgacgccagaaatgcgcgatacagagcacttcttctttgatctgcctgttttcagcgacatgctgcaaaaatggacgcgttccggctccttgcaagaacaagtcgcaaacaaaatgcaggaatggttcgacgcgggtctgcaacaatgggatatcactcgtgatgcaccttatttcggtttcgaaattcctgatgaaccgggcaaatttttctacgtctggctggatgcgccaattggctacatgggctcgttccaaaacctgtgcagcaaacgtgatgacctgaatttcgacgaattctggtcgaaagattccgaagcagatctctaccacttcatcggtaaagatatcgtttatttccatagcctgttctggccagccatgttggaaggcagcaactatcgcaagccgaccaatctgttcgtccacggctatatcacggttaacggcacgaagatgtccaagtcgcgcgggacgtttatcaaagctgaaacgtacctgaagcaccttgatgcagattgcctgcgttattactatgctgcgaagctctcctcccgtattgatgacatcgatctcaatctggaagatttcgttcagcgcgttaacagcgatatcgtgaacaaagtggttaaccttgcttcacgtaacgcaggtttcatcaataaacgttttgcgggcaaactggctgatcaacttgctgatcctgcgctgtaccagcaatttgttgatgcggctgaaggcattgcggaagacttcacccaccgtgaattcagtaaggccatccgtgaaatcatggcattagccgatttggcaaaccgctacgttgacgaacaggcaccgtgggttgttgccaagcaagaaggtcgggatgccgatctgcaagccatctgctcaatgggtatcaacctgttccgcgttcttatgacttacctgaagccggttcttccgagcctgactgaccgtacagaagcattcttaaataccgaactaacttgggatggcatccggcaaccattgcttaaccatgaagtttcaccatttaaggcactgtttaaccgtatcgagatggcaaaagttgacgcgatggtggctgactccaaagaaagcatcgagccacaaaaaaccctgacaggcccactggccgatgatcccattcaggacaccatcgcatttgatgattttgccaaggttgacctgcgtatcgcactgatcaagcaagctgattttgtcgaaggttcagataagctgctgaaactgacccttgatcttggtagtgaaacgcgtcaggtcttctccggtatccgttcagcctatccagatcccaaagcgctggagaaccgtctgacagtgatggtcgccaacctcgcaccacgtaaaatgcgtttcggcatttctgaaggcatggtaatggctgctggccctggtggaaaagagattttcctgttaagcccggacagcggcgcacaaccaggaatgcaggttaaataa

SEQ ID NO: 4126 - DNA, 444 bp, Xenorhabdus bovienii
  Coding sequence Name=Xb4151_4152.C441.gene227.dna; Position on contig= 177213..177656bp; Strand=+
atgtctttccgaaacatgctggtgataggctggcaatacctgcgtgcattcgtgctgctctatttgtgcctcatcgccgggaatatcacttcagcactacttcccttctctctccccggcagcattattggcttacttcttttgttttgtttacttgcattccagcttattcctgcatattgggtgaaaccgggctgtagcctgttgatgaaaaacatgacattactgtttttacctatcggggtgggtgttatggattattacccgcaacttagccagcaaatgttcccgattgttctctcctgtatcgtcagtacagtaattgtcatgattgtcgttgcttacagttcccattatgtccattgcaaacgcattattaccggcgctcaacgaaaagaacccgatctcacttccccgccatcacaacaatcggataaaagataa

SEQ ID NO: 4127 - DNA, 696 bp, Xenorhabdus bovienii
  Coding sequence Name=Xb4151_4152.C441.gene228.dna; Position on contig= 177659..178354bp; Strand=+
atgttaagccatatctggtggtcactgccattaacactgctcgtattttattgcgccaaaaaattatcacggcagctcaagctgcccatctttaatccattgttgctatcaatggccgttatcattcctttgctactgatgactcacaccccctatgagcactattttatcggtagcaggatcttaaacgacttactgcaacccgccgttgtcgcattggccttccctctttatgagcagctccatcaaatccgcgctcaatggaaatccattattagcatctgttttatcggtagtattgtcgcgatggtgacaggtacagctatcgcgttatgggcgggagccagccctgaaatcgctgcctctgtgctgcccaaatccgtcacaacaccaattgccatggccgttgctgactccgttggcggaattcctgctatcagtgcagcttgcgtaattactgtcggtattttgggcgcgatctttggtcataacctgttcaatattctaggaataaaaacgtcggcttcaagaggattggccatgggaacagcatcccacgccgtgggtactgcacgctgtgccgaactcgatcatattgaaggtgcatacagttctttggcactgatgacctgcggcattatcacctcattgatagcaccttttttatttcctgtactgcttcatctatttggctaa

SEQ ID NO: 4128 - DNA, 885 bp, Xenorhabdus bovienii
  Coding sequence Name=Xb4151_4152.C441.gene229.dna; Position on contig= 178539..179423bp; Strand=+
atgcaagctcgttttcacgctatttggtcagaaattacccctaaactgcaagaagccctgttaccctatatcggtaatgacgattttccagcaatgctgaccgcggagcaggttgagtcaatcaggcaaatctgcggttttgatgatcatgcgctggcacttgctctattaccacttgcagcggcctgtgccattacacctatctcgcatttttacgtcggggcaatcgcacggggagaaagtggcaacctctattttggtgccaacatggaatttgctggagttcccttgcagcaaaccgttcatgccgagcaatcagccatcacccatgcttggctgcgcggtgaaaaaaagctggtttccatcaccgtcaattattcgccttgtgggcactgccgccagttcatgaatgaattgaacagtggaacacaattggaagtctgtttacccaaccgcccacgtttgacgctggctgactacctgcccgaagccttcggcccacacgatttactggacgcaccattactgctggataccgtcaatcatggctaccaattggatacctgtgacgaattagtgctggcagcactggatgcggcgaaccaaagccatgctccttacagccagtcccatgccggtatcgcactgctggatgaacaagatcaggtttacaccggccgctatgcggaaaatgccgcatttaacccaagtttaccgcctttacaggcagctctgatcttaatgaatatgtctggtggcaattgtcagtccatcaaacgggcaatattagtggaaggaaaaaatagccatctatcccaatcaagcgcaaccgaatccacattaactgccctcggttgcaccaaaatagaatgccatagattttga

SEQ ID NO: 4129 - DNA, 1698 bp, Xenorhabdus bovienii
  Coding sequence Name=Xb4151_4152.C441.gene230.dna; Position on contig= 179689..181386bp; Strand=+
atggaactggaacacgaaagtaaacgtcctctctatattccctacgctggccctatcttgttggaatttcctcttctgaataaaggcagtgcctttactgaagaagaacgcagcaatttcaacttacatggtttattacctcagatagttgaaacgatagaagaacaagccgagcgtgcctaccgccaattttgcgattttaaaagtgacggtgacaaacacatttatttaagaaatattcaggacaccaacgaaaccctgttctatcggcttcttgatgcccatctcagcgaaataatgcctatcatctacacccctacggtgggtgaagcatgtgaacacttctctgatatttatcgccgtgcccgtgggttgtttatttcctatccaaataaagcgtctatcgatgacatgctgcaaaatgccaccaagcagaatgttaaagtcatcgttgttaccgatggtgaacgtatccttggtctgggagatcagggcattggcggcatgggtattcctatcggtaaactctcgctgtatacctcttgtggtgggatcagcccagcttacactctgccagttgtattggatgttggtacaaacaacccgcagcgtctgaatgacccactgtatatgggctggcgtcacccacgcattaccggcaaagaatatgatgaatttgtcgatgaatttattcaggctgtgaaacgccgctggccaaacgtgctgctgcaatttgaagattttgcccaaaccaatgctatgccgctgttgacacgctatcgtcatgatctttgctgtttcaacgatgatattcagggcacagcagccgttgccctcggcagcctgattgccgccagccgcgccgcaggacgccagttgagagatcaaaccgtgaccttcctcggagcaggttctgccggttgtggtattgccgaacagatcgtcgctcagatgaaatctgaaggattgagcgatgaacaggcccgcgcccgcgtgttcatggttgatcgctttgggctgctgactgataaacagccaaacctactggacttccagagtgtactggtacagaaaaacagcgtcctgcaatcatgggatgtcagcaatgacagcatttcactgatggatgtggttcgcaatgccaaacctaccgttttgattggtgtttccggccaatcgggtctgttcacggaagagattatccgtgaaatgcacaaacattgtgagcgtccaatcgtcatgccactgtccaacccgacatcacgtgtggaagcgcgccctgaagacatcattaactggacggatggcaaagcgctggtcgcgactggcagcccatttgcccctgtgaaatatgatggtcaggaataccctatcgcacagtgcaacaactcctatatcttcccaggcatcggcttgggcgtcattgcttccggtgccagacgtgttacggatgatatgttgatggtagccagccgcgcattggcggattgttcaccgttggcacaaacgggttcaggcccattactgccaccgattgatgatattcaaaacgtttcccgcaaaatagctaaagaagtggcgaaaaaagcccagattcaaggcatggctaccgtcacgtcagaagatgcgctggagcaagccattgagcgcaatttctggaaaccagaatatcgcgtctataaacgcacttcattctga

SEQ ID NO: 4130 - DNA, 720 bp, Xenorhabdus bovienii
  Coding sequence Name=Xb4151_4152.C441.gene231.dna; Position on contig= 181529..182248bp; Strand=+
atgtggaagcgcctgattaccgggctggttttcatcatggctgttttaatactaacagtcattatgcttgaccgctggattagctggaaaaccgccccctatatttatgatgacctcaaccagcttcctgaacgagaagtcggtatggtactcggcacgtccaaatattacacatccggcgcctataaccagtattatttctaccgtattcaaggggctgctaacgcctacaacagcgggaaggtgaattacctgttactgagcggagataacgcccaactcagttataacgaacccattacaatgcagaaagattttatcaaggcgggaattccggcttccaaagtaataatggatttcgctggcttcaggacgttggattccattgtccggactcgtaaggtctttaatgccaacaactttactatcattactcagcgtttccactgtgaacgcgccctgtttattgccatgcatatgggcatagacgcacaatgttatgccgtatcttctcccaagaatatgatgatcatacgtttcagggaagtatttgcacgcctcggagccttggctgacctttatattttgaaacgggaacctcgctttttaggcccgttaacaccgattcccagcgaaactctcatcccgacaggtattgaaggctatcctgccgtatcgccagaagagttacaggaattgaggaaaaagccccgcagttaa

SEQ ID NO: 4131 - DNA, 1152 bp, Xenorhabdus bovienii
  Coding sequence Name=Xb4151_4152.C441.gene232.dna; Position on contig= 182300..183451bp; Strand=-
atggaaaagagtgaggtaatgggtcagcggattgaggcacttgatagtgtgcgtggtttcgctattctgggaatattaattttgaatattttcagttttgccttgccatatgccgcttctatgaatcttttttatacagatccgatctcattttctgatgtgatgacatggtctgtcctgagtcttcttactcagggaaaatttttattcattttgactttgttatttggtgcttcacttgaattactatggcagcgagggcgtgaatggaatattcccagactgattatactggctgttattggcttgttgcacggtatcttgctgtgggatggtgatattttactgttatatggtattgtcggtcttttggcatggcactttatccatactcgtcatagattgtttggtaaaggaattactttttatctgtttggtttgatgatgttttatcttctggggttgtttccagtgggagaaaatagtgccttctggcagccaacaccgcaggatatttttcatgaaagtcattggaaaacccagggtgggttattggctatcgagtatcgttttcgtcaggtaagtggcatgatgatagtggttatcgtgcaatatggttggcaaatggttggggtgatgctctgtggggcgatgctgctacgcaatggctggctgaaaggggagtttagtctcagccattaccgcagggtagcattatggctacttccgtcaggtatggtcattcaggttattgctctgtccatacagtgtttatatcccttcagctattttgcctcatggactattcgtcatactatctccgaactggcgacgcccttgctggcattggcttatatcgcgttgatttatggtttttggccaatcatttcccattggcgagtgaacttctggttacgacaagttggtagaatggcgctgaccagttacttgctgcaaactttgatttgcaccacgattttttatcgttgggaattttttgatcagtttacccgtttggaattgctggtgtttatcccgttggtctgggctttcaatatctggtttgcctgctggtggttaaaacgttatcagcaagggccgattgaaaagctctggcgtggtttaaccagaaaactggctggcagggtttaa

SEQ ID NO: 4132 - DNA, 669 bp, Xenorhabdus bovienii
  Coding sequence Name=Xb4151_4152.C441.gene233.dna; Position on contig= 183467..184135bp; Strand=-
atgtcatccctaagtacagaagccgctctggtgcactcagcactggtctcccgtggccttgaaaccccattgcgtgaacaaactctgaaaccagaagtgcgtaaggtactgattcaggaacacatgacagaaattatgaaactgttaaatctcgacctgagtgatgacagtctggcggatacgccgagtcgtattgcaaaaatgtatgtagatgaaatattttcaggattggattacaacaactttccgaaaatcaccttgatagaaaataaaatgaaagtggatgagatggtaacggtgagggatatcacgctgaccagtacctgtgaacaccattttgtcactatcgatggcaaagccacggttgcttatatccctaaggataaggtgattggcctgtcgaaaattaatcggatcgtgcagttttttgcgcagcgcccacaggtgcaagagcggctgacacagcagatcctgattgcactgcaaacgctgctcggtacaaataacgttgccatttccattgatgctgttcattactgcgtgaaagcccgtggcatccgcgatgcgaccagcacgacgacgacaacttctctcggcggtttgtttaaatctagtcagaatacacgacaggaatttttgcgtgccgtgcgtcacctgcacttatcatga

SEQ ID NO: 4133 - DNA, 216 bp, Xenorhabdus bovienii
  Coding sequence Name=Xb4151_4152.C441.gene234.dna; Position on contig= 184167..184382bp; Strand=+
ttgacgggaaatcgagacgcatattttacgcagatatctgtgaatctaacaccttacatacaatacggattcacaagacacctgctgacatggtatccactcgcgtggtatgtgtttacattgtatctgtgtacaactctatctgcacgttatcaatatcaatgcgccaaatttggattactcactgtggatctgattgcgcctgaagaccagtaa

SEQ ID NO: 4134 - DNA, 1179 bp, Xenorhabdus bovienii
  Coding sequence Name=Xb4151_4152.C441.gene235.dna; Position on contig= 184344..185522bp; Strand=-
atgagaaatcaaattatcacttctggccgtcgtcattatcaagctttccagattgcattgagcggttttctcgctttagttgttgcaatgggaataggacgcttcacttttactccacaagttccgctgatgatcgctgaatcccaattcacactgacgggagcgggaattgttgctgcatttaattaccttggttatctggctggctcttatgatgcgatgcgagcacagcgattcgtggaataccgcctgtggagtgggctgtggggggcggtgattatcacgttgctttcggcactgctggatgggccaatattgcatagtattgctcgcttctttattggctgggcgagtggttggacgttggtattggtcgctgcatgggtaaatgatgaactggcaaaactgaatcgtccgagattgagtgccgctgtctttgccggaacaggaatgggaattttgattagtggtgtgctggctgttggtatccaatcttgggcgatgggcgcggccaaggcttgggtgatttatggcatgttggcgttgctatgcagtatctatgtcagtcgttatctgccgcgtcgtggtgaactgcaccgcccacagactaacgtccaaaaacttattctgacaccggaaatcaaacggttgatatggagttacagtctggctggatttggttatatcctacccgccacattcctttctcaaatggcgacagagcgttttcctgacagcctgtttgcacaatttgtctggccgatatttggtggcgcttctgtactcggcattgtactgggaattttgctgagccatgtatcgactactcaaatccgcttggcgatcaccttgtggcttcaggcgattggaatattgattgctgaagtgctgccgggtattggaggccttgtgatcggggcattgttggtgggagggggatttatgtgtgtcgtgcaactggccttgttgtatggacgtgaattagcgccgaatcatgctcgttatatggcggggctgctgaccacgggttatgcgctggggcaattagtcgggccaatgttttcagctacttcgacgtggctaacgggcaaactggagcctgctttgtatatcgcatttattggtctggtcgttgcggggttactggtcttcaggcgcaatcagatccacagtgagtaa

SEQ ID NO: 4135 - DNA, 1242 bp, Xenorhabdus bovienii
  Coding sequence Name=Xb4151_4152.C441.gene236.dna; Position on contig= 185725..186966bp; Strand=+
atggatcattgtcatacctcaggcttaatctcgctcgaacaagcgctggaaaaactattggcacaagccgttgccctgactcaaacagagactatcagcctgacgcagtccgctggccggatcaccgctacagatattatttcgccaatcaacgttccccctttcgataactcagcaatggatggttatgctgttcgtcttgccgatctaaacggaaatcaggctttgccagtagcaggcaaggcattcgccggtgcaccatttcaaggagaatggcctgccggcagttgcattcgtatcatgactggcgctcctattcccgctggtgccgatgcggtgataatgcaggaacaggctgaagttacggaaacagatattcgattctcctatcccattcaacaagggcagaatatccgtaccattggagaagatatcactcagaatgcggtcgtattgccaaaaggaaccaaactatccacagcacagttgccggtgatcgcctctctgggcattgcaaaggttgaggttattcgcagattgaaggttgccattttttctacaggtgacgaattacaggcgattggtgaaccattacaggcaggtcaaatttacgacactaaccgttttgctgtgcgcctgatgctggaaaaactagattgtgaggtaatcgatctcggtgtgatccccgataaccctgacgcattgcgcaatgcctttgccgaagctgataaacaagcagatttagtgattagcagtggcggggtctctgtcggtgaagcggattacaccaaaccggttctggaagaagtcggcaaaatcaatttctggaaactggctattaagcccggcaaaccttttgcgtttggcaaattggaaaacgcgtggttctgtggtttaccgggaaatcctgtctcagccgtgctgactttttatcaactggtacaaccgctgattgtccgtctgtcaggttttacagcatggcaaccgccaatgcgcctcaatgctaaagccatcacaccactgaaaaagtccccaggcaggctggatttccaacgcggcaccgcttccattaatgaacatggcgaattagaagtacaaaccaccggacatcagggttcccatattttcagctcatatagcctcggtaattgctttattgtgctggaacgagagcgcgggcatattacgaccggcgaaacagtgcaaatcgaatttttcaaccacttactgaaaaaccaatag

SEQ ID NO: 4136 - DNA, 747 bp, Xenorhabdus bovienii
  Coding sequence Name=Xb4151_4152.C441.gene237.dna; Position on contig= 186981..187727bp; Strand=+
atggttatcgagctcaccgatgaagaaatcctgcgctacaatcggcagattgtcctgcgtgatttcgattttgacggacaggaaaagttaaaatcatccaatgtgttgattgtcggtataggcggtctcggctgtgccgcctcccagtatcttacttcggctggcgttgggacaatcactctgctggactttgatgctgtttccctttccaacctgcaacgacaaatccttcatcgcgatgagcgcatcggtatacccaaagtgcattcggccgcccagacactacgggaaataaacccgcacgtcaccttacatcccattgagggattattggatgatccatcactgaatgaattgattggccgacatgatcttattctggattgtacggataacgttgccattcgcgaacagctcaaccgcctgtgttacgagcgaaaagtccctttggtttccggtgctgctattcgcatggaagggcaactggccgtgtttacttatcaaccggatgaaccctgttatcgttgcctgagccggttatttggtgaaaacagcctgacctgtgttgaagcgggcgtgatggcgccactggtgggaattatcggctccctgcaagcgatggaagcgattaagttactgactcaatacgggaaagtcagccgtggcaaagtgttattgttcgatgccatgaccctgcaatttcgtgagatcaggctgcctaaagatcctcagtgtgaggtttgctaa

SEQ ID NO: 4137 - DNA, 654 bp, Xenorhabdus bovienii
  Coding sequence Name=Xb4151_4152.C441.gene238.dna; Position on contig= 188041..188694bp; Strand=+
atgcaagaactgaatgataaaaaatcaacggaagctgatgccttgttatccaacatcgctaaaaacattgattttttgattaaaaagaacaacatagactcacaaactctgagcagattaactggtctcggaattgcgactatcaacagcctcagacgtggagttggaaaccccactattgctactgtttcatcaattgcagatgtatttggtgtgaatgtgggtgaaattaccgatggaaaattatctgaatcaaataaaaatgaagaaattatctcatcaatacctctggttaggtatgatgaattggatggttacgtatctggcaaaataatcactaaaaatttatataagctcagtattcaggataatcatgaagactctctttttgccgtagaatttggaaataaccttttatttccctattttgacagtaacaccatcgcaatagtttctaaaaccgaggcagtttgtgacagtgatgtcgttctcgtaaaaattaaagatgctcccatttgttttagacaagtttttgtcggcgaaagtggaatttacttttcaatattaggcattgagaacgaacggaaaacagttttaacgcagaattacacaataattggagttgtgattagatcaattagaaacttaaaatag

SEQ ID NO: 4138 - DNA, 261 bp, Xenorhabdus bovienii
  Coding sequence Name=Xb4151_4152.C441.gene239.dna; Position on contig= 188932..189192bp; Strand=+
atgagagaaaaacaaaaattcaaaataatagaggagagaagagatctttcattcatcatacagaatgcatattctcgcagagaaattaatgaaaaagaactgcttatagaacagaatatagtagaaaaaatagatccaacgagtcttgtgagaatagcctatatgtcaggattaaaagatggaaggaaaatatctgacgagatctcaaaagctgaaaaaataaaaccctctaaatccccaaatttaaaggtaatcaaatga

SEQ ID NO: 4139 - DNA, 699 bp, Xenorhabdus bovienii
  Coding sequence Name=Xb4151_4152.C441.gene240.dna; Position on contig= 189189..189887bp; Strand=+
atgactcagaattaccccactcattcaaagtttaagtatgattctttgtttatttctctatctgtaacaataatgataacttgtgatgttcttgtatataaaacactagacttttatgattttaaaattacatttagtggaattttgttttcgttttactttcttatatccacgattcagacagaggtttatggataccggcaaggtgtaaaaacggtctggatcatggtgttatgccaatcaatctttgtcatggttatctttgtagcatcgcatatgcaacccgaaaacaatcagatatcaatgaattttaagtcattattcggagaattttggcgtgttatggtaggaacatggacttctgtacccatttcttactttattaacggatttgttatatccagcctgaaaaaagtctttcttggcaggttctttttcatcaggtatctcattgcctcgatgaccactcaggcagctcttctgttatcggcttatcctataagcctctcttcaaaatataatttcaatgaattaataacaataatcacaacaacatggtcttacaaagtcgtaatgtccattattcttctgcctatagggatcatcttagcggataaagtcaaaaaactagagtcggctgatgtatatgattggggcatatcatataatccatttttcttcagaggtaataaaaaatga

SEQ ID NO: 4140 - DNA, 744 bp, Xenorhabdus bovienii
  Coding sequence Name=Xb4151_4152.C441.gene241.dna; Position on contig= 189884..190627bp; Strand=+
atgaaagtcgttaatttgacagacatacacctgaccagaaacagagataaaaaactatttgatgtaaatacgtatgataactttgattttgtttgtgaggaaatacatagaatacagaaccttactgaaatagagttaattatcgtgtccggtgatattgcaaatgatggtgatgttgaggcctacagatattttttgaataaaatggagtcactaaaaacaccttatatttccatactcggcaatcatgatctcaataaaaactttgaaataacactggcggaagaaaaaccaaaatacattatttcctcccgtgaatataacaatgataattggtatataactgccgtcgatactgtcgttgaaggagaagattatggttttataactcaagataaccttgctgaattagaaagaaaaattatcacaaacagcaattttaatatcgctatatttatgcatcatcatgccatgccggttggtacgccaattgtagatagctgcatgctgaacaatgccaaagcaatactggaactttgtgagaaacatagggttaaatttattggtagcggtcatgcacacacaccccgcgtttggcatcataataatatgacagcatgtgtttctcctgctgtttcatttcaatggttatcaggcaccaatacagtgaaaatttcaaaaggctttggctttaatgttatagatttttcaccagatttatctatcacttcatgtatttattaa

SEQ ID NO: 4141 - DNA, 1653 bp, Xenorhabdus bovienii
  Coding sequence Name=Xb4151_4152.C441.gene242.dna; Position on contig= 190806..192458bp; Strand=-
atgcgcgactatcgattttttccaaattcccttttatccactttaagagcaaaagttgtgttaagtacaaacaacatcaccatgcagtttggcagtaagccactatttgaaaatatttctgccaaattcggcaacggcaatcgttatggtctgattggcgcgaatggggcgggtaagtctacttttatgaaaatcctgggtggagatttaacgccaaccgccggtaatgtcagtcttgatcccaatgagcgattgggtaagctacgtcaggatcagtttgctttcgaaacctacacggtgctggatactgtcatcatggggcactcggaactgtgggaagttaagcaggaacgtgaccgcatttatgccttggcagaaatgagcgaagaagacggctatcgtgtggctgatctggaggtcgcctacggtgaaatggatggctatagtgcagaggcacgtgcgggagaattgctgctcggtgtcggtatccctgtggatcagcattatggtttgatgaacgcggtggcaccgggttggaaactgcgtgtcttgctggcacaggcactgttttctaatcctgatgttctgctgctcgatgagccaaccaacaacttggatatcgatactatccgctggctggaacaagtgctcaacgaacgtaacagtaccatgattattatttcccatgaccgccatttcctgaatatggtctgtactcacatggcagatctggattatggcgcattgcgtctgttcccggggaactatgatgaatacatgactgcggcgacgcaggctcgtgaacgtcaattggcagacaacgccaagaaaaaggcacagattgccgatttacagtcatttgttagtcgtttcagtgccaatgcgtctaagtctaagcaggcaacgtcccgtgctcgccagattgacaaaatccagttagaagaagtgaaagcttccagccgccaaaacccgtatatccgctttgaacaggagaaaaaactgttccgtaatgcgctagagttggaaggtgtcaccaagagctatggtaacgaaccactgtttaagaacctgaacctgctgatggaagttggcgaaaaaatggcggttattggtgaaaacggtatcggtaaaactacgctgctgaaaacgctggtaggtgaagcagagccgaacagtggtacgatcaaatggtctgaaaataatacgattggctattatgcgcaggatcacgccagcgattttgactgcgatctgacggtatttgaatggatgagtcagtggaagcgcgaaggagacgatgagcagtccgtgcgcagtgcgctgggacgtttgttgtttggtcaggatgatatcaagaagaaggtcaaggtactgtccggtggtgaacaaggacggatgctgttcggtaaactgatgatgcacaaaccgaatattctgattatggatgagccaaccaaccatctggatatggaatccatcgaatcccttaaccttgcgctggaactttatcaaggtacgttgattttcgtttcccatgaccgtgcatttgttagctcattggcaagccgtgttttagaaatgaaatccgacgaagtgattgatttcagagggacttatgatgagtatctgagaagtcagggaattgctgagtaa

SEQ ID NO: 4142 - DNA, 276 bp, Xenorhabdus bovienii
  Coding sequence Name=Xb4151_4152.C441.gene243.dna; Position on contig= 192670..192945bp; Strand=+
atgcaaaaaatcagatggggtattattggttgtggtgatgtaacagaagtaaaaagtggccctgctttttataaactggaaggttcagaattaattgcagttatgcggcgcaacgccaatttagcaaaagaatttgccaaacggcataatgtcccaaagtggtattctgatgccgaatcgctggttaatgatcctgaaattgatgcgatatacattgcgacaccccctcgacacacaaagaatatactatcctggctgcacaagccggaaaaatag

SEQ ID NO: 4143 - DNA, 717 bp, Xenorhabdus bovienii
  Coding sequence Name=Xb4151_4152.C441.gene244.dna; Position on contig= 192963..193679bp; Strand=+
atggcgctgacctttgaagaatgcaatgaaatgatcgctgcctgtcgttctcagaatgtgccgctatttgtcgcgtattatcgaagagcactaccaagattcctaaagataaaagaattaattgattcaggtgccattggtactccgcgcattgtaaattgccaactcttcagagaaatggaatcccgctaccaagatcctgataatttaccctggttcgtaaaaccagaaatatccggtggtgggttatttgtcgatttagcctgccatacacttgatatattggattttctgttgggtaaaatcgtttcggtcaaagggcatgccaattcacaggcaaaagcctatccggcggaagattgtgtctcaatgtcatttatgtttgaaaaccatatccaaggcgttggtatatggaattttgtcgctggcgaccgtgaagataaagtagaaattatcggcacaaaaggcaaaatcacgtttgcgacattcggtgatgcagctatttcatattatgacgaaaataatcagctgcaccaattccattttaaaaaccccaaacatattcagatgccatttattcaaacggttattcatcaattgcagcgcaatgatatcagttcatccaatggagaagccgccgcaagaaccagttgggttattgatgaagttctaaaagagtatcgaactgccctatacataaaaaacaaagaaccataa

SEQ ID NO: 4144 - DNA, 303 bp, Xenorhabdus bovienii
  Coding sequence Name=Xb4151_4152.C441.gene245.dna; Position on contig= 193818..194120bp; Strand=-
ttggttgcggaagatgataatggtgatattaaaggattttccattgcgcaagagcaaaatacgccaccgtttaattgtttgataccacgaacttatggttatgtttttgatttgatcgtcagtcaggatgccagaagtcaaggaattggtcagcgactgttagctggaatgaaaaaatggacacaagaaaacaattattcgcatttggaattgacagtattgtcgcaaaattttgaagctattcgtttttatgaaaaagaaggatataacgaagttaataaactgatgtcaattactccgtaa

SEQ ID NO: 4145 - DNA, 138 bp, Xenorhabdus bovienii
  Coding sequence Name=Xb4151_4152.C441.gene246.dna; Position on contig= 194145..194282bp; Strand=-
atgataataagatcggctttcatacgggatattgacgctattttgtcactctataacgttttatttagtgaaatggctgaattgcagccagataggctaaaaggctcggagcaggatagaaatttaattatttcttag

SEQ ID NO: 4146 - DNA, 144 bp, Xenorhabdus bovienii
  Coding sequence Name=Xb4151_4152.C441.gene247.dna; Position on contig= 194285..194428bp; Strand=-
atgattgaactggcagaggattttgtggcactacccggcggctttggcgcgctggaagagttcagtgaggtctttacttggagcatgattggctggaataataaaccgtgtggcactttcaataatttcagcattaaggactaa

SEQ ID NO: 4147 - DNA, 891 bp, Xenorhabdus bovienii
  Coding sequence Name=Xb4151_4152.C441.gene248.dna; Position on contig= 194536..195426bp; Strand=+
atgtctttttccaaacaccgggcggcttcttttccactgcttcctatcgttttattattactttcaatgacatcaattcaagcgggtgcttcactggccaaaacagtatttcatgtcattggcgcacctggtgtcaccgccctgaggctggcgttggggacgattattttatttctgatttttaaaccttggcgtctgaaattccagcgagagtctcttattcctctttttgcctatggcatttcattgggcgcaatgaattacttgttttacatggcattgtcccgtattcctcttggtattgctgttgcgcttgaatttacggggcctttagctgttgccatgttctcttcccgacgcccgctggatttcctttggatcgccttggtcattgcaggattaggttttctgttaccggtcggagatggcgtcagcacacttgatcctatcggagtcttatatgcactgggagccggtgttttctgggcactctacattattttcgggcaacgtgctggtgccggctacggggctgcaacagtttccattggatcattgattgccgctatgattttcttccctgtgggattgatacaaactggccctgagttactgtttgatccctcgttgctgcctattgcactagggatcgccattttatctaccgcatttccctatacactggaaatgattgccctcacccgattacctgccaaaacgtttgggacattaatgagccttgaacctgccttgggagcattatcagggattatcttcttgaatgagcatttgacgatgactcagtggatcgccctgttctgtattattttcgcttcaataggctctacctcaaccattaagcggaaaactaaaatagaaaaattagaataa

SEQ ID NO: 4148 - DNA, 186 bp, Xenorhabdus bovienii
  Coding sequence Name=Xb4151_4152.C441.gene249.dna; Position on contig= 195432..195617bp; Strand=+
atgaagggtatatcaactatcaatgtaatagagacaagcaatatgactcccggagagttatcaactaatcttatttcatccgatgagataactcattatacggcattaagggaacatcattatgagtacagcaaaattaatcaaccccaacacttcccacctgatttatacccgcaacaacgttaa

SEQ ID NO: 4149 - DNA, 510 bp, Xenorhabdus bovienii
  Coding sequence Name=Xb4151_4152.C441.gene250.dna; Position on contig= 195553..196062bp; Strand=+
atgagtacagcaaaattaatcaaccccaacacttcccacctgatttatacccgcaacaacgttaataaagatgtaaagcagagatcgattactgccctgaatcatatggtgatccactttatcgacctctccatgatgactaaacaagcccattggaacatgcgtggcagaaactttattgccatccatgagatgcttgatggtttccgcactgctctcactgatcaccttgatacattcgcagaacgtgcagttcaattgggcggcaccgcgtcaggaaccgttcaggaggttcacagccgaaccctgctggaaaattacccaacgggcatccatgatgtgcaggatcacttaaaagcattggcagaccgctacgccgttgttgcaaatgatatccgtcggcgattgttaatgcagaagatgaagatacggcggatatgtttaccgcagcttcccgtgatctcgacaaatttttatggtttatcgaagcaaatattgagcaataaataa

SEQ ID NO: 4150 - DNA, 222 bp, Xenorhabdus bovienii
  Coding sequence Name=Xb4151_4152.C441.gene251.dna; Position on contig= 196248..196469bp; Strand=+
atggataccgaagtcaaagattctaacggcgcattattaaatgatggtgacactgttcaggttatcaaagatctgaaagtcaaaggtacttctaagacgctgaaacgcggcacattgatcaaaaacattcgtctgactcaccgtgaagatgaagttgaatgtaactcagataaaatcaaaggattagtgcttaaaacctgcttcttaaagaaaattggataa

SEQ ID NO: 4151 - DNA, 399 bp, Xenorhabdus bovienii
  Coding sequence Name=Xb4151_4152.C441.gene252.dna; Position on contig= 196733..197131bp; Strand=+
gtgatactttcctatctggtttgctatattacttatcagcaaacaccaaatagaaaaatctatataacaataatacatctcagttttacactctatatattcactctgtttttctacaatatcattcacatagaaaataaacacctatcttatcttgttaatttctcatcaaaaagaaaatttatttttattaattacagcctgtgtcttttattatttacaatatgcggcctgtattatattataataacccaatcaaatacgatattacttttttattattcaggcatttactctttaatatcattaataaatttatcaaggtcgcaatatacaaaattgatcaccttgtgcgttattgttttattttcttgtttaggaggatatatttatgcttaa

SEQ ID NO: 4152 - DNA, 216 bp, Xenorhabdus bovienii
  Coding sequence Name=Xb4151_4152.C441.gene253.dna; Position on contig= 196957..197172bp; Strand=+
atgcggcctgtattatattataataacccaatcaaatacgatattacttttttattattcaggcatttactctttaatatcattaataaatttatcaaggtcgcaatatacaaaattgatcaccttgtgcgttattgttttattttcttgtttaggaggatatatttatgcttaattccaaaacgggaagttagcataacttatcgtggtcaataa

SEQ ID NO: 4153 - DNA, 2136 bp, Xenorhabdus bovienii
  Coding sequence Name=Xb4151_4152.C441.gene254.dna; Position on contig= 197185..199320bp; Strand=-
atggcactttccagcgcaataaaaaatcagatcagccaatggtataaggcgttatccatccatattgatggcttcattccacgcgagcctcaacgtcagatgattgcagaggttgcaaagacactggcagatgaagaaggacggcatttggtgatagaagccccgaccggggttggtaaaacgctgtcttacctgatcccgggtattgccgtcagtcgggcggaaaaaaagccgctcgtggtcagtacagccaatgttgctttgcaagatcagatttacagcaaagatttgccgttgttacgcaagctcatccctgacctgaaattcaccggggcttttggccgtgcgcggtatgtttgcccacgcaatctggaagctatctgtgctgcggagggggagcagattgatctgatgcttttggtcgaagacaaaactgaaatcgccaatagtgaagaacgggatctgtgtcgtaggctgcgcagtgattacagcacttttatctgggatggcctgcgtgaccatcatcaactggcgctatcggattctctgtgggcaaaggtcagcaccgataaaatgaattgtttggcgagaaattgccagttttaccatcgctgcccatttttccttgcccgtcgggaaattgaaagtgcggatgttgttgttgccaaccattctctggtcatcgctgcactggaaaatgaatccgttttgccggacgcgaaaaacctgctgctgattttggatgaagggcatcatattcccgatgttgcaagggattcactggaagttgaaggcgaaatcacgttatttcaacttaatgggcagttggatacctttgttcgtaatgtagaacaatacttgcttcaatttcgcccgacaaaaccgccagctttggcaaatatcacccgtttgcaggcgcattgtgaaaaaattcgtgaatgttttaaagagctggcggatatcacacaggtattattgccggaacgccgtgaagcagcagaatatttatttgaactgggaaaattacctgaaaatttgctgttatgctgccagcaattattcaaacttactgatggggtgcgtggcctgtctgaagcgattgtaaatgatcttaccgatcaaacagccaaacaggatattgtcaggttgcaccatgctattctgcaaaccagccgaacattgggttactttgagaatatggtgaaactgtggcgtttagcatcacaggaagaatcttcccatgcaccaatatcgaaatggctcactcgccgttatgagaaaaaccaatcgcatctttattttcactgtgcaggcattcgagtcagtgagcaattaacccagttgttatggcgtaagattccccatattgtagtgacatcagcgacattacgctctctaaatagcttctctcgtattcaggagctgacagggctgcatgaaaattatgatgatcgctttatcaccttgtcatctcctttcgaacacgtacgtcagggacgtattattattcccctgatgacgcaggaacccactattcaaaatgaaatgcagcatcttgaagaaatggcgcgttattttcgttcgcagatactgatgggagcctatcggggaatgctggtgctatttagcagccagcgtgcaatggaaggttttcttactttcgtaaaagaattgcggcttatgttattggtacaaggtgatcagccgcgttatcgattggtggaaactcattgcagacgtattgatgaagggcagcccagcgtgctgattggattacaatcattcgcggaagggctggacttaaaaggtgattatctttcacaagtacatatccataaaatagcttttcctcctgtgaccaatccggtcatcattacggaaagtgaatggctgaaatccctgaagcgatatccttttgaagtacaaagtttgccgagtgcgtctttcaaccttattcagcaagtgggaagattgatccgcagtcatgaatgttatggtgaggtggtgatttatgatcggcgcctactgaacaaaagttatggttcccgtttgttgaatgctttaccggtatttcctattgagcaaccggatgtgccgtcagaagatgaattactgcaaatgaaaaaaggtcaataa

SEQ ID NO: 4154 - DNA, 156 bp, Xenorhabdus bovienii
  Coding sequence Name=Xb4151_4152.C441.gene255.dna; Position on contig= 199603..199758bp; Strand=+
atgaaaaaaatcctgcttattatcatcgtgttattttccctcggctctattggcggtgtctttttggcagggctgaatatgtacactcgctcaacaactccggtagaagagccacagcagtcacagcaggaaaacgccccgatagggcaacaataa

SEQ ID NO: 4155 - DNA, 840 bp, Xenorhabdus bovienii
  Coding sequence Name=Xb4151_4152.C441.gene256.dna; Position on contig= 199819..200658bp; Strand=+
atgaaaaatgaatattttgttagtccgcaatggctaaacgaccatctccatgatgagaatgtcgtcattgttgacgccagcgcccccatgcctacccaaactatcgattatcaccagttatggctggataaccatattccgggtgcccagttttttaacctggataaaatcgccaatctccagactaacctgccacatatgctgccagaaccggaggttttccgtcaggccgttagcgcgatggggatcagtgaaaaccatctggtaataatttacgatcagggaaatatgttctctgccccacgagcatggtggactttcaagatctttggcactcgcaatatccgtattcttgaaggggggttacagggttggcagcaaatgggttatccaacggaatcaggtgaagttacccgtcagccccaaattttcaatagccaattcacccctgaaaaagtctgttctcaggaacagatccttgatgctctccatcataaagcaccaatacagtttattgatgccagagccgaagaccgttttcaggccaaagtaccagaacctcgccccggtttgagaatggggcatatccccggctcaaaaaatgtcccgtggacaacattgattgataatggaagttataagtcaccagacgaaattgcagctatattcaaaaagcaaggcgttgatttaaaacagccaataatgactagctgtggttctggaatgaccgccgcagttttagtattagggctggatatgattggtcacaaagaagtgggattatacgatggctcttgggctgaatggggtgccgatgattctcttccgttagaaaaatag

SEQ ID NO: 4156 - DNA, 249 bp, Xenorhabdus bovienii
  Coding sequence Name=Xb4151_4152.C441.gene257.dna; Position on contig= 200737..200985bp; Strand=-
atgggtatcctgtcatgggttatctttggcttaattgctggaattattgcgaagtgggttatgccgggggataacagtagcggtatcatcatgacggtgattttaggaattattggtgcagttgttggtggatatatcagtacattcttcggcatgggaaaagttgatggatttaatctgggaagttttgccattgcagtcgttggtgcgatagttgtcctatttgtataccataaaatttctaattaa

SEQ ID NO: 4157 - DNA, 942 bp, Xenorhabdus bovienii
  Coding sequence Name=Xb4151_4152.C441.gene258.dna; Position on contig= 201363..202304bp; Strand=-
atgcgcgttttgctggccccgatggaaggtgttctggattctctggtcagggaactgctgagtgaggtcaacgattatgacctctgtatcacggaattcctgcgtgtagtggacagtctgctgccggtgaaatctttttaccggttgtgtcctgaactggagcaccagagccggacaccatcaggaacacccgtcagggtacagcttctggggcaatacccagaatggctggccgaaaatgctgtcagggcagttgaattggggtcatggggcgttgatttaaactgcggctgtccttccaaaactgtgaatggcagcggtgggggagctacgttgttgaaagatcctgaactcatctaccgtggtgccaaagcgatgcgggacgctgtacctgaagaattaccggttacggtaaaagtgcgtctgggatgggattccggtgatcatcagtttgaaattgcggatgccgttcagcaggcgggtgcgaccgaactggtggtgcatgggcgtactaaagaagatggctataaagcagaacgcatagactggcaggcgattggcgaaatccggcgtcgtcttgccattcctgtgattgccaacggtgaaatctgggattggcacagtgctcaggagtgcatgaaggtgacgggatgtgatgcggtaatgataggccgtggcgccctgaatgtgccaaatttgagtcgtattattaaatataacgaaccaaaaatgccgtggaatggtgtgcttcagttattgcaaaaatatacttatctggaaaagcggggtgatacaggcatgtatcacgttgcccgcatcaagcagtggcttggttatctacgtaaagaatatgatgaagccgatgagttatttatgcagatcagagcattgaaaacgtctgctgctatctcaaatattatcttttcagccgcagaagcatga

SEQ ID NO: 4158 - DNA, 1380 bp, Xenorhabdus bovienii
  Coding sequence Name=Xb4151_4152.C441.gene259.dna; Position on contig= 202308..203687bp; Strand=-
atgaattttgagtcactcggcttgaaggctgatattttacgtgccgttgaagaacaaggttacgtggaacccacccctattcagcagcaagccatacctgttgtgttgtccggtaaagatcttttggctagtgcccagacgggaacggggaaaacggcagggtttactttgccaattttgcaattactgagtgaatctccggctcaggcaaaaggtcgtcgtccggtcagggcgctgattttgacaccaacccgtgagctggcggctcaagtgggtgaaaatgtatgcaattacagtaaatatctcagattgcgttcattggttgtatttggtggtgtcagcattaatccacaaatgatgaaattacgtggtggtgtcgatattctcgtggcaactccggggcgtctgttggatttagaacaccagaatgcggtggacttatcccatgttgaaatccttattttggatgaagccgaccgcatgttggatatgggctttattcatgacattcgtcgggtattgagcaaattgcctgcaaaacgccagaatttactgttttcggcgactttttccgatgatatcaagagccttgccaataaactgctgcgtgatccggtgagcatagaagttgcccgtcgtaactcggcttctgaacaaattgatcaagctgttcattttgtggataaaaaacgtaagggagaattgctctcttatatgataggcaaccagaactggcagcaggtattggtctttacccgtaccaaacatggcgcaaaccgtctggcggaacagctcagtcaagatggtgtcactgctgccgcgattcatggtaataaaagccagggagccagaacccgtgcgctggccgatttcaagtcaggccggatacgtgcgctggtggcgacagatattgctgcccgtggattggatatcgatcagctgccccacgtcgttaactttgaattgcctaatgttgcggaagattacgtgcatcgtattggtcgtacaggccgtgcggaagcgacaggacaggcaatatctctggtttgtgtcgatgagcacaaactcctgcacgatattgaacgactgctgaagcgtgaaattccacgtattgcgatttcgggttatgaccctgatccttccattaaagctgagccaattctgaatggaagtaattcccgtggcagtcagcgtggtaacggtaggcaaagcccttctaaccaaggcagcagcaaaccgaaccgctccaaccagagtcgttctaaccaaggcagtaccaaacaacacagtgatcgtccgcgcagcaaaggaaccccatcgggtcagcgtcggcaacgtacttcatccaaaacatcaaatgtagccgcatcaggaaaataa

SEQ ID NO: 4159 - DNA, 120 bp, Xenorhabdus bovienii
  Coding sequence Name=Xb4151_4152.C441.gene260.dna; Position on contig= 203697..203816bp; Strand=+
atgctccagacttcaccattcctgaaacccgttcaggagcagttttatgggaagaaaacagacgcgataaatcgcaaagaaattacacaaactgcaatgcatcataaggcggcattataa

SEQ ID NO: 4160 - DNA, 678 bp, Xenorhabdus bovienii
  Coding sequence Name=Xb4151_4152.C441.gene261.dna; Position on contig= 204062..204739bp; Strand=+
atggcagctaaaacgactcaaacattgcgaggcgaacaggccaaacagcaacttattgaatcagcgatagaaattttcgggaagtccggtctggaaggtgcgaccacccgtaatattgcccagcacgcaaaacagaatatcgccgctatttcttattattttggctctaaagaagggctataccttgctgtcgcacaatttattgccgataagttaaaatcggaattttccccactcgttgaagcgattgaccgtttttttgtcgaaacttctcagccttatccacaagcgccgatactggcatttatccatgaaggaatgacgaggtataactgtctgattttcgaaacaagcagcatcaatctcagccgaatcatgtcacatgagcagttgacgcccacagcggcttacagcgttatccatgaacaagggcttgccccggtttattcccgtctgaataaactcattgccaattatatcggcgcggatgaacaccagatttcaacacagatccacacacatgccctgttgggggaaattctttctttccgtctggctcgagaagcgttactacgccaaacgggttgggacaatcttggcaccaaagaatacgaattaatcaatcaagtgttatctcaacacatcactttattgcttaacgggttacggcagaagtaa

SEQ ID NO: 4161 - DNA, 993 bp, Xenorhabdus bovienii
  Coding sequence Name=Xb4151_4152.C441.gene262.dna; Position on contig= 204797..205789bp; Strand=+
atgaacagtaaaaagtttgctcttttcctattagcgatcatcattgttatcggagctattgtcggcattgattattatcaggaacaaaatgacaaggaattaatgctgtatggcaatgttgatgtcagaaccgtcaatcttggctttcgagttgcaggtaagctggcagccctacaagtagatgaaggcgatacaatcactgcgggtcaggcactcggccagctcgacaatacccccttcatcaatgccctgaatcaggcaaaagcaacccgtgacgccgccaaagcaaatcttgccaaaaccgaagccggttatcgtactgaagaaattgctcaagtacgtgccgagaccacgcaaaaagaatccgcattccgcttcgctgatagcttcctgaaacgtcaacaggggttatggcagcgtaaaatgatttccgacaacgatttggacaatgccaaaaccggccaacatcaggcgctggcggcctatcaagcggcaaaagataagttacgtcagtttgaggctggttatcgcaaagaagaaattgccgccgccaaagcgcaactggcgcaagcacaagctgccgtggcacaggcagagcttaattcacaagatacgcaactgacttcaccgtcagcgggtgtcattcttacccgagccatcgaacccggcacgatgctggcagccggaaacaccgtctttacactctcgctgaccaaacctgtctggatcagagcatatattgatgaacccaatctgaatcaagcgatagcagggcgtgaaatccaaatttataccgatgggcggaaaaatcagccctatcacggcaaaatcggctttgtttctccaacggctgaattcacgcccaaaaatgtcgaaacacccgacctaagaaccgatttggtctatcggctgcgcattattgtcaacgatcccgatgaagggctgaaacagggtatgcctgtcactctgcgttttactgattctaataagtaa

SEQ ID NO: 4162 - DNA, 1737 bp, Xenorhabdus bovienii
  Coding sequence Name=Xb4151_4152.C441.gene263.dna; Position on contig= 205799..207535bp; Strand=+
atgaccagttcggcttacacgatagtactgaacggcgtagagaaaacgtttccggggttggaagttcctgccgtatcgcacttgaatgcagaaattcaagggggatcggtcaccggtcttgtcgggccggacggtgccggaaaaaccacgctgattcggatgctggcagggctattgaagcccgataacggcaatattaaaattatggggcttgatcccatcaaagacagcgttaaagtacgttctgaactgggctatatgccgcagaagttcggtctgtatgaagatttaaccgtgctggaaaatctcaatttatacgcagagctgcggggtgtgcttcgcgaagagcgcaaggccacttttcaaaaactactgactttcacagagttaacccatttcacggggcggctggcgggaaaattgtccggcggtatgaaacagaaactggggcttgcctgtacgctattaggaagcccgaaagttttgctgcttgatgagccgggagtaggtgttgatcccattgcccgtcaggaattatggcagatggtgcacgaactcgcttccgacggaatgttgattctgtggagcacgtcttatttagatgaagcagagctgtgccgtgatgttttgctgctgaaccgtggtaaattgctctatcgcggccagccgcagaaattgacccagaatattgtcggacgatcttttctacttgatgtcaaacaaggttcccgccgtaaaatcctgcaacatgcgcttacgctgccacaagtgactgatggggtgattcagggaagatctgtgcgtctgatcttaaaagctggtgtagaccaaagcaatctactccagcaaatagggctgcctgatgccaagctatttgacgctgaacctcgcttcgaagatgcctttatcgatctactgggtggcggtccctcccatcgctctgcactggcagaaatcatgccgcagataccgcccaatccgacggaaaccgttatagaagcccgtagtctgaccaaaaaatttggtgattttgcagcaactgatcatgtggattttcaggtgaagcgcggagaaatttttggcttgctcgggcctaatggtgctggaaaatcgacgaccttcaagatgatgtgcgggctgatcatccccacttcgggcaatgcgctggttctggatatggatttaaaaaccagttcaggcaaagcgcgccagcgtctcggttatatggcacagaaattttccctctatggcaatctgaccgttgcacagaatcttaagttcttctccggtgtttacgggctgaaaggccgccatcagcgggagaaaatggctgatatggtcaatgcctttaatctcgaaccgatcttacatcaaaccaccgatagccttccgctcggctttaaacagcgccttgccctcgcctgcgctttgatgcacgaacccgatattctgtttttggatgagccaacatcgggcgtcgatccactgactcgccgcgagttttggctgcatatcaacggaatggtagataaaggtgttaccgtgatggtgactacccactttatggatgaagcagagtattgtgatcgtatcgggctggtatttcggggaaaattgatcgccgccgggacacctgatgagttgaaactgttggtcaccactcctgaacgccccaatccttcaatggaagaaacctttatcgatcttgtggtgaattatgataaggagcagcaatga

SEQ ID NO: 4163 - DNA, 1176 bp, Xenorhabdus bovienii
  Coding sequence Name=Xb4151_4152.C441.gene264.dna; Position on contig= 207532..208707bp; Strand=+
atgagccatcctgaacgcattcgccctgaatatcagggagcacataaagctgtcagtttttcatggcgtcggttaaaagcattgtgcattaaggagagcaaacaaattatccgcgatcccagcagtgctttgattgcggtagttatcccgttgatgctgctgtttatctttggttatggtattaaccttgattccggcaaactgcgcctcggcattctgatggaacagcaaagtgaagatgcccgtgaactcgttcatgcatttacaggctcgccctatatcgatgctactgtcagcgacaatcgccaactcttgatcaataaaatgcagatgggtgggattcgcggcatcatcgtgataccggtaaattttgatgtccagctcgcccgcgttggtggtcatgcccccattcaagtaatcactgatggcagtgaacccaatactgcgaattttgttcaaggctatgcgaaaggtgtctggcaaatctggctacagcaacgcggacaaaatcgcgcggtttcaacgactccactcattgacatgcaaatccgttactggtttaaccctgcggccatcagccagcattttctcatccccggcgctatttcaattattatgacggtggtaggagcgatcctcacttctcttgtggtcgcccgcgaatgggaacggggaacaatggaagcactgttgtcaacccaagtcacccgaactgaattactgctcgccaaactattaccctatcaagtgctgggttctttcgtcatggtgctttgcatggtattcactgtgtttgtactgggcattccctatcgcggctcactctggctattggcactgatttccagcctctatctcgctaccgccttaggtatgggcttgctgatttctactgtgacacgcaatcaattcaatgcagcaatgattgccctgaatgccgcttttttgcctgccattatgttatccggctttgtttttgaaatagacagtatgcccgcgtttattcaggcaaccacttatgtcatccctgcccgctatttcgtcagcagcttacaaacgctatttctggcgggtaacatcggcactgtgctgatcacgaatttgcttctgctgattgccagcgccatcgtttttattggcctgaccgcatggaaaacccgtcggcatctggattaa

SEQ ID NO: 4164 - DNA, 1107 bp, Xenorhabdus bovienii
  Coding sequence Name=Xb4151_4152.C441.gene265.dna; Position on contig= 208720..209826bp; Strand=+
atgttttacagcctgtatacgctagtcatgaaagagttacagtctctcctgaggaatccccaaacacgggccactctgattgtgccggttctctttcaaatgaccctgtttccctgggcggccacactggaggtcaagaatgccaccattgctatttataatgaggacaaggggcaggcttccattgaattaacccagcgtctggcaaaatcgaaagcatttcctgacattattttgttaaccagttcgcaggaaatccgcccgacgttagataaccgtaaggcactgctattggtgcgctttcctcaaaatttcagtgccaatattgccagccagacaccgacatcaattcaggtcttactggatggacgcaactcaaacagcgcacaaatttccgctaattatatccagcagattgtgatgaattatcagaaggaattattaggcaattcggccagtctcaacaatagcgatttaatcattcgtaattggtataacgccaatctggattataaatggtttgtggtgccatcactggttgccatgattacgacaattggcgttttgatcgtgaccgcactttccgttgcccgtgaaagggagcaaggaacactggatcaattgctggttgctccgttggcgacatggcagattttcctcggtaaagcgatccccgcattggttgttgcaaccactcaggcaagtattgttttacttattgggacactgttttaccaaatcccttttgccggctccctgctgctattttatggctgcactctggtttatgggctatcgcttgttggttttggcttacttatctccgctgtctgttcaacgcagcagcaggctttcatcggcgtgtttgtgtttatgatgccagctattctgctgtctgggtatatttcccccgtcgaaaatatgcccgtttggttacaggatattacgtgggttaatcctattcggcattttactgatatcactaagcaaatttatttgaaaggcgcggatttttcagtgatttggcacagcttatggccgttattagtcattaccgtgacaactggcgggatcgcctatcggttattccgtagtaaaattgcttga

SEQ ID NO: 4165 - DNA, 711 bp, Xenorhabdus bovienii
  Coding sequence Name=Xb4151_4152.C441.gene266.dna; Position on contig= 210091..210801bp; Strand=-
atggaccgatatcaacgttctagtggttcgattgtccagaaagctggctctggtgtacaaacttatatggcacaagtctacggctggatgacttgtggtctgctgttaactgcatttgttgcaggatatgtagcaaatagccctgaaatcttaaacgcaatttttagcagctccattgtattttatggcctgatcatcgcccagcttgcactggtatttgtgctgtctggcttggttcataaaatgagcggtgcgctggcaacagggttgtttatgctgtattccatgctgacagggctgacgctttccagtatttttgtggtttacacgagtggttcaattgccagcacttttgtcatttcagcggcgatgtttggtgcactgagtgtctatggttataccactaagcgcagtctgagtggcttaggtagcttcctgtttatggggttgattggtatcgttctggcttctctgataaacatctggctgaaaagtccggcactgatgtgggcaatcacctatattggtgttctggtcttcgcgggtctgactgcttatgacactcagaaactgaaagaaatgggtgcggagctggatgttaacgataaagagaacctgcgcagatattctattactggcgcattgactctgtatctggacttcatcaacctgttcctgatgctgttacgtattctcggtgaccgtcgttaa

SEQ ID NO: 4166 - DNA, 459 bp, Xenorhabdus bovienii
  Coding sequence Name=Xb4151_4152.C441.gene267.dna; Position on contig= 211001..211459bp; Strand=-
atgatcatggaaaacacacgaatgtgtgtccaaagggagagattcaacgttggtgacgaataccaatggctctcgcagtgcgatgacgatggtgcggttgttacctttacgggcaaagtgcgcaactataatcttggagatagcgtcaaagcactgacactggagcattatccgggtatgacggaaaaaatgttgcaggttatcattgacgaagcccgtcagcgctggccgctgcaacggatcagtgtcattcatcgcatcggtgaattgtatccgggtgaggaaattgtgttcgttggtgtcaccagcgctcaccgtagcatggcttttactgcggctgaattcattatggattatctgaaaaccagagcaccattctggaaaaaagagtctctggtggaaggagagcgctgggtagcaacgcgagagagtgatcaggaagcggctgggcgctggtaa

SEQ ID NO: 4167 - DNA, 246 bp, Xenorhabdus bovienii
  Coding sequence Name=Xb4151_4152.C441.gene268.dna; Position on contig= 211456..211701bp; Strand=-
atgatcaaagtcctattttttgcacaggtccgtgaactggtaggggctgattcactcgaactgcctcatgaatatctaacggttgcggatctccgtcatttcctgattgaaaaaggagaacgatgggcgctggcattggaagagggtaaattgcttgccgcagtgaaccaatcctttgtacatgctgaacaccctttgcacgatggtgatgaagtggcttttttcccgccagttacggggggatga

SEQ ID NO: 4168 - DNA, 438 bp, Xenorhabdus bovienii
  Coding sequence Name=Xb4151_4152.C441.gene269.dna; Position on contig= 211698..212135bp; Strand=-
atggtggatatttctgccaaaacggaaaccgtgcgagaagcacgggcggaagcctttgttgaaatgcaggctgaaacgctggccatgattgttgctggtgatcaccataaaggcgatgtttttgcgactgcccgtattgcggggattcaggcagcgaagagaacttgggaattgatcccactgtgccatccgctgctgctgagtaaagttgaagtacaactagaagcacaagccgaacataatcgtgtcagaattgaatcctgctgccgcctgacggggaaaaccggcgtggaaatggaagccttgactgctgcgtccgtggcggctttgacgatttacgatatgtgcaaggcagtgcaaaaagatatggtgattgggccggtacgtctgctggaaaaaagcggcggcaaatcaggaaactttaaggtgggatcatga

SEQ ID NO: 4169 - DNA, 996 bp, Xenorhabdus bovienii
  Coding sequence Name=Xb4151_4152.C441.gene270.dna; Position on contig= 212212..213207bp; Strand=-
ttggaaggtgttattgtggaacaactcgtagatgcatttgcccgcaaattttattacttgagattatcgattaccgatgtgtgtaattttcgctgcacatattgcctgcctgatggctatcatcctcatggacaccaatcgtttctgtccctgccagaaattcgccgcgtcagccgtgcatttgctgaacttgggacggaaaaaattcgcctgacaggcggagaacccactatgcgtcgtgatttttgcgatatcatcgcgacagtgcatgaaaacccacagatcaaaaaaatcgccattacgaccaatggctaccggatggagcgtgatgttgcccgctggaaagaggcgggactgacggcgatcaacgtcagtgtggatagccttgatccccgccagtttcacgccattaccggacaggataaatttttccagattatgcgtggcattgatgcggcttttgacgcagggttcagtgcagtgaaagtcaatgccgtattgatgaaaaacgtcaatgatactagcctgcccgctttccttgcgtggattaaacatcgtccgatccaattgcgttttattgaattgatggagacgggggaaggtagtgaattgtttcgtcgccgccatctttccggtgaagtgatccgttgccatttgttgcaacagggctggcagcaacagcaacgcgcccgtagtgacgggccggcgcaggtttttagtcatcctgattatcagggcgaaattggccttatcatgccgtatgaaaaaaatttctgccaaagctgcaaccgcctgcgggtttctgcgattggcaatcttcacctgtgcctgtttggtgaacagggcattccattacgtgatttattgtccgatgacacgttacttaatgatctgaaattgcgcattcagggtggcttgcgccataagcgtgagactcactttttacatcagggggatagtggcattacccctaatctttctttcattggcggttaa

SEQ ID NO: 4170 - DNA, 909 bp, Xenorhabdus bovienii
  Coding sequence Name=Xb4151_4152.C441.gene271.dna; Position on contig= 213630..214538bp; Strand=+
atgcgaaaccgcacattagatgatttagatcgtgtggtcgccctcggcggcggtcacggacttgggcgcgtcatgtcttccctttcatctctcggtgcccgtctgaccggtattgtcacaacgactgacaatgggggatcaaccggaagaatacggcgtgctgaaggtgggatcgcctggggtgatacccgcaattgtttgaatcaactgatcactgaaccgacggtcgcttccgccatgtttgaatatcgattcagtggtaatggcgaactggccggccataatctgggtaatttgatgttaaaggcgttggatcacctgagtgtccgcccccttgaggccattaacctgctccgtagcctgctgaaagtcaacgcacatcttatcccgatgtccgaacatgctgtcgatttaatggctgtcgatgatcaaggcaatagggtgtatggggaggtcaatgttgatcaactcagttgtgtaccacaggaattaatgctctatccccatgtcagcaccaccaaggaagcgttggaagccatcgaacgggcagacttgattttgatcggacccggtagtttttttaccagtctgatgccgttgttgttgctggaagatttaactcaatctctgcgccgtagcaatgccagtatgatttatattggcaacttggggaaagaactcagcaatgctgccgcagggctgtcattgagcgataaacttgagatgatggaaagtaagattggccgcaagatgattgatgcgattattgttggcccctgtactgatatcagttccttaagtgaccggattgtgactcaacaaattttggaagctcaggatattccctatcgccatgatcgtgaattattacgacaggctatcgaaaataccctgcaaaaattgggctga

SEQ ID NO: 4171 - DNA, 2019 bp, Xenorhabdus bovienii
  Coding sequence Name=Xb4151_4152.C441.gene272.dna; Position on contig= 214611..216629bp; Strand=-
atgacaaataaagtattcaagttacattctgatttcgagccgggaggggatcagccagacgctatccggaaattacaggaagggctggaagatggtctggcccatcagacgcttttaggggtgacgggatcaggcaaaactttcacgatagctaatgttattgcaaatctgaatcggccaacgatgatccttgctcccaataaaacgctggcggctcagctttatagcgaaatgaaagaattcttccctgaaaactcggtggaatactttgtttcctattatgactactaccaaccagaagcttatgtacccagctcagatacctttatcgaaaaagacgcttctgtgaacgagcatatcgaacaaatgcgtttgtcggcaacgaaagccctgctcgaacgtcgggatgtggtagtggttgcctcggtttctgcgatttatggtctgggtgaccccgatagctacctgaaaatgatgcttcatctgaccgatggtatgctcattgatcagcgcgccatcttgcatcgtctggcagaactgcaatatacccgcaatgatcaggcattccagcgcgggacattccgggtgcgtggagaagtgattgatatcttccccgcagaatctaatgaacatgcgctgcgtgttgaactgtttgatgatgaagtggagcggctttccctgtttgatccactgaccggtcagatccagtacaacgtgccgcgttataccgtctatcccaagacgcactatgtcacaccgcgtgagcgtattactcaggcgatggaagacattaaagttgaattggagcagcgacgcaaaatgcttctggcgtcggataagctgctggaagagcagcgcatcacccagagaactcaattcgatcttgaaatgatgaacgaactgggttactgctctggcattgaaaactactcccgttatctctctggccgtgccgaaggcgagccgccgccaacgttgtttgattaccttgctgcggatggtttactggtggtagatgaatctcacgtcactatcccgcagattggcggtatgtatcgtggcgatcgttcccgaaaggaaacgctggtggattatggttttcgcctgccatcagcattggataaccgcccattgcggtttgaggagtttgaagcactggcaccccagacgatttatgtttccgcaacccccggccgttatgaattggaaaaatcaggtaacgaactggttgagcaggtggtgcgcccgacgggtcttattgatcctgaaattgaagttcgtcctgtcgccacacaagttgatgatctgctatctgaaattcgtatccgtgccgagaaaaacgagcgggtactggtgacgacgctgacaaaacggatggcagaagatttgaccgaatatttggaagagcacggtgaacgagtgcgttatctccattctgatatcgataccgttgaacgggtggaaattatccgtgatcttcgtctgggcgagtttgatgtgctggtgggcattaacttactgcgcgaaggcttggatatgccggaggtttctctggtggcaattctggatgccgataaagaaggttttctgcgctcagagcgttcccttatccagactattggtcgagcggcgcgtaacttgcacggtaaagcgattttgtacggtgacagaatcaccgactctatggcgaaagccattggtgaaaccgagcgccgtcgtgccaaacagcaggcatttaacgaggagcacggtatcgtaccgaaagggctgaataaaaaaatcggtgatctcctgaaaattggtcaaccagtgagtggcaaaggaaaagccaaagggagaggtaaaatttctcccgacactgacgattaccgtaaattgtcggcaaaagagctggaaaacaaaattcgggaattggaagaaaaaatgtaccagtatgcgcgggatctggaatttgaacaggcggcgaatattcgtgatcaggtacaggcattacgggtgcagtttattgctaactcgtaa

SEQ ID NO: 4172 - DNA, 1065 bp, Xenorhabdus bovienii
  Coding sequence Name=Xb4151_4152.C441.gene273.dna; Position on contig= 216664..217728bp; Strand=-
atggcaataaataaacaaccaaatgggaaatggctagttgagctttatcctaatggcaggaatgggcgcagaatccgtaaacagttcacgaccaaaggtgaagcaattgcctgcgaacgccatatattagatgaaactgtagaaaaaccctggcttggagagaagcaagataaacgtcttctttctgagttgattgacatttggtatcgggcgcatggcataaccctaagcgatggcgaacaccgtaaaaaaagaatgttctttgcttgtaaagaaatggatcatccttttgtaaccgagtttgataataagctgttttccatttatcgagaaaaaagattaaatggatatgcggacaaattaaaacccgttgcgcctagtaccgttaataatgaattggcatatttccgtgctatgtttaatgagttgcataggcttggagaatggaaagcagggaatccattaaaaaacatcagagcgttcaacactggtgagaaggaaatggcttttttatcaaatcaacaaattattactctgctaaatttctgtgctaaaagccgagcaaaagatttgcttattattgtcaaaatagctttatcaacaggagccagatggtctgaagcggcgggattaactgattcacaaatcacgccttataagataacgttcactaaaaccaaaggtaaacgcaatcgcacagttccgataactaaagagctgtatgatgagataccgaagagaaaagggaagttatttagctcttgctacaatgcttttcgtacagcggttaagcaagctggtatagagttaccatctcaccaatcgtcccacgtgatgcgtcacacattcgcatcacattttatgatgagcggaggtaatatcattgtcttacagagaatactgggacataccgatatcaagatgacaatgagatatgcccattttgcacctgaccacctgaatgatgccttgatatacaacccattatcgcagttacaaaatggcggcaaaatggcggcggagaacttaaaccctcaatactcaccggcacttatcgtttcataa

SEQ ID NO: 4173 - DNA, 855 bp, Xenorhabdus bovienii
  Coding sequence Name=Xb4151_4152.C441.gene274.dna; Position on contig= 217715..218569bp; Strand=-
atgctatttatttctggtttacttttatgctatttatcctatcgttggattctactgcatcgtaaaaaaaataaacctgaaagtagccatagtctagtaacagataggaactcttctataacagatagaatctctgccgaatttaagaaagaaaataataagttaaacgcagaagaatcaactaataatagttcaactgagtatactcctgcttccagcactgattcaaaagaacttaaaaaacacacatacacaatggttaatgacgaagcaaccatttggacaggtaatattaataacatcagtttttcatttttaaacgataatgaaaaaaaacagagaattactggtgagttaaataggatattcctccataaaaaaggagatttttacttatccataattgatggcgatggtataaaccacattatcaatgaacaatatgttgaaactaaattcttagtcagatcatcacgatatgaattcgttgaactttgtagagaaatcttaaagctaaacaatagcgacgtgtttgaatatgcaaatattatccgtgacatagccgcaaccgctaaaattatcaaagaaactctcccaatcagaacttcattcacctatacatactttaaaaatgaattaagagtaagagaaaagtatgacgttcttatagatcaataccttgagaatgaatacggccatcaatggatatctggtcttgactctaatacgggtaaaagacatatctttcagaaaagtaaaattgacactatgttaaatagtgaaggacataaaaaacacaaatttgacgaatggttaagcgttatatttggtatagaaaataatggcaataaataa

SEQ ID NO: 4174 - DNA, 588 bp, Xenorhabdus bovienii
  Coding sequence Name=Xb4151_4152.C441.gene275.dna; Position on contig= 218691..219278bp; Strand=-
atgggtacatatgactttgtgtcatgcgaaaacaatgctgaggtattggatcgtataattgaagcatacggattttcttcaaaaattatgctagctgagcattttaatatggctgcaagtagcctatcagggcgctataaacgttctatctttcctgcggatatggttatccgctgtatgcatgagacaggggctaatcttgagtggctagcttttggaacaggtcacccgtttgatcatgaaaaagttgatatattgaaactacctaatcatcgactggttgatggcaatttaaaacaatcaggtcatatcatgtttgataaagtaatgcttacgaacggtgctcttttaccttctgaccctgtatcaatccaagaagataaagattactacgttattgaccgcaaattcgctgatgtgtttgacggtaaatggcttgtcgacattgaaggaaaaataagcataagagaactaactagaatccctatcaaaagagttagagtaactggagctggcatccctttcgattgtgatttatcagatttaactgtgcttggtcgtgttattaaggaaattaaggattattaa

SEQ ID NO: 4175 - DNA, 243 bp, Xenorhabdus bovienii
  Coding sequence Name=Xb4151_4152.C441.gene276.dna; Position on contig= 219432..219674bp; Strand=+
atgcgtcccatcatttcaatcaatgtcactgaaccctatctccctcttgaggagttttgccgccgtactgcgatgcctaagaacactgttcgcgacatggtcaatgacggccgcttacctgtccgtgaaaaatcagttgataaaaaacgtggcaaagttcttatcaatatgatggcgctaacagttgaagcattaaatgcgagtaacgttgctgctatttcatttaacacgcaatatgagtaa

SEQ ID NO: 4176 - DNA, 585 bp, Xenorhabdus bovienii
  Coding sequence Name=Xb4151_4152.C441.gene277.dna; Position on contig= 219628..220212bp; Strand=+
atgcgagtaacgttgctgctatttcatttaacacgcaatatgagtaaagcatttcgcttttggagaaaaaaagcaatgtttgattatcgggtttccaaacaatcgtactttgataatgcgtgtcgtgcgttctccaatgcccactcaggcgatttagttcagatcgcggaatctatcggcatgactccgcaaattctgcgcaataagctgaaccctgagcagcctcacatgctgacttgtgttgacttaatgaagttaactgatgcaacagaagacgcttccattttggacggtctgctggagcaattacagtgtcagccatcagtgccggttaatgaagtttgtgatgccaacatgccaagttacctgttaggagctacggcagaagtgggcaagctggcaagtgaagctgtttcgggtgagcatcttaatcagacgcgtgttgcggagtttaagaagacggttaataacgcagtaaggttattgacgttggcgggtgtcactatgtcatcaagattatattctaaccctgcgtttaatacgacggttgatgttgtggcagggatgggagcaacgttagtctga

SEQ ID NO: 4177 - DNA, 135 bp, Xenorhabdus bovienii
  Coding sequence Name=Xb4151_4152.C441.gene278.dna; Position on contig= 220220..220354bp; Strand=+
atgaacgcattaaagcaacagcaataccaatataaattgactggtgagtcattcaaagccaataaaggagatggatttatcttcccaatcgttttgtgtgctttcgcttattttattttgtttcttattcggtga

SEQ ID NO: 4178 - DNA, 354 bp, Xenorhabdus bovienii
  Coding sequence Name=Xb4151_4152.C441.gene279.dna; Position on contig= 220362..220715bp; Strand=+
atgaacacggagtaccaatttgaatcaactgaacagcgagcttttccaatgtcctttgaaatgcgcgctaatggtttaaatcaactcgctcaaatcagagcgcagcatttaaaatctggtaatgagcagttggctacctttattgatgaaatgcgtgataaacgcaatgaacactatgctgataacatccgaatgttaggcgctatgttctatcttgcccatatacctaaagagcggcataaattgaaattaaatcaatttaccagtgaagaaagaattaatttaattaaggcagtgaatttaattaaggcagcgagtgcagtattgccagaaggtttatcactacccaactaa

SEQ ID NO: 4179 - DNA, 258 bp, Xenorhabdus bovienii
  Coding sequence Name=Xb4151_4152.C441.gene280.dna; Position on contig= 220795..221052bp; Strand=+
atggaaaataaaaatttaataattggctatgaccctgctcaagggcgcgatgtttctgtctgtgtaagcattgaacaattaattaaagatgtacgtatggaagagcgcaaacattgtgctgatttatattcggctcgtttagttaaattgtctgcccgcgttttgaaaaacaagatggttcattctgacagtgccgcacttctgcaaagtgaatcggagaacatcgaccgccaagctcaagagtggaactatgtttga

SEQ ID NO: 4180 - DNA, 318 bp, Xenorhabdus bovienii
  Coding sequence Name=Xb4151_4152.C441.gene281.dna; Position on contig= 221117..221434bp; Strand=+
atggatctatttgaaatttctactgatgaacgttcgtttactcggcttttaaatcatggcaatgagtatatttcagtgcttgatgatacccttaattttactgttggtactgtgttaattataagagaagaaattttgaaaggttatgagcctcctaaattcacgggaagaaaactaacagccaaaattgttagtgttattcgttcgtttggatgtgtacaaaatatgtatccatcacctccttttgtctatgtctacgaattaaatgttttgccaatgtcatttttctaccaaacggagtatagcgatgacaaataa

SEQ ID NO: 4181 - DNA, 309 bp, Xenorhabdus bovienii
  Coding sequence Name=Xb4151_4152.C441.gene282.dna; Position on contig= 221424..221732bp; Strand=+
atgacaaataaatctatctctgagttggaaaagaaaagaacgcatagcctaatcatcagtggagttcattttaatttcatggctgtagttgacggcgatagaaaaacagcgtttgtcaaagacgatagagattataaaagcggtgattttctggcattgaatgaaattgataatgacgggaatttcacgggcagtttaatggcagcaagaataacagatgtggcggcaattgataaaaacctgtatccgcagatagcgggggaatttgtttttctttcgtttgaattggtttccgttaattacctatag

SEQ ID NO: 4182 - DNA, 2223 bp, Xenorhabdus bovienii
  Coding sequence Name=Xb4151_4152.C441.gene283.dna; Position on contig= 221734..223956bp; Strand=+
atgaatattgcagtcaaggaagaacacaacagcgacgcattactttcaatgtgtcgccaacagtttcagccagagatgccacaaatagcaactctggctgaacgcgttatgtgggaagtgaaccccgcagattacacatggtgtcaccaatactttggacacctgccggattcgttggcggtttacttcgtcaatcgttatgccaacatcttcaaacagtcaggtcgcgacggtcgtcgccgtgctaataaatttttgcgccagttcagcaagaatgtattaccacggttcaatctggtcagtgaacaataccagtttcaaagtttggccgtaggtgctgaacctttccctttcattgaacaacttgaccgtcttccaacattaggacgtaaagagatcaggttactggcgcacggtgtagcgcggtatatgaccgacagttacgaacactttgttaatcattcagcaaccccagacaatgagcaggaagcccgccaaaggttaatttatatctatacccagttggcaaaattaactcagcaaattgggacagccgcaccctattcacaacagtttacaaaaggccgggtttcacccaccgaagatcagctatgcgccagtttgctgcgcatgatgtcggatcaatggtggtatgcccgcttaaagcgtctgcgtgatattcgcgctgaacatatggcaatggcagtcggtcaggtacaaaaggccgcttcatcctatgtttcacgccagaccttacacgaatggacagagcagaagcgccggaactgggaatacctgcaagagtttgaattagaaaatgaagaaggtgagcgggtttcactaagcgataaggtcttgggcagcattgcaaatccggccgtccgccgttgtgaattgatgatccgtatgcgtggatttgaggacttagccaatgaaatgggctgtgtcggtgatttctataccatcactgcaccttctaaatatcattcggcacacagtggcggcggttttgttaagaactggaacggggcaagcccacgggatacacaaaaatatttgtgtggtgtctgggcaaaaatccgggcggcgtattcccgtgcggggattagcgtcttcggtttccgtgttgttgagccacatcatgacggcacaccgcactggcatctgttgttatttatgcagcctgagcatgtcgaagacatgcgggaaattgtgcggcaatatgcgactcaggaagatgcccatgagttaaacagtgaagccgcccgcaatgcccgctttttggtgaagccgatagatccagaaaagggcagtgcaacaggctacattgccaaatatatctcaaagaacattgatggctacgcgctggatggtgaagtggacaacgaaacagggggaaatctcaaggatatgtctcgttctgtttctgcttgggcgagccgctggcgcattcgtcagttccagcagattggtggtgctccggtttctgtctggcgtgaactgcgccgtttaaggggtgacaaacagattttgcctgatgaggatatggataacgtccgctttgcggcggatgtgggcaactggtcagcatataccgagtttcagggcggggcattggtttcacggaaaaatttaaccgtgcgcctgtcttatgaagtcaccgaacagggcagcatctacggtgaggatgtacaacgcatttcaggtatttactcgccccgtttgggtgagtcctcatcttttattacccgtactgtgaaatggaagattgtacctaaatccagcgctgcacctgcgggtgatggttttggggtttcttctaattctggcggctctgccgcctcttggagttctgtcaataactgtacggaggcacgaagtacggtcagcaacggtagtgatctttgtttagatgagtttcatcagaattggtctcagatgagcgagaaagaaaagatccagagggtttatgaatcagccaaattgaatgatatagagatgagtgatggtctggcgctgggattactgaggggcaatagcatgacggtagagggtcaatattatcggttatcgatgtttggtcatttatgtcccgccaaaccgccgcatactgaaagggcaaaaataatactgaaaaggttaaatgaaacgggacgtgtcaagattaatattaatgcaattatccgtgatcctaaagggtattatcttaatgctttggagtaa

SEQ ID NO: 4183 - DNA, 204 bp, Xenorhabdus bovienii
  Coding sequence Name=Xb4151_4152.C441.gene284.dna; Position on contig= 224076..224279bp; Strand=+
atgtctgattctttgaataaatttgttcttttagaacgtattgaattaatttctaaaattggcggtggggatagctttaacgataaagataggcaagtggcgttatattgggttggggaactggcggagcaagttaaacaaatgataatagaaaagccactaaagagtggctcaacggaattatgcggcgctagtctgcaataa

SEQ ID NO: 4184 - DNA, 321 bp, Xenorhabdus bovienii
  Coding sequence Name=Xb4151_4152.C441.gene285.dna; Position on contig= 224256..224576bp; Strand=-
atgagcaaaaaaatggtaaaatcgaggaaaatcgatacattgggaatgaggaacatgcgcgtattaaaaataatctgtcctgagtgtggcgctaaagctatcattcgcaaaaccaaccggatgcatcgtgaaattgccgatgtgtactgttcgtgttttgatgtggaatgcggccatactttcgtcatgaatctgacgttttcccacaccataagccccagtgccaaaacgggcaatattctgttgcagactgtgattaataacctcaatccgcaacagcgccaaatggcgttagatttattgcagactagcgccgcataa

SEQ ID NO: 4185 - DNA, 1029 bp, Xenorhabdus bovienii
  Coding sequence Name=Xb4151_4152.C441.gene286.dna; Position on contig= 224573..225601bp; Strand=-
atgagtaagaaaacgttaaggaagaccgccaaagcacagacaaatcaccgtcaacggaaaatgagcctgatcacgctgggtaaaccggagccgatactcacgaccatgacggattaccaaaaaatctggtatgacaacgactatgatcattacaccctgccgattgaccgtttagcactggcacaactgaccaacatgaacggaacgcacggcggcattatctattcccgccacaatatgatttcctcggattacctcggcggcgggctgacacatgagcaatttaaggcggccatgatcaatttcctgattttcggtgatgtggccatcctgaaagtccgtaatttctggggcgatctggtcagactggacgtgttaccctcgctctacctgcgccgccgcaaagacggggattttgtggtattgcaggagggtgagccgttggtctattcaccggaagaggtcattttcatcaagcaatatgatccccagcagcaagtttacggcctgccggattatatcggcggtattcatgccgccttgctcaactcggaagccactatcttccgccgccgctattatcacaatggcgggcatacgggcggcatgatttacattaatgacccgaatatctcagatgaagccgaagaagagatagaacgcaagctggcacaaagtaaggggattggcaactttgaaaccctgtttgtgagcattcccaatggcgaccctgacggcattaaatttattccggtcggggatatctctgccaatgatgaatttgccaatgtgaaaagcatcagttcgcaagacgtgctgaccgcgcaccgattcccggcaggactggcgggtattattccgaccaatgtcggcggtctgggtgatccggaaaaagcccgtgatgcctaccgcaaggatgaagtgatccccgttcaaaatatgttcatgagtgccatcaacagccgtgaactccccgaaatattacacctacgttttcaacaagataacgtaagttcggatgcagaatga

SEQ ID NO: 4186 - DNA, 1785 bp, Xenorhabdus bovienii
  Coding sequence Name=Xb4151_4152.C441.gene287.dna; Position on contig= 225601..227385bp; Strand=-
atggctaaatactcggatgagttaatcaaagtggcaaagtcgctttacctgcgccgctcgactccggctgaaattgccgaagagttaaatctgcccaatcggcggatcgtttactactgggcagaaaagtggaattgggcggatatgctcagccatgaaagtgtgattgaagcgattaaccgccgcgcggcgttactgagtgaacgtaataataaaaccgcgctggagctggacgaactcgaccgcctgattatccatcatgtgaaattgatggcgcaggaaaataagcacaaggaaaagctggccgacattaaagcgcgggcgcaatcagacaacgatagtgattatgcgccatcgggtgacggtgagccgaagaaaaagaaacgctatcgcaaaaatgatatttcggcactgacggcggaagatttccagacctttattgatagtaatttgtttggataccagaaacatttgcgtgacaacaagcaccagcaagtacgcaatatcttaaaatcgcgccaaatcggggcaacttggtactttgcgtttgaagcctttgaagatgcagtcttaacagggaagccccaagtgttcttgtcggcttccaaaccacaggcgcaagttttccgctcctatatcgttaactttgctgaacaacttttcgggatcaccttatccggtgaacacattcgcctgagcaatggcgcagaactacgctttctttcgaccaacaagaacaccgcccaatcttacagcgggcacttatattgcgatgaatacttctggataccggattttaagcggttcaacgaagtggcttcggcaatggccacccatgatcattggcgcacgacttatttttcaacgcccagcgcgaaaacccatcccgcctactctctttggacaggtgacgaatggcgcggcaatgatcccaagcgtaagaacgtggctttccctgcctttgatgaactgcgggacggcgggcgcgattgtcccgatggtcagtggcgctatgtcattaccttggaagatgctattaagggcggctttaacctcgccagcatcgaccgactgcgcaacaagtataacccggactcatttaacatgctgtttatgtgcgtgtttgttgacagcggtgcctctgtcttcacctacagtcaggttgataaatgcggtgtcgatatcaacctgtgggaagatcacgcccccaacgcttcacgcccgtttggtgaacgtgaagtctggggcggcttcgatcctgcccgctccggtgatacgtccacttttgtgattgtcgccccaccgatgatggcaaacgaagcctttcgggtactggcgacgttctactggcagggcatgaactggaagcatcaggcaaaactgattgaagaactgttcaaacgttatcgctttacccatatcggcattgataccacggggattggtcacggggtttatgagatggttcaggatttcgccccacggcaaacgcaggccattcactacagccagcagagcaaaaaccagttggtcatgaagatgatcgatgtggtcagtgaagaacggctggaatgggatcaggaacaaaaagaactcctggcctcgtttctgtctatccggcacaccaccacggccaaaggcggcgcaatgacctttgtcgctgaccgttcgcaggaaaccggacacgccgacgtgttctgggcagtctcccatgccctgatgaatgagccgttaaattacgagaagaaacgcacctctaaatataaatttgcaaaggcagcatga

SEQ ID NO: 4187 - DNA, 840 bp, Xenorhabdus bovienii
  Coding sequence Name=Xb4151_4152.C441.gene288.dna; Position on contig= 227566..228405bp; Strand=+
atgtctcagttaatgacgaactggatatgtattgccatggaaggcgacaccgtcgatggccgggtgatggagccgcaatggattctggatgcggcagaactttatgaccctcaattgtataccgccctgatttggccggagcatgaacgctggacaggaacgatgggcgaagtgctcgcggttaaggccgaacgcggggaggacggggctttgcgtctttatgcgcaattgcgacccaatcaccgtttgttggacgccaaccgggacggtcaactgttgtttacctcggtagaatttacgatagacggtaactggcgcgggacaggcaaatcatatctggaagggctggctgtcaccagttcgccagccagtgtaggcacgacacgcttacagtttagtaaaaagaaaaaatctcatcggtcaggcacgtattcgccgctggtgattgacgaagtcagggaatttaaacaaaagggaacaaaaatggctaaaagcactaaaaagacatggcgtagtcgcttcggtattgaagagccggaagaaacctcagccgaaaacacgggtgacgatgcgttgcaggctatcgctgaagcattggcagaaatggataagcgaatggctgccgtcgaaagcaagctgaaatccactgagcaggaagtggaagaagtacagggcgatatcgaaaccgtcaaagaggtggttgatactgaagagtttgcccgattgcgtgacagtctgccggatattctgaaaaagtttggcaaactggatgggattgcgacccacttgccgtctaaaaatccaaaaggcaacaagaacaagagttttaattatctgtga

SEQ ID NO: 4188 - DNA, 1032 bp, Xenorhabdus bovienii
  Coding sequence Name=Xb4151_4152.C441.gene289.dna; Position on contig= 228438..229469bp; Strand=+
atgcaattaaatcaacgggcacacgcatttttgcagaattactctgtgggattggcaaaagcctatggggttacggatacctcacgttacttcgcgctgagtgacccgaaagaaaccgccttgcgcgccgccctgctggaatccgtcgaattcctcaacatgatcacttgtgcggatgtggatcatctgtccggtcaggtggtgtctgtgggcaatccgggactctttacgggacgcaagaaagatggccgctttatgcgtgcgacgggcattgatggcaatgaatataaattggtggaaaccgattccggcgcagcgctgaaatgggacttgctgtccatctgggcgaactccggcagtgaagaagaattcttcctgcgtatgcaggcctttaccaatgagtcatttgcactggatatgctgcgcgtgggctttaacggccagcgtatcgccgagacaaccaacccggacgagaacccgaatggggaagatgtcaacaaaggctggcatcagattgccaaggaatggaacggcggcaaacaggtgattaccacgcctgtcacactggatcaacatggtgaccataagtcattggattcgatggcttccgacctgattaacacctgtattccgcagcaatttattcatgatccgcgtttggtggtgctggtcggggcggatttggtggcagcggagcagtaccggctttaccagtcagccgacaggccaacggaaaaaattgccgcgcagatgttgggcagctctattgctggccgtccggcgatggtgccgccgtttatgccgggcaaacgtatggtcgtcaccatgttgcctaacctgcaaattctgacgcagcgcaatacccgtcagcgcaaggcggaatttgtggacgaccgcaagcagttcgaaaacaagtacctgcgtaatgagggctatgcgctggaaacgccggagttgtacgcggcctatgatgagagcgccgtgacgattggcaaagtggccgaacctgctgaaaaaacgggtacagactaa

SEQ ID NO: 4189 - DNA, 708 bp, Xenorhabdus bovienii
  Coding sequence Name=Xb4151_4152.C441.gene290.dna; Position on contig= 229469..230176bp; Strand=+
atgttgtcacctgctcaacgacaccgggcagcggttgaacttcgccagaaactggcacggcaacaagccgtcgccattgccgatggcgcgagtatgcatctgcaagcccgtgcccttgagcaggacgtgaagcggttgcgtcagttggcgttgaccgcagaacgggtcgagatgaaaaagcgggaattgctgcccaattatcagcctacagcagagcgctatttagctgagggcgaggtgtaccgcaacccgatttttgcccattgcatcatctggttatttgatatcggggattttgataagggactggactgggcggatatcgccattgagcaaggacagctcaccccggactattttaaaagtggctttccggcgtttgtggccgatacagttttactctggtcacaggcggaagccgaagcgggaaaccccgtggaaccctatttttcaaggacatttcagaatgtcactgaaaaatggaaggtacacgagaaaatcaaggctaagtactacaaatttgccgccctgaacctgctgaaaggggataaccccgacattaaggtgagttcggttgacagtctgggcgtgctggagcaggccgatagttggctggcgaaagcccacaagtgcaaccagaaatccggggtaaaaacttatcggcaacggattgccgcccgcttgcgggcactgacaaccgaaccataa

SEQ ID NO: 4190 - DNA, 99 bp, Xenorhabdus bovienii
  Coding sequence Name=Xb4151_4152.C441.gene291.dna; Position on contig= 230221..230319bp; Strand=+
atgttaatggccgtggaaaccggacagcccgctttttattcagggagaaaggcacgatgtttaatggcaacaccgtcgattatcgggatgcaccgctga

SEQ ID NO: 4191 - DNA, 453 bp, Xenorhabdus bovienii
  Coding sequence Name=Xb4151_4152.C441.gene292.dna; Position on contig= 230277..230729bp; Strand=+
atgtttaatggcaacaccgtcgattatcgggatgcaccgctgaccaatgacggcttttggccggacttgaacctgaaagagtttcaggtcaatcgcaagctgcccgctgatttggacaatgacatgctcgctaatgcgttgctggcaacggtggctgagatcaatctggacttgcagcgcctgaaatcgcgcttgcaggccaaaggctacccatgtgcggctgatgtgctgggcatttccatcaatggcaataacgcactggtcagccagtataaaaaagcggtctatgcgcgggcaaaggccgatttactgggggagtacacgacactggtcagccgtgcccccaatccgggacaggaaagccccgaagcgcgcaacagattgctggctgaagcctcggtcgtactgcgcaacatgaaaggcttaaaacgcgcaacggtacgactgatatga

SEQ ID NO: 4192 - DNA, 501 bp, Xenorhabdus bovienii
  Coding sequence Name=Xb4151_4152.C441.gene293.dna; Position on contig= 230726..231226bp; Strand=+
atgagcaaattacagcagttaaccgcctttctgcgggaaaacctgccggaacgcctttgcgagacggaatttaccagcgaaatggatgaaattcgctttattccggcacaacgggatttaggtctggggcaataccagatgtttgtccagcaatatgaggtggtgattgcgtgggggcgttttccttatcgggagtgtgatccgcgcaatatccccctgctgatagatatctggctgactgagcaaggtgaaagtttgggtgatgccaatgtcgagcaggaacggccatcattaacggttgaagtggatggcgacacggcggttgtggtggtgtcgctgtcactggccgagccagtggtgatccgggaagacccgaaaggcatgatcccgtttgatggcaagcgctggtcactggctgaacccgaagtgtggttcgctgaacaaggcgcggtgcacagtgttgacgagacaggtgcccagattgggcaagtacggtcatga

SEQ ID NO: 4193 - DNA, 675 bp, Xenorhabdus bovienii
  Coding sequence Name=Xb4151_4152.C441.gene294.dna; Position on contig= 231223..231897bp; Strand=+
atgatcaacggtcagttgaaccgcaaccagcttaaggcactgcaagatgaattgagccgccttgagttaccgccgaaaaagcggcagcgtctgttatggcgcattgcaaaatatggtgtgattcaggcggcaaaacgtaatgtacgtaatcagcaatcgcccgatggcagtagctggcctgtccgcaaaagtccgtggcgcaagaagatgctcaggaacatgccgaagctcttgcatattcgggaaatgccggaaaataacgccgtgcgcatttacctgcaaggcgggcattaccggaatgggagtcagccagtgccagcgggtgtcgtcgggtatgcacagcagcacgggatgcgttttcaggtcagtcggcggcaggtgcaaaagaacgttgaccgtgaacgtatggcaacgatcaaacaggcaaaaaagctgcgtgagttaggctatcaggtcaggaagggaaagcgctggcgaaagccgccaataaaggaaatcaccgccaatatgaagtttattcaggccggatcattgatccgagaactgagcggtaaagtggcgaaaagcgcatggacggtggatgttccatcccgtgagtttttaggcatgaatgatgaggaattcagtcaggcgttggctcgccagttacaaagcattggatacggcgcgccttaa

SEQ ID NO: 4194 - DNA, 1122 bp, Xenorhabdus bovienii
  Coding sequence Name=Xb4151_4152.C441.gene295.dna; Position on contig= 231921..233042bp; Strand=+
atgtggccacatgttcaggttaatcaggttaaccaactgcaaggcgaaaccaaggtgattgaacgggtattgctgttcgtgggggcgggaaaaacccatgtgggcaaaactcttgccgtgaatacccagacggattttgatgccgtgttgggaacggcgcaaaccgccctcaaacgtcaggtactggcggcgatggctaacgcaggccaaaactggtctgggtatgttcatgtgttgcccgaatcggcggatgaactggcgttcgtggaggccgtcattgcggcgcaaactatcgcgagcgttgaaggttatgtactgactgtcggtgccaccaaagccattatcaaggcggcgcagacgctgcgggcaaacacgattgcccagtttggccgctggcagtgggcgattttggcggttgatggcacacaatctaaggagccgtgggcagattacgtcactcgcttggcggagttacaaaagggtgaagccgtgccttcggtgcaactggtgccgtgtctgtgggggcatgaggctggcgtactggccgggcgtttgtgcaatcgtgccgtgacggtggcagacagccccgcccgtgtccagaccggggcattgatggatttgggcgcaacggatttcccgaaggatggtgcagggcaaacgcttgatttagcgaccttgcaggcactggaaaaactgcgtttcagtgtgccgatgtggtatcccgattatgacggcctgtactggtcagacggccgcaccttggacgtggaaggcggcgactaccagagcatcgaaaatttgcggattgtcgataaagtcgcccggcgtgtgcgtttgcaggccatcgccaaaattgccgatcgcagcctgaacagtacaccgggcagtattgccacgcatcaggcgtatttcgcccgcaccttgcgtgagatgtcgcgcagtaccgagattaacggcgtgacctttccgggcgaagtgaaatcgccgctcgacggcgatgtcgctattacatggcgcaataaaaacacggtggaaatttatatcactgtccgtacttacgaatgtccgaaagggatctcggtcagtttgttgctggatagcagtctggagaaaaccgcatga

SEQ ID NO: 4195 - DNA, 456 bp, Xenorhabdus bovienii
  Coding sequence Name=Xb4151_4152.C441.gene296.dna; Position on contig= 233039..233494bp; Strand=+
atgagtaaaaggatttcaggccagtcggtcgatttcaatatggacggggatcttgtccatgctgaaaaggtcaatctgtccattacggataataccgccgccgcccagacgcagggcgtaccggatgggtatatctccggtgatgtggcggcagaaggggagattgaactcagtaccaagtatctggatatcgtgacggccaaagcccgttcagcgggttcgtggcgggggatttcgcccgtcgatttgatgtggtatgccaaggcaggcaacgaagaaatgaaggtcgaagcctacggctgcaagctgatcgtcagcgacattctggatgttgatccgaaaggcggtagcgtcatgacccataaagtgaaatttgtggtgaccagccccgactttgtacgcatcaatggtattccctatctggaagcagaactgacacaaagcctgattgggtaa

SEQ ID NO: 4196 - DNA, 294 bp, Xenorhabdus bovienii
  Coding sequence Name=Xb4151_4152.C441.gene297.dna; Position on contig= 233507..233800bp; Strand=+
atggaagaacatgaaaaaacctttgtcacgctggtgctattgggggcactgattgcgttaggcaaaatgctgacaggccatgaaccgatcaccttacggctgtttgttggccgtatcattctggggtcggcggtgtcggtcatggcgggggcgttgctgatttggtggccgggtatcagcccggtggccgtgaccgggattggcagcgcaatggggattgccggataccagttaattgaggtctggttacgcaagcgcggcagcgcttggttaacagggaagttaaagaaatga

SEQ ID NO: 4197 - DNA, 339 bp, Xenorhabdus bovienii
  Coding sequence Name=Xb4151_4152.C441.gene298.dna; Position on contig= 233797..234135bp; Strand=+
atgacactgagtgaaaaacaacaattattttctgtcctgattgcccaactgattttatgggcagatgagcatggatatcgggtcacgttcggggaagcctaccgcacaccggagcaggccgcactgaacgcgaaaaaagggatgggtatccgcaatagcctgcatagccaacgtttggcggtagacctcaatttatttattcagggcacgtatcagacaagcagtacagcgtacttgccgttgggcgaatattgggaatctctcggcggcacatggggcgggcgtttctcccgtcctgatggtaatcatttctcactggcgcataacggggtgaaatga

SEQ ID NO: 4198 - DNA, 390 bp, Xenorhabdus bovienii
  Coding sequence Name=Xb4151_4152.C441.gene299.dna; Position on contig= 234135..234524bp; Strand=+
atgcccaaggcacggatgctctattttttcgttgtggcactggcgttcggtgcaggttggcgcgttaatcactattaccgtgacagtctggaattgaagatcacccggacggcggcggaaaccggggcaaaaatccggcaggaactgcacgccatttccagcgcctccgcccgacaattggaagaaaaactggaagggatcgcccatgccgccccaagagaaattcgtactgaagtggttaagcctgtttttactgctgtgtgcgttagccctgagtttgtcaggatgtacaacgagaccgccgacagtattgagcgaacattatcaggaaaacttactgacaaaatgtcagggcacattaccgaaactgaccggaacgaccggaaataa

SEQ ID NO: 4199 - DNA, 270 bp, Xenorhabdus bovienii
  Coding sequence Name=Xb4151_4152.C441.gene300.dna; Position on contig= 234626..234895bp; Strand=+
atgagcaaagaaaataaaatgattacgttaattatcggtgaaacagaaattaactttgagccgaatatggtcgcctataacagcatgattaatgatatggcaatggataataagattgtgcccattgtttcttatttacgccgtattgtacagcctgcgtctaaagcagcactggatgaactcttgcttatccccggcgcagccatgcagattgtggaaaaggttaattcggaatatgcgcccaaattggatattgaaataaaaaactaa

SEQ ID NO: 4200 - DNA, 2109 bp, Xenorhabdus bovienii
  Coding sequence Name=Xb4151_4152.C441.gene301.dna; Position on contig= 235080..237188bp; Strand=+
atgatgggacagttagattttacattgagtttaatcgacaaactgacacaaccgctggcgggggcaaaagcggcagtctctggttttgcccagtcttcacaggatgcctttggcaaactggcggttggcggcgcaggattggccgcctcgttctggtcaatcaagggctttcttgatccggcgattgagatggatgacgccctgaaatccgcctcattacagggcattgatagcggtgtcatggcgaaagtcgctaaagacgccatgacctttagctcacagtatggcaaatcgtcggttgagtttgtgcagtcggcatcggaaatcagcaaggcggttaatgggctgtcacaaagcgacttgccccagatgacccagattgctaacaccaccgccgccgctctgaaatccagcgcaaccgatacggccagttatatggggaaaatgtttgcgcagttttccagccatgccaaagaggtggggcatctccagtttgccgaggagctggcagataaagccgtggtgatgtcgaagaccttcggcacgtccatgacagaaattgccgacctgatggaaggtgcccgcgccgccgggacaaactttggcgtagggatagatgaacagttggctgtgctgggcgagttacaacgctcactgggcacggaatccagcggggcgtatgagtcatttttaacgggcgcggtcagcggggctaagacgctgggcttaagttttgtgaatgcgtccggtcagatgttgtccatgccggacatgctggaaaagttacaggctaaatacggcaagagcattgaaggcaaccttaaggcgcaggctgaaattgaagcggcctttggggattcggccgtggtggtcaaacagctttacggtaatgtcgatgtgctgcgcaagaacatgacttcattgggcgcgaatgatggcatgaagcggactcgcgacatggccgcacagatggccaacccgtgggaacggctgcaagctatttggcagaatattcggattgcggttggctcaaccttgttgccggtgatctcttcactggtcaatcggctcgccaatgccagtcaattattggtgcgttggttgaaactgtttcccaatatcgcccgttgggtcggctatatcacggtgggtattctgagttttgctgccgcaggggcggcggccaatatcatcatgggcgtgtctaaatttatctggctgggtcttaaggggatttgggtcgcctgtacgctgatcatgaaactgtggacggcagcagtatggatttgtaatggtgccattattgtctggaataccacattacgcgtgttacgcggggtcttactggcggtcaggattgcggcttttttagcgggtatttcgttcagctttatgacgtggccgatcttgctgattattgcggctattgcgttgctggctattggcatttatctgcttatcaagcattgggataccatcaaagcggccatcatgaacaccacggcctttaaggtggtggcggcctatgtgaaatgggtcggcgggatattcagcgcggtctgggattggattgccgagggctggaataatctgtgcaactggttcagcagtttttcactggcggacaccttttccggcatggttgacggcctcagtaatatcttcggcggtttatgggattggctgaaaggatcgttcagcgatacctataactggattgtcgataaattaaattaccttccgggcatcaatattgaaacccaagccattgaaaagacggtgactgaaccgatgggaaaagtgacagcacccacgggggggatgggggaaaatacccagaaacttatcgcccagcctcatggcctcttgcagggacaacctcaagcgaggatacagcctgtaaaagccattaagccgccagaaacggagggcgtattaacgggcgggaaaaagcaggggatcggcaagcagggtctgatgaaagaagtgaccacgaattcacagaccctcacggataacagccgccgctttgaaaatgtaacattcaatgtcgccaacggcatgacgccggaacaattaacggaatgggagcatgtggcttatggatga

SEQ ID NO: 4201 - DNA, 345 bp, Xenorhabdus bovienii
  Coding sequence Name=Xb4151_4152.C441.gene302.dna; Position on contig= 237172..237516bp; Strand=+
atgtggcttatggatgagcctaaatacattgatttattgatcaccgagggtagcttcacgctgaactcagggaatgagccgcgattttgccataaccgcatttccattggtcaggactgtgtgcatgccattatggaaagcgggctggctacggagcttgttgccgaacgcagcccgacactgcgcgcggatattcgtacccagatagaaattctggttgaagacgatgagcggattattccgggcacggtcatcattaacgaagaaacgccgacccagttatggatcacggctgagacgtatgattttggccgcctgaatgtgagtgtgggacatggacactaa

SEQ ID NO: 4202 - DNA, 1185 bp, Xenorhabdus bovienii
  Coding sequence Name=Xb4151_4152.C441.gene303.dna; Position on contig= 237506..238690bp; Strand=+
atggacactaaaccgacgattgattacgagaaagtgctgcgtgatagcgggatgccgaccacggaaaccgacatcagcgccgcgttcgccaccgtcgtggatgaagccgggctgattaccaacacgtctcggatgtccccgttctggcggttgattaacacgattgtgacgcggcctgtgttatggctgaaagaggcgctaatcaacgtgacgttaaaaaatatgtatctggcgaccgcagcgggggcatggctggatatgttcgcatggggcgtcaacctgaaacgcaagcctgcaacagcggcacagggggttattcgcttctataaagccgcaggtgcatcggcggtgacggtgcctgccggaacggttatccagactgagcgcattaatggcgaaatctatcgtgtcagcaccacagaaagcggggttatggcggaaggcgttacccgtgctttacttccggtaaccgccgatgctacagggggcgcctttaatctggctccgggctattttcgcctcctgcccgtggccgtgtccggtattgaacgggtacaaaatgaggaaggctggttattgacgcccggcgcggatgctgaaagtgatgatgatttgcgcgaccgttgccgcaaccaatataacttggtggggaattatcacacggacgcggtttatcgggggatgattgccactgttgcaggcttgagcattgaccgtattttcttcctgcatgacgcgccccgtggcgcgggaaccgccaatgcgtatttattactggattcgggcgtcatcagccagccgtttattgaggcggtgaacgattacatcaccaatcaggggcatcatgggcacggggatgatatgcagtgtttgccgatgccggaaacccatcatgcgctgaccgtgacactctttgtcgggcacttggcgaactacagtcaggaacagatagccagactgaaaacagacgtgggcaaccttattcgctgcgcttttcgggaaaacactgattatccagtgaagaaaacatggccgtactcgcgtttttctttttccaacttgggacgcgagatacaccgcgaattcagcgagattgaatctctgactttttcattgggtgacatcctcagtgagttgagtgtgccacggctgcaatcgctgtcggtggaggtgaaggatgtctga

SEQ ID NO: 4203 - DNA, 657 bp, Xenorhabdus bovienii
  Coding sequence Name=Xb4151_4152.C441.gene304.dna; Position on contig= 238683..239339bp; Strand=+
atgtctgaattcagggaacgcctgaaacggctggcgctgccctcatggatggataagggggagcctgccaagctgctccgtgcggcgcgggcattctggctaagtgtctatgactggctgacatggccgttggcacaactggacgcggaaacctgtgcagcggcgctcttgtcgatgctggcgtaccagcgggatatccagcgctttaacggcgaaccgctgccgttgtttcgcaagcgggtgaagtacgcctttatcaacgccagagacgcaggcagcatcgcaggtttcattgccatctttgagcgtctgggcgtgggctatgtcgaattgctggagcgccagccggaaattgattgggatgtgattatcctgcgcgtcagtgacggccagatagccgaaaatcccgatttgctgatgaacatcatccgtcagtatggccgcacctgccgccgctaccgttttgaagtgatcgcaaaaaatcaattactgatgcgtgtgggcagcgtgggcgcagattactgctgttattacgcggccatgccgatacagccattattgttaagagtggggcatctatcgggcgaatccgtctgtgagaatgcccgcttaaaggaaaatagcgcaccgaatgtgacctacggtgcctcattataa

SEQ ID NO: 4204 - DNA, 2016 bp, Xenorhabdus bovienii
  Coding sequence Name=Xb4151_4152.C441.gene305.dna; Position on contig= 239349..241364bp; Strand=+
atgtcttcagtaattacgacagactttgaaaaatggaaggcacaacagaccgcagcgggaaacccggtggtacttgatgaatttgtctttgcttacgtgccggatttagatcctgcgcaggccatcaatcgtgatgagaaattgcccgccgacaatcatattgtgcatcgtcaggcggtgaacaaaaccggactcgccagtgagaacgccgtggcctacagcgtcacgttgggaacggaagtgggcagttttgattttaactggattggtttgctcaactcggcttctggtgtgattggtatgatcacccatgcgccaacccagaagaaaatcaagacggcaaacggcttacagggcaatgtcctgacccgctcttttttactggagtttgaaggagcggccaaagagaccgccatcacgaccacggcggaaacatggcagattgattttactgcacggttgacgggcattgacgaaatgcaacgcctgataaatattgacagttacggcgaagcggcgtttttcggcgatggctttgctgtggtgcgccacggtgagcagtaccttgtaaaaaaagggctggcttatgtgggcggcttgcgtgggatgctggagtttgaccagacgcttaacagtcaacgcaatacccgtgtgtatgccgattttagttatcaggggaatcttgtcagtcagtggaaaaccgctgggcaaatcaccgtcgccaatgaattgcaaaattacatcgatgcggcagggtatccgcattatgtttttgcggttgccaatattgataataacggtgatatttcagatttgcgtcctaaagggacgttgagtgatcgtgaccttgctgaactggatgaagaattaggcaaggttaaacaagattatgcgcccaagaaatgggtagcgggtagtttcgcccgtggcgatgaatcatccgtcgtcattaaggggagttacccccgcgttaattttatgcaatccaatatcaacagtgattatttggcctttgaagcggattttaacagtgatacacgtgacctttatatgtatcgtcgggatgcacaaggtgacaatatttatgtcctcggatttcctaaaaaaatgggaatgctggctacgctggatgacattaatagcggtttggctgacaccaaagaattagcggaaaatgcagcaccaagggaatgggtggcagagggttttgcccgtgggaacgattcatccgttgttattcagggaaattatccccgcgttaattttatgcaatccaatagcaacagtgattatttggcgtttgaggcggcgtttaacagtgatacgcgtgatctctatttatatcgacggaatgcgcagggagacaatatttatgtcctcggatttcctaagaaaacagggatgctggctactttagatgacatttctgacggtctggcgggaacaaagcaagttgcagacaatgcggcgcccaagctgtgggtggctaacaattttgctcgtgggagcgattcaactgttgttattaaagggggctacccccgcgttaattttatgcaacccaatagcaacagtgattatttggcgtttgaagccgattttaacaatgatacgcctgacctctatttgtatcagagaaatgcacgaggtgacaatatttatgtcctcggattcccacaagaaacaggaacgttggctaggttagaggacatcactaaaagttcagcgctcaaatcaaatgatggatggtgggagtgtggtgatacaggaatgattgtccaatttggtacggtttcagtcggtgataatgaggttgtcaccgaaaaattcccggtcacattccctaataaatgtacgtcattggtcgttaccgcccgctcagaatcgaggaacgggggagctgatgtcttgtcggcctatggagtggctatcagtcaatcgcatatgcgggtgtcaatcagtactaatttttcggctgcaatcgcaggtgtcagtttcatcgcaatagggtattaa

SEQ ID NO: 4205 - DNA, 417 bp, Xenorhabdus bovienii
  Coding sequence Name=Xb4151_4152.C441.gene306.dna; Position on contig= 241366..241782bp; Strand=+
atgtacgtatacagtgctaaaacaaattcattttatccggttaagttgcagttacgttatattgatgccggttcttggccggatgacggtatagaagtcagtgaagaaacgtatcttgaattttcaacaccgccagaaggtaagatgttgattgctgacgatgatggcttgcccgtatgggcagatatcccgccccccacatcaaaggaattgcaacgcggtgcggaatccaaaaagcagcatttgataaagattgccaaagaaaaaattgatatttttcaggatgccgttgatttagggttggcgactgatgcagaaaaatcgacattaacccaatggcgccgctacagggtgctactcaaccgggtagattgtgctatcgcctctcatattgattggccggagcaaccagagtga

SEQ ID NO: 4206 - DNA, 729 bp, Xenorhabdus bovienii
  Coding sequence Name=Xb4151_4152.C441.gene307.dna; Position on contig= 241782..242510bp; Strand=+
atgcgatggcagcgtaaaaccctgcaactgtccccgaccctatcggggctatcggccgctatcgtgcctgtacacccgtttatttatggtgtcgggcagcaggcagacagtggcagttacttaagtccggccaacgcccttcattacctgtcaaataagctgatgggggctgagaacctgaacgccgttgtgctgatgatctgcgccaagacccacgatgaatttatgcagagcctcacgcaattttcatcggtgttaccgttgcccgtcttttttcaggtcacgcgcatggcaaaaaccgcagacagtctggcagcaaccaaaatgcaactgccgggcaaacagggcggcggtttaccgctgcctcaaccgctgtcaacatcgaccagccgcttggccgtcaatgcacaacggatagagcaggccaaagcccaagccagcgcgggcagtagtctggcgggattaaaatcacaattaagcgggtttaccacggcaagacagaacgccttgcaacacgtgacggataccttaaacgggatcaaggataaatcagcccgcgtctggacgttctccgggaaagggaacggcgcattgttggccgaaaagatgcacaaggacatccccgaacccgatgccgtttacacgttggcgacactgtttgtcggggatgacatcagcccgttagaaaggatgctatcgcatgagccagattatcaccctcgcccttga

SEQ ID NO: 4207 - DNA, 546 bp, Xenorhabdus bovienii
  Coding sequence Name=Xb4151_4152.C441.gene308.dna; Position on contig= 242482..243027bp; Strand=+
atgagccagattatcaccctcgcccttgatggcgaggccatcccgttaaaaagcctgaccgtcacgccgtcgatgatgtttcaggatgctgaccaaagcggccagtcatccagcacggcggtggcagagcagggcattaaaccgaaagaattgcgcatcacggggattattccctttaccgaacagaagacctttgcccggctgtttgctctggcggaagccaaagagaacggcaacctgaaacgctaccgcgtcgccaacctgaccgcacaggccattaactttcgcatcgggacattcaccagtacccttgatgccagtaaggtagacggtaaacaggcctggcaggtcacatttaccttgcgggaacatttgtcggtgtccgaaaaacgcgatgcccgcgcagtcggcactattcagtccaagaaacagacaaggcagggagccggagccgccaaggaagaacccgaacagttaagctggtttgagcgtgaggtcttaaagccgattaatgacaaaataggggcagccgatgaaaccccttaa

SEQ ID NO: 4208 - DNA, 1647 bp, Xenorhabdus bovienii
  Coding sequence Name=Xb4151_4152.C441.gene309.dna; Position on contig= 243014..244660bp; Strand=+
atgaaaccccttaaccgattgtcgttatccggtgatgccgttcatttggtcgatgccaatctcatgctggaactgtcatcctgtggccgggggtttatcacggcagagacgggcaccgattacaccggaaaactggtgaggctggatgtcggttacaccgatttaatattacgctggtttacgggctatgtggagcgctcgcagcctgcccagaacggctatcaacgcctgtttgtgcgtgagctggtcggcgtgtttgaccgattgtggccatgctcttttcagcatccgaccctgcgccagatgacggactggttgcaagcgcatagcggcttgacgttcaccttaccggatgcgccttatacggataagcctgtcccgcattacacgcataatggcacgggctatcagctattggcgagtctgggacaggttttttccattgaggactatatctggcagcagttgccggatgggtcggtttatctggggagctgggcgcattcgatgtttgccggaaagcccgtcaagatcccgaatgaattcagccaacatcagtccgcaggcaatgccatgaccctgcccatgatccaatccctgcgccccggcgtggtggtcaatcagcagcggctgaacaaggtcaacctgaacaatgaaaatatggtcattacatgggaagccatcaacaaactgacaggccagccggaaagcaaaacgccgatgcagcgccagattgacgccgcttaccccgaattatcggccgggctgcatttgcctcaattcgcccgtattgaagcacacaccgaaaacacggccagcggcgatatctccgatcccttccggccgcgctatgccgttgatgtgcaattgctggatgatgacggaagagacgccgccgcccctgtttaccgtgccgttccgctgcccctgccgatggcgggcggtgaagcgggcatgttccagtatccgcctatcggtacgcgggttgagattgctttcgaaggtggacgcccggacaagccgtttatccgccaaacgttgagtcagggcaataccctgcccgatatcaagcccggtgaacaattgcagcaacagcgggcggaagtctcgcagcgggtgacgcaggaggggagctggattaggcagactgaccagaccattaatgaatcgtccatgcaccgtgaagtcagggcagacacggaaactcgcaccgtcgttgcacgggaaaccacggtacaggccacggataaaactacggtcttgggaacgtctaccttactggcgggcgctatccagcaggtgacagacggcgaccacagtctggcctcatcgaactacctcgccagcgtggggaaagacgccactatcgacgtcggccagaaactgattgagaaaatcggcttgcttaagcagagcattgccggagtaaagcaagagatagtcgcgcccgtggtgtgggtaggcagccagcaaatcaacgtcatgcaattgatgctagacacccttggcgtggtcaaggagttggccgaactgaccgccgcgcatacccatcacaacacaggtacaccggagaacgccagcgcgataaggaacacggctgataaatcggatggactgaaacagaaatattcgccagtgattgggtga

SEQ ID NO: 4209 - DNA, 228 bp, Xenorhabdus bovienii
  Coding sequence Name=Xb4151_4152.C441.gene310.dna; Position on contig= 244564..244791bp; Strand=-
gtgctatttacgtggttggtagcctcgactatagcgcgacattctcaagccaacatcgtcagtctaatacctatagcattaaatatcaacctatggtatggcgtagaggatctcacacaaataaacgatattcacccaatcactggcgaatatttctgtttcagtccatccgatttatcagccgtgttccttatcgcgctggcgttctccggtgtacctgtgttgtga

SEQ ID NO: 4210 - DNA, 126 bp, Xenorhabdus bovienii
  Coding sequence Name=Xb4151_4152.C441.gene311.dna; Position on contig= 245030..245155bp; Strand=-
atgctttcatccgcttgctcctcatttagggagcgcgatttacccaaccgttgcctttacactgcctgtccggttggctttcatcagcgttggcttgagaatggcgcgccctggccaaggcactga

SEQ ID NO: 4211 - DNA, 105 bp, Xenorhabdus bovienii
  Coding sequence Name=Xb4151_4152.C441.gene312.dna; Position on contig= 245131..245235bp; Strand=+
atgaggagcaagcggatgaaagcattcaaaggctttattgacactgctatcatcgttctcaaagctttagttgcgcttttagaattgatccgtgcatttttgtaa

SEQ ID NO: 4212 - DNA, 315 bp, Xenorhabdus bovienii
  Coding sequence Name=Xb4151_4152.C441.gene313.dna; Position on contig= 245279..245593bp; Strand=+
atggccttacatttactgctcacgatcaagcccactgaggcttataattttctacctctccacaaacgtaatcagacacacacagcaccattcactcatcaactcactgaccatctgtgtttaatttggatcgcgtccctgcatcgctcctatgctgcacaatccccacgaaataaacgtaaacctgacgtaaaacgcactacaccgcacccgcctgcacgttttggatcaaaaaattatttcagttttaaaatccgacaaagggaaccgccagagcgcgccagcacaggcggcgtgagagaaatcgcaaattga

SEQ ID NO: 4213 - DNA, 123 bp, Xenorhabdus bovienii
  unsure (1)..(123): unsure at all n locations
  Coding sequence Name=Xb4151_4152.C441.gene314.dna; Position on contig= 246380..246502bp; Strand=-
aaacgctcgttagcccganccacaagagcccggggagaaccttgtgcattacgttttataaaagtcctctcacacaagataatacgcggcctgcgcaagatttgctgttattctctcctctga

SEQ ID NO: 4214 - DNA, 256 bp, Xenorhabdus bovienii
  unsure (1)..(256): unsure at all n locations
  Coding sequence Name=Xb4151_4152.C442.gene1.dna; Position on contig =1..256bp; Strand=-
atgttaccgctttcactatcaatgaaaagagtaacatgccagtgcaccccaaaagtcatttttttctgctcagtaaagcaaagtcctttgttaccagcctattgtgcctgtcacttagtcttaatggttatgcagattcagaacctaacaatcgggacgatactacaatccagcttggggggaatacctncccaatgggggcaactgacccgctcacactcgttcggtgaagccgcaaaacactggcagctaagca

SEQ ID NO: 4215 - DNA, 474 bp, Xenorhabdus bovienii; identical to SEQ ID NO: 3661
  Coding sequence Name=Xb4151_4152.C442.gene2.dna; Position on contig =318..791bp; Strand=-

SEQ ID NO: 4216 - DNA, 2766 bp, Xenorhabdus bovienii
  Coding sequence Name=Xb4151_4152.C442.gene3.dna; Position on contig =891..3656bp; Strand=-
atggaaaaacccaaggcactgaaccgtcccggtaaattgcgtgaggcggatgaaactactatttaccatgcaaacccttccatcatcgattacctgccctgggtggaatatctggaagacgggcaatgtttattgttggatgacgggatttccgtcggcgcggtctatcagattgaatccattgccaccgaaggccgtcccgctgagcggttgactgaaatccgggatcaactggaagatgcgatccaggacagtctggaagaagatgatatttcgccgtgggtggtgcagtttttttgtcaggatgacgatgatcctgctgactatctcaacaccttgcggggctatgtgaaaccctgggcacagggaacactgtttactgacgcctttctgacggaatcagagcatcacctgaacagcattgcccggcctgacgggatatttcaggacagcttaatcaccgggcaaccgtggcggggccagcaacgccagacccgtatggtggtttatcggtggctgcctgacgggcgcagatcccatgttagcaatccggccttatcagcggtggctgcgctcaatcaggtctgcgaacgtctggtctcgtcactggcttctgccggtgtgattgcccgccgacaacatggcggccagatccacagttggctgttacgtcactttaatccggcaccggattgggggatggcaaaagccgatttttaccatacggtgagttatggtaccaccaccctatcggatctccccgtcaacaatgactttgctgaaagcctgtggtttaccccgccggtgtctgatcccgacgcgggcgtctggtggtttgacgggttaccgcataaagcggtgctggttgagcgtctgcgccgtccgccggaaccgggaacactgacaggcgaagtgaaacggggcgacaatatcaatactctgatggatatgatgccggcagggacggtagtttcgctgaccattgtggcgcaggcacaggacaggctggaagaggattttacccggctgacgaaaaatgcggtgggagaaaatactgaatcgctgcgcgtccggcaggatgtgcaggaagtgaaagaacttctggggcggcggcataaattgtaccgcagtgcgctggcctttctggtgcggggcagggatctggatgatataaaccaccgggtacatcaattatcctccaccctgctgacagccggattacagcccgtccggccggaattcagtgtgtcaccgctgaatgcctggttacgggcactgccgatgtgctttaacccgcagaaagacaaaaaacacgggtacagccgcctgacctgggtacagcatctggccgggttattgccggtgacaggtcgttcgaccggcaccgggcatccggggttcagtttctttaaccggggcggggcaccgctgacctttgatccgatgaacaaacaggatcgcacccagaatgcccatttactgctgtttggtccgaccggcgcggggaaatccgccaccctgtgcgcctcgctcatccagttaatggcagtacatcggccgcgtctgtttattgtggaggcgggaaacagttttggcttgctggccgattactatgaaagtctggggctgacggtcaataaaatcggtatcagaccgggttgtggcgtcagtctggcgctgtttgccgatgcccatcaactgttgaaactgagtcccaagcaattgcgcattaatgaagccgatatccccgataccgatgaacaacaggaagaggagggggatgaacagcgcgatatcctgggcgaaatggaaattgccgcccgactgatgatcaccggtggtgagaaaagagaagaagaacgcctgacccgctctgatcgcggtttaattcgtgaggccattatgatggcggcgcagaccagctttaacgagaaacgccagatggtggcctcggatttacagaatgccctttatgccatcgcccgtaatcaccggcaggatgaacacggccagccgttaatcaccgctcaccgacgggcacgggcagatgaaatggccagcgccatgtcaatgtttacacaaggctttgagggtgaactgtttaaccgccccggtacgtcgtggccggaagtggatgtcaccctgattgatttgggcacactggcacgggagaactactcggcgcaaatggcactggcgatggtgtcactcatcaacaaagtcaataacctggctgaacgggatcaatatcaggatcgcgaactgcaactggtgattgatgaaggacatatcaccaccaccaacccgctgttatcaccctatatgactaaagtggtcaaaatgtggcgtaaactggggacctggctgtggcttgccacccaaaacctggcggattaccccgatactgctgaaaagatgctgaatatggctgaatggtggctgtgtctgaccatgccaccggatgaagtggagcaaatcgcccggtttaagaaactgacggaagaggaaaaagccgtattgctctctgccagcaaattaccccgttgttatactgaaggtgtggtattagcgaaaaaaatcgaagccttgtttcgggtggtgcccccaagcctgtatctggcgctggggatgacggaaaaagaagaaaaagccgagcgtagggcgttaatgcgtgaacatcagtgcagtgaactggaagccgcttttctggtggccagaaaaatggatatcgcacgggggttaaaggttgattccggttctgtatga

SEQ ID NO: 4217 - DNA, 402 bp, Xenorhabdus bovienii
  Coding sequence Name=Xb4151_4152.C442.gene4.dna; Position on contig =3656..4057bp; Strand=-
atgtggaaaataaaatattatgggatagtgtgtctggcggggttactggccggctgtgctacctcgaaagagaccttattacctgccggagagcaaacggtgctggcaatgtggcaggggaataaggccggtcatgccaccgcatcggcaagggaaacattgcgccgttctttaactgtatctgaacggctcagggcactggaagaaccctatcattacagccgttcagccgcgcaggaaatcagccaacagtttccccgcttacccaatcccgatatggtgatgtatgtttttccgcatctggtcgccggcaatacgccgataccgggctacagcacggtgttcccattttacagccaagtacaatatgccctgtcgggtgaacgcacggaggcactgtaa

SEQ ID NO: 4218 - DNA, 357 bp, Xenorhabdus bovienii
  Coding sequence Name=Xb4151_4152.C442.gene5.dna; Position on contig =4045..4401bp; Strand=-
atggaaaagaccccttctcagtggatattcagtgcgggttccccgtattgcctgcaagtgccggtgacgtcacgggctgaacccgcacaggtacagctttactggcgtacagtgcgcaaaaaagagtgtcggttgtatctttcagccggcagagaatgtcagccgttgagtgacggagattttactgttttccgcctgacggaaacccagtggcaggcagtggtggacggtaaagtcagcatggcgcctgaacagtggaagcctttgccttttaccttatcagagctggcagtacacccggaatttgccacgtttaccgtctttggcaccccggagaccgccgtatgtggaaaataa

SEQ ID NO: 4219 - DNA, 1431 bp, Xenorhabdus bovienii
  Coding sequence Name=Xb4151_4152.C442.gene6.dna; Position on contig =4401..5831bp; Strand=-
atgcaggttaaatccaacagtctggtgaaaatcctggtgccgatggtgctgatggtcggcgggtttatcggcatcaaaagttgcagctcaaccgacactaccgcgcccgatacgccacccaacaatgtcctggccacattgtcaccggaggagttacaggcgctgggtgtcggcggtgatacgccggaagataccttgcgtacgctggtgggaacactcaataaagtgcggtcagagcagcaacgcttaggtcagcagaatgccgatatcctgaaagaaaatgaccagttaaaaaatcagcgtcaggatgtcgccggtcagatagacgcggcggtggcagctatccggcaggacgatgaacagcgccggcgtgaattacaggatgaacagcagggattgctggcacagattgatttactgacggaacgcttaaattcagcgcctttgtctgcgccggacagtccgataccacttgggtcgggaagtattccgtattctgccaatgcaggcacagggcagaatgaacttatctggataacaccggccgatgaaaagcccgcagacatacaaacccccggcagtggaaaagccacggcgcagttcccgacctcatttttaagtgaacagtcagccgccgggcaaagtaagccccaaagcccatcgcttcaaaacccatcaaaggaagaaaatgaacagccggtctataccctgcctgaaaatgccacgttagtgggcagtcaggccatgaccgcgttattaggccgtgttcccgtcaatggtgcagtgactgacccttatccattcaaaatccttatcggcaaagacaacctgacggccaacggcattgaactgccggaggtggaaggggcggtggtgtccggctcagccagtggcgactggacactctcctgcgtgcgcggtcaggtcaattccatcacggttgtttttcaggatggcacggtgcgtaccctgccgggcagcgggcaaaacaacaataccagcgcgaacggcatcggctggctgtctgatgaaaacggcattccctgtatcagcggtgagcgcaaatccaacgccgccacctatctgccgaccctgtttgcgctctcggccatgcattcggccggcgatgccctgagtgaaagtcagcgtactgcccagaccagcggcacaggcggtatcaccaccgcgttaacgggcaatgccggacaggccgcattgggcaaagcgatgtcaggtggcatgaatgacatgagcgaatggctcagacagcgctacagccagacgtttgatgcgatttacgtcccgcccggtgcccgtgttgtggtgcatatcacacaacgcctggcgattgattacgaaacgaaaggacgtaaggtgcgctacggcgtgcgtgaggccgcccaacgtgacaatcaggaagcattagattaa

SEQ ID NO: 4220 - DNA, 837 bp, Xenorhabdus bovienii
  Coding sequence Name=Xb4151_4152.C442.gene7.dna; Position on contig =5821..6657bp; Strand=-
atgaaaagatatccatcttgctcttctgcctgtttttggctgggattggtcagcctcgtgctgttcagcctcggtgcaaaggctgatgaactgatgaaatgggaacgcattccgttatccattgccctcaaggtaggtcaggagcggattattttcgcagacagaaatgtccgtgttggtttgtctccgtcactcagcgataaactgcgggtgcagagcgcagggggagccatttacctgaaagccagccaatcttttccgtctacccgtctgcaattgcaggacagtgaaaacggcgaaattatcttactggatattaccgccaccaaaacggggccaacggaacccgtccgcattctttatccggatgaaaaaaattctgtaccaaaagagggggcaccgcatcagagaaaatcagcacctttggctcccgcgcctgtgatattaacccgctatgccgctcagcagctttatgccccgctgcgtaccgtcgagccggttacggggatccacccggtcagtctgcatttacccgccgccatcaccaccgtctatccgtcggaaccgattgcggtttccccgctggccggctggggcatgcaaaattacacggtggtagccctgaaactgcgtaatacggccaaacgcaacattacgctcgacccacgagccttgcaggggcaatttgtcgcagcaacgtttcagcatcgttggctgggtgaagcagggacaccggaagataccacagtgctgtatcttgtgacccgaggacagccggataatgcttttatccctgagccggtaacagtgaaaccgggaggccgtcatgcaggttaa

SEQ ID NO: 4221 - DNA, 657 bp, Xenorhabdus bovienii
  Coding sequence Name=Xb4151_4152.C442.gene8.dna; Position on contig =6654..7310bp; Strand=-
atgagccggtttcgtcatgcgctgaaaaaccgtgaccagcatattctgaccctgcggcttgtctgcggggtgctgatactggtcttgctgattacgctcacgggctggatgacgtcaccgcgtagtctcaccatccataatccgccggacttacgcagcggcagcacccgcccgtggtgggaagtgcctgcgccgagtgtctacagttttgccttttatcttttccagcaactgaacgcctggccgaaaaacggggcacaggactacccggctaaaattgcggctttgtcgccttacctgacccccgcctgtcaggattttttgcaggaggatgccaaaacccgggccgacagtggtgagctgcttgatcgggtgcgggtggtgtatgagatccccggccggggctacgggacgaaaagtgtgacggtgcgtaaccgggataactgggtggtgcggctggatttggtggccgatgaatattatcacgccgagccggtcaaacgggcgctggtgcgctattccctgaaagtggtgcgctgggagggcgatgcggagcgtaatcctttcgggctggcactggattgttacgacaggatgccgcagcgtctggaagcgatgccgcaacctgtggaagagaaaaagggggtgttccaatga

SEQ ID NO: 4222 - DNA, 375 bp, Xenorhabdus bovienii
  Coding sequence Name=Xb4151_4152.C442.gene9.dna; Position on contig =7307..7681bp; Strand=-
atgcagacgatcccgtttttacccgatcgcttaaatgccgaaccggtcgtatttcgcggattcaccacaccggaaatggggctggccgctttgctggggctggcattcgggttgatggtgagccttccttttatcccgttagccggctgggtcatgataccgacgggtatgctgttcatgcccttgttattgattagttttggcggtcgctggctcgctcagcttaagcgcggcaaaccggaaaattatctctggctgacactggaagagaaaaaacgccggctgggtatcggtgatccggcattgattattgcggctcagggttggtcgttgcgtcgaagcaggctgactcatcgtaacgggagcctgcgatga

SEQ ID NO: 4223 - DNA, 378 bp, Xenorhabdus bovienii
  Coding sequence Name=Xb4151_4152.C442.gene10.dna; Position on contig =7692..8069bp; Strand=-
atgaagccaatttttaccgtctgccgtcgtctcagtgcgaatctgataaccagaataagcacactccttttgctgttcggcttttcctgtcagtccgcctgggcggatttacctgccatcgaaccgccaaaaagtggcggcgggggcggattactgggacaggtgaaaggctatgcgcaggatggcattgtgattggcgggctgatcctttcggcagtggcgttttttaaggtcgcgtcggcggcggttgaaaccttttcggaagtgcgggacggcaaagccacctggacccagtttggctcgatcatcgtggtcggcgtagtgctattggttgcggtgatttggctgctggcgaaatcggccggcattatcttttga

SEQ ID NO: 4224 - DNA, 237 bp, Xenorhabdus bovienii
  Coding sequence Name=Xb4151_4152.C442.gene11.dna; Position on contig =8105..8341bp; Strand=-
atgacggaggcacaacgcactgcctttaccgtggcctcggggcattttgatatcacttttctgtatctggtctgcgtcggatttttcctggccaccctgtttctctgggccgcctgggccgcggtcgatgtctggaacggctgggcgaatgaaaaagtacgtaaccagaccatcagccagtttgccatgcgaaccgccatcttactggtggttgcggtctggatgtttgccagctga

SEQ ID NO: 4225 - DNA, 333 bp, Xenorhabdus bovienii
  Coding sequence Name=Xb4151_4152.C442.gene12.dna; Position on contig =8341..8673bp; Strand=-
atgtttatgcacggttacttttccctgtcccgttctgcctgtctgctgagtctgatcctgatgtgtgtaccgattgcgcaggcggccgagaaagacgaactggcgagtgcaaaaaatctgattgagcaggtgcagatggcactggagcgcgcaaacctcgctgaaaagcaggctgacaccccaacccgccctcgctatgactttgattacctccgtatcaaagcggatctcaacaccattaaatccggtattgatcactacctgaccccttcccgcgcccagcagcaggaatcaaacgtgttatccggtcattaccgtcaggaacgcccgtaa

SEQ ID NO: 4226 - DNA, 693 bp, Xenorhabdus bovienii
  Coding sequence Name=Xb4151_4152.C442.gene13.dna; Position on contig =8817..9509bp; Strand=+
atgctgcggattgatttaaacgtccccgatgatgaatacgagcaggcacggaagctgggtgcacactgggatgccgccgcccaaatctggtatattgacaacagttttgacccgacgccgtttatgaactggttgccgttctacaatgtgcacgctgaattctggtatctcgcccagacccaaacatcctgcccgcactgtcatgaacacaccaccgtgacggcgtttatgctgcctgccggacaccagctactggaagcggataacggcgatgaacccggcacggaagttgactacacagagcaggacagcccggcgtttttgttttatctcgccgatattccctcactcgtgcgtaacgtgctgcccggttttcaccaccgccttcgcaaagcggtcagccagcgactgcaccggcagcactggataaaccactgcgaacactgtggtgcacaacaggatgataccgaactgtttgcagaaatcggcggcgcattttttcctgcctccagagagcaagcggcgactcttcagctgcatcgtatcgatcagccgtttgtggggtattgtgaagatatttcgcatcatcactaccattttgacccgaagcaggataaccgtatctgtaaagcgtgtgacgggtttgagtggatgacgcaggtggtgaatgcaccgtcaaagtaccagcattag

SEQ ID NO: 4227 - DNA, 123 bp, Xenorhabdus bovienii
  Coding sequence Name=Xb4151_4152.C442.gene14.dna; Position on contig =9616..9738bp; Strand=-
atgaagccttttacgaaaaaatggcagcgtatgaggattaatatcctttttattagaagaattattctgatgctctacgatgatgctgtgtatggtgacgcggatggcagtctcaatatttaa

SEQ ID NO: 4228 - DNA, 654 bp, Xenorhabdus bovienii
  Coding sequence Name=Xb4151_4152.C442.gene15.dna; Position on contig =9698..10351bp; Strand=-
atggaaaatcaatttgatacatttttgtctgctataaaaaggaaaaataagaatacagtccttaatccaatgcccagcgaaaaattgaatcgtcttcgtctgcgaaaataccgcgccccaaacagaacagaaactgcacctctaccgaagagcctctccgcgttacttgcttatgattgcgatctcaccaacccttatggcaataaagtatttgaatatctcattgattcaatagaaaaaaatataataacctcatgggatcctgatgaatttgctttttatggttcctattatgtcagtaacattcctgacgttgaaatggaagatttaatgccaatctggaatgattcgcctgatttacctgctctattttcgatcgctcatccgggagaccaacgtatttggatttatacgtctgaactggatgaaaatggtgaatacccgattacaaggcaagaagtggaggagttttggttatctgagtgctctctaatagattacttatcaggtattttcgagatcgtggaagaaattgatcctgagaatacatttcaggagaaacgggagaaatatgaattgagagacgctgcattattagaaaaagaaaggcttcatgaagccttttacgaaaaaatggcagcgtatgaggattaa

SEQ ID NO: 4229 - DNA, 759 bp, Xenorhabdus bovienii
  Coding sequence Name=Xb4151_4152.C442.gene16.dna; Position on contig =10468..11226bp; Strand=-
atggctcaatcagaaaatccctcccgtcaatcttcccaaccgccccgcaagcatggcctgttgtatcgtctgttatgggaatggccgtggcaacttattgggtttatggtgatgtcctggctattcagcctgttactggaatatctcggtatggcttttttctggccggaacagggcgccgctcacagtcagaacatgatgaagacagagcttaactatctctcctcagaatttacccgaagtctgttgctgtcagaaccctcacaaaccgtttcggcagggttggcgcaagcctatcaatggctgtttgtggacagtggttttatgaactgggttcagggacaatcacaatatcagttccatagccgtaatgattttatgcgtgaattaaattccgtattacagggtgtatcgggctatttgcaagaatattggctggccacggtgtttatcacgatggtgacgctgatccgactggtaattttgttgttatacgtacccttatttgtgatggtgattttggtggcactggttgacgggctgggacgtcgggacttacgacgttacggagccgggtatgaatccagttttgtctatcaccatgccaagcgagggataaaaccggcctgcacggttccctgtgtactgtatttatcgtggccgaatgtggtgtatcctatggtgatattgttgccagcagcgctatttttaggtatggcagtggtgatcaccacatcgatgtttaaaaagtatttatag

SEQ ID NO: 4230 - DNA, 2064 bp, Xenorhabdus bovienii
  Coding sequence Name=Xb4151_4152.C442.gene17.dna; Position on contig =11236..13299bp; Strand=-
atgagccgccattatgtggttgaagccctgctgcgtcctgccgtcgagctgaatactgcggtggtctcagtcgttgcggcttttgtctgtatcagggcgccttgggccatcgcactggcaccttcagtcagctatgtcatggcaggcggttttgccgtactggcaatgatacgcacatggcagggtattcaggtcatccgttatcgcagaaacctgcgtcgcctgccacgttaccagatgagcaccaggcaaattcccgtcagtcaccggcagttgtttctgggcaggggatttcgctggcaacagaagcatacccagcgtttgcaggatacgcgacgaccggaggtcgaacgatttgtgcaaccgtctcaggcttatcagcttgcccgcgcactggagcgtcgaactgaataccgttggccggcattatctgcgctattacgcaaagactcgccatttaatccggtacgtccgctgccaccagtgggcggtaatccggcactccacgggattgaaccacaggagactgatgtttttatggatctgcgcgaacgggtcgggcatacgctggtgatggggactacccgtgtgggaaaaacccggctggctgaactgcttatcacgcaggatatccggcgcggtgaagtggtgatcgtctttgatcccaaaggcgacgctgatctgttaaggcgcatttgggcagaagcgcaccgcgcgggtcgcggcaatgaactgtccctctttcatctgggctggccggagatttcggcgcgttataacgccgtcgggcggtttggccgggtgtccgaagtggcttcccgtctggccggtcagctcagcggcgaaggcaacagcgccgcgttccgtgaatttgcctggcggtttgtcaatattgttgcccgagctttggtggctctggggcatcggccggattaccagctcatcacccgctacgtcaataatatcagcgaactgtatcagcgctatgccacccgaatgatggaggaaagacagccggatctgctggcgcaaatcaatcattccctcagcaaactgaaagaaaaagacattccgcgcaatatgcaggggcaacccgatgccctccggctctgggcgatggaaatgacgctgagttctgacgcaggcaagcaactctatgacccgattctggatggtctgcgttctgccgtgcgttatgaccgtacctattttgataaaattgtcgcgtccttattgccgctgctggagaaactgaccacaggcaaaattgcggaattattgtcaccggattatctcaatatggcggatctgcgtcctatcttcgactgggaacaggtgatccgcaaaaatgggattgtctatatcgggctggatgcgctgtctgacagtgatgtggcctcggcggtaggcaacagcatgtttgcagatttggtcagtgtcgccgggcaaatttacaaatatggcatgaacgccggattgccggtacgtcatgacggtaagctagcgattaacctgcattgtgatgaattcaatgaactgatgggcgatgaatttattccgctgattaataaaggtggcggcgcgggcatgcaggtgacggcatatacccagacctcctccgatatcgaggcccgtatcggcagcatggccaaaacggcgcaggtgataggtaacttcaacactttgattatgttgcgtgtgcgggataaccggacggcagaacttctcaccagccagctgccggaagtggaaatctacagtaagaccctggtatcggggcattcagatattgctgatgttgaacaggggcaggattttacctcgtccacacaagatagggtaggcaccgtcaaaacaccactaattacgcccgctgaaatgattaacttgccgaaagggcaggcgtttgcgttattggaaggtgggcagttgtggaaaatccgtatgcctttgccaacgggagatgacgatgatgctctgatgccggccaatttgcagaacatcgctgaacagatgcgcaggcactaccgcaccagtgaaaattggtgggaagagaaggggtag

SEQ ID NO: 4231 - DNA, 540 bp, Xenorhabdus bovienii
  Coding sequence Name=Xb4151_4152.C442.gene18.dna; Position on contig =13296..13835bp; Strand=-
atggcaaatcacatcattatgaaacggctgagtgtatttcccgttatcggcctgttatggataagtgcctgccatgctgaactgaacatcattgccgatttaggcggcaaagatgcctcgcctttttatgaaagcattaatgctgagcaacgcgatgagcctgtgtcatcggtgcaaaattcctcacctgaaatggcaggtgaagcggcgatgttgcctgtcaaaacactggagctgacgccgggaaaagtgtcaagcagaccactgcaattgccgggaattggggcactgtttctgattggggatgatcccggttcacgccggtggttaagccagaatgcggccacattgacgaaactgcatgctgtgggtctggtcgtcaatgtcagggaaatggcgggtttgcagtcactgcgggcattggcaccggatttattgttatcgcctgcttccggcaccgagctggctcgtcgattgcaactgcaacattatccggtgttgatcacggaaactcaactttcccaacagttatcaccatga

SEQ ID NO: 4232 - DNA, 699 bp, Xenorhabdus bovienii
  Coding sequence Name=Xb4151_4152.C442.gene19.dna; Position on contig =13814..14512bp; Strand=-
atgagattacatcaaatcggtctggtaacgtggatagtgctcatcagcccaacatgggcagccacaccgtcacccttaacgtcgcagcaggcacatacggtggaaagccaaaagcaaacattgagaatacaggccgggcaatggggattgagcacggatgaatatcggcgttatcagcaattattgaatggtccaaggggaattcagtcgccggggcttgatccgttgacaaccctggggattgaagctgaaagtgatgcagaacgccgccgttatgctgagcagtgggtcaaagcggaatttgcccgcactgaaaaagaactgcgttttcagcgggaagtggatgccgcctggcaacgattatttccggatatgttgccggtcaatatggagaaatccggtgaggcaaaggggcgtttggcgttgtttgtcaaaatcaacgattgcccgccgtgtgacgcccgtttagcggaagttctggcattgatgcaaccgattgacatttatctggtcgacagcaagggcaatgatgacacactacggcaatgggccaaaaaacaccgtatccccgttgaacgggtacgcaaccgacacatcacattgaatcatgatgcggggtactggttccggttcgggcagggcatcatgccgattttattacggcagggagagcagggatggcaaatcacatcattatga

SEQ ID NO: 4233 - DNA, 537 bp, Xenorhabdus bovienii
  Coding sequence Name=Xb4151_4152.C442.gene20.dna; Position on contig =14509..15045bp; Strand=-
atgagaataaccgtattaatgggtgtattggtcactatcctgacgggttgcaatgccccgtcaaataaaccgccgtctcaatgtgcttccgaaaaagccatttcagcaacgcagctcacgcgcaatattcagcccgtctcacccgatatttatcaacaagcgccggaagtagtccgttacggtcgttatatcctggtaagtaccgacccaacagcagcacagcgtgatccgctttcccaattgattgaggttcatattccggcgtctcagcatcccacggtagccgatgccctgcgtgacgtattacgccagtcgggttatcggttatgtgcgcctgaaaaaaccaatgacattttatatcgccagccgttgccgtctgtgcactatcagttaggccctgtccggctgcgtaccgctttgcagcttatggcaggcccggcctggcaactggaggtggatgaggtgcaacgtgaggtttgtcaccatttgcggccgggttatcagcttccacaaccccggcagggaaagcagccatga

SEQ ID NO: 4234 - DNA, 306 bp, Xenorhabdus bovienii
  Coding sequence Name=Xb4151_4152.C442.gene21.dna; Position on contig =15249..15554bp; Strand=-
atggcggttcaggcgggggagactaacgtctcaccggttgagtgtacccggtacctgagaatccctgtcttgaatcgccaccattcaataatcaaaagaaggggaagcaggtatgactatgactcacactcagaaagactggcacccagccgaaattatttgcgcattacgcaagcgtggtacaacactcgccgccgtctcccgcgaagccggattaagctcttcaactctcgccaacaccctgtcccgcgcctggccaaaaggggaatggatcattgcaaattatctcgatgttcatccctctga

SEQ ID NO: 4235 - DNA, 144 bp, Xenorhabdus bovienii
  Coding sequence Name=Xb4151_4152.C442.gene22.dna; Position on contig =15693..15836bp; Strand=+
atgtgtaagtttaacaagttaataaaattgttggattatgccttctgcatcaatttaacacataaaaaaacccgcctatttgcgcattctctcaatgaaagactcagcgtggcaggtgtacttaaccacgattatacccattaa

SEQ ID NO: 4236 - DNA, 1092 bp, Xenorhabdus bovienii
  Coding sequence Name=Xb4151_4152.C442.gene23.dna; Position on contig =15901..16992bp; Strand=+
atgaaaccagtaaccaataatgaccatttaagccgaattaagataacaggctacaaatctattgcggaatgtgatttaccgatgggatgcctgaatgtactcattggagccaatggtgctggaaaatcaaattttatcagtttctttcgcctcattgccaccgtacttgatcatcgtctacagtctcttgttggcaaaatgggcggccctgatacattgctgcattttagccgtaagaaaaccgaatatatgagttctgaactttattttggtcacaatggctataaatttgaactggaatccaccaatgacaatcgtatgatgttccggcatgaatcactttttgggaatatcagcggtgattatgatatcggctcgggtcattttgaatctcaggtcgataaacatcacacaggcatcaacgatgataccttacctgccatgctccgttggcgggtgtaccattttcatgatacgagtgacagtgccagagttaaacaaactcatcgtattaatgacaatgattatctgcgggaggatggtgccaatttagcggcatttctgtatcgcctgcaaaaacatcatccgcagcattacaggcgcattatcaaaacccttcagatggttgcaccgttttttggtgatttttacctgcgatccactccggataatgccgattacattcaactcgaatggacagaaaaagagcaggacattccttttaaagccagtgaactatctgatggcactctgcgctttattttattggctaccgtattgctgcaacccgaaaattatatgcccggctcaattattattgatgaacctgaactcggactccatccctatgccattaacgtactggcaggtttgatcaaaaatgccagcaataaacatcaaattattatttctacccagtcggtcgaactggttaaccaatttgatgctgacgatctgattgttgtcgacaagcaacaaggcgcctccacttttaaacgcctgaatcatgaaatgctttctgaatggcttgaagactatagcctcggggaattatggaagaaaaacttactcggcgggagaccacaacgatga

SEQ ID NO: 4237 - DNA, 672 bp, Xenorhabdus bovienii
  Coding sequence Name=Xb4151_4152.C442.gene24.dna; Position on contig =16989..17660bp; Strand=+
atgatccgcatcaatgtttttgtcgaagggcagacagaagaaactttcgtgcgggatgtgctggcaccttatttttctgcacagcaaatctacctgtcccctatattggctcagacgagtgccagccaaaaaggcgggatcacaagttatggcaaagtaaaacaccagattacccgcttgtgtcggcaagatcccagtgcgttcgtcaccacgctcatcgactactatggcctgccgactgatttccccgattacaacaaacaacgggataatgctgccagcgaacgggtagtgaagctggagcaggcttttgctgatgatattgggcaggccaattttattccccatctgttattacatgaatttgaagcgctgctattttgccaacccgaaaaatttgcagactggcttgatgacagcgcccccattgctgcactacaagccatcagaagtgaatttgctaccccggaggatattaataatagcccgcaaacggcgccatccaagcggattctaaccatcatccctcattatcataaaaccttgcatggcccactgattgccggtgatataggtttagataccattcgctctcaatgcccgcattttaatcagtggttagaaatgctgactaatttgatagcacgtattcaatttgctccgaaaaaatag

SEQ ID NO: 4238 - DNA, 552 bp, Xenorhabdus bovienii
  Coding sequence Name=Xb4151_4152.C442.gene25.dna; Position on contig =17710..18261bp; Strand=-
atggacacaacgtcacccccgataacaggagaaaacaagatgtcttcacgcggtgtgaacaaagtcattttacttggttatctgggacaagacccggaaatccgttacctgccgacagggggtaccgtggcaacactttcactggctacgtcagaaaactggaaggataaacaaaccggcgaattgcgggaaaaaaccgaatggcaccgggtggtgatcttcggcaagttagcagaaattgccgaggaatatttgcataaagggactcaggtttacattgaagggcaactgcaaacgcgtaaatggcaggataatcagggtcaggatcgctattcaacggaagtggtggtaaatgtgaatggttcgatgcagatgttggggagccgtaatgattcaaagagtatggcacctcaacaggcagggcataagccagcacaaaagcagccaccgcctaaacccgctaatcaggaaagaaaaaacacgcagccggtacaggtctcagtttcaccggaagaggatgaaaccgactgggattcggcgatcccgttctga

SEQ ID NO: 4239 - DNA, 210 bp, Xenorhabdus bovienii
  Coding sequence Name=Xb4151_4152.C442.gene26.dna; Position on contig =18237..18446bp; Strand=-
atgaatgctgcaccgattgggtttctggccctgcaatattgccataaacaactgccgttaatcgttttgcgccgccgtgcggggttttatatcggcacgatggatgaaggcattccctgctctcgtgagtcagtggagtattttgcccgacgtgaacaggcggagtttgccctgaaacaggggcaatggacacaacgtcacccccgataa

SEQ ID NO: 4240 - DNA, 558 bp, Xenorhabdus bovienii
  Coding sequence Name=Xb4151_4152.C442.gene27.dna; Position on contig =18517..19074bp; Strand=-
atgcgtctgacacccggcgggaaaaatcattcccgtcaggggacaggattttctccgtcacaccttattttttacctgcatggagaacatcgaatgtctgagaacaccgcatccttaaccaaaaacgactatttcaacctcaatattaaaggactgggctatctgaataacatccgccatgtcagcactgccagcggaacgttcctgagctgtgtgatcaatgcgctgaacggaccaggtgataacccggtttatgtgcgttttgatatcaccgtggtcggcaaggaagcgaccagtctggtcggccgttgccagaaggcggtagatgaggataaaaaagtgttgctgggctttaccttaagcaatccctcgactgatatctttaccctgaaacgcggagaccatgccggtgaacagcgcgtcagcctgaaagcccgtctgattaaggttgactggattaaaatcggtcaggagaaagtgtatcaggccgaacaatccgactcgatgccgcctcagaacggcatcacgcaaaaagaatatgcagagaactctttctga

SEQ ID NO: 4241 - DNA, 201 bp, Xenorhabdus bovienii
  Coding sequence Name=Xb4151_4152.C442.gene28.dna; Position on contig =19014..19214bp; Strand=+
gtgacggagaaaatcctgtcccctgacgggaatgatttttcccgccgggtgtcagacgcatacgttgctgacgtactgataaagaataaaaaaaccttcactgccactggactgacaatatctgctttcaaaggtgggcagatgtaccgcaatcatgcgctccctttcaggctacgggagttttcggctaaaacagcatga

SEQ ID NO: 4242 - DNA, 2013 bp, Xenorhabdus bovienii
  Coding sequence Name=Xb4151_4152.C442.gene29.dna; Position on contig =19258..21270bp; Strand=-
atgcagggagggggtgatatgccactgtatttatgtgaaaagccctctcaggccagagatatcgcccgggtgctgggcgtgaagcagcgcggacagggctatctctttggcgacagtattactgtcacctgggctatcgggcatttgctggaaatggctgcacccgagcactatggtgaacaattcggcccgccgtggcgcatggaacccctgccggtgctgcctgtgcagtggcaatggactgtgaagaaagagaccgccgatcagtttgcggtgatcagacaattactgaaacaggccgacgaagtgattatcgccactgatgctgaccgtgaaggggaagtgattgcccgtgaactgctggagtattgccgttttaccggccccgtcagacggctgtggctgtctgcgctggatgaaaccagtatccggcaggcactggccgcgatattactgggggagcaaaccgaaccactctggcaggccggactgggacgggcacgggcggactggctgatgggaataaacctgacccgcctgtataccctgaaagcgcaggcacagggatttggtgaggtgctgtccatcgggcgggtacagacgccgacactggcactggtcgtgaaccgtgataacgatatcgcccggtttgagccaaaaccctactggcaggtgatggccgcattgcaaaaagatgacattagctttcgggttaaatggctgcctgcgcccgacgattgcgatgaagaaaaacgctgtatccgggaggatatcgcgcagagtgtggttcagcgttgtcagcaggcacaagatgccgtggtgactgaactcacgcagaaacgggaaaaaaccccgccgccgctctgttttgatttggggatgctccagcaggtagcctcccgtcaatggggaatgggggccggtcaggtactgacgattgcccagtcgttgtatgaaatccataaagcgaccacctacccgcgcacggattgcggttatctgccggtttcaatgcgggaagatattccggccgtgttcaccgcactgacccgtaccgatcctgcgatgaatgccattatcagccagctggatgccagcactctctcccgagtctggaatgacagccaaatcacggcgcaccatgccattattccgacccgccacacttttgatatgacgaaactgaccgcggacgaattaaagatctatcagttgatccgccactattatctggcgcagtttctgcccgtacaggaaacggatgtgactgacgtgacattcactatcggcgggcaggtatttcaggcgaaagggcgggtcagtgtggtcacgggctggaagacgctgtttgccgatgaaaaacaggtgcaggagcaggacgacaataccgcgctgcctgcattgaaaaaagaggaaatctgcccggtactccgtgcagaaatacagccccggcaaacccggccgcctgcgccttttaccgaaggtacgctgattgccgccatgaaaaatgccgctgcgtttatccacgatccgcagcttaaaaaagtgctgcgggaaaatgccgggctgggcacggaggccacccgggcaggtatcattgaagccctgtttaaccgtcagctgctggcgcgaaaaaagaaaaacctgcatgcaacgccgctggcgcaggagctgattgccgggctgccggacgtcctgacccatccggggatgactgcgctgtgggaacagtctctggacgacattgcccggggccgggccacactggatggctttatgcagaaacaggcacaatggctggcgcatttagtggaaaagggcaaaacacagccgatccggtttaccctgccgaaaaccccggcgtgcccgcgctgtggcggcccgatgcaaaaacgggcgggaaaaacaaccccgttctggggctgcactcgctatccggcatgcaaagggatgctgaacgctaacgcggtgaccggctcccgaaaaacccggcggggaaattcaccggactga

SEQ ID NO: 4243 - DNA, 726 bp, Xenorhabdus bovienii
  Coding sequence Name=Xb4151_4152.C442.gene30.dna; Position on contig =21254..21979bp; Strand=-
atgtctgaacctgatgaaaaaaccgcaccgtcgcccccccgtcgtgccggtgcactgaaatccacgttaaccattgaactccatacccactacgccatccgcctctgggcagggcgtaaaaaagaagacgtcaccggccgccgtcaatacccggacattatcggcatgccgcaggtaattaaacgggcgggcaccatcagtgaggatgcggctgccgataacccgtatgccgacagctggctgatgaaactggaacaggccctggtggcggcctcggccagccttcagcagcgtattgccaccttgcaggaaacactgaacgccctgccggcacaggtgacgttatccgcggtttcctctgttgaaccgctgaatatcggggtctacagtcactccccgctgggttaccgctgtgtctggctgttggtcggtttcgaccagctggcgatgaaaacctttcaggcgtttcattacggttttatttctcgttcagagcgggatgcgttgctgcataacggcagtcgggtgatccgccagatttatggtctggtgcgttcttaccgccctctgaaggtgacccgtgcggatattgaggaaaaaacaccggctggccttgaagccattaaatggctgggcgaaccggaccccgatattctgtcgggccggctgcgttctgatttttcaccccccctgcgcacggtggctcaggatgcagggagggggtga

SEQ ID NO: 4244 - DNA, 1224 bp, Xenorhabdus bovienii
  Coding sequence Name=Xb4151_4152.C442.gene31.dna; Position on contig =22435..23658bp; Strand=-
atgataaacctgtcagcagacagcttaattgcccacactatggccaaaatgaaaagccgtctggaacaacgccccgacgatgacgtttcacagctgcgcagtggtctgctgtttatgggtaacattcaggatgcctatccccgtcgcctgttactggatgatcgcctgtcaccactggataaaacgggctggatgatgatccgtttgtatgcgcaacaaaatgaaggggcggttttccccagctacgatgaattgcagctgctgctggcctcgccctataaaggcaaagcctcccgtgaaaccgtcagccgggtattgctgatgctgcgaataaccggctggctgagtttatgcaagcgtatccgcgacgagcatgggcgggtgcggggcaatatctatgcgcaacacgatgaaccgctgacctgccgtgatgccgagattctcgatcctcactggctgaatactgtggcagaagcctgtcgcagcaaaaaccgcactatcagccagacggcacgggaggtactgactgacattcaagaagatccactgatgcgtcatcgtcacagtcatatccgtttgctggaagcgcggctgaatgcggtgcagacgccacagcaaagggtcatgaggcaggcgcttcaacagggaaaacagcaaaccgaactcagggaaatgaaaccgggttcggaaaccgaatccggtcagttaaaagggcagaataagccgaattcggaaaccgaactcagcgtgaaatcaatgacttgtcgtcaaaccactaaaccgaactgttatgtacgttctttcacacagagtgtgaataaaaaaacatacgtagatacaccgtccgctatttttctgccggaaaagttatgcaggcaactggagccggaagatggggggatgctgaacagccagttgcaggcactgcctgctgaacaggcgcagactgtgttgacttgtctggataaggcgttacaggcaggcaaaatcggtaatccggtcggctggctgctggcgatgatgaaacgggcacgggagggaaaactgtatgtgcaggctgaaccggctgtcacgacgacggcggctgcgaagaaacccgttgaattcacacgggaaacggcgcgttctgttcccccctcttcacaagcccatgtcagcagtgtagtgaaagatattcgtcagcggctggcgcaggcaaaatatcaccgtgatgacatggggtaa

SEQ ID NO: 4245 - DNA, 330 bp, Xenorhabdus bovienii
  Coding sequence Name=Xb4151_4152.C442.gene32.dna; Position on contig =23754..24083bp; Strand=-
atggcagcaacagggtgcatccggatcggtctctgtgaaaaaacagggataaaacgggtcatacaggaaacgatgtcaggaaaattaaccgaaatcatgcccggcctgcatgtgccggtaacggcaccgctgtcctttcgccgtaaggcgcaatatcaggtgaaatgttatcggcggggtcagcgtaattacgtccggctgaaggaaaaaggcaccgggtatctgaaaatcaacgtggggctgttctggcggttgttaagccgtgatagcgggcaatcgtgggagctgatgcaccacgaacgctacaacaatgaaattcgtaaatcgtaa

SEQ ID NO: 4246 - DNA, 582 bp, Xenorhabdus bovienii
  Coding sequence Name=Xb4151_4152.C442.gene33.dna; Position on contig =24032..24613bp; Strand=-
atgaatcatttatcgcaagcgaccaacagcctgttgttgcagttggtgatggatttgaagaacggctatatccgccgttgcgaagcactggggctggcaccctcggagatgctgatgttacagagcctgacgattgaggatttgcattatctgggcaacagcccggtatcggtgctgagtgtgcaaattcatcacgccaatctggcccgcatcttacatcaggcgcgtatcgaacagcaacggatacaacgcattgatcgggcactggccctcagcggatcgattgacctgatgcactatttttttggcctgtccagtctggaggtggcggcgcgccggcgtattgccggtattgccgtgaagtcggggcgggtttcggtgctgacagaagcggaaaaccgtgacctgtggcagcgctggcaggcggcaaagatgagggatgcggacagtgccgacgggctggatatcatgatggacgtggcggagcatcatgatatttcgctgacgtccgtctggaatgccgtcaaagaatggcagcaacagggtgcatccggatcggtctctgtgaaaaaacagggataa

SEQ ID NO: 4247 - DNA, 1557 bp, Xenorhabdus bovienii
  Coding sequence Name=Xb4151_4152.C442.gene34.dna; Position on contig =24694..26250bp; Strand=-
atgggcaatgccctgttacaacaagggcgccaggccgcggcgacactcagtgaacaaccccctgtgtcggaaatgccgatggtactgacactggatcaactccgccccaatccggataacccccgcaccagtcggaacccgcgttatgaggatatcaaggcctcgatcaaagtacgcgggctggatacggtgccgaaagttacccgtgacccggaaggtgatgatgtttatatcttcagtgatggcggcaatacccgctatcagattttgtccgaactgtggcaggaaaccggcgatgagcgtttttatcgtgttcactgcctgtttaaaccgtggccgggcagattgcagtgtgtcatcgggcatctggcggaaaatgaactgcgcggtgaactcagttttattgaaaaagccctgggggtctgcaaggccagaaccctttttgaagtagagaaacagcagaaaatcacccaaagtgagttgtctgcactactgggggaagccggttttcctgtcagccgcagttatatcagccggatggaagataccgtgcaatatctctatccgtggatgccggatctgctgaactcggggctgaaggtaccccaaattcgtttgttactggcattacggcaggatgccgaggctgtctggctgcaacatgttgtcagtgcaatatcggagcctgcctgttcctttgatgcgatttttggtgcctgttgccgcaaatttgactccccggaatcctggtcgccggagatgttccgggatgaacttatcggcgatttattgcaggtattaccgcacccgcagctgaattatgaccgctgggtactggaactcgatccgaaggaaagtaaccgccggcaactctttggtgaacaggccaccccgcttgaccctgtgccggaaaagccggatacgcctaaagcggatcggattagggcgccagacagggaaccgaaccggcgaataatgtctcaacccgccacggatgcggagcaggcatcggagacaacatgcgctccggtcgataagacacccgtgcctgctccgtcttcccgaaacaatccggtgctcccgccttatcagccggatagtccgcctgaaccggcactgtctgagcctgaagccgacgatcttcactttgcccggaccgggctggagccggtcagctcagtctggcacatttccccgatgcaggacgatatcgaccatctgcaaaatatggcgtttcgcctggcgtttgaactggccgaagtgatgggctgtgaccgtgatttgctgccggtatcggatgaacggtcggcgggattttgcctgattgacgggccggatgttcatcctttttcgtgtttattgcactccctgaccggggaaatctcgactgaccgtcatgaactgacgctgactgccgttctgctcggcaccgccggacgggaggcggtgccattgctggatgacagtcagaccgtgaagtttctgcggctgctgcggattatccgccgcctgcgtgaacttcagcgcgaaatggtgccggagatgttggcgatgtag

SEQ ID NO: 4248 - DNA, 1380 bp, Xenorhabdus bovienii
  Coding sequence Name=Xb4151_4152.C442.gene35.dna; Position on contig =26271..27650bp; Strand=-
atggacatggcgcatgaacatttacagatcatcagtgaagaggcgcccagctatgcgtatgccgaagtgggggtgttgggggggctggtactggagaatgagcgctgggatagcgttgtccagctattggttgccgacgatttttattttccggcacaccggataatatttcaggccatcgctgaactgagcgaaaaaaactgtccgttcgacctgattaccctgaccgataggctgacccagcgtgggcaaattgatcgggcatgcggttttgcttatgtagcggaagtgtgtaaaaacacgcccagtgccgccaatattgaggagtatgcccgtattgtggcggaaaaaagccggttacgtcagttactggcactgggaaaatccctcagcgctgacgtttttcagccgaatattcagtcagataccctgatagagcaggcagaaagtcagttgtttaatctggctgaaaaaggttcgacccgccagcatcaggaaatgaccctgttgcagggcgcagacagcctgattgcccatctggagcgaatacaaggctcacagggaataaccggcacaccgaccggatttcaggatcttgatgaaaaaaccggcggcttgcaggccggtgatctcattttgctggctgcccgcccttcgatggggaaaaccgcgttgggactggcctgttgcttgggtgtcctgcggcaccgggatgatgccgtggtacagattttcagtctggaaatgccggcggcacaactgatgctgcgcctcactgccatggaaggcggggtttctctgagcgccctgcgcagcgggatgctggatgatgagcagtggggacgcatcagccagagtctggatcagtttacccgctgggatcagcgtctggtgatcgatgattgcagtcatcagacgcccgcactattacgcgcccgtgcccgccgctatacccgcaaatacggtaaacccgccctgattatggttgactacctccagctgatgtgtgcgcccggccaggaaaaccggacacaggaaattgccgatatctcccgtaacctgaaagcgttgggcaaagaactgggctgcccggtactggcgctgtcccagcttaaccggcaggtcgaaaaccgttccgataaacgtcctaataatggtgacctgcgtgattccggctcactggagcaggacgccgacctgatactgcatctctatcgcgatgaagtttatcacccggacacacccgatacgggtatcgctgaaatcattattggtaagcagcgtcagggtccaacgggcgtggttcgtgtgggatttgacggccaatatacgcggtttttggacttatccgcagacagtgatggttacggggggaaatga

SEQ ID NO: 4249 - DNA, 432 bp, Xenorhabdus bovienii
  Coding sequence Name=Xb4151_4152.C442.gene36.dna; Position on contig =27634..28065bp; Strand=-
atgggcggaaaaattcgacgcggtattgactgtgcaaccgacaggagaggcgcaatgaatgttatctggcgggcggtctgctttcgttatgagcgcgttgaattactgttcagtgatgatgagaggtttgtgtttgtggatgcgccggatcgtgaaaccgcgcaggcgaaacttcagatcctgttgccagctgttcccgatgtttctccggaaggggtagagcattattatccccgtatgcgcaggcaggccatgcgccccgatgcgtctccggatttggcgttgctggaatgtggctgggaaaatgaccagccgcagtatctgacccataacgaggtgctgttctgggtttcttcccctcatctgcaacagcgtttaatcgctgccctgaatgcgatcagcagggaggcagccgatggacatggcgcatga

SEQ ID NO: 4250 - DNA, 888 bp, Xenorhabdus bovienii
  Coding sequence Name=Xb4151_4152.C442.gene37.dna; Position on contig =28008..28895bp; Strand=-
atgataattcttcccataatttcccccaaagggggagaaggtaaatcgactcactccgccaatctggcgggtttttttgccgatgccggtttacgtgttctcctgattgatgcggattattcgcaacccactgccagcagtatttttcccctgaactatgaagcgcctgccggactatatgagttgctgatgcagacggtagatctgaaccagtctgagcagatcatttcccgttcggttatcaaaaacctcgatattctgatctccaacgatccggatgaactcctgcccacggcaatgctgcacgcgcccgacgggcgtttgcgtctgcgcaatgtcctgcaacatcctctcttcagccagtacgatattattttcattgattccaaaggggcgaccggcgtgatgaacgagctggttgtactggcggccacgcagggcgtgctgggggttatcaagcctattttacccgacgtccgcgagttcctgcgcggcaccctgcggatgctgacccggctccggccttttgaacactacggtatccggctgccggctatccagatactggtcaacgggattgaaggaacgaatctcgaccgggatacgctgagtgaactggctgacattatcaataatcaacggtatgacgcttccgcactgggtggcaggcaggtttaccagctgctggaaacccggatagacctgctggatatctacaaactggggcatgtccgtgcccagcccgttcatcgccttgagtataaaaccacccgaaaaagcccggctgccgcgcaaaccatgcaccgcctcgcctgtgagttagtgcccttatgggcggaaaaattcgacgcggtattgactgtgcaaccgacaggagaggcgcaatga

SEQ ID NO: 4251 - DNA, 1008 bp, Xenorhabdus bovienii
  Coding sequence Name=Xb4151_4152.C442.gene38.dna; Position on contig =29383..30390bp; Strand=-
atgttaaataatgaggaaacaatgggctgggatgcgttgctggacgagtatttcttctcacggatgttacggccggcaaccgaatggagttatcgcaaggtagtgcgggtatttatccggtatctgggggaaacggagtcgccggagagcgtgactcaccgggatgtcctgcgctggcggcgtcatctgctgacggaaaaaaatcagtcccggtatacgtggaacaataaggtggcgcacctgcgggccatttttaatttcggcatggaaagaaaactgttgtcacaccccaaaaatccgtttaatgacgcgtcagtcaaaaaagagaagaaacaaaagaaaaccctgagtaaagctcagataaccgggatttacctgcggatgcagcagtatgaggaggaagaacgtttacagacttccccacggggcggacgctgtgccctatacccgacagggtactggctgactgtattggatactttccggctgacgggcatgcgcctgaaccagctgttgcatctgcggttgcgggatattaatctggacaacagttacattgagttgcgcgtggaaggcagtaaaaaccacagtgagtggcgggtgccgatgatcccgcaactgaaaccccggctggtgcagctggttgaacaggcaaaagcctgtggcgcgaaagagaatgatccactgtttgatttaacccgtctgcgttttcgttatcacggacgccatgtcagttatcagtatcatcatgacagagaaaagcagcatcttcgttctttctttaaccgcctgtctaaagagtgtggttttgccgtctcgccccaccgtttccgtcatacgctggcgacagagttgatgaaggctcccgatcgtaatttgcagctggtcaggtgtttgctgggacaccgtagtctggcgaccacgatggaatatattgatatcgatatggaaatcgcgggtaaaaccctggcgaatgaactggcgttttatctggatattgcagagtaa

SEQ ID NO: 4252 - DNA, 1506 bp, Xenorhabdus bovienii
  Coding sequence Name=Xb4151_4152.C442.gene39.dna; Position on contig =30501..32006bp; Strand=-
atgaaaattgatattgatgccctgcccaatgaccccgctgaactgaaacggctgctgattaagcagtcgcagcggctggcctttttggaagagcagttccgtttagcccaacaaaaacggtttggggcttcctcggaagcgttccccggccagggggagttgtttaacgaagcggaagaaattgcgctgccggctgaaacggccgccgcacaggaaaccctcacacctccccgccgtaagccgacacgcaaccccctgcccaaagatttaccgcgcgaaaccgtgttccatgatatcgccgaggaagaaaaacagtgtgcgtgctgtggcggcaggttgcatcagatgggggcagatcgcagtgaaaaactgttgttcattcccgctcaaatcagggtggttgagcatgtccgccccaaatacgcctgccgtgaatgtgaaaaatccggcattcagacgcctgtcaaacaagcctccttgccagcgatgcccatcaagaaaggcatggcgaccagcagcctgctcagccagcttatcaccagtaaatatcagtatgggttaccgctgtaccgtcaggaaagtgtgttcaaacagtatggcattgacctcagccgccagacccagagtgactggatattaaaatccgcgcagttgtttacgccgttggtggccaggttcagggaaatgctgttgcaacaaccggttctccatgcggatgaaaccccggtgaaggtggtgacgtctgaaaaaacgacccattacatgtgggtctattgtgtgggcactgatacccccgaaccggcggcgctcacaccgaatattgtgctgtatgaccaccaggccagccgttcaggcacctgcgctgctgactatctcgccggttttcaaggttatctgcaggtggatggctatcaaggctatgagcagaccggtgcccggctggtcggttgcatggcccatgcccgccgtaaatttatggaagcgaagcaggcgcagggaaaaaacaaaacgggcaaagccgatatcgcgctgagcctgatccagtcactgtaccgggtcgagcatcaggtcaaggggttaagcccggcagaaaaataccggatccgccaggaaaaagcgcttcctatctgggataagttatcggcctggctggttaaaacccgatcccaggtgatccccaaaagcaagctgggtgaggccgtcacttatctgagcaatcaatgggcaaaactgatccgctatcgtgaggatggccgcttgtcaatcgacaataaccgggccgaaagggcgatcaaaccgtttgtcatcgggcgaaaggcgtggctgttcagccatacctcgcgcggtgcacaagccagtgcgatcctctacagcgtcattgaaacggccaaagccaatggattgatccctttcgattatgtcatgacttgcctggatgagttatgccaacccaccccggatctggaaaaactactgccctggaaaaaagtgataagcaaggtgtag

SEQ ID NO: 4253 - DNA, 354 bp, Xenorhabdus bovienii
  Coding sequence Name=Xb4151_4152.C442.gene40.dna; Position on contig =32077..32430bp; Strand=-
atgaaaatgtttgtggatgtgccggaggtgtatttgtgccgctcatttatcgacttccgaaaatccatcaacgggctggcggtctgggtggagctggaaatgcaactgtctccgacgcaaaccgcgttattcctcttttgcaacaagaagcgggataaactcaaaatcctctactgggataaaaccggatttgcgctctggtacaaacggctggagaacgcgaaattcaaatggcccaccgccgtcaacagtgcctccctgaccctgacagagcagcaactgcacgggttgttatcgggttatgatgtcatcgggcaccagcccttctccgtacaggattgccatgtcgcctga

SEQ ID NO: 4254 - DNA, 348 bp, Xenorhabdus bovienii
  Coding sequence Name=Xb4151_4152.C442.gene41.dna; Position on contig =32427..32774bp; Strand=-
atgatggaaaaaactcacatgagccaatccaggtttactcaagccgagtggcgggacctgtttgaacagcagaaaaaatccgaactgactgtcccgcagttttgccaaaaaatcggtgtgtcgacaacccggttctatcaccaccgccaacgcacctcccatccaccaaaaaagccgtctgggctggcttcaccgtctgcttttattaaagtcagcaccgctcagaaaaaatccgcctcatccagcacactccccatcttatttgagacaccacatggcacactgcgttttcctgccggcacggataagcatgttatcattgcgattattcgggggctcgccgcatga

SEQ ID NO: 4255 - DNA, 180 bp, Xenorhabdus bovienii
  Coding sequence Name=Xb4151_4152.C442.gene42.dna; Position on contig =32801..32980bp; Strand=+
atggatttatcctggctaggtggggttccccgtacgcttacttttatttttcatatagtgaccttttatacattgcggaaacaaggcattccggcactgatgcggtgcatttggataatttcaaatcgttatcgttaccatttgtattatttttcatcagaatttcattcctccgcctga

SEQ ID NO: 4256 - DNA, 894 bp, Xenorhabdus bovienii
  Coding sequence Name=Xb4151_4152.C442.gene43.dna; Position on contig =32965..33858bp; Strand=-
atgtttcagcgttttaaatcccgttttacccgtgacccttccccgtcacaaaaagcgcccgggcaagcgcctgaaagaatacgcggtgccggaggttatttccgtccacagtcagcagaggtgctgctggcaacttcagagcgtggccagtatctccgccaactgtgggaaaacagtgcgctgcccgccgggttgtatcagcaattctatctggatccgctccggcaattatgcgcccgtgtgcagcatgttcccgcgacacaagagggcatctggtcttgtcgcggcggatttatcgatctgaccctgcaatttactgcctgtgccgtgcggctggcaaaagggcatatgttgcctccgggggtggcgccggaaacacaggccgcacaaagtctgctgtggcaggcggtggtgttctgggcggcgctgttttaccacctgcctctgctgcggcaactggaaggggaactggaagacgggcatcactggcagccgggattgtggatacctgaacgtcgtttccgcttccggtttcaggcaccggggcctgagctgcctgtcctttataagacgctgctggctgcccgtttgttaccggaggaagcggtgacctggctgtctttagtgcccggtgcgtggcagtgcctgatgttgcatcttggcggacatccgtcttctgtcccgttgacggactcactgcttcagtctgccgctgagcaggtgcagtcaccgctgctgaatcccgttgaatctgctaaacaggctaccgataccaggctgtcatcatcagaacccgatccggttattccgccagtcacaccgggaacagcccctgcgcctgacaccgccgaggatacccggacattactgtcattgtttcaggcggaggaatga

SEQ ID NO: 4257 - DNA, 687 bp, Xenorhabdus bovienii
  Coding sequence Name=Xb4151_4152.C442.gene44.dna; Position on contig =34079..34765bp; Strand=-
atggcctcccgaaccgatcatcagaaagaattcatttcactgtttaagcaaacggcacgttatcatacccgttatcaggtcttccgggatttttgcaactgtgccatggcagcgatccacaataagcactgtttcagtgaggagctggagcagtattatctgaaaaccattaacaagtacgaacgggccgatgttgaccggatcgtacagttgttttcccatgtggtgctcggactggtgcaggaacccggtgattttctcggcagtgtgtttatgcagctggaactgggtgataaggatcttcagcagttctttaccccctggagtgtggccagaatgatggcacagatgcagttgcaggatgccgccgggctgttgcagacacaaccgtttgtcactctgtgtgaaccttgtgttggtgcgggctgtatcacgctggccgctgccgatgtattgcgggagctgggacacgatccgttgtgcagcctgtgggtttacgcgattgatattgacccgctggcggccgtgatggcctatatccagttctcgttgaccgggattccggccgccatcaccatcggcaatgccttgcatgatggtggtgacaagcgaacccgttatacgcccgcgcattatctgggcaactggtctcagcgtttgcgggaggcggagcttatcgccgcctga

SEQ ID NO: 4258 - DNA, 129 bp, Xenorhabdus bovienii
  Coding sequence Name=Xb4151_4152.C442.gene45.dna; Position on contig =34719..34847bp; Strand=-
atgtcaaccgaaaggggaaccgatccccttttcggggcgtgttttccttttttcgctttttgttcagcaaggaaaacacccaatggcctcccgaaccgatcatcagaaagaattcatttcactgtttaa

SEQ ID NO: 4259 - DNA, 924 bp, Xenorhabdus bovienii
  Coding sequence Name=Xb4151_4152.C442.gene46.dna; Position on contig =34885..35808bp; Strand=-
atggcagaatggtgcaccaatcaactggaaatcaccggcaaatccgtttgtctcgatgtaatgcagcagtgggtctgcggggaagaagtcccccgttaccgtcaggcggtgttacaaagtcttcgcctgtttctggcaggctgtgcggggatactgaaaccgactaaaccacaaacctacactccgtacccggcgctggtgcgcggcacggcggtgccaacggcgcagcatctggcctttgagcagtggttgctgttgttgcagaataatgtgccgttgaataatgacaatatcaaacgcattgataacctgtaccgacagtccggtctcagcctgatgcagtgggacaaggtgccggaagcggcgcgtgatattatcgctcgtctgctgacccgccagtatatcgactggtttggtatggtgggctggtctgatacaccggatatcggggcctgctgggataagctgaatgtgtacccgcaggcggcacagccctgcgatatgctgatgatgatgtcaacgaatctggccaccgaaatcaacggcaacagtggcttactgaaaggcattcccaccacagcgcagttttatgaggaacaatacgggctggaatggccgtttggtcaccatgtccgctgggagcgccggaatgtcagcagtttaaccgtgcgttttgattctccctgggcaccgccttcggcggagctgatgggggaactgtccgcgatgtttgactgtgaaatccgtcattggtacagcgatgcgtcaggcagcctcaaaggctatgattgctatgaccagggcgagcacgtggacagcggtcacgggcagtcaggacgggaaaaccggccggcactctatctggtcactggcgagcagacggaagccgcattggccctgccggccatcgcagtcggacagtaa

SEQ ID NO: 4260 - DNA, 297 bp, Xenorhabdus bovienii
  Coding sequence Name=Xb4151_4152.C442.gene47.dna; Position on contig =35901..36197bp; Strand=-
atgaccacgttacgtttaaccgtctggcaggtgattgcggctgccttgctgaaacggcattttggcttgaatctgactgacacggtattgtgtgaaaccggtacggtggcagcactgatagcccgcggtgtccggccctcagaagccattaacgaactggtggataaatacgacttaatccggctgaacacgcaggttatcccgcgcaataccccttatctggatatccacgatgagctgacggttatttttgacagtggtctggctgacaggttattcaggcagaccggacagtaa

SEQ ID NO: 4261 - DNA, 549 bp, Xenorhabdus bovienii
  Coding sequence Name=Xb4151_4152.C442.gene48.dna; Position on contig =36194..36742bp; Strand=-
atgataccggcaccggatgataccggtaccgcattacgtgaagagctgtttaccgctcaggtcagcggcctgaggcaacacccgaaagcaccacagtcattgcagccggaaaccctgatgatgtgcgaagccgccaccgtcacggaagtggtgcagcggctgaaggtgatccatctactgggtgactggccggtgccggagaggttatctgctcaggtttcggggactttttttccgctgaccgtcatgatttttgacgcacaggacagaaaagtgctcggtggccggtttgatgaagagattatctgggcgcagccggtcacactgacgtcagaacgcctgtcattggaacagcaacagcagcggttatgtcaggcagcgatgcttgagcagagctggcagaatactccgacggcgcgtgcgttgtggcacaaggcacatttattgtcactgcatggggttgcctcctgttatcagcagtgccatgaagtgcgggatattctccggtatggcgtctccgtcagtgtcttttctgaggggacgttatga

SEQ ID NO: 4262 - DNA, 177 bp, Xenorhabdus bovienii
  Coding sequence Name=Xb4151_4152.C442.gene49.dna; Position on contig =36709..36885bp; Strand=+
atgcggtaccggtatcatccggtgccggtatcatccggtgccggtaaaaaaatggggttcatggtgttgtcccttgatttcacgttaaataaagaaaacacccgcccgataccgggaaggtgttttcgcttccccggtcaggcgctgaagaaaagcgttaacagcctcatgggctga

SEQ ID NO: 4263 - DNA, 462 bp, Xenorhabdus bovienii
  Coding sequence Name=Xb4151_4152.C442.gene50.dna; Position on contig =36891..37352bp; Strand=-
atgccaaataatgaactgattatgctggacagtcttgcgctgtcggtcgtgtttcccgacaaaaccccgctggaacggttgtttctggggttcctgctggcgaataccgcatcaacgttatgcggcgattatcagcctgaacagtggacaagccgacaggtgtctgaatcgctgacttatatggtgccgatacgggcggaaacgtattccgtttacctgccggatacgcagctgacggtcacgctttcagccgatgccttcgggctggcggtcacggccatcgtatcagcccgtatcgcggtgctggagaccccgaatgaggaggtgtaccggttctgcgcattgcaggcgtatgcacaacagcatccggaaagcggcctgatagcctcggtcatgacactgaaacccagagaggatgttatcagtccgtcacttatccctgacaaaaataatcatcactga

SEQ ID NO: 4264 - DNA, 438 bp, Xenorhabdus bovienii
  Coding sequence Name=Xb4151_4152.C442.gene51.dna; Position on contig =37342..37779bp; Strand=-
atgcaacaaaatacaccgccggccattgtgcccgcctctgaacacgccccctttgctgaaatttttccgcacaccggttcgttggagctgatgctgctggagcacacattcattaaagccgccgccgtgctgtgtgacgatgaccgctgtgatcagtggcagtaccggaaagtatcagacactatcgcttatatcgtgccggtacgaccagaacccgctgtggtcagggttgagccaacggactttaaaggtgaggtctctgccgaggctttcgggctgatggtgaccctgagcgtactggggtatctgacgaccttgttaaaattggacggatatgctgaacggttttgtgccctgcgggaatatgcgctgcaacatccccaggctcagtgcattcgggcggctttgggcttaaagggagaatataatgccaaataa

SEQ ID NO: 4265 - DNA, 159 bp, Xenorhabdus bovienii
  Coding sequence Name=Xb4151_4152.C442.gene52.dna; Position on contig =37890..38048bp; Strand=+
atgattgacgatatctgcttccaaaggtgcgcagatgtaccacacatcggtgtactcccttgcaggctacaggagtgttgctgtcgctgcccgaaggtgatcctcacaagcgaccggatcattgataagacttatcacgctaataaatggaaatcataa

SEQ ID NO: 4266 - DNA, 186 bp, Xenorhabdus bovienii
  Coding sequence Name=Xb4151_4152.C442.gene53.dna; Position on contig =38036..38221bp; Strand=+
atggaaatcataaggtcaatgggtaattcattttccgggacagaaaataacatcagaatatcgataccctcatttttcctcactattttggcaatacacctgccggatatagcgccccggattgctgggcaaaatggtatcgcatgctgtgcggcactggcttacccaccagtccggcactgctga

SEQ ID NO: 4267 - DNA, 498 bp, Xenorhabdus bovienii
  Coding sequence Name=Xb4151_4152.C442.gene54.dna; Position on contig =38309..38806bp; Strand=-
atgaaaaaaaatcattggttatatattgcactttcattgctttccattattttattaatagtattatttaaaattatcaatatgagcaataaaaaaaataacatcgagattcgatgtacaggtgagttaacttcacgtagaaaagtgaataacactgatttggctaatttaaatgaaaaattttttttatttttatatgataatgggaccggttttttgacacagaaagggatactgtcaatcggtaataaaaattacataatggatcgggaagtgaatgttaattatactgattttgataaggattatatatacacattccaaattataaatgtaaaattgcgagctaatgacaatatcccatccacggttgagacgatattccccatattgggaagagtaccgttatcctcttacctaaatattacgtcggttgataaagatctttacattttcaacgagctttcggggccttttttcttgtgtaaacgattttaa

SEQ ID NO: 4268 - DNA, 804 bp, Xenorhabdus bovienii
  Coding sequence Name=Xb4151_4152.C442.gene55.dna; Position on contig =38803..39606bp; Strand=-
ttgaaatacgttataaagtttaccatcatatactcacctgcagacaggaaactgtcattactcaacgatagcaatcatgaaatcacactatcaaaccaagcggcgcgactgctgcttgagatgatcactaacagcaatgagactcttcatagagaagatttattgaaaagggtatgggaggattatggttttacacgttcaaacaatagcctcaatgtcgctgtaagcgagattcgaaaatcatttgaatccttgggaagggatccaaagattatcatcaccattcctaaagtcggttttcgttttgagggtgctgtagagccagtcattaaacagagtgaaaacaatacttttcctattgatgaaagtgaggtgcaattaaaacagtccactgataaaactattttcataagacaaaaaaaacaacaaataaaaaaattcgttatatgcatgaccttcgttttcctctgtggctacgcttcttatgaagcttttattaaattcaaacacctaaacgtacgccatgaaaaaacaacatttctgtatagcgttggaaaatgtgacgtttatgcattgggagatctgccaatagatgtgggtgaaaattatattgatatagccaaacaagatatcaacaaagaaatcattaattgtgacctcgcgaaggggaatatttactacaaaaaaacacgtagtggcagtcaggacacacaaattagttttatcggcatatgtggcctggacgacaataacaaacctaaagattgtagaagcatattaaacaaccttggtgtcaatttatga

SEQ ID NO: 4269 - DNA, 171 bp, Xenorhabdus bovienii
  Coding sequence Name=Xb4151_4152.C442.gene56.dna; Position on contig =39791..39961bp; Strand=-
atgaagaactcaacacttacctcttgtaacctgagccccgttttcccgtgtcacactgcgcatctagtcgagcagagaacctctgtgacaacggcgacaatgatagagaataaaaaaacaaacaaaacattatacttatttatttcattaaaaagatttttattccgataa

SEQ ID NO: 4270 - DNA, 144 bp, Xenorhabdus bovienii
  Coding sequence Name=Xb4151_4152.C442.gene57.dna; Position on contig =40359..40502bp; Strand=-
atggataagatgtatatctacattaaaaataacagggtaatagatcctcaattatggggaatgtcccgatacggagaaccaatttattcattgttcgtagaatccacgatcaatgaagtcatcgctaagctcagggttatttaa

SEQ ID NO: 4271 - DNA, 7554 bp, Xenorhabdus bovienii
  Coding sequence Name=Xb4151_4152.C442.gene58.dna; Position on contig =40647..48200bp; Strand=+
atgtacagcacggctgtgttactaaacaaaatcagtcccactcgcgacggtctgacgatgactctcgcagaccttcagcacctttccttcagtgaactgagaaaaacatttgatgaccaactcagttggggtgaaagccattatctctatcgtgaagccgttgaacaaaaaaaacgtcatcgtctgctggaagcccgtattttcacctgtgccaatcctcaattatccggcgccatacgccggggcattgaacaagacgatgcttcacgcagttatgataaaatgtttggctcccgctcttcttcctttgtcaatccgggctccgtggcctccatgttctcgccggccggttacctcacggagttgtaccgcgaggcgaaggatctgcatttcacaagctctgcttatcaccttgataatcgccgcccggatctggctgacctgacgctgagtcagaataacatggactcggaaatttccacccttgcactgtctaacgaactgttgctggcgcatattacccgccagaccggaggtgactcagacgccttgatggagatcctgtcgacttaccgcaaggccgttgacacaccttaccatcagccttatgagactgttcgtcaggtcattatggcgcatgacagtaccctgtcagcattgtcccgtaacccggaagtcatggcgcaggcagaaggcgcttcattactggcgattcaggccaatatctcgccggaactttatcacgtattgaccgaagagattacggaggagaacgctgacactttatttgcgaaaaacttcagtgaaaatatcacgcctgagaattttgcatcacaggcatggatagccaagcattatggccttgaactttctgacgtgcaaaaataccttgggattttgcaaaacggctattctgacaacacctctgtttatgttgataatatttcaacggggctggtagcagacgatgagggtaaactcgacgcttacaagataacccgaattcctggcggagattatgcaaagcacttgaacttttgggatctgctctataaaggtgatagcgatttcgttatcagggccaatttcaaaaaaagtagtggtggtctcacaatacgtaaaagtggagtgggaacgaccaatgatagcaaagttataggtactatctctgcaccaaccgatgcgaatacagtttatcaaagtgaaatattatcaccgcttaccgttgatgatttaaaaaatggggcgacaatatttgcttataatcgtggtggcaataaaaatattgagggaactgctgtctttaccttcgaaagttaccctctgagcatttttgctctcaaactgaataaagccattcgcttatgtctggctagtgagttatcgccgaatgaattacaaactatcgtactcagtgataatgcacagggcatcatcaacaactcggttctgaccaaagtcttctacacgctattctacagtacccgttatgccctgagcgctgatgatgcgcaggtactgaacggatcggtcatcaatcagtatgctgacgacgatagcgtcagtcactttaaccgtatatttaatacgccaccgctgaaagggaaaatctttgaagccgacggcaatactgtcagcattgatccgaatgaggagccagcgacctttgcctgttcagccctgatacgtgggttgggaattaacagcggtgagctgtatcagctaggcagattggcgggggtactggatacaaaaaataacatcacgctttctgtctccgttatctcttccctttatcgtctgaaattactggctcatacccatcagctcacggtcaatgaactgtgtatgctttatggcttttcgccgtttaggggcaaagcaacggcttctctgtcttccggggaactggcgcagctggttatctggctgtatcaggtgacgcagtggctaaccgaagcggcaataaccactgaagaactttggttattatgtacacccgaatttagcggaaatatttcaccggaaatcaataacctgcttaacactctccgaccccgtattagtgaagacatggcgcagggtggcgaccgggagctccaggctgaaattcttgcgccgtttattgctgcaacactgcatctggcgtcaccggatatggcgcgttatatcctgttatggacagataatttgcgaccgggcggcctgaatatcgccggatttatgacgcgggtgctgaaagagacgctgagtcctgatgaaactatccaactggtgcagttctgccatgtgatggctcagttgtcgctttccgtgcagacgttgcgtctcagtgaagccgagctgtccgtactggtcatttccggtttcacggtactgggtgtgagaagtcaacccgccggacagcacaatatcgataccctgttctcactctaccgattccaccagtggattaacgcactgggtaacctcagctctgacacgctggatatgctgcgccagcaaacgctgacggcagacagactggcctcggtgatgggtctggacatcagtatggtgacacaggccatagcctgtgctgacgtgagcagtcttcaaagctggcagaatatcaacgccgtgctgcaatggatggatgtggcctcagaattgcacaccatgccatcggttatccgtaggctggtcaatatccgctacgtgactgtgccgaacaaagccgagtcggatctgccttcctgggatgaatggcagaccctggcagaaaatatggaagccgggctcagtacacaacaggctcaggcactggcagatcataccgcagagcgcctgagtagtgtgctgtgccattggtttctggccaatatccagcctgaagggatattcctgcaaagccgggatgacctgtacagctacttcctgattgataatcaggtctcttctgccataaaaactacccgactggcggaagcgattgccggtattcagctctacatcaaccgggcgctgaaccggatagaatcgaatgcccgtgccgatgtgtcaacccgtcagttctttaccgactgggcgatgaataaccgttacagcacctggggtggggtgtcgcggctggtttattatccggaaaactacattgacccgacccagcgtatcgggcagacccgaatgatggatgagctgctggaaaatatcagccagagcaagctcagccgggacacggtggaggaggcctttaaaacctacctgacccgctttgaaaccgtggcggacctgaaagtggtcagcgcctatcacgataacgtcaacagtgactccgggctgatctggtttgtcgggcaaacacgggaaaacctgccggattactactggcgtaacgtggatatctcacgcaggcaggcaggtaaactggctgccaatgcctggaaagagtggacgaagattgatacggcggtcaccccatacaaagatgtaatacgtccggtggtgttcaaagagcgtttgcaccttatctgggtggaaaaagaggaagtggcagaaaacggcactgacccggtgaaaacctctgaccgttttaccctgaaactggcgtttctgcgccatgatggtagttggagtgctccctggtcttacgatattacgacgcaggtgaaggcggtcactgacgataagcctgacgctgaacggttggggctggcggcatcaggttttcagggcgaagacaccctgctggtgtttgtgtacaaaaccggggagagttacccagattttggcggtagcaataaaaatgtggcaggaatggtcatttacggcgatggctccctgaaacagatggatagtacggcactaagccgctacagcccgctgaaaaatacctttgataccattaacacgaaagataataatttggtaagaaaggccagctatcgtttcgctcaggattttgaggtacccacctcattgaacatgggatcagcccaagacgacaggcatctggtcgtgatagagaacgcggctatcccggagataaccagccaatcttccagtgaaagctttactattacgctgcagaatgcgaccttcaccgtccggtatgacggcagtggcaatgcactcagaagcaaacaaatccgcgccatgaaactcgggggactcgggggtttacctggtgatgactttatactcgccaattcagcccgctatgctggcggcgtcagagacctcggcgggccaatcgcgatttataacaaaacgaaaaactatatcatatcggtacaagactcttatgagccctcccttcatctcagatatctgcgattgagccccattaatgattctggcccaattctaatcagccccgcaccttcttatccgaaagatggaacaaatgtaattgcttatcttggcggcgacaggtcaagtgactttaaaaagtgttactatgcttttgatcgtggaaacaaaaagattgggcccttccaagactggtcatcgtattattcatacggcggctggctggaggttggctcgggggctaaccctgcggggacccagattaccgtcgtggccggcagcaaaccctaccattttaccgccgagaatcatgcggttagtttgccgccaaacagctttgagggcatgcagtataccttcaagcccctggtcatcgatgccgctgggctggtttatctcaataacgcggcgccagtggatatcacctttgaagtggaagggatggggaaaatcagccagaccctgaccgtgagaaaacttgactacggtcaggagaatatcctctgtctgcaagagaccgacaccggtgtgcagtatatgcagctcggagtttatcgcatccgcctcaataccctgctggcacctaaactggtgtccagagcgaataccggcattgataccatcctgaccatggcgacgcagcagttgccggagccgcagttaggcaaaggtttctacgccaccttcaccctgccaccttataatccggcaacgcatggtaccagtcgggcgttcaagcttaaccttaaacatgttgttgatgataacgttcatatcatctactcaggactgctgcaagataccgagcttgcagttcggctctttattcctctggatgatacaccgctttatgagaaattcattgccaaggtgtttttaaccacccagaagaaccccaatgatgttccatgggcaggaccacactttacggatgatagcggtaaaataggtatccatggcagttcgaatgtcagtatgttcactggtgtacaaccccataacggcacaactaccgaaccgctggactttaacagtgcctgcgccctctattactgggaactgttctattacacgccgatgatgtgcttccagcgcctgctgcaggaaaaacagttcgacgacgccaccaaatggatgaactacgtctacaacccggcgggctatatcgttcacggggaaatcgcgccctggatctggaactgccggccgctggaagagactacctcctggcatgccaatccgctggatgccattgatccggatgctgtcgcccaaaatgacccgacgcactacaaagtggccacctttatgcgcctactggaccagctcataacgcgcggcgatatggcttatcgcgaactgacccgcgatgcactgaatgaagccaaaatgtggtatgtgcgcactctggaattgctcggtgacgaaccggaagattacggcagcagccagtgggcggcaccgtccctttccatggcagccagccagactgtacaggcagcctatcagcaggatcttacagcgctggacagtggagaggtttccatgcagccccgcaccgctaactcgctggtcggtttgttcctgccggagtataacccggcgctcactgattactggaaaaccctgcgtctgcgtctgttcaacctgcgcaacaatctatccattgacgggcagccgttatcgctggcgatttacgccgaacccaccgatccgcaagcgctgctcaccagcatggtccaggcgtctcagggcggcagtgtattaccgacaggcaccttgtcgctatatcgcttcccggtgatgctggagcgggcccgcaatctgggggcgcaattgacccagttcggggcttccctgctcagtatggcagagcatgatgatgccgatgaactcaccacactgttacttcagcagggcatggaactgtccacacagagcatccgtattcagcaacggacagtcgatgaagtggatgccgatatcactgtattggcagagagccggcgcagtgcgcagaaccgtctggagaaataccagcagctgtatgacgaagacatcaaccacggagagcagcgggccatgtcgctgtttgatgcggcggcaggtcaatccctggccgggcaggtgctcacagcggcagaaggggtggctgacctggtgccaaacgtgttcggctttgcctgcgggggaagtcgttgggggtcagcgctgcgcgccgcggcgtccgtaatatctctttctgcgacggcttctcagtattccgcggaaaaaatcagccgttcggagacctatcgccgccgtcgtcaggagtgggaaattcagcgtgataacgcggatggtgaaatcaggcagatggatgcccagcttgaagccctgaaaatccgtcgcgaagcggcacagatgcaggtggaatatcaggagacccagcaggcacagacccaaacccaactggagctgttacagcgtaaattcaccaataaagcactctacagctggatgcgcggaaaactgagcgccatctactaccaattctttgacctgacccagtccttctgcctgatggcgcaggaagcgctgcgccgcgaactgagtgacaacggcgtgacctttatccgtggcggtgcctggaacggtactactgcgggtttgatggcgggtgaaacgttgctgctgaatctggcagaaatggagaaagcctggctggagcgtgatgagcgggcattagaagtcacccgcaccgtgtcgctggtgcaggtgtaccaggctctgtcatcagacagcttcagcttgacggagaaactcacccagtttcttagtgaaggcaaaggcagcgcaggcacttccgggaatgaactgaaactcagcagcggccagattgccgcctcggtacggctgtccgacctgaatatttttggtgattaccccgaaagcctcggtcgcacccgtcagttgaagcaggtgagtgtcactttgccggcgctggtcggcccgtatgaagatatccgggcggtactgaactatggtggcagcgtgatgatgccgcgcggttgcagcgccattgccctctcccacgggatgaatgacagcgggcaatttgtgctggactttaacgatgcgcgctacctgccgtttgaaggtattcctgtggatgacagcggtagtctgacgctgagtttcccggatgcgaccgaccggcagaaagagatattgcagagcctgagcgacattattctgcatatccgttacaccatccgttcttaa

SEQ ID NO: 4272 - DNA, 4446 bp, Xenorhabdus bovienii
  Coding sequence Name=Xb4151_4152.C442.gene59.dna; Position on contig =48252..52697bp; Strand=+
atgcaaaatacagcacctttgcagattggaaccccgtcactgcccaaaggcggcggtacactccgtggcatgggggaaacctttaccgggggcggccctgatgggatggctacgctttcattaccgctgccgatttccagcgggcgcggcaccgcccctgcgctgtctctcacctacagcagcggcagcggtaatggcgcttttggcatgggatggcactgtgccaccctggctgtcagcctgcggacttcacacggggtgccgcgttatgagggcaacgatacttttttgagtccgatgggcgacgtaatgcaggttgccccaaacgaacagggcaagccggatatccgtaccacgaaccagttgcagggcgtcacgttagatgagagctggcaggtgacccgttatcagcctcgcatcatccatgatttcagccggctggaatactggcagccggaacagggcaatacacaaaaacccttctgggtgatgttcagccttgagggtcaagtgcatctctttggcaaaaatgcccatgcccggatggctaatccggctgatgataatcagattgctcagtggctactcgaagagaccgtgacgcccaccggtgagcatgtttactaccaatactgtgccgaagatgacgcgggctgcgatgagcctgaaaaaggacagcacccgttatccggtgcacagcgctatttgatgcaggttcactacggcaatatcacgccacaggcgagcctgtttgccctggataaggcgctgcctgctaatgaccaatggctgttccatctggtgtttgattacggcgaacgggcaggctcgctgtatgacgtgcctgcgtttcaggcaacgtctggaaactggcctgttcgcccagactgtttttctcgtttcgaatacggttttgaaatgcgtacccgccgtttgtgccgacaggtactgatgttccatcggttaaaagcgttagccggcgaagacactgcccctgaaacaccggctttggtctcccgtctgatgctggcgtatgacttgaaccattgtgtcagtactttggtttcggcccgtcaggtggcccatgaaaatgacggggcgcccgtcaccctgccgccgctggagctggattatcaacggctggatacggcgtcgttgccggtctggcagcccatgccgcagttggacaaattaaatcacctacagccgtatcagttcgtggatctgtatggcgaaggcttaccgggcatcctttatcaggacgctcctcacgcgtggtggtatcgctctcctatacgtgacaccacggcagaagcacgcgataccgtggcctatggggagataaaaccgctgccgcagatccccgcccagcagaataatacctcactgatggacatcaacggggatggcaagctggattgggtcgtcacctctgccggagtcaatggctatcacacgatggcgccaaacggacagtggtctccttttgtcccgttatctgctttgccggtcgagtattttcacccgcaggcacaactggccgacctgactggcgcgggactggctgatctggtcatgattgggccacgcagtgtacgcctgtatgctaaccaaccaacgggctggaaaaaaggcaacaccgttatccagtccgacggcatgacattaccgatccccggtgcagatgcgcgtaaactggtggcctttgccgatatgctgggttccggccagcaacatctggtggagatttccgctgacggcgtgacgtgctggcctaatctcggacacggccgttttggacaccccatcagactggccggattgacggtttcagccaaaaactttaatcccgatcaggtgtatctggccgatattgacggctccggcacgaccgacattctctatgtccacagcacctatctggagctgtttatgaatgaaagtggcaatcaatttgcggcaccggtgcgcatcaatctgcctgagcatgtccggtttgaccgggcatgtcagttacacatcgctgatacgcagggattgggcgtatccagcattattctgactgttccccatatgactgtgcggcactggcggctggatatgactcaacacaaacccgggttgctgaataccatcaacaacaatatgggcgcggagaccaccctgttttaccgcagttcggcgcagttctggctggatgaaaaacaccaggccgaaaacgtgggacgtgctgtaaccagttatctgccattccctgttcatgtcttgtggcgtgccaaagtcttggatgaaatcacgggtaaccggctgacttcagagcaggattatgcccatggtgcctgggatggccgggagcgtgagttccggggatttggccgggtcagccagaaagataccgacaagctggcacaggcaaccgattcgtcagttaccgatcccctgtcgcccgccatcacgatcagctggtttgccaccggggttcctaccgttgatgcccggctggcggaggaattctggcaaggcgacaaacaggctttcccgccctttacctgccgttttacgcattttgacctggataaagaacaggatgttactctcgttccctcgacggaagaggcttactggctgcaccgggcgttgcaaggccaaccgttacacagtgaggtctatggcgatgatggcaccgcgcaggcgggtatcccctataccgttatggacagccgaccccaggttcggcttctgacggggttgccgggtaattcatcgacagtctggccgagtgtgattgaacagagaacctggcagtacgaacagattgccgatgatccgcaatgccatcagcaggtggtgctgaacagtgaccgctacggtttcccacgggagactgtcgacattgcttatccccgccgtcctaagcccgctgtctcgccttacccggatacgctgccggcgacgttatttgacagcagctatgatgagcagcaacagcagctgcggctcacccggcaacggcagcgttaccatcatctggctgacacggaatatcaggtgctgggactgcctgatgtcgtgcgaagcgatgcctgggcctatccggcagagcgcgtgccccgtgaaggtttcaccctggaggacttgctggcagagaacagtttgatagcaccgggcacgccactgacctatgtggggcatcaacgcgtggcttataccggaacgaccggaaccgaagaaaaaccgacccgacaggcgctggtggcttataccgaaaccgcggtttttgacgagttggccttgcaggcctttaatggcgcattgagtcctgaagccctggaaaagaaattaatcgagtcgggttatctgcatgtttcacgcccgctcaatacgggggcagaatcggcggtctgggtcgcccgtcagggatataccgattacggcggggctgaggcgttttaccgtccgttggctcagcggacgacggtgcaaattgggaaaaacaccctccattgggatacccattactgtgccgtcatccgtatgcaggatgcggcgggtctgtacacggatgccgcctatgattaccgcttcctgacccccgttcagataaccgatgccaatgacaatcagcaacatatcacgctgaccgcgctggggcaggtgtcatccggccggttctggggtacagaggcaggcactgcgcagggttataccccgcctgaagaccgcccatttacgccgccgtcctcagtggaggaagccctcgacttgaaaccggatcttccggtcgccaactgcagggtctatgcgccgctgagttggatgccgttggcgcacacctgtcaggaatatatagccggctttacggggcaggcactgcttgatgcgggtgtggtgacggaagataagcgggtatgtgcgctgggtttccgtcgctgggtgcaacgtcagggcattgtgctgaatgggcaggcattggccgattcacgggaacccgtccatgtcctgacgctggccactgaccgttatgacacggatcccgatcagcaactgcgcaagagcgtcacttacagcgacggtttcgggcgtttattgcaaagtgcaatctaccatgcgccgggagaagcctggcaacgcgcggcagatggcagcctgatcacggatgagaaaggggcgcctctcgtagcccataccccaacccgctgggcggtctcaggccggacagagtatgacggtaaagggcaacccgtccgaacctaccagccctttttcctgaatgcctggcagtacctcagtgatgacagtgcccggcaggatttatatgccgatacacactgttatgacccactaggccgggaataccaggtgagaaccgccaaggggtatttgcgtcaaaacctgctgaccccctggtttgtggtgaatgaggatgaaaacgacacgctctcttaa

SEQ ID NO: 4273 - DNA, 2799 bp, Xenorhabdus bovienii
  Coding sequence Name=Xb4151_4152.C442.gene60.dna; Position on contig =52777..55575bp; Strand=+
atgactgtaaacagaggcgataacctgcatcaaaaaacgccggaagtgacggttctggataaccgggggttgaccgttcgcgagctccgttatcaccgccacccaaatacccccatcaccaccgatgaacggatcacccgccatcggtttaccctcgccggtcagttggcgcacagcattgacccgcgcctgtttgacttacagcaggcggataatacaatcaatcctaatatggtttatgagacggcactgacaggcgaagtggtgcgcataaggagtgtcgatgcgggtaataccctgatgctgaatgatattaccggccggcctgtgctggccatcaatgcaaccggggtcacccgtacatggcaatatgaagatgatactttacccggacgcccgctcagtatcaccgaacagcctgctgacgaagtagcccgtatcacagagcgttttgtctgggcagggaacagtgaggcggagaagaacagcaacctggccggacagtgtgtgcgtcactatgacactgccggactgaaccagacggacagtattgcgcttaacggaataccgctgtccgtcactcgccgactactgccggacggtacggacgcagactggcagggaaacaatgaatccgcctggaacgaccggctggcaccggaaagcttcaccaccctgagcacggcggatgccaccggtgcggtactgaccaccaccgatgcggccggtaacctgcagcgactggcgtatgacgtggcaggcctgctgactggcagctggctgcggcttgcgggcgggacagagcaggtcatcgtgaagtccctggcgtattccgccgcgggtcagaaactacgcgaagcgcacggcaacggcgtagtgaccacctacacctacgaaccggagacccagcgccttgttggcataaaaaccgaacgcccaccgggacatgcacagggggcgaaggtgttacaggacttgcgttatgagtacgacccggtgggcaacgtggtgaaagtggcgaacgatgcggaggttacccgcttctggcgcaaccagaaagtggtaccggagaacacgtatacttacgatagcctgtaccaactggtttccgctaccgggcgtgaaatggctaatattggccaacagagttctctgttaccccccccttccctcattgatagcagtacctacagcaactattcccgcacctataattatgaccgtggggacaatctgacgcagatacgtcacagtgccccggccaacgacaacagttataccaccaagatgacggtctcagatcgcagcaaccgggcggtgctaagtacgctgacggaaaacccagcggaagtggatgcgctgttcaccacaggtgggcagcagaaccagctgctgccgggacagagcctcgtctggacgccgcgcggtgagctgctgaaagtggcacccgtggtgcgtgacgggcaggtttccgaccaggaatcctatcggtatgatgcggacagtcagcgcatcatcaaaacccacgttcagcagacggctaacagctcgcaaacgcagagcacgttgtatctgtcaggactggagcggcacaccacaacaaatggcacgacggtgaaagaggtgctacacgttatcacgataggagaagcaggccgtgcgcaggtgcgggtactgcactggaagaacggaaaaccggatagcatcagtaacgaccagatacgctacagctacgacaacctcattggtagcagcggcctagaggtggacggagacgggcaaattatcagtatggaagagtactacccgtacggtggcactgcggtgtggacggcgaggaaccagactgaagcgggttataaaactgttcgttactcgggtaaggagcgggatgctacggggctctattattatggctaccggtattatcaaccgtgggcggggcgctggttgagcgcagatccggctgggacggtggacgggctgaatctgttcaggatggtcaggaataatccagtatcagggtatgacaatgtagggcttgtgtggactcctgtaaccaaggctgtaggctccggaatattgggtgcggctacgctggggtacgaagcgtataaacactcaaaatcaaaaaatgaacctgtccaattatcatcaaatacattaggcaataataaaatccatgaatttcacaaggcggtcactgataaaaataataaattctcagtgactgaagaggtaaaagaaaatttatcaggtcgaggaaaggttataaaaaactttcttaccaaaggagaagttcctgctcatgattcaattatgaatcaaaaagagaatttaataacaatagcaaaatacagtcaaaacggggacgtgagtaagttggataaaggcaagttagccattgcctctgtatcagacgcaagtaataatttgccaataagaatttatcaggcttataaaggctttcgtacagccacatcagtgactcctgaaggggtggatgaggtgatggaaagtgtggcaacagcgaaggataacgtaaaaagcaccttgaatgttgggattggcgttggcgtcattggaaattcgctattgtcagtggcaaaagtattcgttcctggagctgctattcctattaccgccggtcaggcactatgggcagtatcatccgtcggaaaaactgtaaaccaggtgaataaagcagtaaaagaaaatattgaaaaatcccctatatctcatgaatttaaagaggaattatttaggcagatgggaaagccaacaaataaagatgggtaa

SEQ ID NO: 4274 - DNA, 204 bp, Xenorhabdus bovienii
  Coding sequence Name=Xb4151_4152.C442.gene61.dna; Position on contig =55625..55828bp; Strand=-
atgagttatgccagccaactccggattgagaaaaactgcggccatggaaaatggcagagggcaaggtataattccccatacgctgacgtttggctggcgattcagacagcctctaagaaatggacaatgccgatccagaattggcgtctggcgatggttcgttttatgattgaattcggtgaccgcctaaacggtcacgtctaa

SEQ ID NO: 4275 - DNA, 423 bp, Xenorhabdus bovienii
  Coding sequence Name=Xb4151_4152.C442.gene62.dna; Position on contig =55929..56351bp; Strand=+
atgactgaacagccacgcatttcgcccgatgacaaacggtttgatcgctctttccgtccggttattgtcaatcgacagccgtccatcctcccgtacgcttaccgatctggttggcgagctgcaccagtaaagcgtccacagttcaaaagcctgaccgactccatcgacacgccatcaggccggtttttcttctacgtcatggccagcctcaccgaaatggagcgtgagctgatcgtcgagcgcacccgtgccgggctggatgtcgcccgtcagcttagccgcaagcccaagatgacagacagcaagatcgagtcggccaagaaactgctgaccagcggtgttccacccaaggacgtcgccaagaaccttggcgtatcagttcctacgctgtaccgatgggtgccggcatcaacgcacacttag

SEQ ID NO: 4276 - DNA, 147 bp, Xenorhabdus bovienii
  Coding sequence Name=Xb4151_4152.C442.gene63.dna; Position on contig =56717..56863bp; Strand=+
atggacccctttaaactcctgccgctaacggggtcgccgttagcatgccagatttcacctttgcttgggacgctccttctacgcaccattaaatcacctcattaccaacaggatgagaatttagatcatcgcctgttgcttcgttga

SEQ ID NO: 4277 - DNA, 273 bp, Xenorhabdus bovienii
  Coding sequence Name=Xb4151_4152.C442.gene64.dna; Position on contig =56805..57077bp; Strand=-
atggcaataacacgtttacgtcaacagggcggggcagtggttgtcacaatccctagtgacgttgcaacagcaacggggtggtcagtaggtacaaaattggatgtaaaaacgtcaggcgacggaataagcatcaaaccaacaggtagaatagccagaggcaggaagtctctttctgagttgttgcaaggcattgatgaaacagaagtgcggactttcaacgaagcaacaggcgatgatctaaattctcatcctgttggtaatgaggtgatttaa

SEQ ID NO: 4278 - DNA, 93 bp, Xenorhabdus bovienii; identical to SEQ ID NO: 1411
  Coding sequence Name=Xb4151_4152.C442.gene65.dna; Position on contig =57204..57296bp; Strand=-

SEQ ID NO: 4279 - DNA, 324 bp, Xenorhabdus bovienii
  Coding sequence Name=Xb4151_4152.C442.gene66.dna; Position on contig =57257..57580bp; Strand=+
atgggctacagcttagattttcgaaagcgagtactggcatacaaagacaagcattcgttgactttcgaacaaacgagtgcccattttgaaatctccatgcgtaccttgttccggtggtgcaataaaatagaaccttgcatgacccgcgataaacccgccacgaaaatccctgatgaggtactcattgcggatgtccaaaattttcctgatgactatcaatgggaaagagcaaaacgtttaggtgtttcacaatcggctattcattacgccttgaaacggctgaatatcaccccgaaaaaaaacgctccaacaccctcgcgctga

SEQ ID NO: 4280 - DNA, 405 bp, Xenorhabdus bovienii
  Coding sequence Name=Xb4151_4152.C442.gene67.dna; Position on contig =57678..58082bp; Strand=+
atgccacgtaaacaggggtattcggaaaaagggttacgctgttttggtacgcatgactggcacgcaaaaggccgtctcaacgtcattggcgccattctcgaaaataccttcgtcaccttaagcttatttaccgggaatattaatgccgatgtttcttatgcgtggatgacgcaagatttgctgccaaagcttccacacggagcagtgatagtgatggataatgcgcctttccataaacggaatgacacgacacaagcgatagcagacagcagatgtcaactggaatggcttcccgcttataatccggatttaaaccctatagaacacaaatggggcggagcaaaagcgataaggaggcaaaaaagatgttcagttgatgagttgtttacggagcatattgaatag

SEQ ID NO: 4281 - DNA, 147 bp, Xenorhabdus bovienii
  Coding sequence Name=Xb4151_4152.C442.gene68.dna; Position on contig =58091..58237bp; Strand=+
atgttgattctgctatatgtagtgacctacaatcgaaaactgttgttgattgtaggccactacagatataggcttgttttagttcacctaggtgtaagtggtgatgtagaatgctacatactttattttttgaggtttataacatga

SEQ ID NO: 4282 - DNA, 252 bp, Xenorhabdus bovienii
  Coding sequence Name=Xb4151_4152.C442.gene69.dna; Position on contig =58201..58452bp; Strand=+
atgctacatactttattttttgaggtttataacatgacattgaaatatcaattagctgacttacagaaaaaagccaaagaaagaactgtaaaaacccagaacatagagtatgacttagagacattagtaaaaaaaatagaccgtaaaacaataaagcttaatcctgattatcagcgcagacatcgctggacaacggaggcttcatctcggctaatagaaagcctaatacttaacataccggtcatgtattaa

SEQ ID NO: 4283 - DNA, 279 bp, Xenorhabdus bovienii; identical to SEQ ID NO: 890
  Coding sequence Name=Xb4151_4152.C442.gene70.dna; Position on contig =58632..58910bp; Strand=-

SEQ ID NO: 4284 - DNA, 291 bp, Xenorhabdus bovienii; identical to SEQ ID NO: 155
  Coding sequence Name=Xb4151_4152.C442.gene71.dna; Position on contig =58902..59192bp; Strand=+

SEQ ID NO: 4285 - DNA, 171 bp, Xenorhabdus bovienii
  Coding sequence Name=Xb4151_4152.C442.gene72.dna; Position on contig =59331..59501bp; Strand=-
atggatatgcaatcaagaaagtatggtagaacgtttcattatccgttctcaccaggcacgaccagtgatgatcgtattaatcatggctggtggcaagatgtacagaaaattaagcacctcattcatacgattacaaattttttcatcattgggaaatcttccataggttga

SEQ ID NO: 4286 - DNA, 138 bp, Xenorhabdus bovienii
  Coding sequence Name=Xb4151_4152.C442.gene73.dna; Position on contig =59640..59777bp; Strand=+
atgtggaatattaatactgttattgttttaatgatttattttttagaaaaattaattctgtatggtaacaaaaaccccctgcctaatactacaacaagggattatagttatatattcaatatatattcaagggaataa

SEQ ID NO: 4287 - DNA, 1146 bp, Xenorhabdus bovienii
  Coding sequence Name=Xb4151_4152.C442.gene74.dna; Position on contig =59784..60929bp; Strand=-
atggaagcctttaaaaaagatccccgtgcagaaaaaatcaacctgagcatcggcctgtattacgatgaacagggtataacaccccaattgcaggctgttgcaaccgcagaagaacaaatgagtgctttgccgcagtctgcttctctttatctcccgatggaaggattgcttgcctatcgatcggcaattcaggaattgttgtttggcaaagatcatcctttattagggcagaagcgcattgcaacgatccaaaccgttgggggctctggtgcgttaaaggtcggcgctgactttttacaccgttatttccctgattctgaagtgtggtgctgtgatccgacatgggaaaaccatgcatcgatttttgctggagcagggatcaacgtgaattattacccttattttgatgataaaactaaaggggtaaaattcgataaaatgttggcaacattcaaccaactgccggcaaaaagtattattttgatgcatccttgctgtcataatccaaccggttctgatttaaccaatgaccagtgggatcaagtggttcaggttgcaaaagagcgagagttgattccattccttgatattgcctatcagggatttgcggatggtgtagaagaagatgcttacgctatccgtgcgatggcgaatgcggaactgccatgtctggtctgtaattcattctcaaaaattttctccctgtatggtgagcgcgttggtggattgtcagtcgtttgtgatgatgcaaaagcaggtgaatgtgtcttagggcaattgaaagccagtgtgcgccgtatttattccagcccacctaattttggtgcgcaggtagttgccagggtattgagcgatcctgaattaaaagccctgtggttgaaagaagttgagcagatgcgtttgcgtattaaggaaatgcgaactgttttggttaatgctctgaaaagtgcgctgccagagaaaaattttgatcacttgttgaaacagcgtggtatgttcagttataccggattcagtcaggaacaggttgatcgcttgcgtgaagaatttggcgtctatctggtaatctctggtcgtatttgtatggcgggtgtgaatcaccaaaacgtacagaaaattgctgaggcgtttgcggcggttagttga

SEQ ID NO: 4288 - DNA, 255 bp, Xenorhabdus bovienii
  Coding sequence Name=Xb4151_4152.C442.gene75.dna; Position on contig =60813..61067bp; Strand=+
ttgttcttctgcggttgcaacagcctgcaattggggtgttataccctgttcatcgtaatacaggccgatgctcaggttgattttttctgcacggggatcttttttaaaggcttccatcaacgaaagaataggatcacctgcataagcatcaatattctggaacactgcgtatactccctgttactgggttatatataccctttatctgtccgattgcagctttgtcggctgcaacgagaaatctattgggtataa

SEQ ID NO: 4289 - DNA, 1080 bp, Xenorhabdus bovienii
  Coding sequence Name=Xb4151_4152.C442.gene76.dna; Position on contig =61100..62179bp; Strand=-
atgaaagcggcaactgctgttattgaccgccgcgctctgcgacacaatctgcaacaggtcagagtaaaagctcctgacagcaaactggttgcagtggtgaaagcaaacgcctatggacatggttttttagaagtagcgtacacaatggaagatgctgatagtttcggtgtcgctcgcattggagaagcactggccctgcgtaatggtgggatcgtcaagcctatcctattactggaaggtttttttgaagcggcagatttgcccgttctggtcgtcaaccatatagaaaccgtagtccacagcattgaacagctagaagcactggaacaggcgaacttatcccatcccattaaagtgtggatgaaactggatacgggaatgcaccgtctgggcgttcgtattgatgaagcggaagaattttatcaacgcttgagttgctgccataacgttgagcagccggttaatatcgtcagccattttagccgtgcagatgagctgacggtggatacaaccccccagcaaattgatcgctttatggcatttatcgcagataaatcgggtgaaaaatccatcgctgcatcgggtggcattttattgtggccacaggcacatctggattgggttcgtccgggtattatgatgtacggtgcatcgccgatagcagataaaactgctgctgacttcaacttgatccctgcgatgacattgaaatccagcttaattgccgtgcgtaaacataagtcagacgaatcggttggttacggtggcacttggatcagtgaacgagatacaactcttggtgttgtggcagtgggatatggtgatggttatccgcgtagtgcgccatcgggtacgcctgtattgattaatgggcgcaaggttcctttggttggtcgggtctcaatggatatgattaccgtcgatttggggccagaatgttatgacaaagtcggggatgaagttaccctttgggggaatatcctgcctgttgaaaaaattgcggaacacaccggtatcagtgcttatgaactgatcacaaaattgacttcacgtgttgtgatggaatatctagacgaataa

SEQ ID NO: 4290 - DNA, 1410 bp, Xenorhabdus bovienii
  Coding sequence Name=Xb4151_4152.C442.gene77.dna; Position on contig =62229..63638bp; Strand=-
atggctggaaaaaaaccaactaacaacagtatggctggaccaaaagatcgccaagtggaagggctgaagcttccaccacactctttggaagcagagcaatccgtgttgggcggtttgatgctggataatgaacgctgggacaatgtttccgagcgagtttccagcaatgattttttcagccgcccacatcggcgcatttttgctgaaatgcagcgtctgctcgaaaggggtcaacctatcgacttgatcaccttatcggaatcgcttgagcagaatggggaacttgatagcgttggcgggttcgcctatttggcagagttatcaaaaaataccccaagtgcagcgaacattaacgcttatgctgatatcgttcgggaacgcgctgttgtccgagatatgattgcggttgcccatgaaattgcggatgcgggttatgatccacaaggacgaaccagtgaagatttattagatctggctgaatcacgggtattccagatcgcagaaaatcgggcaaacaaagatgaaggcccgaaaggcattgaacagatccttgaagaaaccgtcgaacgcattgaacaactctatcagcgtccacatgatggagtaacgggggtctctacgggatatcaagatcttgataaaaaaactgccgggttacagaaatctgacctgattatcgtcgctgcgcgtccttcaatggggaaaacaactttcgccatgaacttgtgcgaaaacgcggcgatgatgcaggataaaccggtacttattttcagtcttgagatgcccggcaaccagattatgatgcgtatgctggcatcgctttctcgtgtggatcaaacacgtattcgtacgggtcagcttgacgatgaagattgggcacgtatttccagcactatggggatcttgctggaaaaacgtaatatgtatattgatgactcatcgggtttaacccctaccgaagtacgttcccgtgcccgacgggttttccgcgaacatggcggactcagcttgattatgatcgactacctgcaattgatgcgggttccttccctatctgacaaccgtacactggaaattgcggaaatatcccgctccctgaaagccttggcaaaagagcttcaagtgccagttgtggcactctctcagcttaaccgcggcttggagcaacgtgctgataaacgtccggttaactcagacctgcgtgaatccggctctatcgagcaggatgccgacttgatcatgtttatctatcgtgacgaggtttatcacgataacagcgaactgaaaggtgtggcagagatcatccttggtaagcagcgtaacggccctattggtaggataaggctgacgtttaacggccaatggtcacggttcgataattacgtaggaccaagctatagcgacgaataa

SEQ ID NO: 4291 - DNA, 486 bp, Xenorhabdus bovienii
  Coding sequence Name=Xb4151_4152.C442.gene78.dna; Position on contig =63901..64386bp; Strand=-
atgaaaacactgctcgaattacgccagcaaaaagcaacctttaccgaacaaatgcgttcgttgctcaccaaagccgaagacgaaaagcactcattgactgccgatgaagccaaacagttcgacgaactgcgccactatattctgaccggagaaacccgcaccttgtctacgggcgttccctcagagggcggctataccgttatccctgaactgaataagcagatcatgcagcaactggctgatgagtcggtcatgcgccggatttgtacggtgaaaaccacccgcagcaatgaatataaacagcttgtttcggtcggtggcgcagccgtggtacacggggaagaaggcaagtcacgcagtgaaactgctacatcgaaaatggaagaagtcagcatcaaactatttcctatttatgcctatcccaaaaccacccaagaaattatcgattttagcgatgtggatagcgtactgaccatgttttattga

SEQ ID NO: 4292 - DNA, 396 bp, Xenorhabdus bovienii
  Coding sequence Name=Xb4151_4152.C442.gene79.dna; Position on contig =64622..65017bp; Strand=-
atgaatagtaaatactttcaattattaggtgttctaatattattattgttagtaatatttacggttatttttgttattggcgatgctgtttcattaatattaatgaaagatgaaataacattttctggcactgttgttattggtgtcatgtcttcacctctattattttacgcgttattatgctctatttttttctttatttttaataggcaacctaaatttaataaagtgattattaactttatggtttggctggcaattttatcatttatcatcagcttacctgtctctttttatgttaactataagttaaaaagtgatggttatctgacatgtgataaaatttcatggatgtcacctacgacttatgttaaagacattaagttatgtaagtga

SEQ ID NO: 4293 - DNA, 966 bp, Xenorhabdus bovienii
  Coding sequence Name=Xb4151_4152.C442.gene80.dna; Position on contig =65014..65979bp; Strand=-
atgacacataagaaatataaccccacttgggatggttatatgggggatgttttaaggggtaatgtaggaattaatcagctaaaaccccagcatgaattttttgatgctattgggctagaaaaagtattgagagataatacccaatatcactttgttctcacattatcagaagctcaaagcattattgaggatatcagctcccgccgtccacaaagtccaagttatggatatgcatttgcaagaggtatgaacgaaaaacatctaagttatgaagaagcattttcaagaggtacggactccggcaacaagataaaaaatcctatggcacatatattttctgtcactgatcctatttccacttatgcgggaaatatctatgatacgcatgggttttctgaagtttgcagagagtttaagagcttgggcattaaagctacagaacatgtaggaaaaaatggggaaaagtatattcacatatcagggcatgcaggtcttaggagtcgtatcatggggacacgctatcgtgccaaaaatccccaaatgcttggaatgggaatagggcagcaggggcttaatgctagtatcatcaaaggtgttagattctgtattgtcttttcgattggctatagattgatagaaagtattttcaaggatgaatatactttagccgattttatcggaaacataacaatggatatggctaaaaccgctattattgctgcttcctcctgggttataggatcacttttaactgccactgcatttttaggtggaagtattattgctgttgctctgatagttttagctgttggagttctagcggcttatattttagatactcttgataagaaatatgggataagtgaaaaattaatagcacttttgaaagaagaaatgaaaagaaaaccaagaacaccggaagcggatttacagcatttttttaatggattaggaaggtttagatga

SEQ ID NO: 4294 - DNA, 219 bp, Xenorhabdus bovienii
  Coding sequence Name=Xb4151_4152.C442.gene81.dna; Position on contig =66195..66413bp; Strand=+
atgcactacttggaggtgtcagagcgggagattaatcttgtggcaaaccgattaaataatcgtcctcgtaaaatacgagattacaaaacaccgaatgagttatttaaaggaataccctctcatttacttcgtccattacggtgttgcgcttactatgtgaatctaagcaagttatttattatttgtcgcgataatttcaccgagaaactcatgagatag

SEQ ID NO: 4295 - DNA, 984 bp, Xenorhabdus bovienii; identical to SEQ ID NO: 157
  Coding sequence Name=Xb4151_4152.C442.gene82.dna; Position on contig =66566..67549bp; Strand=-

SEQ ID NO: 4296 - DNA, 234 bp, Xenorhabdus bovienii
  Coding sequence Name=Xb4151_4152.C442.gene83.dna; Position on contig =67868..68101bp; Strand=+
atgggatttttcgcgttggtgaaccctatcggaattttacctgtttttattagtatgacgaattatcagacaccagcgggatgtaataaaacaaaccttatcgcaaatttatctgttgccattattttgtgtatttcattactgataggtgattctatcctgcatatgtttggcatttctatcgattcatttcgtatcgcaggtggggtgttccattggcattgcctattatga

SEQ ID NO: 4297 - DNA, 309 bp, Xenorhabdus bovienii
  Coding sequence Name=Xb4151_4152.C442.gene84.dna; Position on contig =68098..68406bp; Strand=+
atgacagggtcgggagctatcagtgcctgtattgtatggagtgcacgttatcaaggatggcaaaattatttaggacttgcattaacctgtctgttatttactttttgttgctggttattatttcattcagcgatcttactggtcaagttttttgggcaaacaggtattaatgtgattatccacattatggggctactgttaatgtcgctgggaattgaatttattgttacaggaacaaaagctgtgttttctggattactgggatattgcacaggtaatgataacgctggtactgatttggaaagttaa

SEQ ID NO: 4298 - DNA, 123 bp, Xenorhabdus bovienii
  Coding sequence Name=Xb4151_4152.C442.gene85.dna; Position on contig =68494..68616bp; Strand=+
atggtgtcgtttctgtatcatttttttaaaacaattagttatattttattcctttcttatcggctattgctgcaaagccatactgtaattttccacactattttctttccattattccactaa

SEQ ID NO: 4299 - DNA, 1644 bp, Xenorhabdus bovienii
  Coding sequence Name=Xb4151_4152.C442.gene86.dna; Position on contig =68974..70617bp; Strand=+
atgaggaaaacaccatcaaagttgagtcagttaatatcgactattgctttattatcgtttcctgtagcgcagggaatggctgcaattgttcctacaggagtggcattggctgaaaagcaggaagtgaccgttaataatggcgttgaagtcgcttcacttgatcctcataaggtcgagggtgcacctgagacggcaattattcgcaatctactggaaggattggttacgacagggcctgatggtgagactgtacccggggtggcagaaaaatgggaaaatgaagattataaggtctggacgttttatttacgtgacaatgccaagtggagtgatggtaagccagtaacggcccatgattttgtctatagctggcgtcgccttgctgatcctaaagtggggtcaccttataccagttatctgcaatatacttatgtccagaatgctgaggatatcttaaaagggaaaaaatcgcctgatcaattgggcgtcaaagcgctggacaatcaccgttttcaagtgactctcagccatccggttccctatctggtagacatgttgagccacacagcaatgaaacctgtcaggcaagatgtggttgaggcattcgataaaaaatggacgttaccagaaaattatattggcaatggggcttatgtactgaaagattgggttgtcaacgaacgtatcgtcttaacacgcaacccacaatattggaataataaagaaaccatcattgaaaaaggcaccttcctgcctatcgtctcagaagtcagtgatattaaccgttaccgcagtggtgaaatagacattaccaatggtgctattaccccctatctgtaccaaaagatgaagagggatattccagaccaactacacgtttcacctttcctgtgcacgttttactatgaaattaataacaaaaatccactgtttaaagataaacgggtgcgtgaagcgattaaattgagccttaatagaaatattatcgctgaaaagattatggggcaggggcagattccggcttatggcttcactcctacttacattggtgatcgtggctttactaccaacccagaatgggcaaactggacgcaggaacaacgtaaccaacgggcaaaggatctattgaaagaagccggttttgatgtccgtaatcctctcaaattcactttgttgtacaacacctcagatcaaaacaaacaacaagctattgctgcagcatcaatgtggcagaagaacattggtgcacaagtgatgttgcagaatcaagaatggaaaacctcactggagagccgccatcaaggaaattatgatgtggcaagggcaacatggtgcggtgattataacgaaccttcttccttcctgaatactttgttgtccgatagcagtaacaatacaggcttctatcaaagcgctgcctttgataactatcttggtcaggctctggccgcgaaagatgaagcagcacgtaaggtattctaccagcaggccgaagctcagcttgataaagactcagggctgatacccgtttattaccgtgtcagtgtgcgtctgattcgcccgacggtggtgggactgacagggaaagatccccttgattatatcgatcttaagaatctctatattagaaaagcgaataattga

SEQ ID NO: 4300 - DNA, 1638 bp, Xenorhabdus bovienii
  Coding sequence Name=Xb4151_4152.C442.gene87.dna; Position on contig =70742..72379bp; Strand=+
atgatgaacacaacaaagaaaaggttagctgctggcattacggtagcgttaggtatgatgacgggttggcaggcatttgccgcacaagttcctgcgggggtgcagttggctgaaaaacaagtcttggtgcgtaataatggctctgagccgcaatctttagatcctcataaaattgaaggggtaccagaatccaatattgctcgtgatttatttgaaggaattgtgattaatggcccgaatggcgaaattttacccggcgtagcgactcattgggaaaatcaggatttcaaggtttggacatttcatctgcgtaaagatgcgaagtggtcgaatggtgacccggttactgcgcaggattttgtttacagttggcgccgactggctgatccaaatacagcatcgccttacgcaagttatctccaatatgctcatattcttaatgttgatgatgtcatcaagggaaaacaaaagccggagtcactgggtgttaaggcgttggatgaccatacctttcaggtaacactcagcgaacccgttccctatctggtcagactattgattcattcgacaatgtcaccagtgcaccgtgcaacagttgaaaaatatggagacagatggactcagccgaaaaatttcgtaggtaatggtgcttataaactgaaaagctggaacatcaatgaacgccttgttttcgagcgtagcccgacatattgggataacaaaaatactatcattgaccaagttaccttcctgcctatttcgtctgaagtgactgatgtcaaccgttatcgcagcggtgaaattgacataacttatagcaatctaccgatcgagctattccaaaaactaaaaaaagaaattcccgatcaactacgtgttaatccttatttgtgtacttacttttatgaaattaacaaccagaagccacccttcaatgatcctcgcgtccgtaccgcattaaaattgggtatggatcgcgatttgattactaataaggttaagaatcaaggtgacacgccggcttacggttgggtgccgccttacattgccaattttaaagatgaaaaaccagattggtacactaaattaaaccagcagcaacgtaatgaagaagccaaaaaactcttggcagaggcgggatttagcaaagaaaacccgctgaaaatcagtttgttgtataacacttctgatctgcataaaaaaatggcgattgcggccgctgccatctggaagaaaaatatcggtgctgaggtttctttagagaatcaggaatggaaaactttccttgatacccgccatcaaggcaattatgacatcgctcgtgcaggctggtgtgctgattataacgaacccactactttcctgaatgttaaattatcttatagcagcaacaatacagctcattacaagagtgaagcatttgatgctttgatgaaagaagcactaaaagtgaagagcgatgcagaacgagcagaaatctacaaacaagcgaatgctctgatagataaagattccgccgttgttccgctttattattatgtaagtacccgtttagtgaaaccttatgtggggggttataccggtaaagacccattggataacatccataccaaggatttttacattataaaacactag

SEQ ID NO: 4301 - DNA, 921 bp, Xenorhabdus bovienii
  Coding sequence Name=Xb4151_4152.C442.gene88.dna; Position on contig =72462..73382bp; Strand=+
atgtttaaatttattttacgccgctgtttagaggcgatcccgacacttttaattctaattactatttcatttttcatgatgcggttggcaccaggcagtccatttacgggtgaacgaaaattaccgccagaagtgatggcaaatatcgaagcgaaatatcatctgaatgatcctatctataaacaatacttcaattacttagtccagctttcaaaaggggattttggcccatcattcaaatataaagattacagtgttaacgatttggtggccgaagcattgccggtttctgccaaactgggatttgctgcttttattatggctgttgtattgggcgtcagtgcaggcactatcgcagcactgaatcagaatactaaatgggattacacggtgatgggttttgccatgaccggagtggtgatccccagcttcgtggtcgctcccttattggtgctgatttttgccattatattgaaatggctgccggggggaggctggaatggtggtgcaccgaagtacatgatcctgccgatggtggctttgtctcttgcctatattgccagcatttcccgtatcacccgtggttccatgatagaaatactgcattcaaattttattcgtacggcacgagccaaggggctgccattgcgagcgattatcttccgccatgcactgaaacccgccttattgccggtcatttcttatatggggcctgcatttgtgggcatcattacgggttcaatggtcatcgaaactatctttggcttaccgggactgggtcagttgttcgtgaatggcgccttaaaccgtgattactcactggtattgagcctgacgattctggtagggggattgacgattctgttcaatgccattgttgacgtgctgtatgccgtcattgatccgaaaattcgttactga

SEQ ID NO: 4302 - DNA, 909 bp, Xenorhabdus bovienii
  Coding sequence Name=Xb4151_4152.C442.gene89.dna; Position on contig =73397..74305bp; Strand=+
atgttactaaataaacgaaatagcgaagctctggaaaatttttctgagcaactggaagttgaaggccgcagtttgtggcaggatgcacgacgccgtttcattcacaacaaagcagcgattacgagtttgtgtgtgctgcttcttatcacactatttgtgatttttgcgccagtgttgtctcaatttacctacgacgatacggattggaatatgatgacgatgccacctgattccgaatctagccactattttggcaccgactcatcagggcgtgatttgctggttcgtgtcgctatcggcgggcgtatttcattgatggtcggtattgccgctgcttttattgctgtgatattcggcacactgtatggagcgatgtcaggttatcttggcggtaaagccgatatgatcatgatgcgcttgctggaaatattaaactccttcccattcatgttctttgtgatcctgctggtgactttcttcgggcaaaacatcctgttgattttcgtggcaataggcatggtgtcatggttagacatggcgcgtatcgtccgtggtcaaacattaagcctcaagcgtaaggaatttattgaagccgcactagttggcggtgtatctacccgtcatatcgttttgcgccatatcgtaccgaatgtattgggagttgtggtggtttatgcctcattgctggtgccaagtatgatcctgtttgaatccttcctgagcttccttgggttgggaacgcaggagccgctcagtagctggggggccttattaagtgatggtgccaattcaatggaagtcgccccgtggttgttgttgtttccggctggttttctggtactgaccctgttttgtttcaactttattggtgacggcctgcgagatgccctcgacccgaaagaccgttaa

SEQ ID NO: 4303 - DNA, 1008 bp, Xenorhabdus bovienii
  Coding sequence Name=Xb4151_4152.C442.gene90.dna; Position on contig =74315..75322bp; Strand=+
atgaatagcgtagaagctgcaaaaaatgctaaaagtgctgtgccactattaacggtgaaagatctgaatgtcgcgttcagcacacccgatggcagtgtgatagccgtaaataaactgaactttgatttaaacgcgggagaaacgctgggcatagtgggagaatccggctccggtaaatcacagactgcttttgccctgatgggattattagccagtaatggtgttgtgagtggttctgctgcttttaatggaagagaaatactcaacctgaaagaaaaagatctgaaccgaatgcgggcggaagagatctcaatgatatttcaagatccaatgacttcccttaatccttatatgcgagtgggtgaacagctaactgaagtcttgatgttgcataagcgtatcagtaaaagtgaagctgtcgaagaatccattcgtatgctggatgctgtcaaaatgccagaagcgcgtaagcggatgaaaatgtacccgcatgaattctccggtggtatgcgtcaacgtgtcatgattgcaatggcattattatgccagcccaagctgttgattgcggatgaaccgacaacagcactggatgtcactgttcaggctcagatcatgacactgctcaacgagctgaaaaatgaatttaatacggccattatcctgattacccatgacctgggtgtcgttgcaggtatctgtgacaaagtactggttatgtatgcgggcagaaccatggaatatggttctgcgcgtgatatattttatcacccgacccatccatactcgattgggttacttgatgcggttcctcgactggatgacgatgaggaatcattgacgactattcagggcaacccacctaacttactgagactgccaaaagggtgcccattccagccgcgttgtcaatttgccactgagcgttgtgccaacgaagagccacagttggaacattttgatcttgggcgcttgcgtgcctgctttaaacctcagggggaattggtatga

SEQ ID NO: 4304 - DNA, 1002 bp, Xenorhabdus bovienii
  Coding sequence Name=Xb4151_4152.C442.gene91.dna; Position on contig =75319..76320bp; Strand=+
atgaacgcagcagctgaaaaacgagtcctgttggaagtcgatgacctaaaagtttattttgacattaaagacggaaaacaatggttctggcaaccagcaaaaactctgaaggcagtcgatggcgttacactgagattgtacgaaggagaaacgctgggcgtagtgggtgaatcaggctgcggtaaatcgacgtttgccagagcggttatcgggctggttaaagcctctggcggtacggtaacgtggcttggacaaaacctgctggatatgagtgacaatcagtggcggaatattcgtaacgatattcagatgatttttcaagaccctctggcttcccttaatccgcgtatgacgattggtgacattattgccgaaccgctcagaacctatcaccccaaaatgaaatctggggaaataaaagaaaaagtcaaaaatatgatgatgcgggtagggttgttgcctaacctgattaaccgctatccccatgagttctcaggggggcaatgccagcgtattgggattgcccgtgcgctgattctagagcctaaactggttatctgtgatgagccggtttctgcgctggatgtttccattcaggcacaggttatcaatctattgcaggaattacagcgggaaatggggctttccctgatatttattgctcacgatctgtcaatagtgaaacatatttcagaccgcgtattagtgatgtatttggggaatgcagtggagttgggtacttatgatgaggtttatcataatccgttacatccttatacccgcgccttaatgtcagctgttcccattcctgatccagacaaagagcgaaacaaacgcatcgaattgctggagggagagctgccttcgccgattgatccaccatccggttgtgtatttcgaacccgttgcccaatggctgatgcagaatgtgccaaaacacgtccattgcttgaaggcagcttcaaacatgccgtgtcttgtcttaaggttgatccgctatag

SEQ ID NO: 4305 - DNA, 177 bp, Xenorhabdus bovienii
  Coding sequence Name=Xb4151_4152.C442.gene92.dna; Position on contig =76238..76414bp; Strand=+
atgcagaatgtgccaaaacacgtccattgcttgaaggcagcttcaaacatgccgtgtcttgtcttaaggttgatccgctatagttttaagtgtctgtttagtgtgacactgtcactaatctatattctaagccctcgttgtggagggcttatttataggcaaggacagttgaggtga

SEQ ID NO: 4306 - DNA, 354 bp, Xenorhabdus bovienii
  Coding sequence Name=Xb4151_4152.C442.gene93.dna; Position on contig =76416..76769bp; Strand=-
atggaaaataaaccaacacattctctccaattagatttcaataatcggatgactgaggatgaaacgcttgaaaaagcctacgatatctttctggaacaagcgatcgccaatctcgatccggcagatagtctattgtttaatttacagtttgaagaacgaggtggcgctgaattattagctccctcagcgatatggcttgaacatgttgattttgatttacatcctgatttttttgcagaagttattattggcttagcagcatctgacgatgctgaaattgatgatatctttgcacgagtgttaatctgtcgggaaaaatctcacccaatcagccagatcttatggaagaaataa

SEQ ID NO: 4307 - DNA, 1461 bp, Xenorhabdus bovienii
  Coding sequence Name=Xb4151_4152.C442.gene94.dna; Position on contig =76922..78382bp; Strand=-
atgacaaccttttattcagtactgaactggctggctattttcttatactggttgattattgccggtatcacaattcgtgttttaatgaaacgtcggcctgtaacatcagcaatgacttgggtacttatcatttatatccttcctttggttggaattgtcgcttatctgtcatttggcgaattgtatctaggcaaacgcagagtcgaacaagccaaacaaatgcgttcatctgtcactaaatggctctctgagttaaaaaaatccccccatatttttgcccatgaaaatagtgaagtagctgaaccgctattccaattatgcgaacggcgccagaggatcaaaggggtcaggggcaataaaatgcaactgatgacttcttatgataattctctgaaatccatcgttaatgatattgaaaaagccaaccataatatcgaaatggtattctatatatggcaggcaggcgggttagttgatcaagttactgatgccttgatgtgtgctgctaaacgcggtgtcaaatgtcgtatcatggtggattccgcaggaagctggcaatttttccgtagtccatatcctgacatcatgcgcaaagcaggtattgaatttgtcgaatcactaaaggttaatattttccgtctgttcttgcgtcgcatggatttacgtcaacatagaaaaattattcttatcgataatcatatttcatatactggcagcatgaatatggttgacccgcgctttttcaaacaagatgcaggattcggccaatgggtcgatatcatggtaagaatggaaggcccggtcacaacgactctggggattatctatgctttcgactgggaaatggaaacaggtcagcgccaccttccgtcaccgcctgacagccctattatgcctttcgagcaagccagtggacatacagctcaggttatcgcttctgggccagggtttcctgatgagttgatccagcagtccttaatgacagctattttttcagccagagagcagcttattcttaccacaccttactttgtacccagtgatgatttaatgcacgcaatttgtaccgctgccatgcgcggcgttgatgtcagtattattcttccaagccagaacaattcatttctcgttcgctgggcaagccgggcattttttacggaattgctagaagctggcgtaaaaatttatcagtttgaagatggtctgttacatactaaaagtgttttagtggatggacaactcagcatggtaggctctgttaatctggatatgcgtagcctgtggctaaattttgaaatcacggttgtgattgatgataagcacttcggcaatgatttaacattcgtccagcagggctatattgcacgctcgactttgcttgataatgaggaatgggcgaaacgcccactctggcaccgtattcttgaacgtatctgttattttttcagcccacttttgtaa

SEQ ID NO: 4308 - DNA, 195 bp, Xenorhabdus bovienii
  Coding sequence Name=Xb4151_4152.C442.gene95.dna; Position on contig =78439..78633bp; Strand=+
atggaaatcctaacaaaccatcagctaaatgtagtcaacttagcagagaataatcaaaacattaccaatatcatacctgatgtcgtctcacaggtattatgtaatttgattcagttaaatcatgaatcaattatatatctattaactaatgacttagattcaataccgcattgtgttaaaccttacattggttga

SEQ ID NO: 4309 - DNA, 198 bp, Xenorhabdus bovienii
  Coding sequence Name=Xb4151_4152.C442.gene96.dna; Position on contig =78699..78896bp; Strand=-
atgccacacattatagttagagaaattccctgctctgcacgaacagaatcgacctgcgacgcctgtcaccatcagtcttacgcaacgaatagatgtgtaaattacgacgtgattgcccctctaaccagcgacgacgacggcggatgttttggcgaagcattcgccatcgaccgacttcatttctgctatgtttcataa

SEQ ID NO: 4310 - DNA, 711 bp, Xenorhabdus bovienii
  Coding sequence Name=Xb4151_4152.C442.gene97.dna; Position on contig =78975..79685bp; Strand=+
atgctgctaatcaagaattctcttatgcgttggatacactggccggtattactttctgtttgtttacatgtttctattgctgcggcgctctttcatgctattgaacccgaaaaacagctagaagcgactcccatatctgttgctatgatccaactggcagcggaagaagcccctgtctcggagcctgccatgcctgaatcaattcctgaaccacccgaaccagagcctgaacccgaacctattgcgaagattgctctgcctaaacctgagaaaaaaccggaagagaaaaaggttgttaaaaaggagcctaagccgatggagagaaaaatggagaaaacatcggaacaacctgtcaaaccagtttctgatgactctcaaatggcgaataaccggaataatcagttaaaaccaacccatccagctcttaatgacaaacctaaagtgcagaatgggccaaaagcattaagcagatcagtgcctgtttatccatcccgagcgtggcaattgggtacagagggaatggttaaggtaaaatatgatattgacgaagatggtagggttaaaaatattgaaattattgctgccgatcctaaaaacgtctttgagcgggaagtgaagcaggcgatgagaaaatggcgttatgaaaaagcgcctgcaacggggtatgtgacaaccattgaatttaagcttactggtatttcacagtcttaa

SEQ ID NO: 4311 - DNA, 435 bp, Xenorhabdus bovienii
  Coding sequence Name=Xb4151_4152.C442.gene98.dna; Position on contig =79908..80342bp; Strand=-
atgacacaacaacaatgcttaccaaacggagaattggtcctccgtacactggccatgcccgctgataccaatgccaatggggatattttcggtggctggctgatgtctcaaatggatattggcggcgcaattctggcaaaagagattgcagaggggcgcgtagtaactgttagcgtagatggtatcagttttctaaaaccagttgcggtaggtgacgtcgtctgctgttatgcccgttgtctaaaaacgggaaactcatctatcacaattcatattgaagtttgggtgaaaaaagtagcatccgatccggttgggcagcgttatcgtgcaacagatgcggttttcacgtatgtcgctgttaatgaagataatacttcccgccgtttacccgaaggaaaaactcagttcaaactggaaagcagtgattcgaagtaa

SEQ ID NO: 4312 - DNA, 135 bp, Xenorhabdus bovienii
  Coding sequence Name=Xb4151_4152.C442.gene99.dna; Position on contig =80336..80470bp; Strand=+
gtgtcattagaaaacttgctttatttggtgaatacaacaatacctgccgatgtttcggcaggtatccatatgaaggtcattatttttgttcgcgaggcagatgacggtagatatataccacactcaacacagtaa

SEQ ID NO: 4313 - DNA, 570 bp, Xenorhabdus bovienii
  Coding sequence Name=Xb4151_4152.C442.gene100.dna; Position on contig= 80415..80984bp; Strand=-
atgccaccatcggcactacagtggattcaatttatgaaacaacttttagattttttgccattagtcgtttttttcatcgcctacaaaatgtatgacattttttatgcgtcaggggcattgatcgcagcaacgggattggctgttgtcatcacctatctgatttaccgcaaagttgagaaatcatctttgatcacctttattgtggttgctattttcggcacactgacactagcttttcacagtgatttattcattaaatggaaagtgacggtaatttatactatttttgccttagcactgcttatcagccaatggttcatgaaaaaaacattgattcagaggatgctgggtaaggaactggaattgccgggctttatctggaaaaaattgaacatagcttgggctattttctttattgcctgtgcactggcaaatatttatgtcgctttctggctacctcaagatgtttgggtaaactttaaagtgttcggtttaaccgcattgacgctggtttttactgtgttgagtgtggtatatatctaccgtcatctgcctcgcgaacaaaaataa

SEQ ID NO: 4314 - DNA, 1713 bp, Xenorhabdus bovienii
  Coding sequence Name=Xb4151_4152.C442.gene101.dna; Position on contig= 81177..82889bp; Strand=+
atgttgtggaaaagattatatcgctggatgccggggttggagaatttttgttattaccgtaaagagtattttagtcatgatatacggtcaggtctttcggttgctgcggttgcgttacccgtggcaattgcttatgcggagttaatgggaataagcgccatcattggtctatatgcctgtatcttaccgatgtttgcttattctttatttggcacttcccgtcagttgattgtcgggcctgatgccgcaacatgcgctgtgattgccgccgctgttgcaccattggccttgggtaatgaacatgttcgctggcagcttgctattatcatgacactgatgaccggattctggtgtattttagcgagccattttcgattgggtgcatttgccgattttctgtcacgtcctattttaaaaggttttatcaatggagtggcgattaccatcatggctgatcagcttgctaaagtcttcggactttcgggtttacctccggaattaattgagcggttaattgcgcttccgcataaattattagaatctcactggccaacagtaggtatttcagtgatgactttactggtattgttaagtgtgcgttttctgcattcaggttggccagctccactgatagcgatgatcgtttcaacctatgtgagctggcaatttgaactgaatcaatatggtatccagatcgttggcaatatggagagcggtctgcccatcgtcccaatgcctgaatttcaacttggtgttatgcgtgatttggttgttccctccattaaccttgcggttatcagctttgtcagctttatgatgacggctcgtagctttgccagtaaaaatggttatcaggttgatgcggatttggaactgcgggcattgggcattgctaatattgcctcatcattatcactggggtttgctgtcagtgctgccagtagccgtactgcggttaatgataccattggtggtaaaacacaaatggtgtcggtcattgctgctactaccatattattggtactgctgtttatgaccgaatttctggggtatatccctttatcatcactgggtattgttctgatcttttctacatggtccttgttggggttaaaaaatatctggtcatatcgaaaacgtaaccgccgggcttttacgctatctattttcacattggtagccgttttgctggttggtgtgattgatggtattggctttgcggtattacttggtctattacaatttctgcgcatcattttccgtccctccgatcaactattgggtgtcaatgagcaggggatgatccactccatcaatcaaggtaatgatatagcatcggtggatggcatcatgatgtaccgctttaattcgcctttaacttacttcaatgttgggtatttcaaaaaacgggtattacagcatgtagagagagcatcgagacatcctacatggctggtggtagatgcagcggttagttttactcatgatgacgtaagcgtttttgctgtgttggatgagctgattacggaattgaaagaaaaaaatgtgactttagtactggcgggacgcagaacagaattaaattactggatcaagcagaacaggcttagtcgtagtgatgaagatttgattgtcgtacctgatctctattttgccattcgtttgattcaaagtaagcagcaagtagaagaaaaaaaagaagaatatgcttag

SEQ ID NO: 4315 - DNA, 7644 bp, Xenorhabdus bovienii
  Coding sequence Name=Xb4151_4152.C442.gene102.dna; Position on contig= 83874..91517bp; Strand=+
atgcaaagagcttcgctcaaaaacaggcaaaggattactgtaatggtttatatgtccaaagacttcaaaaaattgctcaatactctgatcgatcgacagatagaggtggcgggtcgtcagaccgaatggttcaacatgagtgccgacgcgcgtgccgactatatcaggcaggtaaacgaacggctgcaagaaatgcagcagagtaccctgagtgtgctggctgctcagcattttcagatgcaggacaaccctgtttctgtcggtgaccagttgcagacgctacagcaaaaacggcagcagatggacggtaaatctgacacgccggcgatcaaggcctacaagcagcaactggatcgcgacatccggttatacagccgccagcaggcggccataacgcactttaacagctctaggaaaaaggccttggatatgctcaatcccagcggttccaagaccttgaatgcgatgactctgagggaggatgcggcggtcaagcaggctaatctggataccgagatcaagcatctggaacagcaactgactatacaggtgactgactccacgttcagcccaaaatacgtgaggctgttttccaggctacaggcctacaaggatgtcaaaacccgctacactgccttgctcgagacaccctctaaggatgaaacaaaagaagctaaggctttcagcaagctgatcgaaatgcctctggcctctgatgatttgccggtaaatatttcactgttaatgatggaggaacgtcctggctacatccgcatgaacgttgctttggttaatgccagccccgatggccgcttcaaggacttcttcctgaaggatggcaggctggtcgtgcctaaggacggggtatttaacttttcctttggtactccagcccgctctctggcctggcaacaacaataccggctcaaaagtgagccgccatcctttcgctctccgacctatacaccaattcgctcggtactggtcaaaatcgaattcgtcgagaagtacttcgctaattacctggtttcggaaagcactgagcgcgaaggcttcaaggagcattttctggataacgatcgcaagatactgttgatcagcgttgaccgcaaggtaccgaaccaaattgggattaaggtgtccggccacacccatgaggttccattggctggcaccttgagtgacctgatcaaccagaatgctgatatcaccagcttccagactatcggcttggaggattttcgccagaacagttatgacccggatcgtgatgggcttttcatcaatatccatgagctggaacgcacggtcggttttggcaatcgccagtacttgctggaaatgccacagggcaaaaccccgagcaaaaactacctgtccgcaacaccctttggggtaatgaacgttgacggcgacaaagtcagcagtagtcacttgagtaaggcacagaccgctgaattgtatcaatacaacgccgcatttttcgagaagctggatcgattgcgagacgatggtgcgaaggccagtcgtttgtttgaaggcagcagcgaacgcaaagtgttcgagcagcaactggtgcgtttgctcgaacgcaaccacatcacccccgcaggggtgttggagtcggaatacaccaatgacagagtgcgcgatatcaagggcaataacctgaacaaggtgttgtgggaacaggcgtttgccacgtcggtctgggaaaacaccaataatgacccgctattgttcaagctggcgaatagactgaataatttagtgttctcctccacagcagtggacaagatcctaaaaaatagctatgtgcaaagtgacatcgcccaagtcaagggattgctggcacagcagtacgaacaatggcgcattcgggccaccgaagaagaaacccagcggatcaaccgggctaatgcagaacagcatccaaacaacccgaaagtacaggttttcaatcagaccgaagttgaaagctcgctggacagaaagctactcgctttgttgttggtcggttccgagaactttggaagagccgatgagcaactgtatccggccgttaaggcagctttattgagcaatgagggcaggagtctgtgcaaacaggtcttgttccatgtcttgcgaccgatagccgatagcttttccaagccagcagtcccggtaaatcctcatgctgaactgatgtcggaaagaggggataacaaggtcataatcaataatcgactgaatcagccagacccgtatctgatcctcaatacccgccctgaggagcaggtatatcacgatggttcgtacctgattaaggacgacaaataccgcagctacaaccaattccgtccggatcccaagaataaggctacactctacatgaatgatctggataccccgttcgtaggcgggatttcagggaccacccagactgtcagcaatgtcttaccggaattgttcggtgacacattgagcgtcaaggagtactggaacttccagatggtcaatgcggctttcatgatccgtaacggatatcactcgttctttgaaaccttctacgtcgctgcacgttacgaaccggagggggcggacagtatcggcaaagatatgttacagatgttcgacgaataccgcgctgagggcagagagaaggcattgaagggtgaactgtatgacggagtgatggcacgaatcttgccgatcatcaatcagggcttgccagaggctaagaagttctattcaccgcgttttatgccgacattgctggatcaggaggaaggtcgctatcgtcatgagccagagggtattgctccgttcgatgaaaaacctgtcagtaactgggaaaagcctgtagttgaggctcaccatgagggtgaagtatcccgctttgatggtcagctgattattcagcttgaaaacgaccctgtagtcagggaagcggcagcaaaattagtgggaaaacaccttaattcggtgctggtgcagctggatgcccggggtcaatatcaggtggttcatggtgatctgactatcctgaaagataaagaaaaaatccgctggcaactggttggtcatagccgcgatagtggggataaacctaatcaccagacgctggccaaacgcactccggaagctctggcgtcacaactccgccagttctatacagactccggcgttcaaacgtcccctgaacatatcagtatggtaagttgttcactggctggtgaaaaccagcaggaaagctatgcgctaaagtttgctcgggcgcttgaccagcgtattcgtccactttctgttaaggcttataccacccaaattacggtcagccctgaaggccggaaacaactcatggaaaacggtaataaagccactcttgtttttaatccggaggatagtctatgggcgataaccgtaacgccaggtaaatcagttcctgcagagggtatggttaacccgccactgggaaacaaaacggctccggttccagacaatgtgcagattgacatccggctgctggagatgcttaaccgtgcagaagattttcagcaggccacggaacagctgtacagcaaaaacgcactgcccgcagaagaatggctaccagtactgggcagcctcagggagggtgaatcccggtattctttacagtttattaatatggcacggtctgagcttcctccccagacatttacgacggatgaccgacgtattattgattttattcattcttatgataaagatctcgaaactgtcagcaaaactcacgaatataccaaagggaaattaaccctgcgcacaggcatccccgaagcagaagctgttcacggactaaattccgcctttatggttaagactctgatcccttggtttgccgatagaaaacgcaccaccgtagccagtgaaaaggtgcccaatacgttagagaccgcactgcgggtgcacacttatgttaatctggcacagatggctcacggtatgctggaggacggcgctaaactcgccagtttgtacagggtggtggctagtgaaggccggggagtgaccagcagcctgttttcatcgctgtcccatgtcagcactggtgtcggggcggggttaaatatcttcagtgtggcactggacggcatagaactggcgcatgcacagaatgaatcccagaaggctgtttatggtacccagctggcgtttgacagtgctggtctggttacaactggcgtgggcatcggtgccgggatcttcggtgctcctattgttgctggttttgcctcctcgctggcggtaccactggctggtttgggtattggttttacggctctggccgaggcgttcggcagggtagccagtgatgcacaggcggtaggcaattattttgccgatctggaagcagcttatcagcagggtggatatcggcagacggaaaaagtggcagcagatggcagccgttatacggtgatggaaccgattcccggtgccgtgacccgtcagctcgatttgcgccacggtcatctgacttttgacagccagtatctttatcgcaacgacccgacttattcatggggttcgggtaagagtaattactttttctggtggcccggtagggcggctgatacggataaaaagcatgcaattaatatccgcgaaggcatcggtcacaaacaggcgcagatcaacttccatttccgtcctagaagcagcgacatattgatcctgccagttaccatgaagtcctatattaattatgaatatatgatcctgcccttcgtcactgcccgcaacgatcggggatttgacgttctgcgccgactggaagaagatggacgattcgactttgatttttatgcttttcccggagagcgcgtggtacgccgcataaagccggaatttgttgcgacgccgattgatatcattctggacgatgaagaccgggatattgtcattcagcagttgccggagaaggatcacgggatcctgtcctatcaattgaccggcgggaagggcaaataccgtatcagcttgcaggagggggtttctctgtccttacagggagacaccggtacccactggatactggatgcccgtcatatcggctctaatgttaacaccagtctcagcaaaaaagataacagacaactactgcatatcggcagtataaagataaccctgcctgaaaagacggataatatttctctgataaataatgcagggatattttctgtcaagcagaacaaagagaatcagtggcagataacagagagcgtaacgaatgctatgcagtttaacagcctgcaggcgttgcatgatcatctcaggcagttaagcaattctgaacatcacaacaggccatatttggtggtggaacactaccagtactcaccgcaaagccgtcctgtcggccgtgcattctatgagaccggtcgtgatcgtatgatttacaccaacgtccctgacgcagcagattttctcagctatgcagagctggcgaaagttgaaggtaataaggcgtggtgttaccgggataccacgctctggcaagtggatattgtcagtggcgaggttctgcggcagtatctgccgataaaatttccggggagtgatcaggggaaaatcagcagccatgtgatgcagagcaatgaccagctctggtttgtggtggaacagcagctggatgagggctgtatctcatatacttatcaggtggcagaggaagcactgaaactggtggcagttgacgggaatacggtcatgctggcgggcctggataaaatcagtgaaaaaaactttgtcgcgctgcctgtcccacttgattccagtgacggtgagtttaatggccttctggcaccactggcggcgaatcagtggttcaccggcgatctctgtgcgccggaacatcaggttaaaggcagcccggcggaggtgatcagcctttctgggcgagtagcgggtgtagatagacattactggttacagacggatggaaaacagctgcagaatgtggtcagaatgaaccggataaatccggatcaggaggatgcaggcatcctgactgagctgaaaaagaaaaattcggatttgctgaccctgacggctgatttcacccgcgttttcaccacgaccggtgataaaccgggttattatttttacagccatcagcgacatagtctttattttcagcaggataatggcctgtccggcactccggccagcaaagtggctgttgatgatatcagatccgtatccatagcgaacaagcagttggttgcactttccagcagggggatgctgtggctggcagatgatcagggcagtatccgtctgatcggggtgacggcagattggttgcaacaacctcaccagaagggtctgacagctgccctgaatcagttggcgcaggataatccagatcggttcagcaccctgctgttgctgggattgcaggatagcaacggaaaaccaatcagtgcttggtatgacagtacagcaggtcgggtggtgcagggcggagttggtctcattacagaacacactctgacctatcttggtttagcggaagatggcagtcaggcatggatttttgacactgataaccatcagttataccgtcagccactgtcggtggaggctgaccttaagttgggtgaaaagcaggtgctctctgagaaacctgttgcagcggagccttggcttcgggccagccatcaataccgcagtgcggttcgtcagggcaatacactccggctggaaaccccggacggcgcggtcttactgctgtcagttgatgccaagatgacagaccgcccggtgctgattgcctggcatgtgcaggatcgtgctgacagtcaaattgcctcagccattgctgcgctcaggaatgaggctgaattaccgcaagcagttagactgttttctgagcgtagttatcctgcttggtacctgccagaggaagggaaaatgcttcgttccggcatagttaattcggatcatgttctgcattacttgggtcaggtcgccgggcaggaggccagttatgtccatgaccggactaccggagaattgtggcaagtcagcgaagaacagtccacactagagggaaattactgttttgttaaccgaacaccggagagtctggtgttgcaggtggggcaggttcctctgggggaaaaaatccgtcttccgcaactggcgggcactgatcggctggccatcaccgggcgttcaaaagaattgtattactggctttcctcccccgaggcgctgacccactaccggcatatcacgatagatgatcggggtcagggttcagcgatccggttttctgatacctgcatagccaacctgtcactctggcgcagtgaccaaaatttagtgctgcttcatcaggcatcagaagacaccagtttattccttgtcaatattgaacaggcagcacagcgctatatgaggtttgaaagcaccggaacttcgccactgaagaagatgaagataattcacttactgagaaaaatggacaaactgacggtattaaaccccgatgtcagctgtttcgagctggtatcagaagaaggtgaactcagggtaaaaccggctgagtgtacagagaagttagagtcgttttcatctattccggagtattcagtacttatacccctgtag

SEQ ID NO: 4316 - DNA, 759 bp, Xenorhabdus bovienii
  Coding sequence Name=Xb4151_4152.C442.gene103.dna; Position on contig= 91772..92530bp; Strand=-
atgcccatcacggcaaatatcctgtatcgtgacagcttcaatttttttaagaatcagctgttgaatattttcatactctctatcttagccgcgttggtggcagtactgcttgaacatcttctgatgcctgatggtgaacagctcaaactactggttgagatacaaaacgcctttaaagagtcaggtaatacaggagttaaaaattttgtggcgcaattaacgccagaagaacaattcatgttcttacgcacagcattcggtattctattttccaacatattcggcagtacattgctgaccgccaatgtgttgttacttattaatgccatttctaacggacaccaaaccaatgcgctccacgccagcaaatcatcaataggctcgctgcctaaaatgtttttgctgatgtttatctgtaccttattgattcaattaggttacgcgttgatgttcatacccggcatactgctctctattgcatttgcatttgcccctgtttttctgcttgaaaaaggaaaaggtgttttctcatccatgcaggaaagctggaaattagcgtttgccaatctgcgcctgttagccccggccatactgctatggtttgcaataaagctaattatcgctcttggtttcgctagaatgcccgatatcgtactatcaatactaaataacctactatcttccatactactgatttacctattccgcttatatatgctgactaaatcgcaaaataaatctgcaaatggcatgcaataa

SEQ ID NO: 4317 - DNA, 156 bp, Xenorhabdus bovienii
  Coding sequence Name=Xb4151_4152.C442.gene104.dna; Position on contig= 92786..92941bp; Strand=-
atgaaggcaaaagcgttatctctctggaataaactgatgttgagaaagcgatttttgatagaaacggccggggatcagctcaaaaacatttctcagatagaacattcaaacaccgtagtcagttcggttttttattggaaattgtcgctggcttaa

SEQ ID NO: 4318 - DNA, 864 bp, Xenorhabdus bovienii
  Coding sequence Name=Xb4151_4152.C442.gene105.dna; Position on contig= 93113..93976bp; Strand=-
atgtggcaagcagtgaaccgtctattaagtgagcattttggtgacgctgacattcacaataaaacagaattagcgggaggggatattcaccgttcttggtgcgttgattacggcgaagaacatatttttataaaatccaacttgaaagaaatgttacctgtttttaaaacagaagcagagcaactggaattactggcccgcagcaaaactatccatgtccctcatgtttacggcgttggatacgatcgagaccatagttttcttttgctggagtatttacctataaagccatttactgcctatagtgcatactactttggtcaacaactcgcgaaattgcaccaatggagtgagcaacctaaatttggttttgattttgataacatgctcgcgaccaccatacagcctaatggatggcaaaagcgctggaatcaattttacgcagaaaagcggattggctggcaattacaacttgcagcagataggggaatggtgtttggcaacatcgagcttattgttcaaataatcagtgacaagctacaatctcaccaacctcagccttctctcctacacggcgatttatggccaacaaattgtgcatcattaaatagcaattctgccgtagcatttgatcccgcctgctattggggagatcgtgaatgtgaccttgctatgctgcccctttatccagaactacccctacaaatttttgatggttaccaaagtatttggccattaccacaaggttttattgagcgacaacctctttatcaactttactacttactgaatcgctgtaacctttttggaggggaaaacttcatcgtagtacaaaatatgattgataatatattatctgaatag

SEQ ID NO: 4319 - DNA, 876 bp, Xenorhabdus bovienii
  Coding sequence Name=Xb4151_4152.C442.gene106.dna; Position on contig= 94131..95006bp; Strand=-
atgagtacattgattgaattcattactgaacccttcatgcatgattttatgcagagagctattttcgcttctgtcattgtgggggcagtctgcgcggtactttcctgctatttagtattaaagggctggtcactgatgggagatgccatttcccatgcggtcttacctggtatcgtattagcatttgtcgctggaataccactcgcaataggtgcttttctttcagggatattttgcgcattcgctaccggatatctgaaagaacacagtcgaatcaaagaggatacagtcatgggtattgtattctccggcatgtttgcactgggtttagtcctgtttactcgcatagataccgatcagcatctgacgcatattctatttggtagcatacttggcattacccagcatgaattgattcagacactatgtattgctggcgtaacactggcaattgtgttgctgaaacgtaaagattttatgctctactgtttcgatcccaatcaggcacgcgttgtcggtctgcccgtgaaacttatccattatggcttattgtccctgctggccttaactattgtcgcatcgctgcaagccgttggcattattttggttattgccatgctgatatctcccggtattattgcatttatgctctgccggagttttgatcgcatgcttattgttgcaatgattgcttctgtgtcatccagtgtgctcggtacaataatcagctttcacattgatggtgaaacagggccttgtatcgtcattattcaagctatcttcttcataacagcacttatttatgaccaaataaaattagctagaaagaaaatgagcaagaagcgtaccagagatatcccatccccattatcataa

SEQ ID NO: 4320 - DNA, 876 bp, Xenorhabdus bovienii
  Coding sequence Name=Xb4151_4152.C442.gene107.dna; Position on contig= 95003..95878bp; Strand=-
atgatggagttgctgctacaaccattcaattacaactatatggtgaaagccatgtgggtaagtgccatcgtaggtgcagtctgtgcttttttatctgcctatctgatgctgaaaggttggtcgctgatgggagacgccctttcccattctgttgtaccgggcgtagcaggcgcatatgctctcggtttgccttatgcgggtggagccttttttactggtatgctcgcggcattatcaatgactctggttcgtcatatcacgcggttacgtgaagatgcggtgatcggttttatattctccacttttttcgctgtcgggttattaatcgtttccttaaaccccacttccgttaatgtacaaaccattattctcggcaatattttaggcatttctgatgaagatgttttgcaagtcgaaatcattattgctgtctcctttattatcttgatgctgctctggaaagatcttttagttgttttcttcgatgaaacccatgcacgttctatcggtttatcacctctacggttaaaaatcattttcttcaccttacttagtgcctgtactgttgccgcattgcaaacagtcggcgccattctggtcatcgcaatggtagttactcctggtgccacagcctatttattgacagatcggtttaagcacctgcttatcattgctgtcaccatcggatcattaacgagtgctatcggtgcttacttgagttacttcctcaatggtgcaacagggggagtgattgtcacgctacaaactgtgattttcctactggctttcttctttgcccccaaacatggcatgttagcgtcccgcagacgagcgaaaaaagaatctttagaattaactcaaggaggacgctcatga

SEQ ID NO: 4321 - DNA, 912 bp, Xenorhabdus bovienii
  Coding sequence Name=Xb4151_4152.C442.gene108.dna; Position on contig= 95875..96786bp; Strand=-
atgagtcattcatcgttaaaccatcaatcactatttgagcatcctcatttaattgttgatgatgctaccgtcacttacaacaatgggcacaccgccatatatgacgccagtttcgatattaccggcggcacaatttgtgcgctggtaggtatgaatggcagcggaaaatccacattattcaaaacaatcatgggattagttactccctcccacggaaaagtcaccctcaatgcacaaaccatcaagactgccttaaaacaaaatatcattgcatatgttccacagactgaggatgtagactggaattttccagttttagtttccgatgttgtgatgatgggccgctatggaaaaatgggatttttgcgcagacccagtaaacgtgaccatcaaatcgtggataaagcgcttgaacgcgtcgggctgaatgaactacgaaatcgacaaatcggtgagctttctggtgggcagaaaaaacggacatttttagcacgagcactagcacaggaagggaaagtgctactgttagatgagccttttactggtgtcgacgttaagacagaaaatgccattgtcgatttactccgtgacttacgtgatgaagggcatctagttttggtatcaacgcataacctcggcagtgtgcctgaattttgtgaccatgttatcttgatcaatcgcactgttttggctagtggcccaactgaaaccactttcacccaaaaaaatctggagacaacattcgggggtgttttacgccatatcaacctttctggctcagagcttcatgatgatgatgatctgcgctcactgactgtcattaccgatgatgaacgggctgctgtcttctatggctatgaccgtcatgtcccaccacgtcaaagccaaaagcagaaggaaaatcagccatga

SEQ ID NO: 4322 - DNA, 915 bp, Xenorhabdus bovienii
  Coding sequence Name=Xb4151_4152.C442.gene109.dna; Position on contig= 96783..97697bp; Strand=-
atgaacaaaagacgttcaatttctgctttcccgatattcagtatgattatcgcattattcacgctcaccctattcagccagcaagcctatgcagataaaaaattcagggttgtaactacctttaccattattcaggatatggctcaaaatatcgcaggtgatacagccatcgttgaatccatcacaaaaccaggcgcagagatccacgattaccagcctacgccaaaagacatcattaaagcacagcgtgcagatcttatcctctggaatggcttgaatcttgaacgctggtttgaacgtttttttgaaaacatgaaagacatccctacggccgtcattactgagggtataaccccgctgccgattcgtgagggaccttacaataaaaatcctaatccccatgcttggatgtctcccaaaaacgccctgatttatattgaaaatatccgtaagtctttcgttaaatatgatcctgcgaatgcagaggtttataatcgcaatgcaaaaatttacgcagaaaaaatggtcaaactagatgcaccactcagggaacgcctgtcccgtattccagaaaatcaacgctggctggtaaccagtgaaggggctttcagctatctcacacaagattatggtttcaaggaagtgtatttatggccaatcaatgctgaagaacaaggttctccgcaacaggttcgccgtgttattgataccataaggacacagaaaatccctgtcgtcttcagtgaaagtaccgtttcagataaaccagcaaaacaagtcagcaaagaaaccggggctcactacggtggaatactctatgtcgattctctttctaccccaaaaggtccagtgcctacttatattgacctgctgaacaccactgtggacaccatcgcgaaaggatttaatcaatga

SEQ ID NO: 4323 - DNA, 651 bp, Xenorhabdus bovienii
  Coding sequence Name=Xb4151_4152.C442.gene110.dna; Position on contig= 98026..98676bp; Strand=+
atgctattgacaggatgtgcagaccaagaaattcatcagtcaggagttggtaagcaactaacagcaaaacgcctgctcggtaacaataacgttgtttctagttcccgtaaatttatggctagatctgaatcaacaccatttgatcgttttattgagcaggctgcaagacgttatggcgttgatgaaacgcttattaaagcgattattcgggtggaatctggttttcgtccagaaatcgtcagtaaatccaatgccgttggtctaatgcaaatcaaggcatctacagcagggcgagatgcttatcgaataaaaggaaaatcggggcagccaactatgcgtgagttgaaagatccagaaaccaacattgatcttggaaccgcctacattagcatcctgaaaaagcagcatctggaaggtatcactaatcctgaaacgatgtactatgcgatgatagtcgcttatgttaatggtgcaggagcattattgcgtacatttgattcaaacagaactttggcaatcaataaaattaatcgaatgacaccaaatgagttttatcaatatgttcagaataatcatcccgcaccacaggctcctcgttatttatggaaagtaaaaaaggcctaccgcgatttggatatcattaataattga

SEQ ID NO: 4324 - DNA, 285 bp, Xenorhabdus bovienii
  Coding sequence Name=Xb4151_4152.C442.gene111.dna; Position on contig= 98905..99189bp; Strand=-
atgctttccacttactacaactttgataaatttccagcagacaactacctgaaagagaagcaggagattgtggaatggtgggaaaggaagctactgtcgctacagggcagaaacctgcccttgagatgggatatcacaccttgcggcaaccgtggtgatttcctctatatccgagggaaatattttacgttttttgatggcattcatcatataaatcactttccggacttcagttggataggccaaagagcgtggacagattgccaccgttttcttgccagctag

SEQ ID NO: 4325 - DNA, 1158 bp, Xenorhabdus bovienii
  Coding sequence Name=Xb4151_4152.C442.gene112.dna; Position on contig= 99302..100459bp; Strand=+
atgtatttaaataatattttgtcttctggttataattatcagttgattacttccgatgctcaattgcagtcaatctgtgagcgggcaaaaaaacacgcaacaattgcattagatacagaatttgtacgcacacggacgtattatcctcaattaggtttgatacaactgtttgatggagaacaactttctctgattgatcctctcgatatttcagaatggcaaccctttcgggagttgttgactgatcgagatgtattaaaattcatccatgctggtagtgaagatttagaggttttttggaatagctttcaatgtttgccaacgccgatgattgatactcaggtactggctgcgtttattggtcaccctatgtcatgtggttttgcaacactggttgctcaatatctgcacgtagaattggacaaaagtgagtcccgcactgattggttggctcgtccattgagtgaaaagcagtgtgaatacgccgcggcggatgtttattatttattgcctttggccgatattctgatggcggcaacggagcaggcgggatacatgggtgcggcacaagatgaaagttatctgattgcccaacgccgcaaagaaatcttaatgccagaatgtgcttacaaagatataggtaacgcgtggcaattacgtccaaagcagctggcctgtttgaaaaaactggcgggatggcggttaaatcaggcgcgtgagcgggatttggcaatcaattttgttattcgcgaagaaaacctatggcaggtagcccgttatatgccgacttctttgggggagctggatgccttaggattaagtgggcaggaaatccgttgtcatgggcgtcgtttgctggcaatggttgcagagagcagagatattccagatgaagcctgtccggctctcattacaaacctgattgattatccgggctatcgtacggccttcaaggaaattaaatcgctggttactcaaataagtgagtcccatcagtttagtgtggaattattggcttcccgccggcagatcaatcaattgctcagttctcattggaaactgaagtcacccgattatcagcctgaattactccgtgggtggcgaggagagttgctggctgagcctgttgctgaaatattagcaaactatccggcttaa

SEQ ID NO: 4326 - DNA, 153 bp, Xenorhabdus bovienii
  Coding sequence Name=Xb4151_4152.C442.gene113.dna; Position on contig= 100520..100672bp; Strand=-
atgtataccaatactcactattacgatccgattggtcgagaaatattggtgataaatgccaagggatggctgagtcgggtgcagtattatccatggttcagtatcagtgaggataaaaatgataccgctgctgaagtgatgacacaaagttaa

SEQ ID NO: 4327 - DNA, 168 bp, Xenorhabdus bovienii
  Coding sequence Name=Xb4151_4152.C442.gene114.dna; Position on contig= 100809..100976bp; Strand=+
atgtctttaattcgaaaagccttcaaacggctacactatcctgtcgatattatcgctcaatgtgtccgttggtacctggcctatgccctgagcctgcgtaatttagaggagatgatggctccgagcgtggcattgaggttgaccactcgacactgcaccgctgggtaa

SEQ ID NO: 4328 - DNA, 441 bp, Xenorhabdus bovienii
  Coding sequence Name=Xb4151_4152.C442.gene115.dna; Position on contig= 101056..101496bp; Strand=+
gtgaaaggccagtggaaatatctgtatcgagccgtcgatacgaccggacagaccatcgattttctactgacggcaaaacgggatgcgcctgcagcattgcgcttctttcacaaagcgatacgccaccacggtgagcctgaggtggtgaccattgataaaagcggtgccaacaccgcggcgctagacaagctcaacgccgataagccggaagaagaaatgataaccatcagacaaaacaaatacctgaacaaccttgttgaacaagaccaccgcaatatcaaacgtcggacaggctctatgctcggatttaactcgtttcgtcgagcccaaaccctgttagcggggatcgaagtcgtttcgatgttgcgtaaaggtcaatatatacaacccaaagataatacattatctcccacagagatgttttaccgtttggttgcctaa

SEQ ID NO: 4329 - DNA, 582 bp, Xenorhabdus bovienii
  Coding sequence Name=Xb4151_4152.C442.gene116.dna; Position on contig= 101657..102238bp; Strand=+
atgcgaataaaggaatttgacaccgataaaattgtagatgctgcgatgcaggttttttggctacggggttatgcaggaacatctatacaggatttagttgaagggactggcttatcgagaagtagtctatacaacactttcgaaaataagtatgggctttatcagaaagcactggaacattattctacaatcacatcagctaacgtagaacttattgcgggagaaggaaccgctaaggaattaattcgcaaactactttcaagtattgcggaggatgagttatctgactctctaatgcgaggctgcatggttgcaaatgcatcattagaattggccggacatgatacaactatcgcggaattggttctatacaacttgaaacggctacagaaggcacttgaaaagcgcattcaggcaggacaacttgcaggggagatttcaaaagaaaagaatgcttctgctttagcatatttttttgtaaacacaatacagggcataagaataatgggcaaaggttgccctgttcaagagcgtcaacgctgtttacatgatgtaattaacattgcattggaaacattgtaa

SEQ ID NO: 4330 - DNA, 864 bp, Xenorhabdus bovienii
  Coding sequence Name=Xb4151_4152.C442.gene117.dna; Position on contig= 102325..103188bp; Strand=+
atgactacccaaaaacagctcaaaattgcagtgctaggaactggcttaatgggagcgccaatagccagaaatctacagaaaaaaggatttttagttcatgcatggaatcggacgataacaaaagcactaccgcttcaagcagaaggaattcagatttttaatacgcctgcggatgctgttcgtgacgcagacataatcatcaccgttctcaaagaaggaatgaacgtacaacaggtgttagaagaggctgtatcggctattcgtaaaggcgctattttgctacagctaagcactatcggagtcgaagcggcaatttctttagacgctttagctgaaaaaataggtttgatttactacgatgcacctgttcagggcactaaacaacccgctgaattagctcaattggtcattcttgcctctggcccgatggataaacgtactgaagttcagcctgtttttgatgctattggtaaaaagactatctgggtatcagagcaaaagggatcaagcagttgcctcaaacttgccttaaatagctgggtattttcattgacacatgggattgctgaaagtctgacattagccaaaggtttagggatcgacccacagttagtcgtagatgtaattaaaggcggcccaatggatagcgtatttttccaaagcaaggctgctgccatgttatcagatgattacaccgtaagctttagcattgaaaacgcagtaaaagatgctcaattagtcgttgatgcggctaaacaatttaatctacaaattgacggtgcaaatgtcagtcttacccgatttgaacatgctcttaaaacgggtcatggcgacaaagatatggccgcaacctatataatttaa

SEQ ID NO: 4331 - DNA, 918 bp, Xenorhabdus bovienii
  Coding sequence Name=Xb4151_4152.C442.gene118.dna; Position on contig= 103209..104126bp; Strand=+
atgagtaatctaaatcaagtaaatacagcatttgaatatgatgtaaacccgaataggctgcctatttggaaattattggcttttacaatggctggatttttaaccattttaacggagactatacctgctggattattaccgcagattagtgaagggttaaatgtatccgaaattcaggctggtcagcttgtcactttttatgcacttggttcggtcttagcggcaatacctgttgttgctgtaacgcgtaatttaaatcgtaggtttttgtttttatttgcgattagtggattattagtattcaattcaattactgcaatatctacagattacgttcttaccttggtggctcgttttatcgcgggtatggcggcgggcgttatatggggattatttgcaggttacgctcgtcgtttagttcctcatcgcttacaagggcgtgcgctggcaattgcaggtgttggtcagcctattgcgctatgtattggcgtaccgctgggaacaatgttaggtactctattcgattggcgcggagtcttctggattatgtcagtaatcgctttgctattattgatttggatccgactcgcaatacctgattttgcaggacaatcaagtcagcaaagattatccattcgtcgagttattcttttgccgggtgttcgttcagtattagtcatacttttcgcatggattttagcgcataatattttgtacacctatattgctccttatttaaccgcatttggattgagttctagcattgatgttgtgttactcgtgtttgggatcgcctgcattataggaatttggttaacgggattatttgttgacagtggcgtgaggatattgactttactgagtcttatcttgtctgttatagcatcgctgttacttattttatcggtcatgtattaa

SEQ ID NO: 4332 - DNA, 291 bp, Xenorhabdus bovienii; identical to SEQ ID NO: 352
  Coding sequence Name=Xb4151_4152.C442.gene119.dna; Position on contig= 104143..104433bp; Strand=-

SEQ ID NO: 4333 - DNA, 279 bp, Xenorhabdus bovienii; identical to SEQ ID NO: 890
  Coding sequence Name=Xb4151_4152.C442.gene120.dna; Position on contig= 104425..104703bp; Strand=+

SEQ ID NO: 4334 - DNA, 732 bp, Xenorhabdus bovienii
  Coding sequence Name=Xb4151_4152.C442.gene121.dna; Position on contig= 104654..105385bp; Strand=-
atgggctacagcttagattttcgaaagcgagtactggcatacaaagacaagcattcgttgactttcgaacagacgagtgcccattttgagatctccattcgtaccttgttccggtggtgcagtaaaatagaaccttgcatgacccgcgataaacccgccacgaaaatccctgatgaggtactcattgcggatgtccaaaatttttctgatgactatcaatgggaaagggcaaaacgtttaggtgtctcacaatcggctattcattacgccttgaaacggcttcggatcaccccgaaaaaaacgctccaacaccctcgcgctgatcctcaagctcgtcaggcatttatcgagcgcatcagcgatgatgaacagactggcagacccattgtttatttggatgaaagtggttttgctcaatcgatgccacgtaaacagggatattcggaaaaagggttacgctgttttggtacgcatgactggcacgcaaaagggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 4335 - DNA, 93 bp, Xenorhabdus bovienii; identical to SEQ ID NO: 1411
  Coding sequence Name=Xb4151_4152.C442.gene122.dna; Position on contig= 105346..105438bp; Strand=+

SEQ ID NO: 4336 - DNA, 111 bp, Xenorhabdus bovienii
  Coding sequence Name=Xb4151_4152.C442.gene123.dna; Position on contig= 105465..105575bp; Strand=-
atgaaacctctgatatgtgcattcgaaaaccctccaattagtgttgcagtagacttgctcaacgcgaccgaacctaattttcatgtgacagaaaaacacgttgaactatga

SEQ ID NO: 4337 - DNA, 156 bp, Xenorhabdus bovienii
  Coding sequence Name=Xb4151_4152.C442.gene124.dna; Position on contig= 105675..105830bp; Strand=-
gtgatcttctttctttctgtccagcttcctcaatttgaggtttccaagattaccaatgagttagcgttaactcaccctagcttgttgataatgtttaattgttctatttcggcacaattagactttggacaaaagctacccgctatagcacaatga

SEQ ID NO: 4338 - DNA, 486 bp, Xenorhabdus bovienii
  Coding sequence Name=Xb4151_4152.C442.gene125.dna; Position on contig= 106060..106545bp; Strand=+
atgaaccctgtcatcaatcttaaaaatcttactctcaagccttggaagcagggcgaacgttatgagggatcagatatttcctttggacaacagcttgatctcaagcatttaggcatctcctataacgaagtgccgaaaggtaaaagtagctgtccgtttcacaaccatcatagtgtagacgagcttttctttattcttgaaggtaacggcacttaccgctttggctccgatgaatttctggtcaagaagggtgacgttgtaggcgctcctgcgggagggcaagaaactgcccatcaaataatcaacaccgggtcagttccattgcgctatcttgctatgtcagcgaatgtttcagcagatgtgattgaatatccggactcaggcaagtttcagtctgtgttaaagcaacaagatggaaagttgtttcattttgtcggacggctcagcagcgaagttgattattgggacggagaacctggagcataa

SEQ ID NO: 4339 - DNA, 273 bp, Xenorhabdus bovienii
  Coding sequence Name=Xb4151_4152.C442.gene126.dna; Position on contig= 106658..106930bp; Strand=+
gtgttactttctgcattagggttaggggttgccagagcctttaatccatttccaaagattgacaaattagaagccccgttggttgccactgtcggggtttcgcttcttataccgcacctaaccaaactccctatttcagggtatttgaattttatcaatgagttactcttaccctgtgagctaaaccctgaaaagggcttcgtattgcccgtaatacctgagatttcaccctgtgggctgtcggagccgttcgcgcaggttgtcgggcaatga

SEQ ID NO: 4340 - DNA, 558 bp, Xenorhabdus bovienii
  Coding sequence Name=Xb4151_4152.C442.gene127.dna; Position on contig= 107187..107744bp; Strand=-
atggggatatatttaaaaatgtcgttattagatgctgatgaatttgaaggaaattgggtatttcgcttcaatcaaactctgaattttccccttaagttctcttcgactatgcaaaatggggtctgtagtagtttggtaatggcttgggtaaagatgcacaaattaggaaagtctcacttattcctaggaaatataagactacctagttatataaaaatagttgaaaatcttaaagcgaaaagcatggatggccttctatttcttaatgaaaacggattatcttataggcatgtaagctgttatggtgggggcagtattgtagaaaacttagccactatccataagggttatgacgttttggcgtatggagatcatgctattggactcgcagtaactgccaatggtattgatttttttgatcctaattttggttgcgtccatttcccgacaggccataattttagaacatggtttaaggaaaaatattggcctaaccgtgatggaataggggcgattgcaaggccatgtgataaaattattgtacactcaattgcataa

SEQ ID NO: 4341 - DNA, 183 bp, Xenorhabdus bovienii
  Coding sequence Name=Xb4151_4152.C442.gene128.dna; Position on contig= 108073..108255bp; Strand=-
ttgcccgataacctgcgcgaacggctaccgccatatttagcggttgtgcgtaaatattatttactcgcaaatggcattaactggacgaatttgtcctgtcgggttaaggcgggatcccgcctttggtcaatccaacccgcaggggcaaagcttaggtactacgggcaatacaaagccctttaa

SEQ ID NO: 4342 - DNA, 426 bp, Xenorhabdus bovienii
  Coding sequence Name=Xb4151_4152.C442.gene129.dna; Position on contig= 108274..108699bp; Strand=-
atgtatagagacatgcaaaaaatactatcgcattggggcaggtgggtagcgcaaggtagggttaacattggctggaagtctgtttccgcagggtttgaaaacgcggtgacttatacctgcagtgacaagctatcgtgcagtgacgaggacggcatggtcatcgatggctacgttgccaagctacgtaacgtcggtatgtctcaggaatgtgactttattgaagaccactacgttaaaggcatatccaaacgtgcaattggccgcaagttcaagctcagtgagagcgaagtcagaaagcgaatgctggtggctgaaagttttatcctcgggtgcctggaggtgatcgacgagcctttagaaattgacctcatttatggcttccacggtaactatgcagaaaagcgcagttcagcattgagagtttaa

SEQ ID NO: 4343 - DNA, 192 bp, Xenorhabdus bovienii
  Coding sequence Name=Xb4151_4152.C442.gene130.dna; Position on contig= 108769..108960bp; Strand=+
atgtggccaagagtagatagtcaatattttgaccatgatacaaatcaaggcgttgggtgcatgcccctttttcggacgataatgattttaaaggactttttcaatttcggcgaatcgacggaattaagtttaatcaagaagttaccggggagtttctcagtcatgcgttatgatcgcgtttttgcttcatga

SEQ ID NO: 4344 - DNA, 204 bp, Xenorhabdus bovienii
  Coding sequence Name=Xb4151_4152.C442.gene131.dna; Position on contig= 109016..109219bp; Strand=-
atgcataaacaaaccagacagtaccgacagttgactcccgagcaaagatatcagcttcaagccctgtatacctactttggttttatactcacaggtgagggtgtgagaaatttttcgcataccttttgctcatgtgaaattttcacaactgaaaatttttttgcagttgatgcttttgtacatacgggattttccctcatgtaa

SEQ ID NO: 4345 - DNA, 162 bp, Xenorhabdus bovienii
  Coding sequence Name=Xb4151_4152.C442.gene132.dna; Position on contig= 109508..109669bp; Strand=-
gtgaatgagcaggtacgaaacaatgtctattttccggataccaaaacattccgtgaaacgctgcgctacttttttcatgtcacattgccagaaaaagcgaaagaactcaccactcggttgactgataacttccagattttaaaacccgcctcttcaagttaa

SEQ ID NO: 4346 - DNA, 210 bp, Xenorhabdus bovienii
  Coding sequence Name=Xb4151_4152.C442.gene133.dna; Position on contig= 109647..109856bp; Strand=+
ttgtttcgtacctgctcattcacatacttccataatctctatatgaacgcatcccattcgcaagacaaaaatcacgttgacacaggcggtaggttgcagctctatattcggccttattacagccgcagggctgtgggcctcgatgtaatccgctggcttgttcctcattcaatcaacgatctttatgatcacgcgattattcaggtttag

SEQ ID NO: 4347 - DNA, 123 bp, Xenorhabdus bovienii
  Coding sequence Name=Xb4151_4152.C442.gene134.dna; Position on contig= 109831..109953bp; Strand=+
atgatcacgcgattattcaggtttagcaagtcacggtcttacctgtctttgtcatcgttgctctttgactcagcaatctttctgcattcatccttgtcgttaaatgtgaaagttgaccagtaa

SEQ ID NO: 4348 - DNA, 492 bp, Xenorhabdus bovienii
  Coding sequence Name=Xb4151_4152.C442.gene135.dna; Position on contig= 110016..110507bp; Strand=+
gtgcccagaccgttcgagccagcttattggccattcctacaacggctacgcaaaccggacgtcgtttttttaagttccgtcacccagggcgacggcgttttcgtgagtaaggtggccgttcttgcaccgtggataccactctggcgtttacaactcagtgagaaagaacgggaatatggccattatctgctggttcgtcgcagccgggatgaaaaacaggaacgggcttactatatcgtgtatgcgcgcagagaccaggcggctctgaaaaccctggttcaggtggcgggttgtcgctgggaaatcgaaagtggctttgaggaaaccaaaggggaatgtgggctggatcactacgaagtgcggcgatggcagagttggcaccggcatattaccttgtcgttactggcccatgcagtcctcgcggttctgcgggtacaggagaaaaaaaacaccggtaggccgggttccgctcagtgtagcggaactccgtaa

SEQ ID NO: 4349 - DNA, 234 bp, Xenorhabdus bovienii
  Coding sequence Name=Xb4151_4152.C442.gene136.dna; Position on contig= 110425..110658bp; Strand=+
atgcagtcctcgcggttctgcgggtacaggagaaaaaaaacaccggtaggccgggttccgctcagtgtagcggaactccgtaagctgctgtcaaaactgatggaaaaagcaggaaagacaatcgaacagattttccattggtcagactggcgacgacggcatcaataccgggcacaacaatgtcattatcgtcgccgggcaaatcatcggcttacagagcaattacggctgtag

SEQ ID NO: 4350 - DNA, 888 bp, Xenorhabdus bovienii
  Coding sequence Name=Xb4151_4152.C442.gene137.dna; Position on contig= 110771..111658bp; Strand=+
atgcataatttagttgacttattttgtcatgtcgatgatttttgcaaattgttcatgcctcaatggcaaaaatatctgattgaaagtggtcaacgccagcggttacgcccaacaagaatgacaaccagtgaaatcatgacgattatcattgccttccatatgtcccatcagcgtgattttaaacatttttatattgggttcatgacggtataccacaaaaaagactttccctcattattgagctacacacgttttcttgaggccatgccgacggttttggctccattaagctccttctttacccacctaaaaggtcagccaacaggcctcgaattcattgattcaacccgcattaaagtgtgccataacctgcgaataccacggcatcaagtttttaaaggggcagcagctagagggaaaggaacaatgggatggttctacggatttaagctacacattatcgtgaaccatcttggtgagattgtcgccgcgaagctcacgtcagccaatgttgatgatagaaccccagttaaggcgttctccaaggggcttttagataaactctatgcagacaaaggctatataagcaaagccttaacggaagagttagaaatggaaggcatcacattggtcacagggcaacgcaaaaatatgaaacccaaattattagcggcttgggatagagcgatgctcgctaagcgattcattattgagactattaatgaccaactgaaaaatatcactcagattgagcattctcgccatcggagcttacatggcttcatgttgaatttgctgggcagtttgattgcctattgtttgaagccaaaaaagccatcactgaatctctcaaataccgagaaaacaggacttcaagtaatggcttaa

SEQ ID NO: 4351 - DNA, 1332 bp, Xenorhabdus bovienii
  Coding sequence Name=Xb4151_4152.C442.gene138.dna; Position on contig= 111671..113002bp; Strand=-
atgaagacaaaagcgatcttgttcgcctctgttctacttgccgggtgtcaatcgggtctgcaattaaaaaccccttcccagcaaaatacacagaagatgtcttcgacgaatcagcagacagacggtattgcagaaccaaaggatactgcaaactggaaggagagtccgacaacccaacaagatttgtggggacatatccgtgatgagttgaagatggaaattcctgacaataacagggtgcgtgaacaacaaaattattatctgaaacacaagagtcatctccaaaatgtgatgttacgggcagaaccgtatatgtattggatagttgatcagcttgatcaacggcatatgccaatggaagtagtttttcttcccatagtggagagtgcttttaatcctcatgccacttcttatgccaaagcggctggcttatggcagattattccgagtacaggccaccattatggcttgacacagaataaatggtacgatgcccgtcgtgatgtggctgcatccacgacagcagcgctggagatgcttgagtatctgaatgcacggtttaacagagattggttgttgactatcgcggcttacaacagcggcgaaggtcgggttatacgtgcaatcagagacaatcaggctaagggcaaaccaacggatttttggtctttgtcgctaccacgggaaacgatgcagtatgttccaaaaatagtggctctcagcaatatcattcgccataacgacaagtttagcttgaagctgccgcgacctaacaatcagcaggcacttgctaaagttgaggttggtcagcagatcacgctgtcacaagcggcagagttatctgggctgtccctgacatcaatcagggcatataactctggttataagcagggcataacatcccctgatgggccgcattacatcatgctgcccaaaaggaacgtcaaacagtttaagaacttgctgacagatgaaaaagttttgaaggatatccgtctggctgttgctcaaaatactcgccagctactgcaacaaagccaatatacggttcgttctggtgatacgctgtccgccattgcaaaacgtttcaagacatctcaccgagaattacaaagattgaacagtttgaaaactgtagatcgactcaagatcgggcaagttttgaaaattaatagcagtggtcctatcacatatcaggttcgtaagggagactcctttttcagcatcgccaaacaccacggcgtcaacctcaacgacctgatgagctggaataaaagcatcagaatcaaagatattaaaccaggtatcaatctgacgctttatcctaattaa

SEQ ID NO: 4352 - DNA, 798 bp, Xenorhabdus bovienii
  Coding sequence Name=Xb4151_4152.C442.gene139.dna; Position on contig= 113075..113872bp; Strand=-
atgtcatcttcctttcaacctactataaatatgaggcatataatggagcttatcaggatccctgccctttcagacaactacatttggttactttgtgatgaagacaaacattgtgtcattgtcgatccatctgagtcacagcccgtcattgatatcttagcggccaaccaactcattcctgcggctatcctgttgactcaccatcaccacgaccatgttggcggcgtggctggcctacttaaacaatatgccgacttacccgtatatggtccggaagagacccggagcaaaggcaccactcatattgtccatgaacatgacaccattgagacaggtcattattgtttccacattatggagttacccggccataccctgggtcacattgcattctatcaggctccctatttgttttgtggcgacactctgttttctggtggctgtggtcgattatttgaaggtacagcggaacaaatgttttcttctcttgagaaaatcatgtcattgccggatgagactttaatctgctgtgctcacgaatatactgccgccaatatgaaatttgcacgggcagttttgcctgagaatgaaactattcatgattattataataaaataataagtattcgcgaaaataataaaccaacagtaccaacaactttacaaatagagaaaaaagttaacgttttcctgaattgtcacaacattgatttacaaaaaaatatcggcattaaacctaattcaaaaccactttcttctgtttttcagcaattaagaatttataaagatcgattttga

SEQ ID NO: 4353 - DNA, 717 bp, Xenorhabdus bovienii
  Coding sequence Name=Xb4151_4152.C442.gene140.dna; Position on contig= 113871..114587bp; Strand=+
atgcaatcagcgcgttcaatcaagcaaataacatcccctgcttcttgggctgagttaccgtggggagagtattaccgcgtcgctctggaacgtcaattggaactgtggtggccgaagatttttgggcttcatttggcgaaactgggtaatctgagtgcagaaattgacagccgtacctgcccgatcagtcatcagttcaatatcggcttaatggagggaagcatggatgttattgctgatccttactgcctgccttttgaagctaaatctgttgatgcctgcctgctggcacatatgctgacttacagcgctgatccccactggctgctacgggaagttgaccgtatcataactgatgatggctggttgattatcagtggttttaacccgatcagcctgttgggattaagaaaagtgctgttgccgatacaccgccgtcaggcttatgaggctcaaatgttttccatgcttcgccaagtggattggttaagtcttctcaactatgaaattgttcatcatgtcagttttcatgttttaccgtggcaaagcgggaaaagtttttgtaatcgttctgcatcgatgtttggctgtatgaatatgataattgcccgcaagcggacaattcccctgacattaaatcccatgtgggcgacatcgctgaagccgaagttcagaaatgtattgggagcggcaaaagatcttcaccgacgccaataa

SEQ ID NO: 4354 - DNA, 471 bp, Xenorhabdus bovienii
  Coding sequence Name=Xb4151_4152.C442.gene141.dna; Position on contig= 114645..115115bp; Strand=-
atgagcaaaaaggtagaaattttcaccgatggatcttgcctcggtaatcccggacccggcgggtacggtgttgtactccgttaccagcagcatgaaaaaaccttgagcaaaggctattttcgtacgaccaacaaccgaatggaattgatggcggccattgcagggctggaatcgctcacatgtccatgcaatgtgatcctgactaccgatagccagtatgttcgtcaagggattacccaatggatacacaactggaaaaaacgcggctggaaaaaagccgacaaatcccccgtcatcaatgttgatctctggcagcgactggatcaagccatagcagaccatgatatcgattggcgctgggtcaaggggcatgcaggacatcgagaaaacgaacagtgtgatgaattggctcgtaccgccgccaattcacccacgttgcctgataatggttatactgaaagtgcaaattaa

SEQ ID NO: 4355 - DNA, 750 bp, Xenorhabdus bovienii
  Coding sequence Name=Xb4151_4152.C442.gene142.dna; Position on contig= 115179..115928bp; Strand=+
atgagcactgcaattacccgccaaattgtcctcgatacagaaacaaccggtatgaataagctgggtgttcactatgaaggacacaacattatcgaaattggagcggtagaagtgatcaaccgtcgtctgacggggcgtcattttcatctctatattaaacctgagcgtctggttgatcctgaagcgtttgaagttcacggtatcagtgacgaatttttgcaggataaaccaacgtttgccgatattgccgatgagttcatcgaatttatccggggcgccgagctgattattcacaacgcgacgttcgatatcggctttatggactatgaattccgcaagcttaatcgtgatatcccgccaaccgcagatttttgtacgatcacggatagcttggtgctggcaaggcaattgttccccggcaagcgaaataaccttaatgcgttgtgcgaccgttatcagatcgataactcgaagcgtactctccacggagccttgcttgatgctgagatcctgtctgatgtctatctgacaatgacaggtggccagacatcgctgaccttttcgatggaaggagagatctcaggtggcgctcagatggcagaaatccagaaaattacgcgtccccagacgggattgaaagtgatctatgcttctgatgaagaattgcttcaacatgaatcccgcttggatctggttgaaaagaaaggtggaagctgtctatggcgtccgaaacctgaacaattacagtga

SEQ ID NO: 4356 - DNA, 315 bp, Xenorhabdus bovienii
  Coding sequence Name=Xb4151_4152.C442.gene143.dna; Position on contig= 116140..116454bp; Strand=-
atggcggggctgcaatcgttgaccacgctaatcatggtttcagaaagattctgtctagcttcgctatatgttaagactttcattatgaccatccaatttcagctttttgagggggtaaactcattcacaaggattatctgtacaatgtattgtacgttcaaaattcagtcaacacttgagcataacgatatttcaaccagtgcctgcatggtcgtgatcagtcatcaagaaagggctattttgctggctgtagctgagagtaaccggaaaaagaaaaagccccgagttaaaaactcagggcttatagattctggc

SEQ ID NO: 4357 - DNA, 264 bp, Xenorhabdus bovienii
  Coding sequence Name=Xb4151_4152.C442.gene144.dna; Position on contig= 116363..116626bp; Strand=+
atggtcataatgaaagtcttaacatatagcgaagctagacagaatctttctgaaaccatgattagcgtggtcaacgattgcagccccgccattattacccgaaaaaacggtgaaagttgtgtgttgatgtctttgtctgattatgaatccttacaggaaactgcatacttgatgcgttctccaaacaatgtgaatcgtctaatggactcaattgcagaattgagagcaggaaagggtaaggctaaagagttggatttagattaa

SEQ ID NO: 4358 - DNA, 255 bp, Xenorhabdus bovienii
  Coding sequence Name=Xb4151_4152.C442.gene145.dna; Position on contig= 116626..116880bp; Strand=+
atgaaaattactttttccgacagtgcctgggaagattatctttactggcaacaaacagataaggcaatactgaaacgcattaatcaactcattaaagatatacgtcggcagccttttgaagggattggtaaaccagaacctttaaaacataacttgtcagggttctggtcaaggcgtatcactgaggaacaccgtttgatatatgctattgaagaagatcaaataatgatagcagcctgtcgttatctttattga

SEQ ID NO: 4359 - DNA, 546 bp, Xenorhabdus bovienii
  Coding sequence Name=Xb4151_4152.C442.gene146.dna; Position on contig= 116937..117482bp; Strand=-
atgtcaaaattcaatcttacatctgactcaacctcaattccggccatcatactattggattctatccatgcaaaacgtgatgagcttattaacttactgcatgattgtgtcgaaagtgatgcttctatcggttttattgctccacttgatgtgaacgaagcagagcaatactggcaaaatgttgaagcagatatggtgtcgggtagccgcgtgctgttgatagctctggagggagaagaactcgctggctcggtacaactttctttctgccagaaaaagaatagcctgcaccgtgccgaagtggaaaaactgatagtgcatacagcttaccgtcagcgcggcattggccgaatgttagtgaatgcactggaacggctggcaaggcaatatcagcgtcgtttgctggtattagatacccgtactggtgaccccgcgtcagcactctatcgaaaatgcggttttattgaagccgggcagatcccacagtttgcattaaattccagcggggaattcgcgggaactacatttttttataagctgatttga

SEQ ID NO: 4360 - DNA, 225 bp, Xenorhabdus bovienii
  Coding sequence Name=Xb4151_4152.C442.gene147.dna; Position on contig= 117669..117893bp; Strand=+
atgaaattatctcccatttgcgcaaatgcaccttcagttgtacaaattgatctgaaaatttgtcataacaacgggataaatcaaagaatttatgccagaggaaaattaagattgtttccgttatctggcattaatgattgcggtttgtatgccgcgctgcgaaaattagttcttatgtacattaacgctttcatccgacttggagtaaagaatgaccactcgtaa

SEQ ID NO: 4361 - DNA, 1995 bp, Xenorhabdus bovienii
  Coding sequence Name=Xb4151_4152.C442.gene148.dna; Position on contig= 117880..119874bp; Strand=+
atgaccactcgtaaaacccttgctaatgctgtccgcttcttgagcatggatgctgtgcagaaagcaaaatcagggcatcctggcgcaccaatgggaatggctgacattgccgaagtgctgtggcgcgactatttgaatcataacccggtgaaccctaactgggctgatcgtgaccgtttcgtattatccaacggccacggctctatgctgatttacagcttgctgcacctgactggctatgatgtttctatcgatgatctgaaaaacttccgtcaactgcattccaaaacccctggacacccagaatatggctatactgcgggcgtagaaacaacaactgggccactgggtcagggcgtcgccaatgccgtgggttttgcaattgcggaacgtacactggcagcacagttcaaccgtccgggtcatgatatcgtcgatcaccacacttatgtattcatgggtgacggctgtatgatggaagggatctctcatgaagtctgctctttggcaggtacactgaaactgggcaaactgattgcgttctatgatgacaatggtatctccattgatggtgaagtagaaggttggttcactgatgacaccgccgcgcgctttgatgcgtatggctggcacgttatccgtggcgtagatggtcatgactcagacgctatcaaagccgcaatcgaagaagcacaaaaagaaacaggcaaaccttctctgctgatgtgtaaaaccatcatcggttttggctcaccaaacaaagcaggcaaagaagagtgtcacggttctccgctgggtgatgcggaaatcgaagcgacccgcaaagcgttgggctgggaacatcctgcgtttgacgttcctcaggatatttacgctggatgggatgctaaagcagcaggtaaagctaaggaagcgacatgggaagaaaaatttgccgcttacgcaaaagcacatccagaactggcagcagaatttaaccgccgtacccgtggcgagctgcctgcaaactgggaagcagaatccaaagcattcattgagaatctgcaacagaacccagcttctattgccagccgcaaagcatcacaaaatgcgctggaagcattcggtaaagttctgcctgaatttatgggcggctccgctgacttggctccaagtaacctgaccatgtggtcaggctctaaacccctgaatgaagttcaggacggcaactatattcactacggtgtccgtgaattcggtatgtctgccatcatgaacggtatcgctctgcatggcggttttgtgccttatggcgcgacattcctgatgttcgttgaatatgcccgtaacgcggtgcgtatggctgcgctgatgaaaatccgcagcattttcgtatatacccatgactccattggtctgggcgaagatggcccgacccatcagccggttgagcaaattgccagcctgcgtgtgacgccaaatatgagcacatggcgtccatgtgaccaggtggaatcagcggttgcgtggaaatatgcgattgaacgtcaaaatggcccgactgccctgatcttctcccgtcagaatctggcacagcaggcgcgtacggctgaacaactggcgaatattgagaaaggggcttatatcctgaaagattgtgcaggccagcctgaactgctcctgattgctaccggctctgaagttgaactggcggtgaaagcggctgaccaactgagcgcagcaggccgccaggttcgtgttgtctctatgccatctactgatgcatttgacaaacaggatgccgcataccgtgaagctgtattgccagccgcagtttctgcccgtgttgccatcgaagctggtatcgctgattactggttcaaatacgttggcctcaacggtgctatcgtgggtatggaaacattcggtgaatctgcaccagctgatcttctgttcaaagagtttggtttcaccgtcgaaaacgtggttgccaaagcaacatctctgttgaaataa

SEQ ID NO: 4362 - DNA, 117 bp, Xenorhabdus bovienii
  Coding sequence Name=Xb4151_4152.C442.gene149.dna; Position on contig= 120008..120124bp; Strand=-
atgcaaccgcttaggataactgagcaactgccgattgtacggatgattcatcacaaaattaatcagattgtgacagacaagacattttacgcgccaaaactgaaacggttcagctaa

SEQ ID NO: 4363 - DNA, 1020 bp, Xenorhabdus bovienii
  Coding sequence Name=Xb4151_4152.C442.gene150.dna; Position on contig= 120151..121170bp; Strand=+
atgacaatcaggatagcgattaacggttttgggagaatcgggcgcagtatcttacgtgctctctacgaatccgggcgtcaaactgaaatttcggtgatcgctattaatgagctggctgatgcggaaggtatcgctcacttattgaaatacgattccagtcatgggcgttttgcatgggatgtacgcctgaacaacaacctcttgctagtgggggatgacagcatccggctgtttcatcaaccggatatttcagcgttgccgtggaaagagttgggtattgatatcgtacttgactgtacgggcaaatatggcgaccgggcggatggtgaagcacatattgccagcggcgccaaaaaagttctgttttcccatccgggagggaatgatctggatgcgaccgtagtctatggtgtgaatcaccatgagctggtggcggaggattgtatcgtttccaatgcatcctgtacgacaaactgcattattccaatcatcaaattattggatgatgcattcaatattgaatctggcacggtgacaactattcatgcttctatgaatgatcaacccgtgattgatgcttatcacagtgatttacgtcgaacccgggcagccagtcaatccattattcctgtcgatacaaaactgtctgcggggattacacgtatcttccccaaattcagtgatcgttttgaagccatctcggtgcgagtgccgactatcaatgtgaccgcgattgacttgagcgtgacagtcagcgccgcagtggatgttggggatgtgaaccagctactgcaagaatcagcgggaagttcgtttcgtggtatagtggattacactgatttaccgttggtttcaacggattttaaccacgatccccacagtgccatcgtggatggtacacaaactagggtcagcgggaatcacctgatcaagaccctcgtgtggtgtgataatgagtggggctttgccaatcgtatgcttgatacgacgctggtaatggctgctacgggtttcaaataa

SEQ ID NO: 4364 - DNA, 1167 bp, Xenorhabdus bovienii
  Coding sequence Name=Xb4151_4152.C442.gene151.dna; Position on contig= 121258..122424bp; Strand=+
atgtctgtaattaagatgactgatttagatctggcgggtaaacgcgtactgatccgtgctgatctgaatgtgccggtaaaagatggcaaagttacctctgatgcacgtattcgtgcgtctttgccgacgattgtgtctgcgttgaatcagggagccaaagtcatggtgacttctcacctggggcgcccgactgagggagaatacaacgaagagttctcactgcaacctgtcgttgattatctgaaagaaaaactttcatctcctgttcgtctggaaaaaaattatctggatggcgttgaagtagcggaaggcgaattggttgtactggaaaacgttcgcttcaataaaggtgagaaaaaagacgatgaaacgttatcaaaacactatgcagcattgtgtgatgtgtatgtgatggatgcctttggcaccgcacaccgtgctcaggcgtccactcacggcgttgctaaatttgcggcaattgcctgtgcgggtccactgctatccggtgaactggaagccttgggtaaagcgctgtacaaccctgctcgcccaatggtggcgattgtggggggatccaaggtctcaactaaactgactgttcttgattcactgtctaaaatcgctgaccagctgattgtgggcggtggcattgccaatacttttgttgccgcagaagggcataatgttggccgttctctgtacgaagatgatttgatccctgaagcgaaaaaactgctggaaagctgtgatattccggttcctaccgatgttcgtgttgctactgaattctctgaaactgcggaagcaacgctgaaatccaccagcgaaatcaaagacgaagagcaaatcctggatttgggtgatgcttctgcagaacgtctggttgaaatcttgaaagatgccaaaaccattctgtggaatggtccggtgggtgtttttgaattccctaatttccgtaaaggaaccgaaattattgctcgtgcgattgctgaaagtgacgctttctcgattgcaggtggcggtgataccctagccgctatcgatctgttcggcattgctgataagatctcttacatctcaaccggtggtggtgctttccttgagtttgtcgaaggcaaaaaactgccagccgttgtcatgctggaagaacgtgctaacagtaattaa

SEQ ID NO: 4365 - DNA, 1077 bp, Xenorhabdus bovienii
  Coding sequence Name=Xb4151_4152.C442.gene152.dna; Position on contig= 122482..123558bp; Strand=+
atgtctaaaatttttgatttcgtaaaaccgggtgtcatcactggtgatgatgttcaaaaagtctttgctgtcgcaaaagaaaacaacttcgctttaccagctgttaactgcgtcggtactgattccatcaacgcagtgttggaaacagcggcaaaagtacgtgctccggtaatcatccagttttccaatggcggtgcggcattcgtagcaggtaaaggcttgaaggcagaaggccagcaggcggcgattctgggttcaatttctggtgctcatcatgttcatcagatggcagaatactacggcgttcctgttatcctgcataccgaccactgtgcacgcaaactgctgccgtggattgacggcctgctggatgccggtgaaaaacattatgtgcagaccggcaagccgctgttctcttcccatatgattgacctgtcagaagagtctctggaagaaaacatcgagatttgtggccaatatctggcacgcatggcgaaaatcgacatgacactggaaatcgaactgggctgtactggcggtgaagaagacggcgttgataacagtcatctggacagctcttctctgtatactcagccagaagacgtggcttacgcttatgaaaaactgaacgctatcagcccacgtttcactatcgcggcttctttcggtaacgttcacggtgtctataagccaggtaacgtcaaactgacgccaaaaatcctgcgtaactcacaagactacgtgtctgagaagttcaatctgccacacaacagcctggattttgttttccacggcggttccggttctaccgcagaagagattcaggaagcggtcagctatggcgtagttaaaatgaatatcgataccgatacccagtgggcaacttgggaaggtattctgaactactacaaaaagaacgaaggctatctgcaaggccaattgggtaacccagaaggtgcagacaaacctaacaaaaaattctacgatccacgcgtttggctgcgggctgctcaggtttccatgatcgttcgtctggaacaggctttcaaagaattgaatgcggttgatgtgttgtaa

SEQ ID NO: 4366 - DNA, 2706 bp, Xenorhabdus bovienii
  Coding sequence Name=Xb4151_4152.C442.gene153.dna; Position on contig= 123710..126415bp; Strand=-
atgagccgttttaatcccgcactttataacaaaaccccgggcgtgagtgttcttgataatcggggtttaaacgttagagatatgggttatcaccgtgccgaagtgggcagtgcaaccgatacccgtattacccgccaccaatataatacccaaggttatttgagccagagtattgatcctcggctgcatgccagccagcagaatgacagtactatcaagcccaattttatctggcagtatgatttaaacggccagattttacatacagacagtgttgatgcaggacgaaccgtcacattgaatgatattgaagggcgcccaataatggctgtcacagcaacggaggtcacacagaaatggcagtatgaagcaccttccctgccggggcggttattgagtgtcagcgagcaggccgtcaatgtttcaccccgtatcacggaacgcttgttctggtctgacaataatcagcaagccaaagacaataaccttgtcgggcagtgcgtcaaacattatgatcccgccggattgagtcaactgcaaagcggttcactgacaggtgccatgctcaggcaatcccggcaatttatccttgatgaccagaaagtcaattggacagataacaatcttggtgcactggacaatactcttcacacaacccagagcacagtagatgccacaagcgcccttctcactcagactgataccaaaggtaatctacagcgtttggattacgatattgccggtcaactgaaaggaagctggctgacgttgaaagaccagaatgaacaaatcattctcaaatcactcacttactccgctgccggacaaaaactgcaagaagtgcatggcaatggcgtgatcaccgattatacctacgaaccagagactcagcggttaatcagcatcaccacccaccgcccgtctgatgccaaagtgctgcaagatttacgttacgattatgatccggtcggtaacgtgctcaatatccgcaatgataccgaagccacccgcttctggcgtaatcagaaagtcgtgccggagaacagctacagttatgattcgctgtatcagcttatcaatgccacagggcgcgaaatggcgaatatcgggcagcaaagcaataaacttcctcctcctgtttcacctattgatagcagcacctataccaactacacccgcaattattcctatgacaatgccggcaacctgctgcaaatccgccacagttcaccagcgacgaataataattacaccttaaatatcaccgtttccaatcgcaacaaccacgccgtctcccaagatttggccgaaaaaccggaacaggtcgatgcacagtttgatgccggcggtcatcaaatgaatctgataccgggacaaagcctgaaatggaattcacggggagagttacatcaggtgaacaaaacaggcagcagcgacaaccttgaagagtatcgctatgacagcagcggcaaacgggtgctgaaaatcggtgagcagcagcgagttacctacctgacaggtttggaactacgcaccaccaaaaacgggaatagtattaccgaagatttgcaggttatcagcgttggtgaagcaggtcgggcgcaagtgagggttctgcattgggagagcggtaaaccggaggatatcgataacaatcaactgcgatacagctatgacaatcttcttagcagcagccaacttgaattaaatggcacagggcaaattatcactgaggaagagtattatccttatggcggtacatccgtatgggcgacaagaaacgagaccgaagcccattacaaaacgattcgttattccggcaaagagcgggatgcgacgggattgtattattatggcttccgttattatcagccgcgggtgggaagatggttaagtgctgatccggcaggaactatagacgggctgaatttatatcggatggtgagaaataaccctatcacatttaaggatgataaaggtctagcgcctgaaccaccacaagaaacagaaacacaactcctcatacatgaatttaaagaaggagatattttgtatggtttagataatcccagaactactgctttatcagatttagaaaaagtcggctttaaacgtatgagtaaatctacagctaattcaggtaacgtgttttctaggctcaggcaatcttttcgaaaaaaaaataacaccaaaagaaatatactgatacaaaatgacatcacaaatgcgacttgggatgccagtaaacccagagaatatgctactgataaaagtatcaaaaaagaggtacatgattaccagcgtgtcattggatttagagcgtttttatcagaacatcctaaatacaatgttaaaaatgataatgaacttataactgcgctaattaataatccatcaataactacatcagtgccactttggcaaaaaacaagtaaagctggcttaggctatcaattctttgagaggaaagcccctgttcattttttggttgataccattggtgatgatattaatacggtgatatcaaaacaaggtcatggtgcaagtataacatctagcgaattacgctggttatatcgccataaagataccaaagaagtgaaagagaatttaaaattttggcgagatgggaaagccgtacctcatagcgaagtattctctgaggctaaatggagtagctatcaacctaaacacagatatagctga

SEQ ID NO: 4367 - DNA, 180 bp, Xenorhabdus bovienii
  Coding sequence Name=Xb4151_4152.C442.gene154.dna; Position on contig= 126509..126688bp; Strand=-
gtgacattaacccccagacagggagagaaaagcagccaattatcaagtgcccgctgtaaagcaactgtatcaatcattgttattaagcaacctaaaatttatattttccgtacagatgcaacaaatatatacccaatagatttcaaattaaaagatgaagggtatatttttttcgcctga

SEQ ID NO: 4368 - DNA, 1059 bp, Xenorhabdus bovienii
  Coding sequence Name=Xb4151_4152.C442.gene155.dna; Position on contig= 126612..127670bp; Strand=+
atgattgatacagttgctttacagcgggcacttgataattggctgcttttctctccctgtctgggggttaatgtcactctgtctgattcccttggtaataattggcatagtgctagcgggtttgaacagtttgaaaataaaacggaaatgaaagcattacagcaatgttatatctatagcattaccaaaacatttacggcgatccgaatactgcaattagttgaacaagaaaaactggcattggattcacgattgacggaaatccttggtcattgtgggctcgatccggctatcacgatcagacagcttttgaatcataccgcgggagtccctaattacaccgagttcgatggatatgatgcggcaacgaaagcgagtccggggactccttggagctatgactatacgctggcgttgagtggtgaaaaaggcatgaaattctctccgggggaagggtgggattacagtaataccgggtacatgctattagttaaagtgattaaggtggtgacgggagaatcatttcaaaaaaatattaatgacggcatcatcttgccgttagaactgactaagacatatgtcgccagtgatattgatcgtggcaccgttattccgggttttagccgttggcttaataataatgatgtgatggaaaatataacgggaatatatcatcctcactggtgcaagacagagttgatggtttcaacgaccaaagagatatgtcaggtgtatcaagcactgtttcaagggaaaatcctcagccctgctttattagcggaaatgtgtaaacccatttcgattggcagaagtgctggccttttttatcgtaagccaagttatggaatggggttaatgatcgatcctgaatggggacacggagggttgttcggtcacggtggtgaagggccgggatttaacacatgggcactttatctgccggattatcaggggcgcgccctggcaatatgcattttttgcaataccagtatggcaggacagcctgtttatttagtgaaagattttttgcgcgtactcggcgcaccattcgctgaataa

SEQ ID NO: 4369 - DNA, 123 bp, Xenorhabdus bovienii
  Coding sequence Name=Xb4151_4152.C442.gene156.dna; Position on contig= 127836..127958bp; Strand=-
atgcaagaggaagcaaaaaaggaagatcgcagaaaagcgagagttttcgtcggtattgtcattacccgggagtttaaaaaagtggagaaagattggcttgagctactgtcttggttgaattag

SEQ ID NO: 4370 - DNA, 1380 bp, Xenorhabdus bovienii
  Coding sequence Name=Xb4151_4152.C442.gene157.dna; Position on contig= 128003..129382bp; Strand=+
atgtttaaaattctagatcaaattcgcaagccgacgctggatcttccggtcgaagagcgccgcaaaatgtggtttaagcccttcatacagtcctacttggtagtttttattggctatatggccatgtatctggtgcgtaaaaactttaacatcgcccaaaacgacatgatctccacttatggactgtcgatgacggagctgggcttgatcgggctggggttctctatcacttacggggtcggcaaaaccgtagtgtcttattatgccgatagcaaaaataccaaacaattccttccctttatgctgatcttgtctggccttgccatgatcggtttcagtatgagtatgggcagttccaacatcagcgttttcctgatggtggcgtgttatgccctcagtggctttttccaaagtattggcgggcctgccagctattccaccattactaaatggactccccgtaataaacgcggaacctaccttggcctctggaatatgtcacacaacgtaggaggggcaggggctgccggggtcgcactatttggtgctaattacctgtttgatggccatgtgatagggatgtttgtttttccttctattattgccctaattattggttttattggtttacgctacggcagtgattcgccagaaagctatggcttgggcaaagtcgaagaattatttgatgaagccgtcagcgaagaagatatcgcggcagaagaaaatcaaatgaccaaacgcgagatctttgttgaatacgtactgaaaaacaaagtgatttggttactctgcttcgccaatattttcctttatgtcgtacgcatcggtattgaccaatggtcaaccgtgtatgcgtatcaggaattgggtcattcaaaagaaaccgcgatttccggttttactttgtttgaagttggggcgctggtaggtacgttgatgtggggatacctgtcagacttagccaatggtcgtcgtgcgctggttgcctgtgtttctctgggcttaattattgtctgtcttgaattctaccaacatgccaccagtgagttcatgtatttgtcctctctgttcgtactcggtttcttggtatttggcccacaattgctgatcggcgtggctgctgttggttttgtaccgaaaaaagcgatcagtgtggccgatggggttaaggggacttttgcttacttaatcggtgatagctttgccaaacttggcttgggcatgattgctgatggcgttcccatctttggtttaaccggctggaaaggtacctttgttgcactggatgcttcggcatttatctgtatcggcttgcttgcttttgttgtcattgcggaagagaaaaaaatccgaaaagcaaaaaaaagcagtcgataa

SEQ ID NO: 4371 - DNA, 630 bp, Xenorhabdus bovienii
  Coding sequence Name=Xb4151_4152.C442.gene158.dna; Position on contig= 129522..130151bp; Strand=+
atgattaaagtagcattggtcgatgatcatgttgtggtacgttctggtttcgcccaattaatgagtttagaatccgatatcgaaatcgtcggcgaattcagttcatgtgctgaagccagacatgggctgccaggctcaggagcaacggtttgtattcttgatatttcgatgccagatgagagcggactttcattgctgcaagatctcccttccggtattcactgcattatgctcagtgttcatgattctgtcactatggtagaaaatgcattgaaagcgggggctcgtggttatctcagcaaacgctgtagtccggatgagctgcttcaggcagtgcgtacgacggcaaataatggctgttatctcacgccggatattgcgctgaaactggcgtcatcaaaaaatagtcagacttcattagatcacttgaccaagcgagagcgacaagtgggtgaaatgcttgccagaggcatggatgtcaaggttgtagcggccgagttgggattgagtcataagacagtgcatgttcatcgcgctaatgtgatgagtaaattgggggtaacaaataacgtgggtttagtgaattattttacgactagtgatctcgaccctgttcaccattttgtgtaa

SEQ ID NO: 4372 - DNA, 369 bp, Xenorhabdus bovienii
  Coding sequence Name=Xb4151_4152.C442.gene159.dna; Position on contig= 130239..130607bp; Strand=-
atggaaaaagcgggaaagacaatcgaacagattttacattggtcagactggcgacgacggcatcaataccgggcacaacaatgtcactgtcgcggtcggggaaatgatcggcttacagagcttaaaaatcgcgggctgaatgatatcctcatcgcttgcgttgatgggctgaaaggtttcccggacgcaataaatgccgtttattcagaaacgcgcatccagttgtctattgtccacatgctccgtaataatctgcggttcgtggccgggaaagataacaaagcggtcacacgcgatctgaaaacgatttatcaggttccgacagaagacgcagcgcttcaagccttggacgcgttcagtgaaacctga

SEQ ID NO: 4373 - DNA, 237 bp, Xenorhabdus bovienii
  Coding sequence Name=Xb4151_4152.C442.gene160.dna; Position on contig= 130952..131188bp; Strand=+
atgttaagtaatagagctgcaagacggttgttgggtatgcctcataaattgagtaattccaagcgtaaggtaataatttctcttcttaatctcacttccagtgatagtaaacatcaaatcccagaacaactgagacattcttcttttgtctgtatgaaaaaagatgcttattcaggaaaaataacctatcacccaggaaatacattttatcctgaacatttgaataccagtcgataa

SEQ ID NO: 4374 - DNA, 1383 bp, Xenorhabdus bovienii
  Coding sequence Name=Xb4151_4152.C442.gene161.dna; Position on contig= 131338..132720bp; Strand=-
atgctaaaaattttcaatactctcagtcgccaaaaagaagaatttaagccgatccatgaaggaaaagtgggcatgtacgtgtgtggcatcacgatttatgatttgtgtcatatcggccacggtagaacttttgttgcatttgatgtcattgcccgttacctgcgctatctgggctatgatttaacctatgtccgtaatgtcactgacgtggatgacaaaatcatcaaacgtgccactgaaaataatgaaagttgtgatgcacttaccacacgtatgttgtccgagatgcacagcgattttgatgcgctgaatattcagcgtccagactcggagcctcgtgccactcagcatatatctgaaatcattcagatcactgaagagctgatcaaccgtggacacgcttatgttgcggataacggcgatgtgatgttctccattgatactaatcctgattatggtctgctttcacgtcaggatctggagcagttacaggcgggagcgcgagtcgaaattgctgatgtgaaacgtaacccaatggattttgtgctgtggaaaatgtctaagccgggtgagcctagctgggagtcgccgtggggtgttggtcgtccgggctggcatattgagtgttctgccatgaacggcaaacaactgggtcagcattttgatattcacggcggtggttctgatctgatgtttccacatcatgaaaatgaaattgcacagtctacctgtgctcatggtggcccttacgtgaattactggatgcattccggcatggtaatggtcgataaagaaaagatgtccaagtcattgagcaacttctttaccatccgagatgtactgggatattacgatgctgaaaccgtgcgctacttcctgctgtccggccactatcgcagccagttgaactatacggaagaaaatctgaaacaggcacgtaccgctcttgagcgcctgtacactgcattgcgtggcacggataaatcggctcagcctacgggtagcgaagcatttgaagcccgtttcactgaagcaatgaacgatgatttcaacacaccggaagcctattctgtattatttgacatagctcgtgagatcaactgcctgaaaactgaaaatctggcagcggcgaacggcctggctgctgaactgcgtaaactggcggggatactggggctgttggaacaggaacctgaacagttcttacaaggaggggctcatgtggatgatgacgttgcccaaatcgaagcattaatcaagcagcgtaacgatgcccgaacaaacaaagagtgggcgttggcagatgctgcgcgtgatcagttgaacgcgatgagaattgagttggaagatggcccacagggaacgacatggcgtcgcaaataa

SEQ ID NO: 4375 - DNA, 495 bp, Xenorhabdus bovienii
  Coding sequence Name=Xb4151_4152.C442.gene162.dna; Position on contig= 132995..133489bp; Strand=+
atggtgacttttcataccaactttggcgatgttgtgattaacactttcactgataaagcgcctgtaactgttgaaaacttcttgaattactgccgtgaaggtttctatgacaatacaattttccaccgtgttatcaatggcttcatgattcagggtggtggttttgaacccggtatgaagcagaaaacggttaaatcacctatccaaaacgaagccaataacggcctgaaaaacacccgtggcactctcgcaatggcacgtaccaatgatccacactctgcaactgcccagttcttcatcaatgttgttgataacgattttctgaatttccgttcagaacgtccagacggatggggttactgcgtatttgccgaagtggtagaaggtatggatgtggttgataaaatcaagggcgtttccactggccgcagcggtatgcaccaagatgtaccaaacgaagatgtgatcgttgaacgtgtcactatcagcgagtaa

SEQ ID NO: 4376 - DNA, 723 bp, Xenorhabdus bovienii
  Coding sequence Name=Xb4151_4152.C442.gene163.dna; Position on contig= 133501..134223bp; Strand=+
atgtgtacgctgtttattgcagatcttcatctcaatgagcaagaaccggcaattactgccggttttctgcgttttttgcgtgaagatgttatttatgccgagagtttatatatcctcggtgatttttttgattactggattggcgatgatgaccccaattccctgcacagtgaaattgcccaagcactcaacgagctgaaacaaaaaggtatttcctgctatttcattcatggtaatcgtgatttcctgcttggctcccgatttgccagagagagcggtctgatcctgttgccacaggaaaaggtgctggaattatacggtaagcgtattctgatcctgcatggcgacacgctgtgtacagatgatacaggttaccagcagtatcgtaagcgggtacacacgccgtggatacaacggctgtttttacttcttcctttgtttatccgactgaaaatcgcagccaaaatgcgtgcaggaagccaatacgccaacagccagaaatctgaatcgatcatggacgtcaatcaacaggcggtgattgagcattttgaaaagtatcaggttgattggatgatccacggccatactcaccgtcctgcaatacatgatattcaaatcacggataaaaccgtacatcgcggtgttctgggcgcatggcatcatcaaggttcaatgttcaaagtgacgaaaacgtcgattgaactgatgtttttccccttctga

SEQ ID NO: 4377 - DNA, 252 bp, Xenorhabdus bovienii
  Coding sequence Name=Xb4151_4152.C442.gene164.dna; Position on contig= 134177..134428bp; Strand=-
atggcgattttggcgtggtgttgcattgaagttgcagaaatagcggttgcgggatcagggcgggccgtcataactcagatgctcctgtattgggtgtccagcagaacgaatatatatgaggaggcggatcatatcatgagaatggtacaaggaaaacgtttgcgttgtttgatttatcgatttttacagaaattctcaacagggatcagaaggggaaaaacatcagttcaatcgacgttttcgtcactttga

SEQ ID NO: 4378 - DNA, 546 bp, Xenorhabdus bovienii
  Coding sequence Name=Xb4151_4152.C442.gene165.dna; Position on contig= 134358..134903bp; Strand=+
atgacggcccgccctgatcccgcaaccgctatttctgcaacttcaatgcaacaccacgccaaaatcgccattgtcatgggttcaaaaagtgactgggcgacaatgcaacatgccgctgatattttgacgtcactcgatattccctttcacgttgagatcgtttcggcacaccgaactccggataaactttttcattttgccgagaaagccaaagaaaacggttatgacgtgattatcgcaggtgcaggcggggcagcgcatctgccaggtatgctggcagccaaaacattggttccggtctttggtgtccctgtgcaaagtgctgcactcagcggagtcgatagtctctactccatcgtacagatgccaaaaggcatccccgttggtacgctggctatcggaaaagccggggcagcaaatgcggcgttactggcagcgcaagtgctggcattacatgatggtatgctgtttcagcgtttgtcagactggcgttcagcacaaacacaagatgttttgaataatcctgatccacgggaggacgcatga

SEQ ID NO: 4379 - DNA, 1068 bp, Xenorhabdus bovienii
  Coding sequence Name=Xb4151_4152.C442.gene166.dna; Position on contig= 134900..135967bp; Strand=+
atgaaaccagtctgcgtattgggtaatggtcagttgggtcggatgctccgtcaggcaggcgagccattggggatcgctgtctatccgattgggctggatgccgagcctgaatcagtaccataccaaagcagcgtcatcaccgcagaaattgaacgctggcccgaaaccgcattaacccgcgaactcgcccatcataaggctttcatcaaccgtgatatttttcctctgttggcggatcgcctgccacaaaaacagctcatggatagtttgggtttggcaacggcaccgtggcgattactttccgaccccagccaatggccgcaactgtttgcggagttaggtgattttgttatcgtcaagcgccgtaccggcggctacgatggacgtggtcaatggcgcattcgaccgggtgatgaagcggaattacctgccgaaatttacggtgaatgtattgtggaacaaggcattccgttttcaggcgaagtttcactggttggtgcccgcaatgtgcaaggccaatccgtgttttatacactgacccataatctgcatcaggaaggtattctacgcaccagcgttgccttaccaaatgcgggtaatcagttgcagcaacaggcagagaagatgctgtctgccctcatggatcacctgaattatgtcggtgtcatggcgatggaatgttttattgttggcgataacttattaatcaacgaactggcgccccgggtacacaatagcggtcactggacacaaaatggcgcttccatcagccaatttgaactgcatcttcgtgcaatccttgatctcccgatgcctcagccagaaataatggcgctatcggtgatggttaatctgatcggtacggaactcaatccagaatggctcggtttgcctctggtacatttgcattggtatgaaaaggaagtccgcccagtgcgcaaagttgggcacctaaacctgactcacgcagacaaacacgcattgcaaacaacgttacaggcgttgatccttctactacctgcggagtaccaaagcggtttggaatgggcaaaaattaaattgaattga

SEQ ID NO: 4380 - DNA, 252 bp, Xenorhabdus bovienii
  Coding sequence Name=Xb4151_4152.C442.gene167.dna; Position on contig= 136055..136306bp; Strand=-
atgcggttaacgatatttatcaactatattaagtatttcttcctgaaaggttttattggtcttgatggttgtagtttaactattaatggcattgatgaagagaataaaaccgtagccttgaacctgattccagaaacattaagaatgaccaatttcaacaagatcaaagcgggtgatctcctcaataatgaaatcgaccaaatgacaagaaccactgtagatacactatccagaacgttattgaagaaataa

SEQ ID NO: 4381 - DNA, 189 bp, Xenorhabdus bovienii
  Coding sequence Name=Xb4151_4152.C442.gene168.dna; Position on contig= 136465..136653bp; Strand=+
atgctgccgcaaaagatggggagaagtggcgtgttcttcgcctgctggacggtaacggagaaacgatatctttattccaattttattgtgaaagagactacactttttaatattgattggtttttactcattaatggaattggactaacacggcaaaaaacaaacaacctgatgggagagaccttatga

SEQ ID NO: 4382 - DNA, 1041 bp, Xenorhabdus bovienii
  Coding sequence Name=Xb4151_4152.C442.gene169.dna; Position on contig= 136650..137690bp; Strand=+
atgaaagcacttgtttatcatggcacaggcaaaaagcagtgggaaacaaaatcccctcctcaacttattgagtcaaccgatgcaatcgtccgcattatcaaaaccaccatttgcggaacagatctacatatcctcaaaggggatgttccaactgtggatgcagggcgaacattgggtcatgaagggattgggatagtcgaatccgttggagaatctgtccgtaatatcaaagtgggtgataaagtaattatttcctgcatcaccgtttgtggtcgttgtcgttattgtaaacgccagctttattcccattgtgaagatggcggttggatacttggacataagatcgatggcacgcagagtgaaaaagtgcgtattccccatgcagataacagcctacatcgtctgccggaaggcattgatgaagaggcggcattaatgctcagtgacatcctgcctacgggtcttgagattggtgtcatcaatggcaaggttcaaccgggcaataccatcgccttgatcggcgcaggccctgtagggctttctgcgttactggcatcccagttctattcacccgcccatatcatcatgattgataccgatgataaccgccttcatgttgcacaacagtttggtgctgacacagtcatcaaccccacacatcaaaatgtggtggaagtcatccaaaagctgactgatgggattggtgtcgatgtcgcaattgagtgcgttggtatccctgcaacattcaagatctgccaagatatcattactgctggtggatatatcgctaacgttggtgttcatggaaaatcagttgaattgcacttagaagatctttggatcaagaacatcactatcacgacaggattagtgaacacaagcagcacaccgatgctgttgaaaagcctccaatccggcaaaatttcacccgaaaagctggtcactcatcgctattcgctaagtgaaattaaaaccgcctatgaagtttttggtaacgctgagaaggaaaaagcactgaaaattgttcttaccgcagagtaa

SEQ ID NO: 4383 - DNA, 234 bp, Xenorhabdus bovienii
  Coding sequence Name=Xb4151_4152.C442.gene170.dna; Position on contig= 137677..137910bp; Strand=-
atgacctgttcttcccttaatgcaacagaaccggatgatcaccttcatcaattccatatttatggcaaaaattacggaatctcctattctggcgggattgcctttccgtataatccttacaaaatcacgcctgatgactttgaatttgatgtcggtgatcgttttacttatgaatacaacttttatgtccaaattgcgttataccttatcatccctttatttactctgcggtaa

SEQ ID NO: 4384 - DNA, 108 bp, Xenorhabdus bovienii
  Coding sequence Name=Xb4151_4152.C442.gene171.dna; Position on contig= 137987..138094bp; Strand=-
atgatcttgctcaataagattattgaggtatttgctctgccatcatctcttcgagattgcccaggctcaaagtataagcgaggtacccgcgaatacactgagcagtga

SEQ ID NO: 4385 - DNA, 324 bp, Xenorhabdus bovienii
  Coding sequence Name=Xb4151_4152.C442.gene172.dna; Position on contig= 138122..138445bp; Strand=+
atgttaggctttattaaaaaaggcgagtgccttctttgcgaaagaactgctgtaagatgtgggttcattaaagaacaggcagagccatttcccattcaccaattatgtcgatttatgcctggcaggcaaaatccattcggttactttctgatgaacaacgagaatgacaccgaaaggcaaccgcgctatttaaagacccctgagggttggtcatatctggcgatagtgatggatttgtattctcgccggctagtgggatgggatatgtcaacggagacagatacgacactgattagtcaggcgttgatgaaagcgtatcactga

SEQ ID NO: 4386 - DNA, 252 bp, Xenorhabdus bovienii
  Coding sequence Name=Xb4151_4152.C442.gene173.dna; Position on contig= 138706..138957bp; Strand=+
atggatagaaataaatggaaaaaggttgttggttggtttcgtgaaaagatccagaataatttctgggcaaaatggggctacattccgataattatgttttatcctaattcactcaaattctggttccgtgaatatgccccggaatttttgccgaactttgtaactgatattattttctcaatccctattgtttttgctgtaatttatatcccactgttattaattgattatctggaaaaaacaagaaagtga

SEQ ID NO: 4387 - DNA, 225 bp, Xenorhabdus bovienii
  Coding sequence Name=Xb4151_4152.C442.gene174.dna; Position on contig= 138961..139185bp; Strand=-
atggaagctcgggctgctgctcccagaacgaccgaggaaatctgggactcaatcattaaatcagtagacgaaattgacgtactgacgcaactgatgattggattgaagaaagatatcaaggacgacaacggcagatcttgctgcatgagtgacatagctctttactcaaccaagcagagagctggcaatcggatactgggatcaggcggagttaccacgaggtga

SEQ ID NO: 4388 - DNA, 363 bp, Xenorhabdus bovienii
  Coding sequence Name=Xb4151_4152.C442.gene175.dna; Position on contig= 139119..139481bp; Strand=-
atggaagatctgagcctcaaacagcagcaagagctgattgcggtctgtgccgcaaacccggcggtctgcaaggaaaaatacggcgatatcccggctaacggtattctggtacgtcaagccatcgatcgtgtactgggtgatgatgtgccttcacggatgaaaaatgacatgtcttccctgttggctcagcagattgaagccgaaggtgtggtaagtcgacctcgcaggggatcagtaaacggagtgacaattatttgcggaggacatatgaactcacgacaacgttataagttgagatggaagctcgggctgctgctcccagaacgaccgaggaaatctgggactcaatcattaaatcagtag

SEQ ID NO: 4389 - DNA, 198 bp, Xenorhabdus bovienii
  Coding sequence Name=Xb4151_4152.C442.gene176.dna; Position on contig= 139411..139608bp; Strand=+
ttgcagaccgccgggtttgcggcacagaccgcaatcagctcttgctgctgtttgaggctcagatcttccatttctttcacgatttgcttgcagtcgccacgcgcctcacactctttggctttcgctgcaaagtcatcgatttgcttcgcagtcaaaaagttattctcaacagcatcccagttggcatttaaagggtaa

SEQ ID NO: 4390 - DNA, 366 bp, Xenorhabdus bovienii
  Coding sequence Name=Xb4151_4152.C442.gene177.dna; Position on contig= 139748..140113bp; Strand=-
atgaaaaaagaattatttagtcagtttgatatgggtttaggcttagatttaattatcgtgtcatattttgaacgaatgtatgaggatggtaaatttttagatgctatagagctactatcaaaaaaatggacattaagtgttgatggggcttattgtaattttccggacatggacagttatgatgaaactgagcattttgaaggtgttgaatttgctattgggtatcctccaacagaagaagagagggtcattgtgactgaagaaacttgttaccattacgtcagattagcctgtgaaaagtatcttcaactacacccggaagataaagacaagctaagtatcttactagatcaactgccctgttaa

SEQ ID NO: 4391 - DNA, 312 bp, Xenorhabdus bovienii
  Coding sequence Name=Xb4151_4152.C442.gene178.dna; Position on contig= 140122..140433bp; Strand=-
gtgaagatattgagtgaggctcccactaaagtaccaggaattacagaaatcaaatatcaagtacccacaaaagatcgagcaggaaatcttactggggaatataagccagcaattcaaacaaaaactgtttatgaccctaaagtttttactgatcaaaaaattttagaattgggtcagcaagcttctacaaaaggttataaagatgctatggctagtagtaatgggcaagctactgctgttgttgatggggttagtttcagaatatatgtcgataaaacaacaggaagagtaaaaaattttcatcctaattga

SEQ ID NO: 4392 - DNA, 573 bp, Xenorhabdus bovienii
  Coding sequence Name=Xb4151_4152.C442.gene179.dna; Position on contig= 140491..141063bp; Strand=-
atgacctccgataagctcgaatcgcaactttaccccgcgcgtaccaatcccgtcatgacggatatccctgagccggttttagcgggtgagcccgttgtacgcaagcggtcacgccgcccgaattttccgctcgcgtttaaaatctctctggctgaaaaatcactgcaacctggcgccaatgtagcacaactggcgcgtgaacatggcatcaacgacaacctgttgtttaactggcgtaacctttataaacgcggacttctgagctcccggaatgacagttcatggctcctgccggttacgctggctgaaatcactgtgcctgttgagcagccggtccccgccatgcagcaacccgcagccaaggagccctgttgtgaactggcgcttccctccggaatattgcgcatccggggtgagcgggcggccatcctgtactcattaatcggctcctgtcgtcttaatggtgtagaaccggaggcgtggttgcggtacaccatcagccatatagctgactggccatcaaacaaggtacacgagctgcttccctggaaattcagccttaccaacatctaa

SEQ ID NO: 4393 - DNA, 849 bp, Xenorhabdus bovienii
  Coding sequence Name=Xb4151_4152.C442.gene180.dna; Position on contig= 141060..141908bp; Strand=-
atggccaatcaacaggttgaatacacgccccctatgaccctgattgaacatttatccgttgtgaaagaaacccgctctgatatcaaccgtcagtatgatctggttgatgttattttcctcgttgtcagtgccattatggctggtgccgagggctggcaagacattgagacttatggccgagccaaaattaagtggctgagagaataccgtacctttctccatgggataccccgtcgacataccattgcaagaatactgcaagctatcgagctggattctttactggaagctttactgaactgggttaatgaacagcgtgagcaggatggtaaatcggttatcgcctttgacggaaaagtcctgcgacgggcttaccggaatgaaaagaaaaacgctgtccagctggtcaccgcgtatgataccgaacggggattagtgctgagccagaaagccacggccacaaaaaatggtgaaatcagtgtcgtccgtcaaatgttggatatcctcaatctgaaaggcagtattgtgacacttgatgccctgcattgtcagcgtgaaaccctgcaaaaaatcagtgaaaagaaagcccacgtcgttgttcaggtgaagaaaaaccagccccgtctgtgggatgccgttcagtctcagtttcagtttcagtgtgtgtttgatgcaggaaaagaaaaaattatcactgaaattaaacaagaagcgcatggtcgccgggaagaacgttatgtgtttcaactcaagccgcaatttacccctgatatagcggaaaggtggccgaccatctctttgttcgcttcagaaggcagggaattagctggccgttgcctgataatatga

SEQ ID NO: 4394 - DNA, 366 bp, Xenorhabdus bovienii; identical to SEQ ID NO: 1400
  Coding sequence Name=Xb4151_4152.C442.gene181.dna; Position on contig= 141908..142273bp; Strand=-

SEQ ID NO: 4395 - DNA, 276 bp, Xenorhabdus bovienii
  Coding sequence Name=Xb4151_4152.C442.gene182.dna; Position on contig= 142327..142602bp; Strand=-
atggcattagttgaagtgaagtgtcggttttgtggccaaaccacgcctgttaaaaaacacggtaaaggagaaggtgggcatcaacgatattattgccagtcctgtcgtagaaccttccagctcgaatacacttaccgggcttgccattcgggtatgaaagagcaaatcgtcgagcttgccatgaataacgccggtattcgtgatacggcacgggcacttcatgtcagcattaacgctgttgtacgcactttaaaaaactcgcgctgcgatgtgtaa

SEQ ID NO: 4396 - DNA, 1038 bp, Xenorhabdus bovienii; identical to SEQ ID NO: 3193
  Coding sequence Name=Xb4151_4152.C442.gene183.dna; Position on contig= 142900..143937bp; Strand=-

SEQ ID NO: 4397 - DNA, 303 bp, Xenorhabdus bovienii
  Coding sequence Name=Xb4151_4152.C442.gene184.dna; Position on contig= 144062..144364bp; Strand=+
ttggttcagccactggccagtgatcgcagtctcttttctcttgcacatggtgcggggcggaaatggatgcgtggtgagtgtaaagcacgtttaaccgggcgttacaatgcagaacagctctctcgtacagcatttggcagtcgtgtgatttgcctggataaacaactgatttttcaggaagctccagaggcttataaacctataggcggcgtgatggatgctatgctgcaatcggggctggtgaaattgatagcgcggcttaagccggttctgacatataaaacgcggggtaacaaggaatga

SEQ ID NO: 4398 - DNA, 618 bp, Xenorhabdus bovienii
  Coding sequence Name=Xb4151_4152.C442.gene185.dna; Position on contig= 144361..144978bp; Strand=+
atgatattgttgcagatttccgctgctcaggggccagatgaatgtgcgctggccgtcagaaaggctttggaacggttgatcgatgaagccgacgaattaggtattatggtcaatatattggagaaagagtcagggaggcgttctcgtacattacgttctgtgatggttgctattcagggcgaaaatgaacagcagttttttgagcgctgggacggaaccatcaaatggatttgtgcaagcccgtggcgaaaaggagacggccgtaaaaactggtttattggtgtggcgcagtttaagcctttacagcaaataatggaaagtgaaatacgttttgaaacattgagagcctcaggtcctggtgggcaacatgtcaacaaaacagaatcagcaattcgggcagtgcatattgctagtggaattagtgtcaaggtacagtcagagcgcagccaacatgctaatcggcggcttgcctgtttgttattggagcatcggctacagcagcaacaggatatgcatcaggcccaacttaaggctgaacgacgtttgtttcacaatcaaatagaaaggggtaatcctgtacgtacctttgcaggtatgcagtttagtccgcaaatttga

SEQ ID NO: 4399 - DNA, 372 bp, Xenorhabdus bovienii
  Coding sequence Name=Xb4151_4152.C442.gene186.dna; Position on contig= 145022..145393bp; Strand=-
atgaaacgtcttttactaccacttttccttgtcccattcttctcttatgccgcacatatgaatgcagataaaacagcggaaacctattgtgatttatttggaaaagcctctgtagaagcattcaaaactaatgcttcaccagatgctatagctcaaaaaacctttaatgagttgaacaagaagggattcgatcttaaggaaatccatagcaacaaggatgaactgatttcctctgtcaaacaaacagtcatagaagtcagaaagaataaacaggtatttccgagccataaacattttgacgaatcattagataagtccgtcaagacctgcaaggctcaaataaaagataccttatctcaaagtactcaataa

SEQ ID NO: 4400 - DNA, 483 bp, Xenorhabdus bovienii
  Coding sequence Name=Xb4151_4152.C442.gene187.dna; Position on contig= 145504..145986bp; Strand=-
atgtatttgtgtaaaatactaaaaattgctgttatccctgctctactcgttctatcactatcaaccccggctctcgcaaaagacgcagcattgattaatttacctgataagagatttgccgtcatatccgttagcgatctggaaagtagatcaatcggcagctactctatcgctgttttcaaagatcgggatctgacggaattcgaaaccggagctgttttttcccgtgatggttcggtgttcgaagataacaataagccaagagtgacatttgcagatattaacggtgatggcgtcaaagagttgattgtgtacaaacttacggcaggctctgggaattatcttgaagttgatgcactcaagataacagataaaaatgtcagattcctcgcccgaatcaatacagatagtaaacatgacccaattcagttactccgcatcctgtgtaaaaaaggccagtgcacaggtcagctacaccattaa

SEQ ID NO: 4401 - DNA, 144 bp, Xenorhabdus bovienii
  Coding sequence Name=Xb4151_4152.C442.gene188.dna; Position on contig= 146336..146479bp; Strand=+
atgaaattaattgaaagccaaaaaatcaacgggagtggaaactcccgctttattaatctcaacatatatcaaactctacgtgctgtttttttcaattttttctacaaccttgttgtattctttccaaacaacggatactggtga

SEQ ID NO: 4402 - DNA, 192 bp, Xenorhabdus bovienii
  Coding sequence Name=Xb4151_4152.C442.gene189.dna; Position on contig= 146411..146602bp; Strand=-
atgttagagcgaaaaagaaaaaaccccgcagacaacattttgcctaaacgggtttatagaggaaaatcaaaatacgagtatcacccagcaacaggcggttcgatctctatctgttgtttaagttcaccagtatccgttgtttggaaagaatacaacaaggttgtagaaaaaattgaaaaaaacagcacgtag

SEQ ID NO: 4403 - DNA, 1425 bp, Xenorhabdus bovienii
  Coding sequence Name=Xb4151_4152.C442.gene190.dna; Position on contig= 147415..148839bp; Strand=+
atgctttgggactacgtattattatatttactccttggagttggcctttacttcacactgcgcactggtcttatacagcttcgtcattttggccacatgttttcagtcttgaaaaatagtaataagtcagatgattctggcatttcatcttttcaggctttatgtactagccttgcagcacgtgttggaacgggtaatctggcgggagttgcaattgcgattacggctggtgggcctggcgctattttttggatgtgggtagtcgcctttattggtatggcaacttcttttgtggaaagcacacttgcccagttgtacaagacgaaggacgatcaagggaattatcgtggcggccctgcctactatatggagaaagggttgaagaagcgatggatgggggtattgttttcagtcttccttattatcgcgtttggtcttgtatttaattctgttcaggcaaactcaattgcggaagcagctgcttttgcctttcatgtcaaacctatttatgtcggtattgtattagtcattatcagtggcgcgattattttcggcgggttgcgttcgattgcacgggttgcggaattaattgtaccatttatggctggtgcttatttgttactggcgttttgggttattggtcacaatattgagcgtattccagaagtatttgcattaattatcaaaagtgcctttggtcttcaggaagcgattgcgggaacattgggttatggcatttctcaggcgatgattcagggtgttcaaagggggctattctcgaatgaagcggggatgggttctgcaccaaacgcggcggcttccgcatctccatatccgccacatccagcctctcagggctatgtgcagatgctgggggtatttatggatacgattgttatctgtagtgcaaccgctgtcattatcctgtcttctggtattctcaatgaaaatgtgactgctatcagtggaattgaattgactcagcgggcattatcatcggctgttgggcattggggaacgacattcattgccattgcaattttctgttttgcttttacatcgattattgccaactatgcttatgctgaaagtaacatgatattcctggagcgtaaccacaccgcaggtttgtttatcctacgcttggctacgttaggcatggtgatgtttggttcgttggcagaagtgccattagtctggaatatggcgaacttatcgatggcatgtatggcgattgttaacttgattgctattcttttgctatcaggtattgcgataaagctggctaaggactacaaccagcagagaaaagcagggcagttgccgacattcgatatcaatatgtatccagaacttcagaaggaagttgaagaaggcatctgggataataagctatctcaggacagccaaaagtgtagtcattga

SEQ ID NO: 4404 - DNA, 129 bp, Xenorhabdus bovienii
  Coding sequence Name=Xb4151_4152.C442.gene191.dna; Position on contig= 148855..148983bp; Strand=-
atgtatacactcacctttcaaattgttgctttatttgtggctttcactcaccccagaaatatagctagctatattcctggggattcgcttcgctcatttaccaccgcgctgcaacatgcaatttattaa

SEQ ID NO: 4405 - DNA, 873 bp, Xenorhabdus bovienii
  Coding sequence Name=Xb4151_4152.C442.gene192.dna; Position on contig= 149006..149878bp; Strand=+
atgatgattctatttttcctccataatcactcatcaaaaatgataagaagattaagattaggtgcatgtattacgttgttgattggttgtagtcatcagcctcaacgggaagtcagaaatgattatatcgttgatcactcgtattcttattcgactaagcaaggtatcgattcagcccgatttcttgttttgcattatacggcattgaatgatcaaaattctttacagatattgaccggaggtaatgtcagtgcccattatctcatcccatcgcggccagaatatgagaataaagaacccgttatttttcagttggtttctgaaaatgaaaaggcctggcatgcagggacgagtggctggaggggatataagagtttaaatagtaattctattgggattgaaatcgttaattgtggttttaagcagcactttatcaaaaaagaatggtgcttataccacccatcacaaattgatgcattaatccgattggtaaaagatattattcagaggtatcaaattgaggctgtgaatgttgttggccatagtgatatcgcgccactcaggaaaaaagaccctggtcctgtttttccgtggcaagcactttatcaacaaggtattggtgcttggccggatctcataacggttaataaatatctggccaacagggtgccgagtatgcctgttcccgtcattggtatacagaaagcgttggctctttatggctactccatacctcagacaggtcatttggatgaagatactcataaaatcattcaggcgtttcagatgcacttccgtccatcagatatcagtggtgttcctgatgcggaaacggaagcgattgttttggcattagtcgaaaaatataaatga

SEQ ID NO: 4406 - DNA, 387 bp, Xenorhabdus bovienii
  Coding sequence Name=Xb4151_4152.C442.gene193.dna; Position on contig= 149989..150375bp; Strand=-
atgccacaagataaccacttagcacttgtatgcgcactgagtaaatggatcgaaaaccaccttggacgagttatccatcttgaagagcttgctgcttattctggctattcgctttggcacatgcagaaaatattcaaggaagtcacggaaatttcgcttgggaagtacatacgccaacggcggttggccggcgctgttcacctgctgagaaacagctccttgtctatttttgatattgccttagatttcggcttcggctctcaatctcatttcacctatatgttccgtaaagaatatggcattacaccttacgattttcgtcaaagtacagatatagaacttgaggttaagcttccattgcatttgacttataattgccagttatga

SEQ ID NO: 4407 - DNA, 162 bp, Xenorhabdus bovienii
  Coding sequence Name=Xb4151_4152.C442.gene194.dna; Position on contig= 150464..150625bp; Strand=-
atgctaataaatataaaaacagacacactgttattaaacatagcactaaaaaagttttttttatgttcaattgagtcaccttacaataatttcattgtagttagctttataataaaatattatagagagtttttatgtggaaaaattaaatttcacgtttga

SEQ ID NO: 4408 - DNA, 144 bp, Xenorhabdus bovienii
  Coding sequence Name=Xb4151_4152.C442.gene195.dna; Position on contig= 150650..150793bp; Strand=+
atgaagggtttgagttggggatctgttcaattactcgatacctgcctttttgatattcacctcaatcatcctcttgcaactatctgtgctaacatacgtttgcagtattcattcttgggaaatgatgttttaatattcatctga

SEQ ID NO: 4409 - DNA, 195 bp, Xenorhabdus bovienii
  Coding sequence Name=Xb4151_4152.C442.gene196.dna; Position on contig= 150956..151150bp; Strand=-
ttgaacctgaacagggcgagaaattctctcatttcccctaatttctgcgcgatttgtcgtgctcaaactaccttaacaattgtagctattgggttaagctctgattttagcgcaacatttaaactaaccccattaagctatcttatttatcactttgaacctagactgtgttcatacgaaagcaatagtttttaa

SEQ ID NO: 4410 - DNA, 1371 bp, Xenorhabdus bovienii
  Coding sequence Name=Xb4151_4152.C442.gene197.dna; Position on contig= 151210..152580bp; Strand=+
atggtagaacaagcagaacaatctacgcttaagcgtggtttaaagaacaggcatattcagcttattgccctcggtggtgcagtaggaacgggattgtttttggggattgctcaaaccataaaaatggctgggccttcggtacttctcggatatgccattggtggttttattgcatttctaattatgcgccaactgggtgaaatggttgtcgaagagcctgtcgctggctcgtttagccattttgcttataaatactggggtaattttgccggttttctgtctggctggaattactgggcaatgttcattcttgtcggaatggcagaattgacggcagtcggcatgtatattcattattggtggccggaaatcccaacatggatttccgctgcaatattctttgtgctgattaatgccattaacctgattaatgtccggttatatggtgaaacggaattctggttttctatcatcaaagttactgccattattggcatgattatctttggggcttatttgctcatcagcggcactggcgggccacaggctagtgtaaccaatttatggcagtatggcgggtttatgccaaacggggtttccggtctgattatggcgatggctgtgatcatgttttcatttggtgggctggaaatggtcgggattactgcggcagaagctgaagatcctgaaaaaaatattccaaaggcaactaatcaggtcgtttatcgaatcctgctgttttatattggttcattgtctattctgctttcgctttacccatggatgaatgtggtcgaaggcggcagcccatttgttttgattttcgatcacttggataacttttgggtgtctaatatcctgaatgtggttgtattaacggcggcattatctgtttataacagtggcgtgtactgtaacagccggatgctgtatggtttggcaaaacagggtaatgctcctcgcatcctgacaaaagttaatcagcgcagtgtacctgttttatcaataggattgtcagcattggcaacatctataggggtgctggttaactatattatgcccggaaaagcatttgaactgttgatggcgttggtagtgacaacgttggtcattaactggatcatgatctgtctggcacatctgaaattccgaactgcaaaaaatgcagaaggaattaagacgaagtttcaggcattttggtatccattcggtaactatttgtgcttaatattccttgcattcattctcgtcattattctgatgacaccggaaatacgtatctcagttatcctgatgccgttctggattggcatgttatggggaggctacttgttttccaaggctaaaaaggcaaaggtgcgagttatctaa

SEQ ID NO: 4411 - DNA, 141 bp, Xenorhabdus bovienii
  Coding sequence Name=Xb4151_4152.C442.gene198.dna; Position on contig= 152714..152854bp; Strand=+
atgtgtaccactcagtctaacttctccgttcagttatcttgtatcaccattgccagcgtagccagccaaaaagcatattcctgctattgtaggtcccggaaatataagttgactaaaatgacagcctgttatattcgataa

SEQ ID NO: 4412 - DNA, 105 bp, Xenorhabdus bovienii
  Coding sequence Name=Xb4151_4152.C442.gene199.dna; Position on contig= 153345..153449bp; Strand=+
atgtgtgcgttgggttcagcccctgaaaaaaatggcttgcgattatataaagagtatgtgataaaacacatgggtaaacgaagtattggttctgttaatgaataa

SEQ ID NO: 4413 - DNA, 210 bp, Xenorhabdus bovienii
  Coding sequence Name=Xb4151_4152.C442.gene200.dna; Position on contig= 153521..153730bp; Strand=+
atggcaaaaatcactggtattgtgaagtggttcaacgagtctaaaggttttggttttattactccagctgatggtagcaaagatgtatttgtacatttttctgcaattatgaacgatgggtttaaaacattgtctgaaggccaacaagttgagttcgaaattcagaatggtcctaaaggtcctgcggctgcaaacgtcacagctttatag

SEQ ID NO: 4414 - DNA, 156 bp, Xenorhabdus bovienii
  Coding sequence Name=Xb4151_4152.C442.gene201.dna; Position on contig= 153834..153989bp; Strand=-
atgatggtgactcctagcaccagccaaagaaaagccagtatcagaataggagataccatgacttccctacgctggcattatccagatcaggtaatacgggtacttctcagctcaatcaagaacgccccgagtcaaaataaaaaatcactctattag

SEQ ID NO: 4415 - DNA, 855 bp, Xenorhabdus bovienii
  Coding sequence Name=Xb4151_4152.C442.gene202.dna; Position on contig= 153931..154785bp; Strand=+
atggtatctcctattctgatactggcttttctttggctggtgctaggagtcaccatcatgagaattaattcattgaccatcgcaggaaccgatcctagcggtggtgccggcattcaggctgatttaaaaactttctccgcacttggagcctatggcacaacagtaataaccgctctggttgctcaaaatacaatgggagtccaatcagtttatgacattgatccccgctttgtcgctgagcagcttgaatcggtgctttctgatgtcagaatggatagcatcaagataggtatgttatccaatgttgctaatgtcaatgtagttgcagaagctctgaatcgttaccctgttccccatatcgtgttggatacggttatggtggctaagagtggtgatcccttattatccccagaagcaataactacgatggtagagcaactcttgccaaacgtctcactaattacgccaaatttgccagaagcggcggccatactgaaatgtaacattgccgaaacggaaggtgaaatgttgcagcaggggcgtgaactgttttcaatgggatgtcaggcggttttactgaaggggggacatctggttaatgaagaaagtccagattggctgtttactgttgaaggagagtggcgttttactgctcccagaatcaatacgcgacatactcatggcacaggttgtacgctctccgcagcgcttgcagcattacgtccccgttatcctgattggaaaaacacactgccagcggcgaaaacttatttgcagaatgcactggcgcaggcggatacactggatgttggaaagggaatagggccagtgcaccattttcatcaatggtggtag

SEQ ID NO: 4416 - DNA, 1377 bp, Xenorhabdus bovienii
  Coding sequence Name=Xb4151_4152.C442.gene203.dna; Position on contig= 155604..156980bp; Strand=-
atgtttactccagaattactgtctcctgccggctccttgaaaaacatgcgctatgcgtttgcttatggtgcagatgctatctatgccgggcagccccgttatagtctgcgtgtccgcaataacgaatttaatcatgaaactctggctcaggggattaaggaagcgcacgagttaggcaaacgtttttatgtggtcgtcaatattgctccccacaatgcaaagctgaaaacgttcatccgcgatttgaaacctgtcgttgaaatggagcctgatgcgttgattatgtccgatcctggcttaattatgatggtacgtgaagcatttcctgagatagatatccatctttcagttcaggccaatgccgttaactgggccacggttaagttctggaaacagatgggactgacacgcgttattctctcccgtgagctttcgctggaagaaattactgaaattcgtcagcaagttcctgatatggagcttgaagtttttgttcatggtgcactttgtatggcttattctggtcgctgtctgttatcaggctatatcaacaaacgtgatccaaatcagggtacatgcaccaatgcctgccgctgggaatacaatgtgcaggaaggcaaggaagataatgtcggtaatatcgttcatatgcatgatcctattccggtcaaaaaaatggagccgacacttgggcagggaacgccgacagacaaagttttcatgattgaagaagctaaacgcccaggcgaatatatgagtgcttttgaagatgagcatggcacttatatcatgaattcgaaagatcttcgtgcgattgagcatgtcgaaaaattggccagtataggggttcattcactgaaaatcgaaggacgcactaaatccttctattattgtgcccgtactgcacaaatgtatcgccgtgctattgatgatgccgctgctggcaagccttttgactccactctgatgaccacactggaaggtctggcacaccgtggttacacagaagggttcctgcggcgccatactcatgacgcgtaccagacttatgaatacggctattcaatgtcagatacccagcaatttgtcggcgaattcactggcaatcgtgtaaatggtctggctgaagttaccgtaaaaaataaatttctggtcggagatcaactggaactgatgacaccatcaggtaatatcaactttacgctggaatctatggcaaataaaaaaggccaggcaattgaagtagcacccggagatggtcatatcgtctatctgcccattcctgaagaaattattttgaactatacgctgcttatccgaaatttaaagggaaccaataccagaacaccacaaccaaaggaaatacaagaaaaataa

SEQ ID NO: 4417 - DNA, 123 bp, Xenorhabdus bovienii
  Coding sequence Name=Xb4151_4152.C442.gene204.dna; Position on contig= 156934..157056bp; Strand=+
atgtttttcaaggagccggcaggagacagtaattctggagtaaacatcattaataacgttctcgatctgagttcaaatcaggccttgtcattaaaagcaaggctacgggaacaagaattttaa

SEQ ID NO: 4418 - DNA, 162 bp, Xenorhabdus bovienii
  Coding sequence Name=Xb4151_4152.C442.gene205.dna; Position on contig= 157071..157232bp; Strand=+
atggcacaaatttattgtgggaatagatttgtgcttacagtcgatggaaaaggaaaaaacttggcttttgtgattatcgccggaagggttatgaaaagtcacttcggtttggaaataattaacagtggtattttgggtatcttttcgggagccgacagatga

SEQ ID NO: 4419 - DNA, 708 bp, Xenorhabdus bovienii
  Coding sequence Name=Xb4151_4152.C442.gene206.dna; Position on contig= 157360..158067bp; Strand=-
atgagtacacattctatacaatacaccattttaatcgttgaagacgagccaaaattagggcaactgctcattgattatctgcaagccgcagattatcagacacaatggctgatacgtggtgatgaagttattgcccatgttcagaaacgccaacctgatattatcctgcttgatatcatgctacccggccttgatgggatatcgatttgtcgcgaaattcgccggttttctgatgttcccattgtgatgatgaccgccagaacagaagaaattgaccggctactagggttggaaatcggtgccgatgattatatctgcaagccttatagcccaagggaaatggttgccagagtgaaaaccattttgcgccgttgctatcgtccacaagatatcatcagcgaacatggctccctgacaattgatgaaaatcattttcaagcacgctatcttgatcgcgttcttgagctgacgcctgttgaatttcgcttactgaagatcatgtccagccagccggggcgagtattctcccgcgatcaattgttaaataacctctatgatgatcaccgcattgttaatgatcgtactatcgacagccatatcaagaacttacgcagaaaactggaacaattagatgaggataagtccttcattcgttccatctatgggttaggctatcgttgggaagcggagatatgccgtttggtataa

SEQ ID NO: 4420 - DNA, 1446 bp, Xenorhabdus bovienii
  Coding sequence Name=Xb4151_4152.C442.gene207.dna; Position on contig= 158064..159509bp; Strand=-
atggcaccaccgccgtacgataaaatctcaggtggtaaaatcatcatgagacacatgataagaacaagtgtcagtggtaagctatttttggctattttcgcgacctgtatgctggtgctggtgacaatgcactgggggattcgcctcagcttccagcatagtttcattggttatatcaagcagaatagccaaatacgcgccaataaaatggcagaagcactgacagaacaataccagaaatatggtaattgggatttcctgcttcaaaacgatcggatgatctttcaactcattcgagccattgaacaaaacagtgatagccaccaaaacccgtcatcccgtggctggcgcagtcaattctgggtagttgacaataaaatgcttcgtctggtcggtcattcgggtaagatccctacggacacctatcggaaaccagtgatttatcaaaataatatcgtcggatgggtcattgtcagcacatcagacaaaatcactcgtcaagcggatatcagttttgaccaccagcagcaattaaccagttggattatcgctggtttttcaaccttgctggcgctgattgccacttttctcctgtcccgtggttttctaaagcccgttaaacggttggtagaaggaacacataaacttgctgcgggtgatttcagtgttcgggtgaagccatccagtacagatgagattggtcaattagcatcagactttaatcggcttgccagtacactggaaaaaaatgaacaaatgcgccgtgattatatggtggatatttctcatgaactgcgtactccgctttctgtgctgcgtggtgaactggaagctttgcaggatggcgttcgccaatcaacgccagagacaatccactcattactgacggaaatcaccacactgacaaagctggtggatgatttgcacttattatccctttgtgatcgtggttcgttagcctaccgacaggaactgaccaatgccaacgatctgctgcaaatcaccttagcctcttatcgtggacgttttgctgacaagcagatcacactggaactgaacttgacggaaaacgcaattttgttcgcagacccaggtcggctaacacagttattccaaaacttgctggaaaatagcctgcgctataccgctgctcccggaaacatcatcattcggacacatctcactccccaaaagtggatcctggattggcaggatagcgcacccggactgactgtcgaacagtgccaacagatttttaaacgtttttaccgctgtgagtcttcccgtaatcgcgccagtggtggttcaggtttggggctggctatctgttacaatatcgtcgaagcacacgatggcattatttatgctgaaagatcacctttaggcggtcttaaaattcacgtagaattaccgctggttgaactgcctgaatataaagcacaatga

SEQ ID NO: 4421 - DNA, 2967 bp, Xenorhabdus bovienii
  Coding sequence Name=Xb4151_4152.C442.gene208.dna; Position on contig= 159461..162427bp; Strand=-
atggactaccccttcatttcagttagtgcttacatgccaggcgcatcacctgaaaccatggcatcttccgttgctacaccactggaacgttcactcggtaagattgctggcgtgaaggagatgtcctccaacagttcgctaggtaacactaacattacgctggaattcgagcttagccgggatatcaatggcgccgcacgggatgtccaagcggcgatcaatgcagcagaaagcctgctgccttccggtatgccaagccggccaaggtactataaggcgaatctctctgattccccgattatgattttgactttaacgtcaactaatcatagtgtagggcaactgtatgatattgcctcaacctaccttgctcaaaagctttctcaagtagaaggtgtcagtaatgtgtctgtcggaggcggttctctgcctgcggtaaggattgaactgaatcccaatgccctgtttaatcagggtgtttcactcaatgatgtcagccaagccatcaacagtgccaatgcccaacgcccaacaggacatgtggattcagcgcaacagaactggcaagtacataccaatgacgaactgaagaacgcagacagttatcgttctattattgtgcattatcgtaatggttctcctgtgcgtttgcaggatgttgctaatatcaaggattccgtcgaaaatacccgagtagcaggaatgtccggaggtgagcccgccatcgtactggttattcgtcgtgaatcgggagccaatatcattgcaaccatagaccgaattcgtgctgaacttcctgttctgcgtgaatctattcctgccaatattcagtttaatattgcacaggagcgctcaccgaccattcgtgcctccctgcaagaagtgaaacagtcacttgccattgctgtcgctttagtgattctggtggtttttctgtttttgcgttcaggccgcgccaccctgattcccgcaattgcagtacctgtatcactcattggtacatttactgccatgtatttatgtggtttcagcctgaataacctttctttgatggcattgaccattgcgacaggatttgttgtcgatgatgccattgtggtactggaaaatatttcccgccatctggaggctgggttgaagcctgcccaagccgcactaaagggggtcagagaggttggattcacggttcttgccatgagtgtttcactcgtcgccgttttcattccgcttgtattgatcgatgaattactcggcaggatgttccgcgattttgctgtgacactcgcaacagctatcggaatttcactactgatttctcttaccttaaccccaatgatgtgcgcacacctgctcaaatcatcaccgcaaaaatcgcaaaaacgcattagaggttttagcaaggtactgttaaaaattcagcagggatatgggcgttctctgaaatgggtactcaatcatacccgctgggtactgctaacattaattggcatcgttgtgctgaatgtttggctctatatcaacatcccgaaaaccctttttcctcagcaagataccggacggattttgggattcgtcattgccgatgaaaacagttcattccagtccatgcgcgacaagatgaaacattttatgcaggtcattaatgccgatccaacggtcgaaaatgtggagggatttactgagagcagctcaggatttatgtttatagcactaaagccactaaaagagcgtactgaaagtatcgaaaaagtgatcatccgtttaaaagggaaactctcgaatgaagcgggtgcccaactgtatttgctccccattcaggaactcaaattgggtggacgcggcggagcgaaatcaatttatcagtttgcgttgttgtccgatgatcttggtgaactgcgcaaatgggaaccgattattcgaaaagcattggcgaaattgccccaattgactgatgttaattcggattatgaaaataaaggctcagaaatagccattatctatgatcgcgatctgatggctcgtttgggcattagtgtcaatgaagccaatgccttgcttagcaatgctttcggtcagcagtctatttccacaatttatctgccccgaaatcaatacaaagtggttatggaagtcgcacctgaatatacacaagatgccagctcgttggaaaaaatgtttgtaatcaatgccaagggtgaacgtattccactttcctattttgcccgctggcaacctgcgaatgcaccatcaggtgtttatcatcaggggctgtcagcctcctcgactatcgctttcaatgttgcagaaaactatacactgtcggatgcaatcagtgcgatagaacgaacaatgacagagttgagtgtcccttccgcagtacgcagctctttcgcaggcatagcccaagattttcagaaaactcagagctcacaattgtgggtgatcctcgcagctatcgtgaccgtttatctggttttaggggtactttatgagagttatatccaccctctgaccattctttcaactctgccttctgcgggtgttggcgctttacttgcactagagctgttcaacacaccatttagtctgatcgccatggttgggatcatgctgctaattggcattgtgaagaaaaatgccatcattatggtggattttgcccttgaagcgcagaaaagcggaaaattgagtgcacaagaagcgatacttcaggccagtttattgcgcttcaggccaattatgatgactaccctttcagcattattcggtgccttacctttagttctgaatagtggtgatggggctgaactgcgtcagcctctgggtattaccattgtcggggggctagtgatgagccagcttctcacattatataccacgcctgttgtatatctgttttttgaccgactgcgtaaaaaatggcaccaccgccgtacgataaaatctcaggtggtaaaatcatcatga

SEQ ID NO: 4422 - DNA, 3171 bp, Xenorhabdus bovienii
  Coding sequence Name=Xb4151_4152.C442.gene209.dna; Position on contig= 162541..165711bp; Strand=-
atgcattctgattctccaatgactggcggtggtccatctcgcctatttattctacgtccagttgctaccacgctgtttatgatagcaatactactggcagggatcatcggctaccggatgctgccagtttccgctttacctcaagtggattatcctactattcaggtggtgactctctaccccggagcaagtcccgatatcatgacgtctgtcgtaactgccccgctagaacgtcaattcgggaagatatccggcctgaaacagatgacatcacaaagttctgggggtgcctccgttataacactggtgttccagctttcgttgccattggatgtcgcagagcaggatgtacaggcagcgattaatgcagcgacgaatctattacccaatgacctgccttatccaccaatttacagcaaggtcaatccggctgatcctcccatcttgacgttggccgtcacttctgatgccctgccgatgattcaggtacaggatatggtagagacccgtattgcccagcgtatttctcaagtcggaggagttggcttggtgacactggctggtgggcagcgtccggctgtgcgcgtgaagtttaatgcacaggccatcgccgcacatggactaaacagcgaaaccattcgtaccacaataatgaatgcgaatgtaagttcagcaaaaggcagttttgatggcccgactcgctcagtgacgttaaccaccaatgatcaaatgaaatccatcgacgaataccgcaatttgatcgtggcctataaaaatggtgctcctattcgtctgcgtgatgtcgcgactattgaacgaggcgcggaaaataccaaattaggcgcttgggcaaatgagaaacccgccattgttatcaacgttcaacgtcagcctggtgccaatgtcatcgataccacggacaatatccgtgccatgctgccagagctgatcaacagtttgcccaaatcggttaacatggatattttgacagatcggactgtcactatccgtgcgtcggtacaagatgttcagtttgagttattattggccattgcactagtcgtgatggtgatttatgtgtttttacgtaatgcaacagcgaccttgattccaagcattgcagtgccactttctctggttggcacatttgccgtcatgtatttctgtggcttctctgtcaataacctcacgttgatggcattaaccatcgcagcaggtttcgttgtagatgatgcaattgttgtgatcgaaaatatctcccgctatatcgaacgaggagaaaaaccgatggctgctgccctgaaaggagcaggagaaatcggttttaccatcatatccttaacgttttcattaattgccgttctgatcccacttttgttcatgggagatattgtcggccggctgttccgagaattcgccattacacttgctgtcgccatcttaatttctgccgtggtatcacttacattaacgccaatgatgtgtgcacggatgctgaaagcagaagctgaaattaaacataaccgctttgaacaggccagtgaacacttctttgagcgaataattgcaatatatggcggatggctgaaacgggttctgaatcatccttggataactctcggagttgcattcagcacattggcattcaccgccctgctctatttaacgatcccaaaaggatttttcccattgcaggataacggcttgattcagggtacactggaagcgccacaatctatttcattcaatgccatgtcagataaacagagagaagttacggctctgctgctgcaagatcctgatgtggaaaatgtgacaacgttcattggtgttgatggcagcaactcaacgctgaatagtgggcgtctgcaaatcaccttaaaacctctcaatcagcgtgatatccgagttgatgagatcatcccgcgtctacaggctcgcgtcgctaacgtacctgacgtcaaactgtatctacaaccgacacaggatttaacgattgatacccaagttgcccgcacgcaatatcaatttacattgcaagggactgtctccaatgaccttaacatttgggttcccaaactacaggaagcactgaaacagcgccctgaattggtggatgttggtactgactggcagaatcgggggttagtggcttatatcaatgtcaatcgtgatatggccagtcgattaggtatttccatgactgccatagataatgcactgtacaacgcttttggccaacgtttgatttcaacaatttacacccaagctaaccaatatcgggtgatccttgagcaggatacacaaaatgaagcgggtatgaatgcattcaataatgttcacctgatcggaaccgataacaaggtagtgccactcagtacaattgccactgttgagcaacaattggggtatttatccatcaatcatctgcaacaatttcctgctgtcactttttcgttcaatgtcgcacaagaagcttcccttgaagcagcagttaatgcagtcaaagaaacagaacggtcgattgggatgccaaaaaacatcaatacgcaatttcaaggagcaacactggcgtttcaggatgcgcttggcaataccctatggctgattttggctgccgttatctccatgtatatcgtgcttggtattttgtacgaaagctttattcatcctgttacgatcctgtcaactttgcccactgccggcgtaggggcattgttagccctgatggtaggtggctatgagttggatattattgccattatcgggatcattttgctgattggtattgtgaagaagaatgccatcatgatgatcgactttgccctggcagcggaacgtgaaaaaggcatgtcgccttatgacgcgatttttcaggcttgccttctgcgtttcagacccattttgatgacgactatggctgcactgctgggagcattaccgttaatgctcagtacaggaatcggggcagagttacgccgtccattaggtatctgtatggtgggcggattgatcatgagccagatcctgacgctattcacaacgcctgttatttatctgttatttgaccgattagcgaattattttaaaaacaagcgccaaaacagactccagagtcagaatcaaagggaattagatcattcaccggttaatcatcaggagccgctgtga

SEQ ID NO: 4423 - DNA, 1242 bp, Xenorhabdus bovienii
  Coding sequence Name=Xb4151_4152.C442.gene210.dna; Position on contig= 165711..166952bp; Strand=-
atgaaaaataaacgtcgtacttactttttccaatttgcggtactagccgttgtcatcgcaacagcttatttcgcgtggaactacttcaaagcatccacaatatcagaagaaaaatctgctcaggcatcaaaatctctacaagatttaaaatatttgctacaaccgcctgtgcaagtagcaacagccaaaatacagtccgtcccccattatctgggaggactaggtactgttcaggcggccaataccgtcactgtcactagccttgttgctggtcaattaaccgccctgcattttgatgaaggtcagttcgtcaagcaaggcgatttattagcagaaatcgatccccgttcctttcaaatccaactggcaaaagtacaaggacaatatgccaaagatcaggcaacactagccaattcccgacaggatttagttcgctatcagcaattagcgaaaaacaaatcaatttcccaacaggatctagacaagcagatttctacagtgcgccagtatgaagccctcctgaaagccgatcagtcaagtattgatgatgcgagactgcaattgacttacagccggattacagctcccatttccggccgtgttggtctgaaaaaaattgatgttggcaattacatatctgccggtggaggaactccgctcgtgatcatcactcaggtcgatccgattgatgtgttgtttgctctgccggaaaacgatatcagcgcggtattgaaagcacagaaaaataataaggatgttgtcgtcaccgcctgggatcgcaataaccagcagcaattggcacaaggtaaattactcagtatcgataacctgattgatgtgactactggcacgattaaaatgaaagcacgattcgataaccaaaacaacgtgctgtttcccaatcaatttgtcaatattcagattaaggttaatacactggaaaatgccatcgttatcccgaatgccgcattacagatgagtagtgaggggcattatgtctggaaggtggacaaagaaaacaaagtcaacaagcgtaaagtcaccatcgggttacaaaatgctcaactggtagtcatcagcaaaggtttggcaacaggtgatcgggtcgttacggatggtactgacgcattaaccgaaggtactggtatcacgattgtcaaaccactaaaatcagaatctgccaatacttacgatcagatggataaatcaaagccatcaaacagtaaagtggagaatacttaa

SEQ ID NO: 4424 - DNA, 162 bp, Xenorhabdus bovienii
  Coding sequence Name=Xb4151_4152.C442.gene211.dna; Position on contig= 167417..167578bp; Strand=-
atggaattcaataaaaataatgttgtagctgatatcaaaaaaagtgcttttttcatcgtagttctcctgaaaaactcgctcactatttttacgccagcacaaaaccgtgaattaaaagatcatttatctattacctatccactatctctggttgagggctga

SEQ ID NO: 4425 - DNA, 1983 bp, Xenorhabdus bovienii
  Coding sequence Name=Xb4151_4152.C442.gene212.dna; Position on contig= 167523..169505bp; Strand=+
atgaaaaaagcactttttttgatatcagctacaacattatttttattgaattccattacaaatgcccatgcctatgacaatgtttatgtttttggtgatagtttgagtgatggtggaaatatcggtagattcacaacagatggagaaaattctgaattatacaatgaatatataactcgagaattaactggcaaaaagctaataccatctagacgtggcggaactaattatgcacaaggtggggcaactgccaatggttcactgaatccatcgcatttcctatttaatcccacaacaaaaaaacaaatcgacagttatttgaaggcacactctggaaaggctgattctaatggtctgtatatacattgggtgggcggtaataatattgatgaagcactcgataatgtcgcgaaaggcgataaatatacagcacaaaaaattatcaatgacagttctgcatccgcagcatcgcaggtcaataatcttattaaggccggagcaggtctggttattgtgcctaatgttcccgatattggcacaactccaaaaattatggaggaagtacttcaaggagcattagggaaaagtaaagtgtctgcaaaagaaatcaagcagattctgaaaaaagctcaccaagctatcaaccagtaccctacaccgaatattgctacccggcatcaaatcatcgaaggagtttttaaaaaaattgctgaagatgctgctcctaaaaatccaagcaaagctaaagaaatctataaccaactactcgatgcttataatcaaagtagcaaaattgcttcccaattttctgacgaatataaccagaaagaagaagaccagcttggtaatggtaatattcttcgtgccgatatcaaccacctcttacgggaagtgattgagaatccgaccatctatggtatttccaatacccttggttatggctgcacacaaggtggacttgccgcgttttgttcttcttccgatcccgactttgataaaagccaatcatacttgttttctgatagcttccatccaacaccttatgtacatctgatgataagtcagtacattatgtccatctataatgccccgttacaggtgatgacgttgaatcacatcaatcgagtacccgtcataagtgtcctaaattcacttgatggacacttgcaacaatttcgcaatggtcgtaatgcacaaggtaaaattggaatattcggcggttatacaggtaaccacaatagcactctcacattgggcagtgattatcaactgacaaatgacttgctattaggggcgacagtttcacgttatcgagatgaacaaagttcagcttctaatttcaattatgccgctactggtcatgtcgtaacggcttatgcactctggaactattataaccacggctggctgagtggcgatctccattattcacgcaccaactacgataacctgtcacgttccatccagcttggtcaagccacgcgtagagaaacaggctcaactaccggcaaacagtggggatggcgaatcacggctggctggaatatccctatcacccattacctgaccaccagtccaatcatccagtatgcttgggataaagggaatgttgatggctatcgtgaatccggtaacaatagcacctccatgcattttgaggatcaacactataactctaaagtgggttcagtcggctggcgagtggatactcaattaggccgcttcaatccttacgcttctatcctgttcagtcaccaattcgatgatgaatcttacatacttcgtagcgccattaattccactaaaacttccttcatacaacgggaggaaaagcaagatagaaaccgtttccaatataccgttggggtcaatgctaacctgaccaataattttcgggcatttgcagcgatatcacatgaaaaaagcgataagacatcaaatcataattatggtttcaacctcggtttcaatatcagcttttga

SEQ ID NO: 4426 - DNA, 99 bp, Xenorhabdus bovienii
  Coding sequence Name=Xb4151_4152.C442.gene213.dna; Position on contig= 169610..169708bp; Strand=-
atgctgggattcaaaaactttaggggggctcaggtcctgtttgccgtgatcgataccaataaggttatattatttattcatggcgatggcctcttgtaa

SEQ ID NO: 4427 - DNA, 3510 bp, Xenorhabdus bovienii
  Coding sequence Name=Xb4151_4152.C442.gene214.dna; Position on contig= 170005..173514bp; Strand=+
atgccatcatttgcgaaaaaaatcattgggacttttatttttatttatgccttattgataccttctacaataacgttcgctttagccaaagatgctataagacatgagacatcgcatccacattcaaaagaaacacagaataccccagaatttgatgcgcagaatttcattgtcaataatctccaaaccatgagtcaggtattatcttcttctccttcagagcttaagacgcaagcaacttcttatgcgttgggtaaacttaacagcaccatattatcagaaacacaaaaatggttatcacagtttggtacagtaagcattaattttggcttagacagggactggaaactgaaaaatcactcacttgatctcttattgccattgtacgataacaaagccgactggctgttcttttcccaattaggttatcgcaataaagacagcagaaatacgataaatatcggcttaggcgggcgttatttttatcagaattggatgtatgggctgaatacattttatgactatgatattactggtaaaaacaggcgtataggcttgggaagtgaaatatggggggattatattaaactctcagccaatgcttattatcgcttaagtgactggcaaaactcacgtaatttcgattattactacgagcgccctgctaatggctatgatattaatagcgaattttacctgcctttttaccctaatctgggtgccaaattaagctatgaaaaatattttggtgatagtgtcactttatttaatcgtgataccaaacagaaaaacccgagtctggcaaaaatgggtttgacttatactccaattccgctttttacaataggagtggattacagacagggggaaagcggtcgtagtgaaacccaacttttagtgaatctgaattatagatttggtataccaatcagcactcaactagatcataataatgtcgcttcaatgcggacattagcaggcagccgctatgatttggtagaacgaaataataatattgttttggaacataaaaaaatagaggaaatagaactactcgctgtcgaaccaattcttggttatgggcatcaggaaataaagatcagcgttcccgtccgaactcataaaaatattaaacaggctagttggaaagtggctgataaggcatttgagcaatataacggaaaactttcttctgatttaggaaaagacattacggttacactccctagctatcaagaagctcataaacaggattacatcctcgatatatccatcatggataatcaggaaagaattaaaaatacacatatgccaataaaaattttaccttttttgattgatggaaaagtaaaagttattccacctaaatctctagaatcaacagatgaggaaaaaaatggctataaatttactgatttagttattacttatcaaggtgtgattaaaggagaaattgttaaaaatggtaaaattgataatgtgcgctggatagtggaatcctctttaggtgatgaatctgaattaagttttgcatggaataatagaccagctcaaacaaatgaaaaaggtgaattaatcgatgaaaacaggaaaccaatatctaacattttagtcagtaaaaataaaaaccagaatgataaagtcaaagtgtatatacagttagatggtgcgacaaaacaagaaataggtgaagtgaattttgatcctgttaagcccgtaccagataaacctgaaaacattgaggtgaaatgccaggctcagggtgaaactccggtattagtgaacgagtcctatatatgtaaggcaatagtaacgggtgctaaaggtaaaagtgactatatcataggaaaaaaagtcaattggaaagtggaaggacacaataaacttcaaccgatacctgttatcgagcaaactaatgccgatggggaagccacggcaaccttaactagctctactgagctttcaggtcttgttgttatagcctctgttgatgatggtcaaccgacttataaatcaaataaaatcaattttagttggccagaaatcaccctagatccgctgtcgaaaagtacaactgatggggatgaggtggaacactataccgtgagagcaaccatcttgcgcgaaaaaggcggtaaagtatatacggggaatacagagaataaagggaaggacattaagttcgtatggaaggatctgaaacttgaaaatggtaataatgcctccggcgtgacttccaaaccatcaccgggtactcctcaatctgtagattcccagggtaaattggaaactcatattagcggaaataaagcgaataatgaacaggttaaagcgtgtattaatattgaaggtagagattctgcctcagatatatgttctgagctgataaattttgtgcaggattttaagattgatagtattgaagtgattaattttgatccggctagcccattgttgggagatggtaattcaaaatatcaatatagagcaaagattgttgattataaagataataccaaaataatagcgggtagaaaattcgaacctaaagatattagttggatacacgatcataacaaaatagaatcagcaaaacttccttctcctgaactttattcaccaacaaataaagatgtgtatacaacagatgataaaggatatttatatgcgacgttaaaaagttcggtcggcgttaaaaaagttaatatgacattaaaagtttccggagcaaagaatactaatgaggagcttacgacaacggcgggagttgaattcactccggtagccaaagtagcgctattatatgtttataatagaaatgataaaaaaatatataaatattttgataacaaagacaacttgaaccgtccaagtaatgtgtttgaatctttacgaggggagttaagagaccctaaaaatcctaaatctttttatgatgatccagacgtttctgaagttatttatagtatgaaatttaataaggacgaggcgccatatggaggtattacattaacttttggtgacaaagaacatggcccaattcaatttagagctatggggattgtagagatatattcaaacgtaacaatgcaaagtggcgaaattaaattatataaatataaaatagatatcaaaagtgtctcatcagttaataatcaaaaaggctatgtaagtgtaaatgggagtaatattgattgtggggttaacttaaagggaggaaggcaagatttgtattcagataaggaagcatctgatcctactaatccttattctatacataatgaatggggggaaactgaacggggagaaaggtacagtttatacgattggggactcttcgacgaagttaataatcacaacgctgaaaaagctactattatagtaaagagtaccagttctgctagtagtaaacgatttaggatttatgattctaaaaataatactttcgatcaacagtcagagggggttattttttgttatgatcactggttaaaatcaggtaaaaattaa

SEQ ID NO: 4428 - DNA, 1977 bp, Xenorhabdus bovienii
  Coding sequence Name=Xb4151_4152.C442.gene215.dna; Position on contig= 173865..175841bp; Strand=+
atggcagctattactagcacgaaaatttcaccactggcgaatgaattagaggtgggccagaaagtaacattttcagtaaaattaacatcgaataaacctattgataataacaagtatataatagtagaaagtggctacgttcaaaatataaaatttgataacttaaaagttctacttgtcgataaaaatgaaagtgggctttttaccgcaactgccgaatttgattttacggtgcttgataaaatcggaggagtaggggcgaatgtgaataataatgattctatttcatttacaatcaatactgatgcgaaatcggatgcaactgtatttccaaacatgccccacacgtacaatagtaaaattaaagttaagccagtaaatagcaataaaatagatatcacaattaataaaaatgccgatttagttataggtcagaaagtgagtttttttgtagaattaaactcagataatcctattttaccagcaggtaatataaccatagaaaaaattagttccaatataaagtttgatcaagatacgactaagactattccgatttatagccaagttggtaataaagtatctgcgaagttaagttttaccgtacttgatggtgtgtcaggtggagcatctgcacaagatggtgatgctattacatttgtaatccatactgatgcgttgacgtctgaaggtaatttcggttctgttccattcaatggcacagcaaacgaaattgatatggattcactggcactttttgttgagaacccttttctgcaaatgtcatcagaaagtgatcaacaacatcctacggcaatatatacttatttaaagaatagaaatacacagaaaccattggtgggaacacctgtatttattacatcacaaaagcgtaatcaaatagaagaatttaaatttaaggatggcgatgggaacaatcctataattcttgaggagaaagataatactaaaggattaattatcgcttctaaagatgatggtttagtaaagttctatctctatcctcaaacagcactggtaagtgttgttaatttatggagctatattataagttatacaacagatattagacgtgaagctaagcaagtaatctatgcagtgaactatattaagcctactttctttaattctataggtatgcctgatatttctggctatagtactgctggtatacgtgcagattcgatattaccatattttatggtatccgttagtggtgatcctagaatatcaaaaggtgatacggttttattttttgttaataaattaaactctacgaaagctcctaaatttactggctatacggagttgattgatgatcctaaaacacaattagatcggtatagtatgaaacttccttatacgatttttgaacagtctatatcgtcggaactttcttatactgttgttaagccggatggatcagctttatactctgacacattaccagtaacttatttaggaggaacaccatatgtacctgatcaagaagctaagagaagctatgagctttgcatagttcaccccagtactggtgttgatcctgatgtttttataccagctgataatgatattggttatgaaaatattaagaaatatcctcatcataaatatgatggattatttattgaaatagtacgtttaaaatctaacgatgctgcttcaaaattaaatccagttccattaaatataaaggatattactctgaatatgtatattaattcagataataaaaacttcactaaaccttataccaaacagattaatttggcagatataagtggccctggtaataaagactctattttctttcatattccatatgatgatattgttggtgttaagtggagagggaatatcagttttgattatcaattctttaaagatgaggttattcagtatagtgctgtttggaatggatatattggtaccgaaccgcttgatggttctaattaa

SEQ ID NO: 4429 - DNA, 1503 bp, Xenorhabdus bovienii
  Coding sequence Name=Xb4151_4152.C442.gene216.dna; Position on contig= 176089..177591bp; Strand=+
atgtctaatgttatgactttttcacagccagaaacggggaatttaatcatagggcaaacttttttatttacagtgatattatcctctgatgaggttatagatggcagttcaataatttcattttttaatactaaaaacatttctgtaccaattggagatgtttccgtaaatttggaaagtgacaataaaaaagccacggcaacagtgacgcttaccgtaagtaatttgatagcagaaaatgaggagattcattttagtgtaaaaacatcattaagtggtattcagcaaaaaaaattgcaatatcttgcaaaagaaatttatcctgaatcattgaggttgagcgttgataatgcttttttatcagtaccaacatcatatgatcattctcaaataggtactgtatcaactaaagtacacaccattatcaaagataaagatggtaatccattatcaggaattccgatctttataaagagtagagcatttaatcagctagaagaagtatatatttatgctaatgatgtaagaaataaaataaatgttcaaaacctttctctttattctggtttttctataaattcaggtgataaaggtcaggtggaattttatatttctccaattaaaccactggcattagttattgacttgtcttcaactataaggattccatccgattatgctatttctcatagtactgttttcatcatttttgataataagaaatataaccgacaagaacctgaagcggttactgctattgatggtgatttaacatcgaaaggagaaagtaaattttggctagatacaacaccatgtacagcttatgatgttgatgattttttattattcaatattaatggtgaatacaagtattatgtcagaggatttgatgtaattgaagacaatcaatgcttaattaaattaccttactttattcttgagaaaaataaattatcaaatctttcttatcttgtaataagagggaatggagatattatagctaaatcctatcctgtagatgttacttacagaggaaggacaaataaaccatggacagatgttgatagaatatatgaaccctgtaaggtttatactagctttaatgatgttatagagcaggatggtgatataaacaatcaaaaaatatctaaccatgcaaaaaatccagatgatgctggcttgtttgttacaataacaggaactaatgataatagtgataatactaaagtaaaactcggatcaaaagttactttaaatttatatattaattctaaaaacaaaacagtcacactaccttttaattgtataatgccatatcatccagataataaagatggaaaaacagcggtattaagatttaatatacgttataaattattaaatggtcattttgcatttcctttccatgacgggatgatatattttgattatcaggttggtgatgataatgatagggatgtgacgtatggtggtatttggtctggtcatatcgttacagattag

SEQ ID NO: 4430 - DNA, 1377 bp, Xenorhabdus bovienii
  Coding sequence Name=Xb4151_4152.C442.gene217.dna; Position on contig= 177658..179034bp; Strand=+
atgaatataaaaaataacatcgttttatctaaacctgaattcccccaaagtgattcaaataacgtcattaatatccttgaagttaaaacgatgggaattaaatatttagtaatgaaagtgaataaatatgatggagtagagctattagatagtatagatggtgaactctatctaaaagataattcaaagattaaaataaaaagcattacttactgtgtaacgccagatgttttagataacgactatgattattattctgtgatttttaatgtaaacgattttcatacatatggattatacgaagcagtatatacagtgacaagtttaaatgacaataaaaatacttcaccaatttcaagtgttaatattatagaggacccttctatgaacgcttcagataatgaaataacgtttactgacattaaaaatcgtaaattatatttaagtagtatttctcgtgaaagaggaataaggattcgtacaaactttaaaggttttacggctggggataccatcactattacattaaagattttagatgaagaaaatagcccaataaatactttaaaatctgacaaagtattgctccaagatcaggtaaatcaagactatgctgattatacaataagcacaggtgagggtgggattaattttgtagaggctaaatctattttggctggtttttatagtgctgatattaatataacatcctctttatctcaaatttctatttataacgatttagataatgttaatgtcaaagtacaattgactcaaaatattggtactagtagtgaatctcctgatgtaaaaccttttttaacagcagtagtgtatacaggatcaaatagcaatgcaattattgcccaagtatccaatgcttactttagtgatggttctaatagaaccccactgggggaaataaataacaatggagtggggtatctgaatatttatagtaaagatattgctaaaaatagtgttctaactcttaactatctagatcctgttaatgcttataaggtttgtttgaatttttcggtttggttattatcatcaagtgaagaaattaaatatacttatagctcttatggtgttgcagatggaacgtgccaatgtttcctttttattgaaccgctaataactggaattgagactattaatgttaagtttgatacaccagatatcataattgatgatgttgttaagagttctataccaataaataatcctgtttctaataaaactttaagctataaaataacttcaaataaagcatttagggctaatttttctattaatgccagtggtaaaggtatttatatggaacaaattaataacactatcgtttttgtcgatccgctaacatttgagtaa

SEQ ID NO: 4431 - DNA, 1563 bp, Xenorhabdus bovienii
  Coding sequence Name=Xb4151_4152.C442.gene218.dna; Position on contig= 179041..180603bp; Strand=+
atggctattacaataaactttactccatcatatgaagtatttcaagatagatcggcggttaatattaatatattagcttatgaatattcggagtcattacctgggttagagattgtttttgaatgctcagtcggtagctttgttgttaatggtgaagatacaggtaaaaaaagactttttggcaagattggcggcactggagaaacatctgtcttggttgtggggccaatgacaggtggcaatggtcaactgactgtttcccttagggagaataataagcagattggcatattaccttacgatctaataacaacagactatcagcttaactttagtgttactggtgactatgcaatggcagatggtaaacagagtaataaagttaatgcgattctgacgggaatgggaaccgtgtttgatctcaaaaaccgccagttggatttaattgtgacaggttctgcttcttttgagcaaaataaggtaacccagaccacttctattaatactgatccgttaggtaatgtgagttttgaactttatgatgcaaataatagtggtgagactgtcaccctggcaggccaattgagtggtaataaaatatctcataatacggaacaaattcatttccagcctaacctggattgtgatgctcatccccctagtaacgaaatatatattagaacaatttttacttattctattaataatgatcaataccttttacgccagcgccaatgcgatcatttggtcactgtacataaattgcttgctggcgggaaacagggagagcaaacttcgaccgggcaaaagtgggtaaattattatgatttaatgttcccatttgttattgagaatgagcaatatgtttttggtttagccaaggactttattaatgcaccacaaaatacagataaatcattttggatgattgcaaagttggatgaaaacggacagaaagaaataatagatagtggatattttgatgttagttatgatgttgggtttgcatataatattggaggtagacagtttatcttacttcatggtaaaggaaatggatggcctattatatgttacgaaatttttacaaaagtaaaaatgaatcgtaaaccgatatgtcaacaaaactgggataatttttacggagttgtattctttatttcaatggaaggtaatcaatatatatactgtcatacaaagactactaaaaatatttatacatttgagtttaacaaagatggaaccttaggtaagctagcatattctgatacgtggtcatattattactatcctcagtttccatactttattaaaggaaagtattattacactggtcagagattctatgataactattggtttatttcttacatatatagtaagggtgttcctgagcatgttaacgaacacgcagaaccatgggatacgagttatcaatatttaattccattttccattggtgaaaatcaatattttttgaggcaaaaccaaagtaaaaatcattggtatattacagagattattgctgatactaaaatgggagaagatagggattctaggtga

SEQ ID NO: 4432 - DNA, 321 bp, Xenorhabdus bovienii
  Coding sequence Name=Xb4151_4152.C442.gene219.dna; Position on contig= 180790..181110bp; Strand=+
atgcgacagaatcggtttttagccagctcactagccaaggtgtgtcactgtttttcgttcatcttgtcacctgttctcgttgataaattaaacatattaaaaacaggcaatgacacaaatttagaaacgggatcgaaaacgccgatatcatttataaatcggcgtttctcccatgaagctcaaatcaaaaacagcgttgccaaccccaaaaagataaagaatccgccagtatcggtcattgccgtgatcatcacactggaaccaatggccggatctcgccccagtttcatcattaataaatggaatcaatactcccattag

SEQ ID NO: 4433 - DNA, 408 bp, Xenorhabdus bovienii; identical to SEQ ID NO: 702
  Coding sequence Name=Xb4151_4152.C442.gene220.dna; Position on contig= 181729..182136bp; Strand=+

SEQ ID NO: 4434 - DNA, 402 bp, Xenorhabdus bovienii; identical to SEQ ID NO: 703
  Coding sequence Name=Xb4151_4152.C442.gene221.dna; Position on contig= 182145..182546bp; Strand=+

SEQ ID NO: 4435 - DNA, 279 bp, Xenorhabdus bovienii; identical to SEQ ID NO: 890
  Coding sequence Name=Xb4151_4152.C442.gene222.dna; Position on contig= 182863..183141bp; Strand=-

SEQ ID NO: 4436 - DNA, 291 bp, Xenorhabdus bovienii; identical to SEQ ID NO: 155
  Coding sequence Name=Xb4151_4152.C442.gene223.dna; Position on contig= 183133..183423bp; Strand=+

SEQ ID NO: 4437 - DNA, 729 bp, Xenorhabdus bovienii
  Coding sequence Name=Xb4151_4152.C442.gene224.dna; Position on contig= 183460..184188bp; Strand=+
gtgggcactgatacccccgaaccggcggcgctcacaccgaatattgtgctgtatgaccaccaggccagccgttcaggcacctgcgctgctgactatctcgccggttttcaaggttatctgcaggtggatggctatcaaggctatgagcagaccggtgcccggctggtcggttgcatggcccatgcccgccgtaaatttatggaagcgaagcaggcgcagggaaaaaacaaaacgggcaaagccgatatcgcgctgagcctgatccagtcactgtaccgggtcgagcatcaggtcaaggggttaagcccggcagaaaaataccggatccgccaggaaaaagcgcttcctatctgggataagttatcggcctggctggttaaaacccgatcccaggtgatccccaaaagcaagctgggtgaggccgtcacttatctgagcaatcaatgggcaaaactgatccgctatcgtgaggatggccgcttgtcaatcgacaataaccgggccgaaagggcgatcaaaccgtttgtcatcgggcgaaaggcgtggctgttcagccatacctcgcgcggtgcacaagccagtgcgatcctctacagcgtcattgaaacggccaaagccaatggattgatccctttcgattatgtcatgacttgcctggatgagttatgccaacccaccccggatctggaaaaactactgccctggaaaaaagtgataagcaaggtgtag

SEQ ID NO: 4438 - DNA, 339 bp, Xenorhabdus bovienii
  Coding sequence Name=Xb4151_4152.C442.gene225.dna; Position on contig= 184098..184436bp; Strand=-
gtgatcttccgactttcttttttaagagcagctcattccctgcccttagttgcttttgtcgtcgccaagacccgtacccgccgtgaccacatgaaatatctcaccttgatccagagtatcgcgctgttgcaccaataccagcgggaaatcaaaacggcagaacatcgcggcaagacactggaatatatcgaagtgaccaaagacgatatccggctcgccgtaagcgtcaactgtaagcgtcaactaaactacaccttgcttatcacttttttccagggcagtagtttttccagatccggggtgggttggcataactcatccaggcaagtcatgacataa

SEQ ID NO: 4439 - DNA, 453 bp, Xenorhabdus bovienii
  Coding sequence Name=Xb4151_4152.C442.gene226.dna; Position on contig= 184465..184917bp; Strand=-
atgatcaccatatttattatgaatagtaaattagaagaaaaaatgctcttggcaagagcaaagaggtatatcaataacattcaagggattgaaaagatatctatatctttaagtaataatgataaggaatttcagtggcataaagagataatcaatagtattttaaaaggaaaagaaatacctgaatgcaagctagaacttcctgtatctgaggaggatatttactcatatctgcaatctaaaatacatattggtgaatgtaatagttactacatgttttttgaaggaatggtaaagttttctttcaatattattgatttaaagagatttttatctagctgctatgcattaaagaaaacttttgatttgtatgttttattactaaatccaatgaaagttattgcaataagtgaagaagaatacgagttaagtttttacaataagactatgtaa

SEQ ID NO: 4440 - DNA, 4578 bp, Xenorhabdus bovienii
  Coding sequence Name=Xb4151_4152.C442.gene227.dna; Position on contig= 184892..189469bp; Strand=-
atgagtgtttcacagaatgtcatgatgggggcggcagcggcacaacggccgtccccaccccccgcaaccaaccgccgtccgtcgccggcccagggggacagaagggtgccggccccgccccggacagaaaaatccacctcggataagacattagaattcctgcaaagtgagacgtttgagaatgcgacgctggcaaccagtggtacctttgcggttgccaccggggcggcggtaccttttgcggtgggattggcggccggtgcggccggtgcagcggcgggggcgtatgtcggcgataaaatcggccatgctatcgcggcgggcatgggcatgagtacggtggcgacagaaggggaaaatccggcccgggaaggggatgcgatagcgcaccagaacaagaatgcgggtttgtggggcgcattgggcggtatcttgttgggggcggtggcggccatcgcggtggcggcgctggtcatcgccaccggaggggcggcgctggttgttgtggccgcggcggcggcggccggcggctttgtgggcggggcatgtgcgggtattggcgccgccatcggccagtatggcagcaatacgggcaccattgttgcggggtcaccggatgtgttctttgagggcaagccggtggcccgggtcggcgacccggtcgcgtgcagtgaccacccgcccggcgtgatagccgaaggggccaagaccgtctttgccaatgggcaggggattgcccggctgggccaccgcaccacctgtgacgccaatatcaacagtgcggccgggtcgatttccattacccaggccaccgatggcaaatatcctatcatggaagaaagcaacaaaggtttgcagtgggcggtggtgattgccggactgctgccgttgccgcgtaataagaaaggcgtcaccaagtctgataaacccaaggaatcgacgcaaaagaatagtaaaaagcccaaggaagaggattgctgtggtgatccggtggacatggcgacgggggattttctgcaacaatggccgctgctttccctgccgggcaccttaccgttgtcactgacccgaacctaccgctcgacggcggattttgccgggctgttcggggcaaaatgggcggatgactggtcacagcaccttgttctcgacggtgaagcgacgcgatttaccgatgcggacggtgtggtctacaccttccatacgccggaggaaaaagtcttctcggtcaacctgcatgccgggcattacctgctgtttggggaattgcgtggcagtctgcacctgtttgaccgccagacccagctgaccctgagctttgagcagcgggatggcaaacgccgtttgttgtccgctattagcgatcgctatgacaaccgtatcacgttccattatgacgacttgaacgatgaggggatccctcagttggcacaggtgacgcattctgacggctaccgtctgttgctggattatcaccagcaccggctggtgaccgtggagtacctgacggacgaactgcgccagcgactggtcacctgccagtatgacgaacagggctacctgtcggaatgtgcgaccttccagcacagccacctgtggcatgaatatgatactcacggtcacatgacccgctggcatgatgcggatgcgaccgatgtgtcaatgggctatgacacccggggcagggtggtgtcggtttctaccccgcagggctactggcaggatcgttttctgtatgacgaagtcaaccgggtgaccacgtatcgggatgcggaagggggttgcacccgctattggtataacggggacggtcaaatcacccgtaagcttgacccgctggaacgtgaaaccgttctggagtgggacttgagccataagctctcggaaaccgatccgctgggcagaaaaaccacgttcgagtacagcccgtacggtgaactgacccaactgacgttgcctgccggtgaggtgtttatctatgattacgatgagtacggccagctggtgcaggccacactgccggcgggcaaaagctgggggtttcactacagcgaacagggcgccctggatgcggtgaccgacccacagggacggcgggaagaataccgttataacctgcatggagaactgctgcgccgggtattgccggacgggacgcagtggcgttatgagtatgagcagcaccggttgcatcaggtgttgcaacccaatgggtataccacccgttatgatcaggacgggctgggacggctgcgcggcgtgactgatgcgctggggcagcagacccgttaccagcacagtgcgtttcatgccagcccggcaggaagtgtgacggaaattgagttaccggacggggtaaagcagcacatcgattatgacagcgagcgccgggttacggcggtgacggacggtgaggggaacaccacacgctatgcgtatggggcatttgatttgctgacccgaatgacccggccggatggaaccacgctgcattttgagtatgaccgcctaatccggctgaaccgcgtgacgatggcaaccggcgaaacatatcgttatgaacgtgatttggccgggcagattattcgtgaaacggattttaccgggcggacggtggaatacatctatgaccgggcaggccgccgcaccttgacgcgttacccgaacggtcagttaatccgtttttgttacaccgctgaagacctactcagccggcaggagcactggctggcgggagcatcgtcttgtgagctgcaggtagccaccgaatacacgtatgacgtccaccgccggttgacccgcgcggtgtcaccggatgcggtggtggaatttgactatgatgaggcggggaacctgacgggcgaacggctgaatggccgggaaatcagtcgggaatggaatgaactcaccggcttgccggcagtggaaacccttgacggacataccctgcattttgactataaccggatgggcgcactgaccggcttccgctttgaccggcacagtccgttgacactgagccatgacccgctcgggcgtgaaacggcgcgtgaaagtggtgaaggcttcatcctcgccagccgctacaccgccaccgggatgttagcgcatcagtcggcaggccgggtcacggcgatgttccgtgaaaccctgcaacaaaatgacccccatttcccgccgcaggccacggcggtgaaccgcagctggcagtatgaccgggcgtataacctccgggtgattgatgacggccgctgggggcagacccgctaccgttataactcaaataaccagataaccgagaccctgtatcagggggcccggccgtatgaggagcagttccgctatgacgccaatggcaacctgagtcagcatattccggtggacgcgcagggcgccgtgacgcaaattacccagcaccagcaggccgggcgggttatccggcgcggtgatgtcagctaccgctatgatgacagcgggcggctggtagaaaagaccgcacagcgcgatggtttccggccacaagtgtggcgctaccgctgggatgcactgaaccagctgacccagtgtgaaaccccggacggttcccgctggtactatcagtacgatgctttcgggcggcgtatccgcaaactcaaggtgcacgacggaaaactggcggcagccaatttacagcgctggctggacggcaagccggatctgacgccgaaaccccgtaccatgatggggcaggattacctgtggagcggggatcagctgattgaggaaacgccattgtatgcggatggcacgcccgccgaagatcagcgtatccgctggctgtacgaaccgggtaaacttacgccgtcggcgcgttatgaacggggtaaattgcattacatcgtcagcgatcatcagggtacgccccgggaaatgctgaacgaggaaggcgggctggtgtgggcacagcggctgacgacgtggggcagggcggagaaatctcaggtgctggcctccaatgatgcggattatcacgttagctgcaacctgcgttttgtggggcagtacgaagacgaggaaagtgggctatactataatcgttttcggtattatgaccgggaaactgggcagtacctgacgccggatcccattggcctattgggcgggctgaatccgtatgggtatgtgcataatccgacgaattttatcgacccgctgggattagcaggtgaaaactgtggaaaacccaaaccaaatcgacgccaagccttaaataaagctaaagatttagccggaatacctcgttctcaaaaaccagatagacaatggactgttggaaatgatccaaaacgaagaggacaaaccaattatcaatattcagaagatctgggttctcatggtcgctattacgaatataaagatgcacatgggcataaaaaagttgtacttgaacatacggctgatcctagagcaacacatccacatgcccatgcaggtcaagcgaaaacaggcgcagacccaagaacgtatgactttaaagagaatagatatcagaaaataacagaccctaaaacggatgatcaccatatttattatgaatag

SEQ ID NO: 4441 - DNA, 456 bp, Xenorhabdus bovienii
  Coding sequence Name=Xb4151_4152.C442.gene228.dna; Position on contig= 189484..189939bp; Strand=-
atgagtgacccgcttgacctttctcccttccacttcaacgccggcactatcaaattgccggccagctggcaggattcgagcattctggtgctgaacagcccggatgataaaaacggcaccagctttaccatttcccgcgacagcctgccgtgggggttagcattcaaccagtttgccgagcgggaaatgaccgcgattggcaaacagcttaaggactatgaggttctggcccacgaggccggcgaactgaacggccatgaaaccgagacgtttgagttccgctggcgggcgccgagtggcccggtacatcagctgatgatgatgctcaacgcgcccggtcaggtgttgatattcaccggcacctgtcagggggaaatgaccccggctcagaaggcgcagatgcaggcgatgatggcgacgttccagctgcgcagtgagcagaagggcagcgaataa

SEQ ID NO: 4442 - DNA, 198 bp, Xenorhabdus bovienii
  Coding sequence Name=Xb4151_4152.C442.gene229.dna; Position on contig= 189857..190054bp; Strand=+
atgctcgaatcctgccagctggccggcaatttgatagtgccggcgttgaagtggaagggagaaaggtcaagcgggtcactcatggtcaatcctttttattgcttaccgtttcaaaataaaaatcggtatgttattaatgcgggtcaagatatccggcggactgaactgcggctcgccggactgcaagttttcagctag

SEQ ID NO: 4443 - DNA, 366 bp, Xenorhabdus bovienii
  Coding sequence Name=Xb4151_4152.C442.gene230.dna; Position on contig= 190208..190573bp; Strand=-
atggtaaagaaatcacttttatccttcttaggtgtcatgttgctggcatgctcatctatgttatttgcggcttatactgatgtgttcgaaacaaagacatatcatattaccattaatgtgctttgcccagaaggaaacgtcagttgtgacaatgtgatctatacgggggtaagaaagaaagataatgcctccataacactgaaaggaaccactctaaataaagactgtaatacaggaacatgcgatttttatgggtatgaatttaaaaataaagatgtgacatacacaatctatcaatatggttcattggaaatttcaaaaaaaggagaagtcattttctcagaggatagaatttctaaagagtaa

SEQ ID NO: 4444 - DNA, 3072 bp, Xenorhabdus bovienii
  Coding sequence Name=Xb4151_4152.C442.gene231.dna; Position on contig= 190567..193638bp; Strand=-
atgtcgatgaaaaagaatatggcaaaactgaagaaagggcgggcgctgatccagcagggacagcaggccgcccagctggcaaaacacgtcactggtaagctggggggcggccttggcggcgcagccgcaggcaccgccggcttaattccgggcggcggctttggcgggggtatcgggggcggctcagcaggcaccggcgcggcgggcttaatcccgggcggtggctttggcggcggattgggtggtgccggggggggagccgggcagggactggccgcgcgggcggcgagtggtcagagcggggcggccaaggcgctgcaaaaagccggccagttattgggcggcggggggggcatggccccgagcgggctgcagtttaccctgacggcgggcggcctgccgccggaaacctttgtcgtgacggacttcgccctgacggaaggcttttcccggccgttcagcctgcatgtcgggctggcgagtgccgacccggcgattgactttccggcggtgctcgaccgcagcgcgaccctgaccattctgcaggagggggtggagcagcgcagtatcaccgggatagtggcgcgtttcgagcagggcaacaccggcttgcaccagaccacctaccagatgagcctctacccggatttgtggcgcaccaccctgcggcagaactcgcgtatcttccagcagctggacatcgccgctatcctcaccacgcttttgaaagagcacggtatccgcgacgtggtgttcagcctgcgccatccgcatccggcgcgggaattctgcgtgcaatatcaggaaagcgactttgccttcctccagcggctgaccgcggaagagggcatcttttatttcttcgaatgcggtaacggccgtaacacgctggtgtttgccgatgacgccggctccgtgccgccgggcattgtgctggcgtaccagccgggggaaggcagcacgacgggcacaccgtcggtgggcagctttacctgcagtgcgcaggtgcgcccggcacaggtgcagctcaaggactacaccttcaaaaacccggcgtggccggcagaattcagccagcagatgaaggaagacaccttacagcagatgtactacgagcactacgactacccggggcggtttaaggacgaagcccacggccaggccttcacccgctaccggctggaagcgctgcgcagtgacgcggtgacgggacaggccagcgggcaggccattgccgtgcaaccgggcaaattatttaccctgtttaaccacccgcgtgaagacctgaaccagccgtggcaggtggtgggcgcgagccacaccggcagccagccgcaggcgcgggaaaccgccagcagcgacagcggcaccacgctgcacagccagttcagcttcatccgccacaaccagcactggcggccggccccgttgccgaaaccgaccattgacggcccgcagattgccaaggtggtggggccggccggggaagaaatcttctgtgaccagtacgggcgcatccggctgcagttcccgtgggaccgatacggaaaaagcgacgaccagagttcgtgctggatacgggtgagccagccgtgggccgggcagggctggggcatgctggcgattccgcgcatcggtcaggaagtggtggtggacttcctgcacggcgacccggaccagccgattgtgaccggcagaacgtatcacgccagtaacatcccaccgggcgcgctgccgggcagcaagacccagatggcgttccgctccaagacccacaagggggaggggtataacgaactgctgtttgaggatgcgaagggcagtgaaaggctggcgctgcatgcgcagaaggacatgcacaccacggtgaaagataaccagagcctggtggtggaggcgggtgaccgcacgctgactgtccagacgggggatgagcacaaaaccgttaaacagggcaatctgacggagaccatctgccaaacccgcagcaccgaggccaacgtgatacaggtgaaggcgaaggcgggcaaagcggggctgggaacgcagctgtatcaggctgaggataatatcactctgcaggtgggtaagggtagcatcgagatgacaccggagcatatccgggtggcatttggctcatcggttatcctgctgaacagcagcggagtctttgtggatggcccggctattgggttgaacaacggcagtgcaggagcgggactgccgccggccgccgcagacgggggtgacagtgcttcggagagtggaagtttgcttccggcagcggtgatggcggcgggtctgggaccgatggggatggcggctctgggatcgatggggctgatttcttccgcgtcggcggcaacgccagcatcagcaccaagacctatgcccactcccgccgatggggcagggagacaggcagcacctgctgactctcaggcaacgccagcatccgctccaagatctatgcctgttccagtcaatggggcagggcgacaagcagtacctgctggttctcaggtagcggcaccatcagcaccccctgtatctgcaactaatttaaccaccagcacgaaaaagaccatgggacaagatggactggatttattaaaaggtatcgagtcattgagattaaaaccttatgatgaccagacagggaaaaccgtcaccaaatggactaaaggcgctacaattggctatggtaaattaattgagaagaaagactgggatacctataaagacggtattaccgaagatgaggctgaggagttatttaaaaagacactggcaccttttgagaaaaccgttaatgacggaattacaaaagagataaaccagaatcagtttgatgccttaaccatgtttgcatataacattggtgcaaaaggattcaatgattcatctgttctaaaactggtaaatgatgaaaatgccaaaaccgactatgacacgctggatgatgcctggaaggcttggaataaatcgcaaggcaaagttaatcagggcgtaataaacagacgcgcagctgagttaaaaatctataacgaaggagtttatgaaagatggtaa

SEQ ID NO: 4445 - DNA, 1392 bp, Xenorhabdus bovienii
  Coding sequence Name=Xb4151_4152.C442.gene232.dna; Position on contig= 193654..195045bp; Strand=-
atgagcgaacaccctgagaatttaatcatccgggccggcggcagtccgcagaatctgccggaatttgcggttatccgcgacgaaatcaacaaaatcagccacccggcgcagccggaagtgaactgggtgctggtggaatcgctgtcactgaccctgttccgccgtaacggggtcgatttgcagacggcgatttactacacgctggcgcggatgcagctcaatgggctggcgggctttaccgaaggctgtgaactgctggccggggtgatagtcagtgagtgggacgccctgtggccgccgcagccggcggtgcgcacggatttactggaatggttccacacccgcaccggcagccagctgcgccagatggatttcggcaccggcgacctgcggatgatttaccgggcggagcgggcgttgcagctgattatcgaccggttgcagcagtccgacctgaaacggctgccgcgggtggagaacctgctgtggttcttccagaacgcggcgaaaaaactggaaaaaccgcggccggccgcgaaaccggttcagtcgccggtgcagatgccgccgctggtctacctgtcccagtccgacaccgagccggaaatacctccgccgtccgcaccgccacggcctgaccgcccgccggaagcggacagcccgcgggtgcgggtgcagtttcctgagccgccgcggggttggaatgcgtggcagggttttggcctcggcgcagtactcggcctgctggtgctggtcggggggtggctgttgttctataaaccgctgcaacagcagctcagcgctatcacggcgtccccggcgggtgcccggctggcgtggctgaccgagcccgccctggcgggctatcagggccagctggaccggctggcggaaacccccctgctggcgacgtgggacgcggcccgcacgctgaccggcacggcagcgcagcagtggccggattcggctgagcaaaagaacgccacccatcagtggacacaggcgatgaccgcccgtatcgacagtatcccgctgaaaggcagctggcacaccacccgcgaccagctccagcaactggccgacaaaatcctgttgcaggagcgtacccggggcagcttcacgctctcgtacctgaaaaccgcggtctatgacctccagcgcagccacggcagcgaggtgccgctggaagaactgctgcgccagctcaacggccgggtggtgaacggggaacccgtgccgccggtgctgctgaaaggcattgatgaccgctttaacgccctgctcggccgctatgaccggctgcgtcaggcggccgaaaatccggctgaaaaacaggccgggaaacagaccacccaccatgagtccaccgtcatccctgacggcgggcattaa

SEQ ID NO: 4446 - DNA, 3570 bp, Xenorhabdus bovienii
  Coding sequence Name=Xb4151_4152.C442.gene233.dna; Position on contig= 195128..198697bp; Strand=-
atgaaatggccctctttgtcatccttggcgccgttgaaatcagccttgccggcgctgtcaaaatttaaatccctgccgcgtctcaaggccacgatggcgctggctctggcccttatcccctgcctgctgctgatcgcggtctgggtgtgggggccggaatggaaactgcgcaacgataccccgctggacagtctggcggcgcgctggctggcgaccgctctcatcatcctgatggtgctgctctggatcggcatcaaagcgtggcgtcgcctgcgccagctggaaaaactcaacctggacgtcgagctgaaaggggttgatccggtgcgggtcgatatcgagcaccaggctcgttaccttgatcactggaaagcccagctacaacgccatctggacagctataactacctgtatcagcgtccgtggtacatgatggtcggcagccagcagagcggcaaaaccacgctgatcaaggaaggctataaactgtccgacatcgcggcgccggaatacctgcgtcaggatggcgacattgcgctgcggctgcgctgctggctgggagagaaagcggtcatcatcgatcccgatggcggcctgattgaccagccggtgccggtcaacagtgacaaaccgcagatcaacagccgcctgtgggaatccctgctgaactggctgacggaaaaccgccagcgccagccgcttaacggcattattctgaccgtcgataccctgcgcctgctgaccgacaaccgggagcaacgcgatcgctacgtgcgggaaatccaccagcgcctgcaaaacctccgtctgaccttccacagccagctgccgctctatctggtcatgaccaaaatagacctgctgcacggcttcgaagcgatgtacccgtcgctggatcgccggcagcgtgaccagatcctcggcgtgactttcagcctcaataaccgggatgaaaaagcctggcacagcgagctggcgcagttctggcagcagtggatggccaacctcaacggggcgatgccggacatgatgctcaacggcgtcgatgccggccagcgcagcgctctgttcagctttacccggcaggtgcaggggctgcacagctatatcgcgcagatgctggaagacatcctgtacaacgatgaacaccaccgcccgatgctgcgcggtgtctacctgacctccgcccgtcaggtcggccagatggatgacttgttcacccagtccgcctcagcccagtatcacctcggctcgcaggcgttcccgacctggccggcgggcgataccctgccgtattttacccagtccctgtttgaggaagtgctgctggctgagccgaacctcgccgcggaaaaccgcctctggctgagccgcaaccgccgccagctgtacaccttcgccacgatcagtgccttagtcatcgcggccatgtggggcggctggcattatttctaccagaaaaactaccgggccggggaagaagtgctggcgcaggcgaaaaacttcctgtccgtgccgccgccggacggggatgaccgttacggcaacctccagctgccgctgctgaacccgatccgggatgccactctggcctacggcaactaccacgagaaaaaatccttcctgaccgacatggcgctgtatcagggggacggggtcgggccgtatgtggaaggcacctacctgaaactgctggagcagcgtttcctgccgtcgctgatgcaggggctgctggacgacctgaatcgggcgccggccggcagtgaggaaaaactcgagatcctgcgggtgatgcgcatgatggaagacggcagcaagcgtaacaacggcttggtcgggcagtacatgcgggcgcgctggagcaaggcgttccacggccagcgggatttacaggcgcagctgctgacccatctggattacgctctggcccataccgactggaaggggcagcgcgacaaggacaatcaggatgccctcgcccgctttgcgccgtttattaagccgatgaagcaggcccagcaggagctgagtgccctgaccatcaaccagcgggtttaccagaacctgcgcctgaaggcccaggataccctgtccgccccggttaacctgcgtgaccagattgggccgagttttgacagcgtgtttattgccggcaacgaaagccggctggtgatcccgcagttcctgacccgccacggcctgacggattactttgtccggcaggacaaggagctggtcgaactgaccgagatggacagctgggtgctgaacctgccgctgaaaaccaataagtacagcgacaccgatcaggggaatatccagcgtgagatcaccgaactgtatgtcggggattataccgcgacctggcgggcggcgatgaacaatctggaagtgcgggactttgaggatctgccgcaggccatcagcgccatcgagcaggtgatcagcggcgaacagccgatcaagcgcgcgctgcaaatcctcagtgacaacacccggccgccggagctggtgagtgggctgagcgacaaggaaaaacaggcgctgctggcgcagtcggattaccggctgttaaaccgcatcagccgggactttgcgccggaaaccggggtgctggttgagcacggcgacaagggcagtgccctgcaaagcgtttaccagaaactgatggcactgcaccgttacctgctggctatccagaactcgccggtgccgggcaaggcggcattgcaggcggtgcagctgcggctggaccagaacaacagcgacgcgatatttgaagtgcagcagatggcgaaaaacctgccggagccgctgaaccgctgggtcggtgatctggccgagcaggcgtggcgggtggtgatgatggaagcggtgcgctcgctggaagtggaatggaatgagtcggtggtcaaacagtataaaacctacctggccggccggtatccgttcaacccggcggccaccgaagacgtaccgctgagtgagtttgaccgtttcttccggccggacggcacgctggataccttctataagcagagcctgaaaccgttcgtggaaaacaacctgaccaccggcaccgacgggcgtgagcttatccgggcggatgtgctgaaacagctggcgatggcggaccgtatccgcaccaccttcttcaccccgcagaacgggctgggcacggcgtttgccatcgagccggtgagcctgaccggcaacaaacgccgcggtctgctgaacctcgacggccagctggtggattacgcgcacgggcgcagcaacgtggcgcatctggtgtggccgaactcgatgcgggcgggcacggaaagccggctgaccctgatgccggaccggagcaacgcggcgccgcgcagcctgagcttcaccggcccgtgggcgcagctgcggctgattaacagcggcaagctgaccaacgtgcagccgggggcgtttgacgtgcgcttcgcggtagacggcggcgagataacctaccgcatttacgtggacgaatcggacaacccgtttgcgggcggcctgttcagccagttcagactgccggacaccctctactga

SEQ ID NO: 4447 - DNA, 1437 bp, Xenorhabdus bovienii
  Coding sequence Name=Xb4151_4152.C442.gene234.dna; Position on contig= 198694..200130bp; Strand=-
atggacatcagaacacaattcgactggttcggcgccctgctggcgcccctgtccgacgaacagacgggcaaggcactgagtgagagtgatcccgcctgggaattcatcgacggcgagatggtcaaattcggctcgctgtcacatggcacgctggaagttgacgccctccagcgacaggccttgcaacttttcagcgagcacagcaaggacttccggctgatggttcacctgctgcggactttgcagcatgccggccaccctgccgagctgattctggcgatagagctgctgacagagtacgtaaaaaactactgggaaaaagcctggccggtcaaaccggtattgaagcgccggctggcacagcaggtgatcaaacggtttgaatcggcccagtcgagcttcactgatcaggccagtaaaagccagcgcgacgaggcacaaggcgctctggctcatctggctcagtgctggcacgccagtgagcccgaccttgcgaaagacgtcgatcaactgcgtacccgctataaccgccagccagaggcacgaacggcgccgacacagacggcacctaccacccctgaagcggcgtcggtagctccgtcgcctcagtctcctgaacaggcgccgatgcctgaggtggcggtcaacagttccagtgataaagcatggaaacaaaccctgatgacggtggcggatctgctgtgtgaacggtatcccgaatccccgattggctatagcctgcgccgccatgcggtctggcacaccattaccacggcgccgatggcgaacgccacaggcaaaacgccgctggcgccggcgtcggcggatcgtaccgccgattatctggcgcgactgccgacggcggataacaaattgctggcgcaaattgagcagagcttagccctcgccccttactggctggacggccatgccattgccgcccaagcggcggaacaacgcggctacagccgcgttgcgcaggccatgcgtgacgaactgaaggcgtttttggctcggctgcctgtactgaaaaccttaagtttttccgacctgagtccgtttatttctcctgacactctggactggctcacgccggaacccgacaccagcggaagcccgggagccgcgtcggccgatcaggaagccatctggcactgcttccagcagcaagggctggaagccgcccttcagatgctggaagaacaccagcagtcactgacggagccccgggatcaattctatggtcagttgttcactgcccaactgcttgaagaagcgggcatgaccgcactggcacaccagcattaccggaacttgttacacacgggacaacacatgttactcactgaatgggaacccagcctgctgaccctgctggctgaaaaaataccttcgcctgcgaaggatactgcgtcacacaggagcgttaacacatga

SEQ ID NO: 4448 - DNA, 666 bp, Xenorhabdus bovienii
  Coding sequence Name=Xb4151_4152.C442.gene235.dna; Position on contig= 200136..200801bp; Strand=-
atgaatattgtattaattatcagctcattgctcgcgtcattgacgggtgatcccaaactggcgaatctggttgagccaaaggaagtggtcgcacccaaagaagaatacacggacgaaatgcaaaaatgccgttttgaaccgtctccacttgtccggctggcgtgctatgaccgtacggtaaataacctgaaatttaacgccctgcaaatcccgatggaaaacatggggcttgtgtggcgacaggcgatggagcaggaaatgaaacgcaccgattactctactggcttcattgtgacgcagggagaaaatggtgaggcacccgtgatcctgaccacaccggcggtgggggttccgcctcctcgtccggtcctgatgctgagttgcattgaccgcatcacccgtttgcaggtggcgctgcctaaaccgatgggatccggtacggtcactgtgactacggacaaaacccaattcaaaaccgagtggttcctgcgggaacacggttacttatgggaatccagccgcggcttgccgggcattgaggaaatcaagcgcttaatgaacagcgatcagatgaccatcacggctcgcactggcagcccgataacctttaatatttctcagctggagcaggccgcgaaacccttacgcgatgcctgccgttggtaa

SEQ ID NO: 4449 - DNA, 795 bp, Xenorhabdus bovienii
  Coding sequence Name=Xb4151_4152.C442.gene236.dna; Position on contig= 200798..201592bp; Strand=-
atgaaacagcggctgaaaagcgcgttagcgttattagatgatgacactatagaacaactggttgaccattttctgctggtaagccagagctcgcgttttgatgccctgttagttttcttgcttaacaccaatgaaaacaggctggaatgctacaacctgccggaactccaccaagccagctcacgccggctgaatgtagatattgatgacgtcaataacccgctgatacaggttctgcgcaagggaaccccgacggtatgggattccctgaatcacggcgcgcgtattgacgacgtgcatttccgcacgtttgttgcggaactgccgcataactgcgggttgtatgccattcccctgtttgactgtaacggacaggcctgcggtgtgattgccatttttgccgaacatgtcagccattttatcaataatgaaaacatgttcggcctctattgccatgtcatgcagcaccgcctgaaaaagttgcaggaactcgagcaactgcgtgggcagttacgtcaaatccgtcaggtatttcaggttcagcaacagaaagaaaaacaactggatgaactgcttgcctccctgagtggatcgaaacccgcaggagtgagccgtatttctgtggattacagccacatcgataatctgccaaaggccatcgaagaatttgaaagcgccgtgttggttcaacgtcagcgtcagtatggcaatgacacccgactgattgcccaaagtctggggattgccacgcgcacgttggtttacaaactggctaaatacgggtgtagattatga

SEQ ID NO: 4450 - DNA, 2715 bp, Xenorhabdus bovienii
  Coding sequence Name=Xb4151_4152.C442.gene237.dna; Position on contig= 201592..204306bp; Strand=-
atgattcagattgatctgcccactcttgtaaaccgtttaaacccgatgacccgccatgcactggaagcggcggcggcatcctgtgtcagccaacagcagcctgaaattactgttgcacaactgttgtttcagatgatcgacacaccactcagtgatgtgcgcctgatcctcaataaggcagacatcgataaagatctgctgaaagaacaactcgatcagatgatgcctcatcatcaggcgattgtacaaacctacccgaacttctcaccgatgctggtggaatggttacaggatagctggctgctggcttctacggagatgcagcatactgaattacgcggtggcgtcatgctgattgctctgctgttcagtccaatgcgttatctgactccacagcccgcgcgcatgctggcgggtatcaaccgtgaattgctgcgtcagaactttactgaatggacgaatggctctgccgaacagcctttcagcggcgacgataaaaatgggcagggcgtccatccggcaaacagcgacagcctgctggcgcgttttacccagaatatgactgaacaggcgcgtcagggcaaacttgatcctgtgctgtgccgtgataacgaaatcgatctgatgatcgacattctctgccgtcgccgcaaaaacaacccgatcgtcgtgggtgaagcgggggtgggtaaaagtgccctgattgaaggtctggcgctgcgcatcatcaatgaccgcgtaccggataaattgcgccacagtgaactgatgacactggatctgggggcattgcaggcaggggctgcggttaaaggtgagtttgaaaaacgcttcaaaggcatcatggctgaaattagtcaatcatctaagccgatcatcctgtttatcgatgaagcgcacaccctgattggtgccggtaaccaggctggcggactggatatttccaatctgctgaaacctgcattggcacgtggtgaactgaaaaccatcgcagcgactacatggagcgagtacaaaaaatacttcgaaaaggacgcagcactgtctcgtcgcttccaattagtgaaagtctctgagccaagcgcggaagaagccactgtgatcatgcgtggtttgcgcgccatttacgaacaggcgcatggtgttctgatcgatgatgaagcactgaaagcctctgcggtactgagtgaccgttatctctctggccgccaactgccggacaaagcgattgacgtactggataccgcctgtgcccgtgtcgccattaacctgacatcgccaccacgtcagatctcctcactgacgactgaattgcaccagatgcaaatggaaatcgatgttctgaaaagagaacagcggatggggctgaatgaacatgcggacagactggaagaactgcaaaaccagcaggtagagatccaagaagaactcgtcacgctggaaaaaaactggcggcaacagcaagagttggtgacacagatcatcgaattgcgcggccaactcctggcggatagcgacgagtcagttgcagcagaaacgacggataaaaccatcgaaaatgcggttgaagagacggctcaagacgcgaaagagcaggaagctattgcgcaagacgagccagaagccgccgctgatgagcaatccctgatcgaaaaactggctctgctcaacgcacaactgacagagttacagcagaagcaaacgctggtttctccccatgtagacaaaacgcagattgcctcggttatcgctgagtggacgggcgttccattgaaccgcctgtcacagagcgaactgtctatcgtgaccgaactgcctacccatctgggacaaagcatcaaagggcaggatgttgcgatccagaacctgcataaacacctgctgaccgctcgtgcagatttgcgtcgtccgggacgtcctctgggcgcattcctgctggtggggccaagtggtgttggtaaaaccgaaaccgtgctgcaaattgctgaactgatgtttggggggcgccaatacctcaccaccatcaacatgtctgagtttcaggagaaacataccgtttcccgcctgattggctctcccccgggctacgtaggttatggggaaggtggtgtactgaccgaagccattcgccagaaaccgtactccgttgtgctgctggatgaagtcgaaaaagcgcatcctgatgtactgaacctgttctatcaggccttcgacaaaggcgaactggccgatggcgaagggcgtatcatcgactgtaaaaatgtcgtgttcttcctgacttctaaccttggttatcaaactatcgttgatcatgccgagcagccagatcaacttaacgacctgctctaccctgaactggccgcgtttttcaaacccgcattgctggcgcgtatggaagtgatcccttacctgcctttgggtcacgaaacgctgaaaaccatcattcagagcaagctggctcgactggatagcctgctgtctcagcgctttaacgccgaagtcacgatcagcgatgacgtatcggaagagatcctgcaacgtgccacccgtgcggaaaacggcgcccgtatgctggaatccatcattgatggtgcactattaccgcctgtttcattactgctgttgcagaaaatggccgcaggcaccgcaatcagtgccattcgcttaaccgtagcagaacatgagttccatgctgaggttgaggaggcagaataa

SEQ ID NO: 4451 - DNA, 768 bp, Xenorhabdus bovienii
  Coding sequence Name=Xb4151_4152.C442.gene238.dna; Position on contig= 204316..205083bp; Strand=-
atgagtgatatcaatgttggcagtccgtcactggaaaagtctgagacgctgaaaacgtttcagcgccagtatcagctaccgttgcgtggtgaaagcctcaacccgatgatcgatgcggccactcccttactgggaatggttctgcgtttgcaggatatgagtgatcaggcactgccagataagctttaccaacaggttgttactgacattcgagccattgagcagtttctgcaaaccaagggttatgaacccggcgcgattgtttcattccgttacgtactatgcaccttcattgatgaaaccgcgttggggcacggctggaacagtcagaatggctggttgaagcaatcgttgctggttcacttccataatgaaacctggggaggcgaaaaagtttttgtattgctcgaacgcctgatgggggagacccagcgctaccagcacctgctggagttcatttatctctgcctctgtctgggttatcgcggacgttacaaagtcagcacccagaaaagcgatgactttgatcgcctgttccgtcgcttgcagcaacagcttcactcactgcgtggagaagctccgccgaccacgctatatgtcgatatcaacgagcgtgatgagcgttatcgtctgagcagacgttggaccatcaagcacctgttttggataagtgtaggtttactggctgccatttacagtttctatgccatccgcctcggtgatcagacccaagacatattaaagcagctaagtaacttattgagatag

SEQ ID NO: 4452 - DNA, 1353 bp, Xenorhabdus bovienii
  Coding sequence Name=Xb4151_4152.C442.gene239.dna; Position on contig= 205086..206438bp; Strand=-
atgccaggcaaaaatcgggtgatttggcacgaaggattgttcatcaagccacaacattttcaacaacaacaaaaacataatgattatctggctcatagcctcgtatcggtgttggccgcttatggtcacggtttcagctccttaagcatcaatcaggatctgctcaatttagggcgcatcggcattaccgaagccagcggcatcatgcaggatggcacgatattctctgcacccagccaagatctgctgccaaaaccgctggacatcgaaagcgtcaatgacctgaaaagcaaagacatctatctggcattaccaatgtccagcgataccattcgggaaattgctgacaaggaagcggaaatgcaaagcgcggtacgttatcgggaactgccgagcgatgtccgtgacctgcataccaagggtggcgattcctttgccctgaaccttgcgcaattgacgccggttctgatgcaaggctccgaagatatgagtgcttacacggcgatcccgctgtgccgtatcaaagaaaaacagaaggatggcactatcgttctggatagcgaatttattccgacctgtctgtctatctttgtcgctgacaagttaagacgttttatggtggaaatcgacggcctgctgactgaacgctcaagaacactggccaaacgcattggctcaccgggtcagcagggcgttgcggatgttgcggagttcatgatgcttcaattgttgaaccgcgtgcaacctctgttcaaccattacgcaaaacagactgtcctgcacccgctgcatttatatacccaactgctccagacctgcggtgagctgagaaccttcaccgatgcgagtcgcttaccggggaatgtgctggcgtatgaccacaataatctgacggatactttccaggacgcgatgcatgccattcgtgatgcactgaacgttgttctgacaccgcgtgcaacgtcaattgtcctgaaacagaacgaaggtggtatccgcgtggcaacgctccacgacaacgatctgctgcgtaaagccgaatttgtactggctatcagtgcaagtacgccgcaggagcaattacgtcgtcagttcgtgcagcaaaccaaagtcacctcgatggagaaaatccgcgatctggtcagcgttcagttaccgggtgtgccactgattgcattatccgcggctccgcgtcagctgccgtatcactctggatacacctacttccgtctggatcagaagagtccggcatggaaagagatccagcaggggaattccatcgcattccacgtatcaggggatttccctgacttagatatgcagctctgggctatcaggggcggtaaggaataa

SEQ ID NO: 4453 - DNA, 555 bp, Xenorhabdus bovienii
  Coding sequence Name=Xb4151_4152.C442.gene240.dna; Position on contig= 206441..206995bp; Strand=-
atgaaacgttccgctagtcatcgtgtatgggctgtagggattttattgttgtcagcgatgttgctgaatggctgtagcggtgcatggaacgcgacaaagaaagtcggtcaagtgatctgggatccttccacaccagtaggaaaaccggatgaacaggcttctgttgccaacattacgttattggccgaaccgaatatcaaccccaatgaaagtggtgaagcggctcctgttgaaatgaatctggtttatctcagtgaagattctcgttttttggctgctgattatgaccagcttgaaagcgacaaactcgaaaaagcactggggaaaaattatatcgatcatcaggattacacactattaccggggcaatacaagcccctgtcaacgctgatattggaaaagaataaccgttacatcggtgtcatcgttcactatgcagatgcaaatcaatctgaatggaaaaagatcatccgagtaaaagacatcggccgccattacaacatcttggtgcatgtcagaaataacgacgtcgaacttagaaaagaggaggagtag

SEQ ID NO: 4454 - DNA, 1296 bp, Xenorhabdus bovienii
  Coding sequence Name=Xb4151_4152.C442.gene241.dna; Position on contig= 206979..208274bp; Strand=-
atggaaaaacaacaaccaacgctttcattgcgggttctcaacagtgagcaactggaaagtggcagatccgccagttgcctgttttcggcacagggcggtacggtcggtagcagtgaaagtcacctgtggtctgttcaggatcagcagggaaatattcatccatcacaattctccgtgcagtggcgggatggtgcattctgcctgcaagtactcgcagaacctgtgcagatcaacaatgccgcattaacgcctcagtcaagtctgatccgtttgcagcagggagatcagattaaggcgggtaatctgtctattaagatccacatcagtttttctgatgcagatcgtgttgatccttcgacggtatcacctgaatccttggtatcgagttacagcaacccgctggatgccatgatggaaggcgcagtagtacaaaaagccgtgtttgccgacgataacagtattgctccaacgatccagcatagtttcagcgatgacccgctcagggtactcgatagcgaaagcctgaccacgctgaagcagcaggttgaagctgatgatactgagcagcttttgccgccggatcatttccaatcacccccatttgctaaccctatttctgataaccgaggcagtgttatggatcaggagttccttgatttaccgggtatcacttccgagcggcagtacgcagatatggatgttgatcatgttgccattacccctctcatgcgtgggctggatgcacagttacctctgcatgacagccagcaggctaatgattttctgcaagagatgggcaaaaccatgaaagccgccattgaagggttattggctctccagcgtgaacagcatggactgcgtgataaacaactacgccccatcgaagataaccctctgcgcctgaatatggattatgacaccaccatgcaggtgatgttctcggatcagaaaagcccggttcacttgtctgcacctgcggccgtctcggaaagtctgcataacctgcaattgcattatcaggccaatcgggaagccatttcggcagcattggacaccatgctggaagctttctcccctgatcaattgctccgtcgcttctcacattaccgccgcagcaacgaagtcagaaataaagatgcggcctgggcgtgggaaatgtacaccaactattaccgtgaattagcttccagccgccagcaggggttcgaaaagctattccgtgaggtgtatgagcaggcttatgaccgcgcactgcgtcagggcttagaggactccagcaatgaaacgttccgctag

SEQ ID NO: 4455 - DNA, 1053 bp, Xenorhabdus bovienii
  Coding sequence Name=Xb4151_4152.C442.gene242.dna; Position on contig= 208280..209332bp; Strand=-
atggccggtacagataggtcaacactcattgatgtaatcactgagcaagatcctgccacacccttggcattggacatttcacagtacaacttttatcagttggttgagctgctcaatcagctggcggtagcgtgggaaaaaacgggagagaccgatcgtcctgatcgtgagtctgttcgtttcagagccagtgccagtctggcatttccgactcgtgacgtgatctcactctcgcagaccagacggggttattttgagctggaagtctcctttatggggctacacggcagtcagtccccgatgccaggttactatctcgattcgctggcttgggaagaagcgcagaacgaaaaccgactgacggattttctcaacctgtttaaccatcgcttaatcacgcttctgcatcagatctggcggaaataccgctattacgtctgctttaagaaggggggagaagatcatttttctcagcgcatgttttcccttgtgggtctggggagcgatgtcaaccgccggatgctgaacattaatcacagcaaaatgctggcctatgcagggctgctggcaagccccggccgctcgccggaagtgatatgcagtttggtttcccactgttttgatttacaggatgtcaccctgcacggctggcaattcagaaaggtcactattccccttgatcagcagaaccgcttgggaagcgaaaggaaaggacaggtaatcggtgactctaaactgtccatgctggggcagaatttcaccattggttcatgggtcggcgattacagcgggaagttccttctcagcatcaataatctgactcgtgatcggttcctgtctttcctgccggatggaaagaattatgccccattggtgatgtttatttctttcgtcatgcgcagtcaatttgcatgggaattgcgtcttggtctggcagaaaatcaggtcagcggcatggtattgggggcgcagcagaataaccatctggggtggactagttttctcggcgaaccggaaaagaaaccttttgtcacaatttcagttatggaataa

SEQ ID NO: 4456 - DNA, 1833 bp, Xenorhabdus bovienii
  Coding sequence Name=Xb4151_4152.C442.gene243.dna; Position on contig= 209296..211128bp; Strand=-
atgtcatttgaaaaatatttcagagatgagttgaattatctgcgacaactggggaaagaagccgcagttgagcgtcctcatcttgccgcatttctgtctgaacaaggttctgaccccgacgttgagcgtttgcttgaaggttttgcattcctgactggcaatctacgggcaaagattgatgatcaattccccgaactgactcatggcctgctcaatatgctttggcctaattacctgcgtccgacgcccagtatgactatcatcgagtacacacccgatgagagcgtcgtgacgaaagcgacaccggtcaagcgtggcacgcagattatgagtaacacgctgtcaactcatgatgatatttattcgaacgaaaaatcgggtggtaaaagagacgaacaaggccgctgtacttttacgctgtgtcgtgatgtctggcttttccctctctccatccaagacatttctgtcaataacagtaatgagcaaggcatcatcggcctgaattttgcgtcgaaaactgaactgagcctgcatgaactggaactggacaaactgcgtttttacctgagcggtgatgactataccacttctcagctctacttctggctctgttattacttcagaaaagcagaactggtggttggcgataaggtaatcccactaccggattttgattttgtgccggtagggtttgaacgggaagatgccctgttgccgtaccccaaaaacgcttacatgggatatcgcattttgcaggaatatttctgttttgcggagagcttcctgttttttgatgtgaagggtttcccaacattacctgaagatcttaagaccaaagatttcaaactgaatttacatttttctcaggcattaccaccagaagccaagattcggcatgatactttccgtctgcactgtacaccagccatcaacctgtttccgatggacagtgaagctattgaactcaatggcagccaggctgaatatccattgaaggccagttatagcctccccgataactacgatattttttccgtcgatggcgttgaaagctggttggcgggtgaaaatggtgaacgcagtcgggcacgtatcggcgagcgtgtctatacaccgttcgaaagtttcaatcaccagattgatgacgaagatgaacgctcaatgcgttattaccgccttcgggtgaaagaatcgcctttccgtcgggggctggaacatttcatctcatttgtacggggagatgaatcggatctgctcagactcaaactaaaagaaaatgtttctatcagtttgacatgtactaaccgtgaattgccgttgcagctgcgtgttggcgacattaattacccatccatcggcagcccgacatttgcgacattccgcaatatcacgcgcccgtcagtgccactctatcctcttctggatggcggtctgcactggtcgctactgtcaaacatgtcgctgaactatatgtcattgctggataaggacgcgctgaagcaggtactgcgtacctatgatttcccgagtatccataaccgacagtccaaacggtcatcgcagaaacggcttgatgccattgaaaagatcgagacagagccgacagatcgcctgtttcgtgggcagcccgttcgcggcttgcgctccacgctatatatccggcaacaggcattcagctcagaaggcgagctttatctgttcagtacgattttgtcacggtttttctcactgtatgccagcgtcaacgcttttcatatgttgaaggtaatcaatttagataatcaggagtgttatgaatggccggtacagataggtcaacactcattgatgtaa

SEQ ID NO: 4457 - DNA, 441 bp, Xenorhabdus bovienii
  Coding sequence Name=Xb4151_4152.C442.gene244.dna; Position on contig= 211129..211569bp; Strand=-
atggctgcgctgtacagttggaacaggggcagctctgccagtctgttcgagcgcattcaagggaagggctccggctcttcccgtcagtcaaggatgcgttcactgcttgattctataaagaagcatctgaaggaagtgctgaattctcgtcctggtgcctgtcagagtgctattgatctgggtgttattgatctcaatgacgcgacggcaacatcggtggattttaagcaaagcatcgagtgggcgatagaagagtgcatcagaaattatgaacccagaatatcagcggtttccgtcagcgccatcaacgatgattcagatccgttgctgttgagctttcacatcagcgctgaaatcttgttggatgatatcaacgatattgtggaattcagcattcagttggataacaaccggcgctattgcctggagcgaactcaataa

SEQ ID NO: 4458 - DNA, 1479 bp, Xenorhabdus bovienii
  Coding sequence Name=Xb4151_4152.C442.gene245.dna; Position on contig= 211572..213050bp; Strand=-
atggctcagcacgaagaaaacagcaccgctcttgcttctggcgcaacgacctccctgcttgatgaaattatgtctcaggcaagaatcacaccagaaaatgacggctactatatcgcaaaacaaggtatcgctgcgtttatcagcagtattctggacacaggcgctaacgaagaaccgatcaacaaactcgtcgttgataaaatgatcgttgagcttgataaaaagctgagtgagcagatggatgaaatcatgcacgcgaagccgtttcaggagctggaatcctcatggcgttcactgaaaattctggtggatcgcactgatttccgtgaaaacatcaaaatcaacatcattcatgctactaaagatgaaatgctggaagactttgagttttcgcctgaaatcattcagtctggtttctacaaacacgtctactctacaggctacggtcagttcggtggtgaacctgttgctgccgtcatcggtaactatgcattcaccaattcctcacctgacatcaaactgatgcaatacgtcagtgctgtcggtgcaatggctcactcaccattcctttcttccgtttcacctgagttctttggtgttaacagttttaccgacctgccagccatcaaagatttgaagtctgtcttcgaaggcccttcacatactaaatggcgtgcactgcgcgaatctgaagattctcgctatctgggtctgacagcaccccgtttcctgttgcgtctgccttattccagcgttgaaaatccaatcaaaaacttcaactatcaggaaaatgtcagtcgtgaccacgagcatttcctgtggggtaacacggcttatctgatggcgagttgtctgacggacagctttgctaaatatcgctggtgtccaaacatcatcggtccacagagcggcggtacggtgagcgatttgcctgtgcatctgtatgaggcaatgggtcaggtgcaggctaaaatcccaactgaggttctgatcactgaccgtcgtgaatttgaactggcagaagaaggctttattacgctgaccatgcgtaaaggcagcgataacgccgcattcttctctgcaaactcagttcagaagccaaaagttttcccgaatacccgtgaaggtaagattgcggaaaccaactacaagttgggtacgcagcttccatacatgttcatcatcaaccgtctggctcactacatcaaagtattgcagcgcgaacagatcggctcttggaaagagcgtcaggatctggagcgtgaactgaatatgtggctgaaacagtacattgctgatcaggaaaacccgccaactgatgttcgtagccgtcgtccgctgcgtgcagctgaaatcaaggtactggatgttgaaggtgatccaggttggtatcaggtggctatgcaagttcgcccacactttaaatatatgggtgcaagtttcgaactgtcactggttggacgtttggataaggaataa

SEQ ID NO: 4459 - DNA, 498 bp, Xenorhabdus bovienii
  Coding sequence Name=Xb4151_4152.C442.gene246.dna; Position on contig= 213071..213568bp; Strand=-
atgagtaagaatagtccaggtagcgtagctccgaaagaaagaattaatattaagtatgttccgaatacgggtgaccagaccgcagaagtcgaattaccgttgaatcttctggttgtcggtgatttgaaaggaaagaaggaagatacgccaattgaagaacggcaaacagtttcagtcaataagaacaatttcaatgccgtaatgaatgaggcgaacatcaatctgacttttaacgtccctaatcgtcttgatgaaaaaaatgaagaagacatgcctgttaatctggaaattaaatcactgagtgatttttcaccggataatatcgcaaaaaaagtgcctgaattaaataaacttctggaactgcgtgaggcattggttgcactaaaaggccctctgggaaatatccctgcatttcgtactcgcttgcagtcgcttctggatgatgaatccgtgcgtgagcaactcctgaaagaacttgaaatcgtcaataaaaaataa

SEQ ID NO: 4460 - DNA, 156 bp, Xenorhabdus bovienii
  Coding sequence Name=Xb4151_4152.C442.gene247.dna; Position on contig= 214291..214446bp; Strand=+
atgattataaaatttttatttgtcattgaattagagcttgccttgcaatttgcaaattactttgcattacacgatttcagctttattattcgctccgagtgttcggcggcgacagttttatttaattatagaatgaaactatcactcacggaatga

SEQ ID NO: 4461 - DNA, 519 bp, Xenorhabdus bovienii
  Coding sequence Name=Xb4151_4152.C442.gene248.dna; Position on contig= 214490..215008bp; Strand=+
atgccaactccatgttatatttccatcaatggaaaaactcagggcaatattactgctggtgcattcactgctgaatcagtaggtaatattttcgttcaaggtcacgaagacgaaatgctggttcaagaatttgaccacattgtcactgtcccaactgatccacagtcaggtcagccttctggccagcgtgcgcataaaccattccgcttcaccgttgcattgaacaaagccgttcctctgctttacaacgcactggcttctggcgaaatgttacctactgttgaattgaaatggtaccgtacttcaatcgaaggtaaacaagagcatttcttcacgaccaaacttgaagatgcaactattgttgacattgattgcaaaatgccacattgccaagatccatcaaaagcagaatttactcaattaattcgtgtgtctctttcttatcgtaagattaactgggaacacactacagcaggtacttctggttctgatgactggcgtgcgccaattgttgcttaa

SEQ ID NO: 4462 - DNA, 135 bp, Xenorhabdus bovienii
  Coding sequence Name=Xb4151_4152.C442.gene249.dna; Position on contig= 215175..215309bp; Strand=-
atgcggttttggtgcgattgttcaataaatcatcatgcaaaagtgggtgctggcgtaaagcagtatcaacaagatagcatcagtcagattggttacgtacgtaatcatgtatttatgcatctctgtttagcataa

SEQ ID NO: 4463 - DNA, 159 bp, Xenorhabdus bovienii
  Coding sequence Name=Xb4151_4152.C442.gene250.dna; Position on contig= 215233..215391bp; Strand=-
atgttatgggaaggcgttgacatatcactgtgttcaatgaattcagcgtggattttagaaaaatttgaggtcagaatgttatatgcggttttggtgcgattgttcaataaatcatcatgcaaaagtgggtgctggcgtaaagcagtatcaacaagatag

SEQ ID NO: 4464 - DNA, 1671 bp, Xenorhabdus bovienii
  Coding sequence Name=Xb4151_4152.C442.gene251.dna; Position on contig= 215725..217395bp; Strand=+
atgattaaaaagacggcaatttttatcttattatgtaccgcccttcaggtaaaagcgtcacctgaagaactcaatgtcatattaccgacagatgagacaagaaggactttacaagacagttcaagggaaatagaccagttaattgaacaacgccgtcaccaaggattagtcaatcgttccggtgccctttcgcctcagaccgtctctccagtattggtagaagcgccagtatgtctggatatccgcggcgtctatctccagggcattacgctgctgactctgactgatctgaatacactcagcacattgcctgacaactgtattaccagcaatgatatcaataaactgtcagcagaaattactaacctctatattgccaagggctatattacggcgcgggtgcaatttattcctcccagccatcatggggaattgggaattaatgttgtcgaaggttttattgaggccattgaaggtggtgatcgctggatcaatagccggatgctgtttcctcatctgacgaataagccactgaatcttagtcagcttgatcaagggctggatcaggcgaatcgtctgcaatcaaataaagcaacgctcgatattctgcccggtaaggtcaatggcggttcagtcatcaggctgagtaaccagcattccaccccgtggagaatatctacaataaccgataactacgggcaaaaaagcacaggtaaatggataagccgactgaatgccagcatggacagcccattggggttgtccgactttatcagtctcagcggcatcagtaccgtcgataaccccgacacccaatataatcgggcggcgactctgttctattcacttccatacggtgctgcgactttcagcggttttaccagctattcccgatatatcagccatccaaagctacagcataatgtgcacaaactgtatgggaattcacagcagtcgggtatgcgtatggattgggtattccaccgcaatcaatcacaaatctcgacattgaatacccagcttgtttacaagaatttcaacaactacttcgatagcgccaaactcagtcacagcagtcaaacattaaccgtgttttcactgggcataagccacttacaaatcattgcgaatggccttatcacttttgacgcaggcattgaacagggaacaccgtggttcagtgcgcaaacctcaaccgacaacttgaataagcaatttaccaaaggaaagttatccgtcaatttacagcagcgcttcagactatttgatatgtcctaccggctcaataaccaattttatacccagtacagcccaaacggactacccggtgttgagtggctcaatatcaccgaccgcaatgcagtacgaggattcagtaaaaatacgttatccggtgataacggctggtatctgagaaataccttatcccactcaataccgatactcaaaggttcgcttgacctgcgggcaggagtggacatcggacgggtcaaaggttatctcagtcagaatggctggcaaagtagtgccggattaagtactggcctgacatggcgctatcagcgtctgcttgccgatatcgaggtcagccgaggcaaattattatcccatcaaaatagagacaaggatgagtccatgcaattgttaacacgcgtttcttacaccttttaa

SEQ ID NO: 4465 - DNA, 120 bp, Xenorhabdus bovienii
  Coding sequence Name=Xb4151_4152.C442.gene252.dna; Position on contig= 217428..217547bp; Strand=-
atggatacggcaagttttcccgtaggagataacttgaattttttttcttgcatattattacctctgtttactttcttctattgccatgtgcagccccctgagaataaaaccccaagttga

SEQ ID NO: 4466 - DNA, 4449 bp, Xenorhabdus bovienii
  Coding sequence Name=Xb4151_4152.C442.gene253.dna; Position on contig= 217495..221943bp; Strand=+
atgcaagaaaaaaaattcaagttatctcctacgggaaaacttgccgtatccatggcaattattctgacaacctgttcagtcagttttgccaacggaatcacgcccggaggtgatgcaggacatcgccctgatgttaccctcgcggatacaggtgctacggtagtgaatatcgtagcaccttctgactcagggctgtcccataaccaatatgaggatttcaacgttaatcagatgggggcggtattaaataactcattgatcgatggctcatcagaattagccggccagttatcggccaacagcaatctgaatgggcaggccgccagtgtgattttaaatgaagtgatcagccgcaacccttcactcttgctcggtcaacaagaaattttcgggatagccgccgattatgtgctggcaaaccctaatggtattacctgcaacggctgcggttttatcaataccaatcaggcctctctggttgtcggtaatccgttagttgaaaatggcgttctgcaaggattcaatacttttaacaaccaaaatgcgctgagtatcaaaaacaatggcttgtcacatactgacgttctgaacttgattgctcccaaaattgatagtcatggtcgggaaatcaccgccaaaataatcaatatcacgacaggtaataaccagatttcagccgatggaaaaattctggcatcacaacaagcagatgttggtgtgctcgacagttattacctcggcagtatgcaggccggacgtattcgcctgctgaataccgcagaaggcagcggcgtcaatctgcaaggcaagatgacggccaatgacagtattgatattaagtcttacggggatgtgaatttgcaggccgctaatctgaaaggcggggatatcacattgcaaggcaacaatgttctgtcccaaggacgcctcaatcaatcctcatcagacaaagacggcagtgacaaccaccaaggcagtttcagtggtctttatgcccaacagaagcaaatcagtgaatccattgcccgtacccaattggaaggcaagaatattacgctggtggccaagcagaataaccgcgttatggcgaccgatattgtaggggataatgtcacgctgaccggtgctgatctaaaactggatggacagcaactccaccagcttaccagcaacaccaaaaatgaatggaaattatcctggcagtacgatgttactgaagaaagtgaaaaataccatcatgaaggcaataccatcaaggcgcatgaaaatgtccacctgacagccagcgaaggtaatgcagaagtgcttggcagtaaaatcagcgctggcaataaactgtccgtatccgcccggaaagatgtgaaactggcgggtctgctggaatcagaagtaacagccgagaaaggctataagaagaaccacactgttggtttgcagaccggaaactggaacaaaaaccatactgcccagagaagcatcggcagtgaattgagtgcagggggagatttaggcatcaatgcaggggcaaatgctgaaattatcggttctcaggtcaattccggcaaaaacctgattgtttctgccggtcagcaggcgaaaatcacggctcaatctcttgttgataatcaaagcattgctaagaataaaaaatactggggtggcattgcgggcggcagtaacaaagataacctcaataaagaagaaactcatcatatctctgatatcaacgcgaacggacatttgctgctgtcgggaatgaatggtgtcactattaccggcagtaaagtgagagcacaacagggagcttatgttgaagcaaatgatgggcaattaatcattgataacgtggttaacaactcctataagaaagtgaatgaaagaaccggtacgatatttaacatcaccaaaaattcgaaccaagaacacaatacacagcagaccacgtccaatagtcagctggtttccgataccgacctgaaattactcagtaataaagatatcaatatcattggtagtctggtgaaaagtgcgggtgagctgcaaatgaatacatcaggcaacatcaatgtgctggcttatggtgagcagaatagccatcatcaggaaaagaccgatctaaactggcaatattacgcccatgaagcagaagacaagcagtaccgtgtcggtatcggcctagagcacacgcgtgatggtcagaaaaccgatgtcacaacgcagcgtccatcagaattgaacggtggcaacctcaccctcaatgcaagcgaaaatgtcaccgtcaccggctccaaattagtgacgacacaaggggatgccaaagtcaccgggaacaatatcaatttactctctggggaaaacaggacatcaaccgaaaactcacaagtaaaaggccgtggcggtctgttcttgaccggtggtatggataggctcggtggtggtattgaaggtggttacgcaagtcatggccagtcccaaaaccaaaccacggctgtagtgtcaaagactcaagttaccggcaatcttgaattgaatgcaacaggagagttaaagcagcaaggcactcagcatcagatcaatggtgtttatcaggccaatgccgggagcatcaaaaatctggcgacagaaaatacggaatcaaactccactaatcagttgcaggtggacagtgaaatcagtggttcagccgattacagtgcaacgactcgtccggcagaaaaaacagccaaagcggccagtgagaagaaattggatacttccattgccaaaattggcttaccgaatgccggccttgagttagcggccaaaggcaacagccattataccggcaatagccagtcaaacgcagtcgtcacttcaatccaggcgggtaacgtcaaagtcaccactaacggtgatgtttacgatcaaggaacccaatatcaagccaatacaggagacgtgtcactgacagccggcagtcataccagtgaagccgcctacaatcgtaaagatagccattcttctgacaccactggcaacgcccgtctgcgcgtttacacctcaaccggcagtgatatttccgttaatggcaaaggtgatggcagttatcaggcaacctccaacagcagtgctaatgccgtgaccagcggggttcaggcacaaaacggtattgatatccaagtgaccagagacgcccgttaccaaggcacctccatgaatgctggcagtggcagtacaaacatcaatgcgaaagaaaatatccagtttgatcaagccactaaccgcaacgagcaaaaccgtacaggtcacaatggagagatttctctgaccgtgggaaccaacccggatggtaagaatttcagtgccagcgctggcggtggttataacactgaccagcagaccagcacgacggctcaaaccagtaccctcacagcgggacagggtgtaaacctgaatgcaggcaataatctggcactgaaaggttctgatgtctctggtaagcaagtcgatttaactgcacaacgtgggaaaattgaactgacttccgctcaggacaccatcaacaacaatggctggaatgttggtctcaagggcaaagggggtatgtccagcaaggcccgaaacaatgaaagcggggatagcgcaggaagtgtcaatgcggcaactgacaattccactggcagcagtgaggctggcaacaaaatcatcgataacaaatataacattggtggtgaagtgaaattcggtgtcaatcgtctggatacaatgacataccataacggccatgtgtccggcggtaacgtcacgctgaccagcggtggcgatacttcactcaaaggcaccaatgttactgccgatcgcgtgacaggtaatgtcggcggcaacctcaatgttgaaagccttaaagacagtacacatagcctgaatgtcggtctggatgctggtttgggttacagcaaaacagtcaaaggggacgataaagctacacttcctgtaccgaccgccaatagcagttcatcagaaacagcgcctgaaaccgcagcagcagatggtaaaaaagaggtgccgggactgaaagaccaactgaccgccgctttcaaaggttacagcggtaaactgaaaggcaattacgatacgctagacagagaagccactggtgagcaatccaccctgaccggtactcacggcgttaatctggatgttgcaggaaaaacctatttagtcggtggtaaaattgacagtgcacaagggacggtatcagtgaatacccagcagattgggcatcagcctgtgactggatacgataaggggagaaacctcggtgttaatctgccagattccatggtaggtcttgccggtgctgcacaaaaagatattttttccggaaaaattcctttcgtaaaaaatgagagccacgatacagcaactcctgctacccacagtgggatcaaaggccatcaattagattaa

SEQ ID NO: 4467 - DNA, 156 bp, Xenorhabdus bovienii
  Coding sequence Name=Xb4151_4152.C442.gene254.dna; Position on contig= 221982..222137bp; Strand=-
atgggcaataaatggaacaaaatctcttggcattacattcccttaattctggttttgcctagtgtactcattatgttagcgctatgcgctaaatgggtatgtggaaaaagagtaacaggcaaaacagaaaaggcaacaaatacggtagccgcatga

SEQ ID NO: 4468 - DNA, 858 bp, Xenorhabdus bovienii
  Coding sequence Name=Xb4151_4152.C442.gene255.dna; Position on contig= 222105..222962bp; Strand=+
atgccaagagattttgttccatttattgcccatttgattcgggctgcccagcgcttcaatgatcggatgggaagccagttcggtgccgccattacttatttttcatttctatctctcatcccaatcttgatgctctcttttgccatcgccggttttgtactggcatccaatcctgatttgctgacaaggttgatcaatggtattgctaacagcatcagtgacccatcgctggctaacacgctgaaaaacagtgttgatactgcggtgaatcaaagaacgacggttggattgacgggtctggcaatcgcactctattcaggtgtgaactgggtaggcaacttacgcgaagccatcctcgcccaatcccgcgatgtctgggaacgtcatcatgcagaaaaagaaaaaatctactctcagtatatccgcgattttttctccctatttggtctgctgttcgcattggtgataacgctttctctgacctctatcgccggatctgctcaggcaaccctcgttcatgcctttggattagaaggtattgaatggctgcgccctgcatggacactgataggcatgaccatttccatttctgccaattatttgttatttctgtggatattgtggatcttaccccggcatcaacctgagcggaaagcgctgtttcagggcaccttaatggccgcaattgggtttgagatcattaaatatattatgacgatcatgttgccaaaacttgccagttcaccttctggcgccgccttcggctcggtcattggcttgatggcatttttctatttctttgcccgtctgacactgttttgtgctgcttggattgccacggcagagaaaacatcataa

SEQ ID NO: 4469 - DNA, 207 bp, Xenorhabdus bovienii
  Coding sequence Name=Xb4151_4152.C442.gene256.dna; Position on contig= 222986..223192bp; Strand=+
atgccatttgtaaacatcagaatcacccgcgaaggtgcgactgccgagcagaagaagcaattgattgaaggtgcaacccagctgctggtggatgtactgggtaaaaatccggcgacgacgtttgtcattattgatgaagttgaaacggataactggggcattggcggtaaaagtgtaactgaagtcagggctgctgcgaaaaagtag

SEQ ID NO: 4470 - DNA, 405 bp, Xenorhabdus bovienii
  Coding sequence Name=Xb4151_4152.C442.gene257.dna; Position on contig= 223281..223685bp; Strand=-
atgaacaaccaaaaagagttaattgcgcatcaaagcatcatggaacttcaccaatggatagaagacgtatttaccaatgatcagcaaaaaggcgctgtgtctctggaaaaactgctttcttgcttcagccctgaattcagcatgattacaacccgtgggcatattgctttttttgttcaggtcagtgagctgtttcatcagaatataggctataaacccagtttaaagattgaaatcgattctattaagacactggttaatactggcgatacggtggtatgccaatacagggaaacacattgcatgaatggcataaaccaatcacgttggtctgttgtcatcattgaatttaaagagggaaatgcgttatggcgttaccttcatgaaacctcgattgtggtttaa

SEQ ID NO: 4471 - DNA, 1350 bp, Xenorhabdus bovienii
  Coding sequence Name=Xb4151_4152.C442.gene258.dna; Position on contig= 223682..225031bp; Strand=-
atgacttatcgttatcgtattgcaataatttttctggttggtttttttatagactgtatcaacatttttatgtcagctatagctttaccggatatcgcacgtaatttatcagtttcggaatcaacagtgacctgggttgcgaatagttacctattgggattgactctcattattcctatcagtaactggttggcaagtcggtttggtacccgccaaatcatgactgcatccatgttggttttctcaatagccgcgttctttgcgggtatggcgacgcattttttcagcctggcactattccgttttatacaaggtctcggtggagggttgttgattcctgttggacaggctctgactttgagcctgtttaaaaaacaggaaagagcaaagatttcaacgattatcatggcggtcgcattaatcgccccagcagtctctccgggagtgggggggataatcgtagatcatttctcttggcattgggtgtttttcagcaatattccttttagtcttatcgcagctctgttgtcatttctttggattaaaacggaaaaaacaacggctcctaaacctgatttgagtggtctatttttggtaagtttgtcgctggcttctcttttactcggtttgtcgctctatgctgaagcaagcactaaattagtgccttacatattggttatcacaggagtcttgtttgctttactttatgttcgccattaccgccgcatcaataatccggtactcgatttaaacattctgaccaacatccggatgcgtttttcaatatgggtctattacgctgtacccggtgtatttaccggagtgaacctgctcaatatcttctatctgcaacaagaactgaattggtctgcggagaaagccggattgctgatgcttttttatgcagccggttccttctgtgcgatattaatctgtggccgaatatataaccagttgggatcggtacgtttgttctttgccggtctcgtcttacatgccgcaggaattgccatactcgttactgtaaatacccctcaggatcagcctcttctgattatggcataccttttgatgggaatcggtggggggataggcgcaaataccgcgcaaaccacggcgatgctggattttgaaggcgagaatttatcccgtgccagcacgatctggaatctcaatcgccagatatgttttagtattggcgccactatttttgccatgatttttaatgtattgcagcatcaaactactccggcaacggcttaccatctcacctttattattgcggcaatttcaggtttattgcccctgttaaaattgcgccaactggctaagagtcgggagactgtatga

SEQ ID NO: 4472 - DNA, 891 bp, Xenorhabdus bovienii
  Coding sequence Name=Xb4151_4152.C442.gene259.dna; Position on contig= 225118..226008bp; Strand=+
atgatgaataaccaattaaaccggattcaaacctttattgctgtagtggattgtggatcattcacacgggcagcagaacgactgttgatcagcaaagcaatgaccagcattcacgttaagcggctggaagagtcattaaacataccgttattgattcgtaattccagaggagttgcgctgacggaagcaggtcagtttctttacaatgaatttagtgaaatttttattaatattcagtccagcttagataatgtggctgaacagtatctttcactttctggcaccctacatatcacatcaacaatcgagttcggtgatcggtttctccttcctctgattggcgagttctgtaagatacatccgcaacttaatgtcagctatgacgctggctctgctcttaatgaccttatttcagacaggctggatttagccatcaggttgggggtattgcgagattcttcgcttaaaagtcgtaaaattgctgactttaaaatttatatggtggcatcacctgactggcttgaaaaaaataaactggaaacagtcaatgatctcaaggatgttgattggattgctaacagtaatttgcaaacacctacacactgggaattaagtcactccaccttaccgtcaattgatatacgagccaaagccagattcaacgccaactcttcgacctcaataaaaacaatggctattgcggggttcggtgtgactgtcttacccgaatggatgatagaaaccgagctgcaatcaggcaatctagtgcgactttttcctgaatattcactgccaaaacagcccgtcacaatcgtatacccaaatggacaccagattcagcgtaaatgccgagtgtttattgattacctgatagataaactcaagttatga

SEQ ID NO: 4473 - DNA, 1485 bp, Xenorhabdus bovienii
  Coding sequence Name=Xb4151_4152.C442.gene260.dna; Position on contig= 226078..227562bp; Strand=-
atgcagggcaagaaaatcgggtatcttattggtggcgccattctggctacgtcttatttagcacaggcagagattttgcagcctgatccggcttggcaacaaggtaaacttgaaaatggattcagttggcaagccctgcaaactccacagcgtcccaatgacaggatacaactgcgtttaatcgtgaaaaccggttcactggcagagaaaacgcaacaacacggctacacctaccttattccaaaagtcgtattgttcagcagcaaagatttgtcatcgcaaaaactggaaaatctatggcgcaacgcgattgatagcaaaaatccccttcctcctgccattgtttcatatgatttcacgctttatagcctcagcctgccaaataaccgccctgatttactgaaagatgcactggtatggctgtcggatattgcgggtggtgcggtttttacgccagaaaccttggcacaggcgatgaaagcgaccgatcattccgtcgcgactttacccgcagatatacaagatcctgtgtggcggatgcggctgcaaggctcgacattgctcgatcatgatccgggtgcgagcgtatcaatgcctgtagatgtcaaaaaaattgaagcattttatcggcaatggtacacgccagatgcgatgacgctgtatgttgctggtcatgttgacagccgggtactgtcagagcgcattaatcaggtgttttcgccattaaaaggaaaacggcagacaccggtagccgttgcgacgttgttgccgctgaaatcagaaacgcttggcgtagtcagtgataaagctcaacaagatcggctgtctttagtctggaacctgaactggcaaccgattaacgattcgcagaccctgcttcagtattggttaaacgatttggctcgtgaagcgctttatcgctacctgcaattggggcgggaagaaaagcaggctgacatgaagttagatctggattgtcgcatattgtaccagcgggcaaattgcttcttgaatatggatacttcttcggacaagctgacagaatctacactttatctggcttctgagctggcatcattgcgtgagaatggcctgccacaagagcaatttgatgaactgtatgctcaaaaacggcttcaactgcaacagctctttgcggtctatgcccgcacaaatactgatctattgattaaccagcgcctgatttcacagcagaataatgtggtcgatattgcaccggagcaatttcaacgcttaaggcagacgtttttatcttctctgacaccaccgcttttgaacaaaaaactgaaagagatgttgtctcaggacatctcctttattctggtgcagccaaaagatgaaacggccgttaatgtgaatcagctcagaaacggttttaaccagattatgcggccgggtcccgtgccggaaacaccagccattgataccaagcaagatgctgatatcaaaaaaggggcggagtag

SEQ ID NO: 4474 - DNA, 201 bp, Xenorhabdus bovienii
  Coding sequence Name=Xb4151_4152.C442.gene261.dna; Position on contig= 227522..227722bp; Strand=+
atggcgccaccaataagatacccgattttcttgccctgcattctcacttacccctacctatttagttttatccttgttatccctggcttcacctgccacagtttaactattcatgccaaaccattaatgcccactactaatcaacaaggcttcattttaatcgcagtttctgcttatcaatctgacgattatagcctttaa

SEQ ID NO: 4475 - DNA, 708 bp, Xenorhabdus bovienii
  Coding sequence Name=Xb4151_4152.C442.gene262.dna; Position on contig= 227673..228380bp; Strand=-
atgaaattgcgtgtcaaacgttcattaactattaaacaaatggccgcagtgacaggagtcgctttgataactattgccattttcattactatccagttatcacacctgttacagcagcggaaagatgattatatcagccagctcaataatgcggctgcacaggttcaagttcctctggcagaagcgctgctgaattcagacctcaataaagcgaaaacgctgttgattgggttaaagacatcaggcattctggggcgggctgatgtggtatcaccgaataatgcccgggtgatgagcttggatttcgcgacttatcgccctatacccgaattggcaaagcagatttttggtattcccgttgaggtacagatccctttgcatatctatggtattaccccgcaaaccgaagcgtcacagggatacctgatcttgcaggtcgattctaaccgagtataccgatttgccttgaatacacttgcattaatgttgaccacctatttactactcgcacttattcttacggtggcgataagttggtgcgtgaatcgcattatcatccatccactacgcgatgttgcgcgtgctctgaatgaagaacagccgactgcgcccatactttgtcccaaaaaccatcaggatgatgaattggggttactggttaaaggctataatcgtcagattgataagcagaaactgcgattaaaatga

SEQ ID NO: 4476 - DNA, 111 bp, Xenorhabdus bovienii
  Coding sequence Name=Xb4151_4152.C442.gene263.dna; Position on contig= 228475..228585bp; Strand=+
atgagttcaaaacagaagaatgaccgcaacataacgtttatgtttaataacgtttgcattatccatatcatatccacgttatatcacggtcaaagacgattatctggatga

SEQ ID NO: 4477 - DNA, 1032 bp, Xenorhabdus bovienii
  Coding sequence Name=Xb4151_4152.C442.gene264.dna; Position on contig= 228574..229605bp; Strand=-
atgagtgagcaaaacattcgtaatcaaaacaggcgcgaacaggaaaaggccactgcccctttactcaaagccaccgagttaaagaaatattatccggtgaagacagggatgtttgcgcctgagcgcatggttaaagcgctggatggtgtttcattcgagctggaaaaaggcaagacgctggcggtggtaggggaatctggctgtggcaaatccacacttggccgcctgctgaccatgattgaaaaaccgacggagggtgagctttattatcagggacaggatttattggtgccagataaacaagcagaaaaattgcggcgccagaaaatccagatcgtcttccaaaacccttatgcctctttgaatccgcgcaaaaaagtgggtcagatactggaagagccgttgctgatcaacacgtcgctcgccgcagcggaacgcaaggaacaagtgttgaagatgatggaaaaagtgggattaaaaccggaatattatcagcgttatccgcacatgttctccggtggccagcgtcagcgcattgccatcgcccgtggattgatgttaaatccggatgtgttgattgccgatgaaccggtttctgcgctggatgtttcggtgcgggcgcaggtcttgaacctgatgatggatttacagcaggatctggggttgtcttacgtgtttatttctcatgatctctcggtggttgaacatatcgctgatgaagtcatggtgatgtatttggggcgttgtgttgaaaaaggcagtaaggaccagattttcaataatcctcgtcacccttatacacaggcgttgctgtctgcgacacctcgtctgaatccggcactgcgtcgtgagcgcatcaagctgacaggggaattgccaagcccgatgaatccgcctccgggttgcgcctttgccgcccgttgccgtcgcgcatttggtcactgtacgcaattccagcctaagctaaggaaatatgacgagcaactggtcgcctgttttgcaattgaacaggacgaaaattcatccagataa

SEQ ID NO: 4478 - DNA, 1032 bp, Xenorhabdus bovienii
  Coding sequence Name=Xb4151_4152.C442.gene265.dna; Position on contig= 229602..230633bp; Strand=-
atgggctgcgtgacgcactcgatcctaagctcaagcagtaggggtattgaaatggcattgttgaatgtagatcaattatcggtgcacttcggtgaagaaaatgcgccattccgcgccgttgaccgtatcagctacagtgtggagcagggacaggttgtcggggttgttggagaatccggctcaggtaagtccgtcagttcactggcaattatggggttggttgattatccgggcagggtcatggcagaaaaactggaattcaatggccgtgatctgacaaaaatttctgagaaagagcgtcgccagttggtcggtgcggaagtggctatgatcttccaagatccgatgaccagcttaaatccgtgctataccgtgggatttcagattatagaagcgcttaaagtacatcagggggggagtcgcaaaacccgttaccagcgggcggttgatttgttgacgctggtgggtattcctgatccggcttcccgtctggatgtctatccacaccaattgtctggtgggatgagccagcgcgtcatgattgctatggcgattgcctgtcgtcctaagctgctgattgccgatgaacctacgacggcactggatgtaactattcaggcacaaatcatcgaattgctgctggagttgcaacagcaggaaaacatggcgctggtcttgatcacgcatgacttagcgttagtggcggaagcggctcatcatatcatcgtgatgtatggcgggcaggtagtggaagcgggcaaggcaactgaaatcttccgtgcgccccgtcatccttacacacaggcattattacgggcgttgccggaattttcgacggataaatcccgtctggcgtcgttgcccggtgtggttccgggcaaatatgaccgcccgacagggtgtctgctcaatccccgttgcccctatgcgaatgaacattgccgtcaggtagagccagcattgaaaacagttggggaaagtcaggttaaatgtcatatgccgctggatgatgaggggagaccgacagtatga

SEQ ID NO: 4479 - DNA, 951 bp, Xenorhabdus bovienii
  Coding sequence Name=Xb4151_4152.C442.gene266.dna; Position on contig= 230593..231543bp; Strand=-
atggcgtcgtcaacccacgtatccgtcataagaaataaggagcacgtgatgactcaaactactgagccagcggtatccggtgcgccgaaattgatgacgccgatacaggagttctggcattattttaagcgtaacaagggtgcggtcgttggttttgcctatattgtcctgatgctgctagtggcgctattggcgaatgtgttggcaccccacggcccggcagagcagttccgtgactctctgttagttccaccgatatggcaggacggaggaagctggcagtttatcctcggtactgacgatgtggggcgcgacattttatcccgtctgatgtatggcgcacgcctctctttgctggttggctgcctggttgtggtgatgtcgctggtgatgggcatcatattgggggtattggccggttatttcggcggccttgtcgatacgatcatcatgcgtattgtcgatatcatgctggcattgccaagcttactattggcattggtactggttgctatttttggtccgtcgattgtcaatgcttcactggcgctgactttcgtcgccttgcctcactatattcgtctgacaagggcggcggtactggttgaagtgaaccgagattatgtaatggcttcacaagtggcgggtgcaggagccatacgtcagatgttcatcaatatcctgccaaactgtcttgctcccttgattgtgcaggcatcattaggtttttcaaatgccattctcgacatggccgccttggggtttttgggcatgggggcgcagccacccacaccagaatggggaaccatgctggccgatgtcttgcagtttgcccagagcgcgtggtgggtcgtgaccttcccggggctggctatcctgctgaccgtattggcatttaacctgatgggggatgggctgcgtgacgcactcgatcctaagctcaagcagtag

SEQ ID NO: 4480 - DNA, 1020 bp, Xenorhabdus bovienii
  Coding sequence Name=Xb4151_4152.C442.gene267.dna; Position on contig= 231506..232525bp; Strand=-
atgctgcaatttatcctccgacgtttgggaatggtaattcctacgtttattggtattacactgctaactttcgcttttgtacacatgatccccggcgatccggtgctgattatggcgggagaacgcggtgtttctgctgagcgtcatgccgaattgatggctgctatggggttggataaacctctctgggagcaatattttcattatattaatggcatatttcatggtgatttgggcatttctctaaaaagccgcattcctgtgtgggacgagtttgtgccccgattcaaagcgacattagagttaggggtctgcgccatgttacttgcgatctctgttggtattccggtcggcgtactggcagcggtcaagcgtggatctgtttttgatcatacggctgtcggggtatcactgacgggctattccatgccgattttctggtgggggatcatgctcattatgttggtatccgttcaatggaatttaactcctgtttccggccggataagcgacagcgtatttcttgatgatagttacccgctgacgggattcatgctgattgatactctgttctggggcgaagagggcgactttattgatgctgtgatgcatatgctcctgcctgcggttgtgctggggacgatcccactggctgtgattgtgcgcatgacccgttccgcgatgttggaagtgttgggggaagactatatccgtaccgcccgcgcaaaaggcttgagccgtatgcgtgtcattattatccatgctctgcgtaatgccttgctgccagtcgtcactgtcatcggcctgcaagtggggattatgctggcaggtgccattctgacagaaaccattttttcatggccggggctgggacgctggttgatcgatgcccttcagcgtcgtgattatccggtggtgcaggggggagtattgctagtggcgaccatgattattctggtcaaccttgtggttgatttgctgtatggcgtcgtcaacccacgtatccgtcataagaaataa

SEQ ID NO: 4481 - DNA, 207 bp, Xenorhabdus bovienii
  Coding sequence Name=Xb4151_4152.C442.gene268.dna; Position on contig= 232440..232646bp; Strand=+
atgtgtacaaaagcgaaagttagcagtgtaataccaataaacgtaggaattaccattcccaaacgtcggaggataaattgcagcatatcctgggttctctttttaattaccagttacagctctcaggctgtttggtgtaatacaagggtcaacttgcctgtcagagaagcgaaaccatccccacagaacaatctgggggatggttaa

SEQ ID NO: 4482 - DNA, 1611 bp, Xenorhabdus bovienii
  Coding sequence Name=Xb4151_4152.C442.gene269.dna; Position on contig= 232669..234279bp; Strand=-
atggcaacctccagtaagaaaaagttcagtttactgaaactgggcattggcctcgttgcgttagcagtaacagcaagtgttcaggcaaagacactggtttattgctctgagggttctccagaaggttttaatccacagttattcacttccggcacaacttatgatgcaacttccagacagatctacaaccgcttggtggatttcaaggcaggtacgacaaatgtcattcccagtttggctgaacgctgggatgtgagtgatgatggcaaagcctatactttctatttgcgcaagggcgtgaaatggcatagcactaaggaattcaagccaactcgcgatttcaacgctgatgatgtgatttttacttttatgcgccagaaagataaaaatcatccgtaccacaaagtttcaggtggcagctacgaatattttattggcatggatctggataacatcatcagcaaaatagaaaaagttgatgattacaccatccgttttgtgttatcccgccctgaagcgcctttccttgccgaccttgcgatggattttgcctcggttctgtccaaagagtacgctgatgtgatgatgaaggcgggaacaccggagaaagttgacttagatccgattggcacaggcccgttccaattgcagcaatatcagaaagactcccgcattctttataaagcattcaaggattactgggaaggcccggcgaaaattgatcgcctggtgttctccattacgcctgatgcctctgtacgttatgccaaattgcagaaaaacgaatgtcaggtcatgccgtatccaaaccctgccgacatttcccgtatgaagcaggacaaaaatattgttctgaaggagcaggctggcatgaacgtgggttatctctctttcaatgtcgataaaaaaccgatggataaccttaaggttcgtcaggcgctggcgatggcggtgaacaaagatgccatcatcgatgcggtctatcagggcgctgggcaaaaagcgaaaaacctgatcccaccgaccatgtggagctatgacgatgacatcaaagattatgcctatgatcccgctaaagcgaaggaactgctgaaagaagccggcttcccgaatggttttgaaacggatttgtgggcaatgccagtacagcgtccgtataacccgaatgcccgtcgtatggccgaaatgattcaggctgactgggcgaaaattggcatcaaagccaagatcgtcagttatgagtggggagaatatctgaaacgcgctaaagatggtgaaccgcagacggtgatgatgggatggacgggggataatggtgatcccgataacttcttcggcactctgtttagctgtgcggccaaagagaaaggctctaactattcgaaatggtgttacaagccatttgaggacgttatcaagccagcccgtgaaacggctgacaatgccaaacgtacagcgctttacaaacaggcacaggttgtaatgcatgagcaagtacccgcattgatcgttgcccactccacggtttatgaaccaatccgtaaggaagtgaaaggctatttggttgatccgcttggtaggcacctcttttacaacgtgactctcgactaa

SEQ ID NO: 4483 - DNA, 156 bp, Xenorhabdus bovienii
  Coding sequence Name=Xb4151_4152.C442.gene270.dna; Position on contig= 234735..234890bp; Strand=+
atgaacaaggagaaagataatgaattatcgaatcagggaaattcagttcctgagcgaattaccgacagtttcagagatgaaatccagatagatgaacaattttatcaaaccgaccgtgatataacgtcgatgtttaaaatagggatcaaggaatga

SEQ ID NO: 4484 - DNA, 114 bp, Xenorhabdus bovienii
  Coding sequence Name=Xb4151_4152.C442.gene271.dna; Position on contig= 234954..235067bp; Strand=+
atgctggtcggcgagagaggattcgaacctccgacccactggtcccaaaccagttgcgctaccaagctgcgctactcgccgaaaacgaagcgcatcttactgccagcgccgtaa

SEQ ID NO: 4485 - DNA, 549 bp, Xenorhabdus bovienii
  Coding sequence Name=Xb4151_4152.C443.gene1.dna; Position on contig =41..589bp; Strand=-
atgaattgcttactgctttattccactcaggatggacagactaagaaaattattacttatatcgctgaaaatctccgtcgcgcgggggctgagtgtgacttaagagatctggcgacaataaagcacattaatttgaaaccttatcataaggtgatgataggggcgtcgatacgctatggccattttaattccgtattacataagttcgctattcggcaccaaaaacaattgaatcaaatgccgacggcgttcttcggggtcaacctaacggcaagaaaactagaaaagaggacaccagaaaccaatgcttatttacgcaagttcttgatgaagagcccttggaagccaaatttatgtgatgtctttgctggcgcgttgctttatccccgctatcgttggctggatcgcatcatgattcagtttattatgcggatgacaggtggagaaactgatacaacaaaagagattgaatacactgattgggagcaggtcgatctcttttctgggaggtttctgcaaatatcatgtgaaaaagtgcctcaaaaatag

SEQ ID NO: 4486 - DNA, 1452 bp, Xenorhabdus bovienii
  Coding sequence Name=Xb4151_4152.C443.gene2.dna; Position on contig =626..2077bp; Strand=-
atgcattttcgcgccataacccgtattgtcgggctacttgtcattcttttctctgtcacaatgattattccgggattggtggcattgatttatcgagatggcgcgggtagggcattcagtcagacatttatctttgctctcgtgattggtttaatgttatgggtgcctaatcggaaccaaaagcatgaccttaaaccgaaagagggttttttgatcgttgtcttgttctggacagttctgggaagtgtcggtgcattacctttcattttctcagagaaacctaacctttcagtgactgatgccttttttgaatcattttcaggcttgacgacaacaggggcaactacacttattggtctcgattctctgccgaaagctatcctcttctatcgacaaatgctgcaatggcttgggggaatggggatcatcgtattagctgtagcgattctgcccttgctcggtgtcgggggaatgcagctgtatcgggcagaaatgccggggccattgaaagacaataaaatgcgcccccgcattgcggagaccgcaaaaacactctggctgatctacgtcttgctgaccattgcctgtgcaatagcgttatgggcggcgggtatgtcgatattcgatgcgatttcccatagtttttctacaatcgcgattggtgggttttcgacacatgatgccagcatcggttttttcaatagcccggctattaataccattattgcgattttcctgctgatctctggctgtaattttggtttgcatttcgccgtactttctggacgaagtttgaaagtttactggcgtgatccggaattccgcatgttcattactatccaattggcattattggtgatctgtgtgctgatattgtggcaacaatccatttacgaatcaggattagatgcactgaatcatgctttctttcaagtggtttcgatggcaaccacggctggatttacaacagtcagttttgccgattggcctctatttctgccttttcttctcttatgttctgcatttatcggaggatgtgcgggatcgacgggtgggggattaaaagttatccgtatcttgttgttgttcctgcaaggctcccgtgaactaaaacgtctggttcacccgaacgccgtatacaccattaaattgggacaaagagcattgccggaacgaattattgaagcagtgtggggtttcttctctgcttatgtgttggtttttcttattagcatgctgttactgattgcaacaggcgttgatgagttttccgctttttctgccatagccgcaacattgaataacttggggccagggttgggagccgtctctgataactttaccaccatgaatccggcggctaaatggatattggtcgtaaccatgctgtttggacgtttggaagttttcactctattagttctgttcacaccgactttttggcgtgaataa

SEQ ID NO: 4487 - DNA, 612 bp, Xenorhabdus bovienii
  Coding sequence Name=Xb4151_4152.C443.gene3.dna; Position on contig =2115..2726bp; Strand=-
atgaagccttatttgatccctgcggcttcagtcaatttcactgaagaaataaagaaaagtcgtttcatcactctgctggaacacaccagcggggtgaatgaggcaaagttatttatccagagcatcaaggagcaatacccggatgcccgacatcattgctgggcttttgtagcaggtgcgccggatgattcccagcaattaggtttttcagatgatggagagccgacaggaactgctggtaagcccatgatcgcgcaattaataggaagcgggatgggagaaatcactgccgtgtcagttcgctattttggtggtatcaaacttggcacgggaggattggttaaagcctatggcaatggtgtgcagcaggcactgaaattactggaaacagaatacaaagtaccgcagaaactgtatcaattgcagtgtgaatatgcctatatctcgatggtagaacaattgctacaaaaattctcagggcaagtgattgctagtgaatatgctgaaaacgttacattgcaagtttcactgccagctacccttgcgggggagataggtgataaattacgtgacttaagccgtggtgctctgtttttaacaccaaaatcataa

SEQ ID NO: 4488 - DNA, 1335 bp, Xenorhabdus bovienii
  Coding sequence Name=Xb4151_4152.C443.gene4.dna; Position on contig =2726..4060bp; Strand=-
atggaaaagttggcatctctgtaccacgaacatattaaaatcttacaaagacgtgcccgcgaaatactggcacgaaatcagcttgacgctctacttattcactctggcgagtcattacgtgtttttctggatgactgcgattatcctttcaaggtaaatgcacacttcaaggcttgggtgcctgtgactaaagtacccaattgctggctatgggttgatggtgttaataaacctaaactctggttttattcacccgtagattattggcatagcgtggaggctttgcccaatagccactggactgaagaagttgagttaatccatctggcaaaagccgatgatatcaaagcagaattgagtggcttatcaaaacagaatacagcttatattggtgagcagactgagcgtgcaaagaacttgggtattctcgaacacaatatcaatcccaaaatggtcttggattatttgagttaccatcgctcatataaaacagattacgagctggtctgtatgcgtgaagcgcagaaaactgccgtaaatggtcatctggccgcatacgacgcatttacatctggtgtgagcgaattcgaaatcaatatgttctatttgatggcaacagggcaccgcgatacagatgtcccttataataatattattgccctgaatgaaaatgcggccgttttgcattacaccaaattacaacagacgttaccttccgaaattcgcagttttttgattgatgctggtgcagaatataatggctatgttgctgatatcaccagaacttatgcagcaaaacataacaacgatttcgcttcactgattaaagatttaaatggggaacaacaagcgattattggctcgatcaaggcgggtattcggtatactgattatcatatcaatatgcatcgtcgcatagccaagttgctaaaaaaacacgggatcattaatggaatcactgaagaaactatggttgagaaagggctgacaacgccatttttcccacatggacttggccattcactgggtctgcaggtgcatgacgctgctggattcatgcaggatgataccggaacccatctggccgcgccgacattacatccttatctgcgttgcacacgtattttggagccgaggatggttttgaccattgaaccgggtatttatttcattgaaacgttattggcaccgtggcgtgaaaatgaatacagcaaacatttcgattggaaaaaaatcgacatgtttaagctttatggtggtattcgcattgaagataacatcgttattcacgacggaaaaattgaaaatatgaccagagatttacagttgtcgtaa

SEQ ID NO: 4489 - DNA, 2187 bp, Xenorhabdus bovienii
  Coding sequence Name=Xb4151_4152.C443.gene5.dna; Position on contig =4335..6521bp; Strand=+
atgctctacctaagtgacactattcaagtaaactggctgaaagatggcattgcagaactgatattcaatgcaccagctgcaattaataaattagatacaaagaccgttgcttcattggataaagctgttgccgtccttgagcaacaaactaaattaaaagggctgttgctacgttctgaaaaacaagcctttattgttggtgcagacatcacagaattcttatcattattcgatgcaccaaaagaaaaacttcaggaatggctgaagttcgccaatgatattttcagccgtattgaagatctccctgttcctactatttctgcgatcaacggctatgcacttggcgggggttgtgaggtagtgctgtcaactgactttcgtgttgcatccccagatcttcgcatcggattacccgaaactaaattaggcattatcccgggctttggtggctctgttcgcctgccacgtttaattggcccagataacgctctagaaattatcaccgcaggtaaagatattggtgctgaagaagcgttgaaaaatggtctgattgacgccgttgtgccgactgaaaagctggtagatgctgctgtttctattctggaactggccatcaaaggcgatctggattggcaagctgcccgccaacctaaactttccccactgaacctcaatgatgttgaacgcaccatgagcttcaccgtggcgaaaggaatggtgatgaaagtcgcaggtccacattatccagcgccaattactgctgtaaaaactattgaaaaagcagcgacattgggtcgcgatgaagccttgaaactagaagcagaaagttttgttccactggctcataccactgttgcccgtgccttggtcggcatcttcctgaatgaccaatatgtcaaaggtctggcgaaaaagcatctgaaagaagtcacagtgccacaacatgcaacgatactgggtgcaggtattatgggtggtggtatcgcctatcaatctgcacgcaaaggcgttcctgttctgatgaaagacattaatcagaaagcgctggatttaggtgtcaatgaagccgctaagttattgcataagcaatttgagcgtggacgtctggatgctatgaaaatggctaagattctgtcatccattcagccaacactcagttatgcgggcattgagcaatctcagattgttgtcgaagccgttgttgagaacccgaagatcaaagctgcggtcttggcagaaacggaatcacatatcaacgatgattgcattctagcctccaatacctccacgatcccaatcactgaattggcaaaatcattgaaacgtccggaaaatttctgtggtatgcattttttcaatccagttcaccgtatgccgctggttgaaatcatccgtggagaaaaaacctcagacaagaccatttctactgttgtggcttacgccagcaaaatgggaaaaacaccgattgttgtcaatgattgcccaggctttttcgtcaaccgcgtattgtttccttatctggcaggcttcggcatgttactgcgtgatggcggtgatttccgtcaaatcgacaagatcatggagaaagagtttggctggcctatgggtcccgcgtatctcatcgacgttgttggcattgataccgcccatcatgctcaagctgtcatggcacaaggttttccagagcgtatgactcgcgattatcacgatgccattgatgtattatttgaaaatcagcgttacggccagaaaaatgacgtaggtttctataaatacacccaagacaaaaaaggcaagccgaaaaaagagcaagatgaaaccgtcgatcaactgctggcaggtataagtcacccgaaacaaattttctctggtgaagatatcattgcccgtaccatgatcccaatgattaacgaagtcgttcgctgcttggaagaaggtgtcattgccagtcctgcagaagcagatatggcgctggtttatggtttaggcttcccgccattccacggtggtgttttccgctatctggatacgatgggaaccgcagcttatgtgaaactggctgaacgttatgcccacttaggcgcaatgtatcacgttcccgctggcctgaaagcgaaatccgaaagcaatgaaagttactaccctgccgcagccaaaattgctgttaatccaggtgaaaaagcgtga

SEQ ID NO: 4490 - DNA, 1164 bp, Xenorhabdus bovienii
  Coding sequence Name=Xb4151_4152.C443.gene6.dna; Position on contig =6533..7696bp; Strand=+
atggaaaacgtagtcattattgatggtattcgtaccccaatggggcgctcaaaaggtggtgtattccgtcaggtccgtgccgaagatctctctgcacatctgatgaaatcgatactcaagcgcaacccatcagtacaacctgagcatatcgacgatatctcttggggatgtgtgcaacaaacgctggaacaggggttcaatattgcccgtaattccgcattgctggcaggtattccccattcggtccctgctgtgaccgttaaccgtctgtgtggttcttcaatgcagtcattgcatgacggtgcccgcatgatcatgactggagatgccagcattgcgatgattggcggtgttgagcatatggggcatattcccatgactcacggtgtcgattttcattcgaaattaaaccgcaatgttgctaaagccgcaggcgttatgggcttaaccgcagaaatgctggcaaaaatgcacggtatcagccgcgaaatgcaagatgaattcgccctgcgctctcatctacgagccgcacaagcgacagaatcaaaagcgttttctaacgaaatcgcaccaattcatgggcacgatgctgatggcaacctgaagttcatcgattttgatgaagtgatccgtcccgataccaacctgaaaaatctggctgggctgcggccggtctttgatcctgtcacaggcagtgtcacggcgggtaactcttcagcactttcagatggcgcatctgcgatgcttatcatgagtgaaagcaaagccaaagaattagggttgaaagcacgtgcccggatccgttcgatggcagttgttggctgtgatccttccatcatgggttatggccctgtacctgcaacacagatggcattgaaaaaagcaggcctgagtcttgctgacattggccttattgaattaaatgaagcatttgcagcccaatcactggcctgtatgaaagggctgaatctgttggatagtatggacgataggatcaacctgaacggtggtgcaattgctctcggccatccattaggctgttctggcgcacgcatcacaactaccctgcttaacctgatggaacgcaaagatgtacagttcgggctggcaactatgtgtattggattagggcaaggcattgctacaattatcgaaagagtttag

SEQ ID NO: 4491 - DNA, 702 bp, Xenorhabdus bovienii
  Coding sequence Name=Xb4151_4152.C443.gene7.dna; Position on contig =7849..8550bp; Strand=-
atgacaacactgagctgtaaagtcacatcggttgactccattacagataccgtttatcgggttcatttattacctgattcgcctttttcttttcgtgcggggcaatacctgatggtagttatggatgaaagagataagcgtccgttttccatggcatcgccaccatcagaaaaacagacgatcgagttgcatataggggcttctgagttaaacctgtatgcaatggcggtgatggacaggatcctggatcagagagtgatcgatatagatattccacatggtcaggcatggtttcgtgaagatagtgaaaacccgatgttattgattgccgggggaactggattctcttatacccgctctattttactgtcagcactggaaaaaaatccgaaccgcgatatctcgatctactggggagggcgtgaattacatcacctctatgatctgggagaattgcagggattgagtgagtgttatcccaatctggctgtggtgcctgtggttgaacaggttgatgaatactggcagggcagaacgggtacggtcttgagtgcagtcttagaagattttggcagtttggcgaaccatgacatttatattgctgggcgttttgaaatggctaaaattgcccgtgaacgcttttgtagtgaacgtgatgcgtctattgatcgcatgtatggtgatgcgtttgagtttatctga

SEQ ID NO: 4492 - DNA, 1473 bp, Xenorhabdus bovienii
  Coding sequence Name=Xb4151_4152.C443.gene8.dna; Position on contig =8561..10033bp; Strand=-
atgaaataccgtgatctacgagactttctttccttgttggaacaatcaggtgaattaaaacgaattcgtatggaggttgatccttatctggaaatgacagaaatcgcggatcgtactcttcgtgccggtggtcctgccttattatttgaaaatccaaaagggtattcaatgccagtattgtgcaatctgtttgggacacctaagcgggttgctatgggaatggggcaggatgatgtcaaggcattgcatgatgttggcaaattactggctttcctcaaagagccagagccgccaaaaggttttcgtgatctggtcgataagctgcctaagttcaagcaagttctgaatatgccaaccaagcgcctcaattctgcaccttgtcaggagcaagtctggacgggagatgaggttgatcttacccgtattcctgttatgcattgctggccagaagatgctgcgccattgataacatgggggcttactgttaccagagggccaaataaagagcgccagaatttgggtatctaccgtcagcaggttctgggtaaaaacaagctcattatgcgttggttatcacaccgtggtggagcgctcgattttcaggaatggtgtcaggctcatccgggagagcgtttccctgtttctgttgcgttgggtgctgatcctgccacgatattgggtgctgtgactccaattcctgatactttatctgaatatgcctttgctggattgttgcgtgggcataaaactgaagtggttaagtgcttgtccaatgatctggaagttcctgccagtgcggaaattatccttgaagggtatattgaaccggacgaaatggcaccggaagggccatatggcgatcacacaggttattataatgaagtggatatgttcccagtattcactatcacccatatcacccagcgtcgtgacgctatttatcattccacttacactggccgtccaccggatgagcctgcggtactgggtgtggcgttgaatgaagttctggtgccaatactacaaaaacaatttcctgaaattgtcgatttttacctgccaccagaggggtgctcctatcggcttgcggtcgttacgatgaaaaaacaatatgcaggccatgccaagcgggtcatgatgggagtctggtcatatctacggcagtttatgtacacaaaatttattatcgtttgtgatgatgatatcaacgcgcgagattggaatgatgtcatttgggcgataactacgcgaatggacccgcagcgagatactgtcttaatggaaaatacaccgatcgactatctcgattttgcatcaccggtttctgggttaggctcaaaaatgggattggatgcaaccaataaatggccaggagagacacaaagggaatgggggcgcccgatagtcatgagtgatgaaattcgcgcccgtgtcgatgaaatttgggataaattagaaattttgaagcgataa

SEQ ID NO: 4493 - DNA, 126 bp, Xenorhabdus bovienii
  Coding sequence Name=Xb4151_4152.C443.gene9.dna; Position on contig =10352..10477bp; Strand=-
atgtcctattgctcgagaaatttgcccgcgtttacagtacagaagataccagcttcccataatattccgactccattacacaatatgtctagcataacaaaaccaaggcttcaggatcatcaataa

SEQ ID NO: 4494 - DNA, 489 bp, Xenorhabdus bovienii
  Coding sequence Name=Xb4151_4152.C443.gene10.dna; Position on contig =10418..10906bp; Strand=+
atgggaagctggtatcttctgtactgtaaacgcgggcaaatttctcgagcaataggacatttagagagacaggatgttatttgcctgacacctacagccaaaattgaaaaaatcgttcggggtaaaagaactaccgtcactgaacccctttttcccaattacctttttgtgaattttgatccagagattattcataccacgactatcaattcaacgcgaggcgtcaatcattttattcgtttcagcacttatcctgctgttgtcccacaaacgttgattgatgaattaatgtccgcaacagaacaggaatatatcgcacctgaaaccccaattactggtgatactgtactgataactgaaggaattttcgaaggtattcaagcaatttataatgagccggatggagaaacccgctcaattctcctattaaatattctcaacaaagaagtatccaaaatattagataataagcaattcattaaaatttaa

SEQ ID NO: 4495 - DNA, 1017 bp, Xenorhabdus bovienii
  Coding sequence Name=Xb4151_4152.C443.gene11.dna; Position on contig =10972..11988bp; Strand=-
atgagctatgtatttccaggtacgtttcctggtcgtcgtatgcgccgtgtacgtcgtcatgatttttcccgccgtctggttgctgaaaatcaactcactgtcaatgatctgatttatcccgtttttgttatggaagggattaatcaacgtcaagaagtgtcttctatgccaggagtgtatcgtctgacaattgatcttttgctgaaggaagccgaagagattgcccgactgggtattcctgttttgtctctgttcccagccattgaagcagacaaaaaatcactggatgcgcaggaatcctataaccctgatggtttgattcagcgctctattcgtgcattgaaaaatgaggttcctgagctgggattactgacagatgtggcactggacccatttaccacgcatggacaggatggtgtcattgatcaggatgggtatgtcatcaatgatattaccaaagagattctggttaagcaggcgctatcccatgctgaagctggggctgaaatcgttgcaccgagcgatatgatggatggccgtattggtgccattcgtgatcagcttgaggtcgatggctatatcaacacgcagattatggcttactcagccaaatatgcctcttgttactatgggccattcagagatgcaattggctctagcggtaatttgaaaggcggcaataagatgacctatcagatggatccagcaaacagcgatgaagcgttgcaggaaattgcacaggatttgcaagaaggggcggatagcgtcatggtcaaaccaggtatgccttatctggatgtgatccgtagggtgaaagatacttttggtgtgccaacattcgcttatcaggtttctggtgaatatgcgatgcatgtggctgctatccaaaatggttggttgaaagaacagccagccattatggaatcattgctgtgcttcaaacgtgcgggtgccgatggcgtactgacttattttgccaagcgtgtagcacaatggttgaatgagcagaaatactga

SEQ ID NO: 4496 - DNA, 780 bp, Xenorhabdus bovienii
  Coding sequence Name=Xb4151_4152.C443.gene12.dna; Position on contig =12107..12886bp; Strand=-
atgtctgtggatgatacccaacctcttatcggtcacttgattgagctgcgtaagcggattttaaatagtttgattaccgtgctggtgatttttctggcactggtttatttttctaatgatatttatcggcttattgctgcaccgttaatggaacagttaccgaagggagcaaatatgattgcgacagatgtcgcatcgcctttctttacgccaatcaaactgactattatggtgtctatcgttgtatcggcaccgatgatcctgtatcaggtctgggcatttattgcaccagcattatataaacacgagcgccgtttgatcatgcccctgctgttttccagcagtgtactgttttatctgggcatggcatttgcttactttgtggtatttcccattgcatttggtttttttgtcaaaaccgtgccagcaggggtggtcatttcgacagatatcagtaattacctgagttttgtcatggccctctttatggcgtttggtgtttcatttgaggtgccggtagccattattttgttgtgttggagtggagttgtaacgcctgaatccctgaaaagaaaacgtccttacattttggttggtgcgtttgtggttggcatgttgctaacacctccggatgttttctcgcaaactttgctggctatcccgatgtatctgttatttgaagtgggaattctgctttctcagttttatgtgggtggacgaaaatcaggcagagcagaaaacgaatctgaatatgatgaaggtaacaatccagaaaaataa

SEQ ID NO: 4497 - DNA, 393 bp, Xenorhabdus bovienii
  Coding sequence Name=Xb4151_4152.C443.gene13.dna; Position on contig =12890..13282bp; Strand=-
atggtgattggtctggttgttttggggccagaacgcttgcctatagcagtcaaaacagtagctggctggatacgggtattacgctcgctggcggctaatgtccagaatgaacttgctcaggagctaaaagtgcaagagcttcaggacagcttaaaaaaaatggaagaaaaagtagatttgcaatcattgtccccagaattaaaggcatcgatggacgagttaagggaggctgctgaatcgctgaaaaaatcgtatcagctgactcctgaagaggctaaagcgttagaagaggatgaaacacattttcattcttctgtatctcactcagtaccagaatcggcgtcaaaacaaaataaaaatcaatctcctgaaaaagccaatagtgaacactaa

SEQ ID NO: 4498 - DNA, 249 bp, Xenorhabdus bovienii
  Coding sequence Name=Xb4151_4152.C443.gene14.dna; Position on contig =13322..13570bp; Strand=-
atgataagcatcccacaattactcattattgctgtcattgtcgtattgctatttggtaccaataagcttcgctctctgggttcagacttgggagcatcgatcaaaggttttaaaaaagcgataagtgatgatgaaaagtcagatcaagctgagaaaaatagccatgatgctgattttgacaccaaaagtattgctgaaaagtccactgttgccgaaaaatcagagagcaaaaataaagagcaggtataa

SEQ ID NO: 4499 - DNA, 1689 bp, Xenorhabdus bovienii
  Coding sequence Name=Xb4151_4152.C443.gene15.dna; Position on contig =13658..15346bp; Strand=-
atgcagttgccaatgatatgtctcatatggaaaaacggctggcggcactggagggaaaatatgactcctagtgagataaaacgcctttactttattgttcgggtctttctttcctatggcttagatgagctgatccccaatattcgtctgacatggccgttgcgcttcgggcgttatttcttgttctggcttcccaatcgacacaaggataaaccactcggtgagcggttacgcctggcattgcaagaacttggcccagtgtggatcaagtttggtcaaatgctttctacccgtcgggatctgtttcctccagctatcgccgatcaactctcaatgttgcaggatcgggttgtttcttttgatggtgccgtggctcgcaaatccattgaaattgctttggggggaccgctggaaacatggtttgatgattttgactcacagccattggcttcagcttctattgcacaggtgcatactgctcggcttaaggagaatggtaaggaagttgttcttaaggtgatccgtccagatatcctgcctgttattaaagcggatgtccgtttaatgtaccgtatggcgcatctggttcctttactgcccgatggctatcgtcttcgcccgcgtgaagttgtgcgtgagtacgaaaaaacgttgcttgatgaactgaatttattgcgtgaagcagcaaatgcgatccaactgcgtcgcaattttgaagatagctcaatgctttacgtgccagaaatttatcctgattattgtcgggagaatgtactggtcatggagcgtatttatggcattcccgtgtcagacattgctatgttggaagcacggaacacggatatgaaactgcttgcggaacgtggtgtgcaggtgttcttcacgcaggtatttcgtgacagttttttccatgcggacatgcatcccggcaatatttttgtcagttatgaacggccggaagatccgacttatatcggcattgattatggtattgttggttcattgaacaaagacgataagcgctatttggcagaaaacttcattgctttcttcaatcgtgattaccgcagagtggctgaacttcatgtggattctggttgggttccagccgatattaatgtggaagatttcgagtttgctatccgtacggtctgtgaacctatttttgaaaagccgctggctgaaatctcatttggtcatgtcctgttgaatctcttcaatacggctcgccgttttaatatggcggttcaacctcagttggttttgctgcaaaaaacgctgctgtatattgaaggcttagggcgccagctttatcctcagcttgatttatggaaaacagcaaaaccttttctggaagattggttacacgatcaggttggtattccggcgattgtgcgcgcatttaaagaaaaagcgccatattgggctgaaaaattacccgaattccctgagctggtttatggtgctcttcaacagcataaacgtttgcagacgagcattgatcagatatcgcagcaattacagaaacaacaggtcagccagaaaaaatctctctatttactggggatcggcgcgacattgtttatctgtggtagtctgtttttcatgactgacaagattcatctatcgtggtggttgatgggggcggcagtcatatcgtggatatttggttggcgcaggcttaagtaa

SEQ ID NO: 4500 - DNA, 651 bp, Xenorhabdus bovienii
  Coding sequence Name=Xb4151_4152.C443.gene16.dna; Position on contig =15276..15926bp; Strand=-
atggagacgcccgaattaagtgacaacctgaattctacggtgttgtttccggtgctgactgcgtttctggaaacgactctgaatcatcttctgtaccgtgaaaccgtattgaagtcctcccgcatgaggctggcaggtaaggtactgtccattgaattgaaagaaattaaaacaccactggtattgatattcagtgaaaaacaggtggatgttttgagccaatggtcagagtctgccgactgttcgatgaaaacgacgttcactgcgttactcaaattgcgagatcgtcactgtctttcatctctgattaacagtggtgaaattgttatcgaaggggatatgcaagttatgcagcaatggtcggctttgctggatatgtctgagtgggatcctgctcattatctttccccttatgttggcgatattgtggcagaaggcctcagccgggtgatgaagggaagcattaaacttgccagtaatgccattacaaggcagaaaacctaccttacagaatcattgacggaagagtggcgagtggcgcccaatccgctggaagtggcttactttagtgaagaagtcaatgcagttgccaatgatatgtctcatatggaaaaacggctggcggcactggagggaaaatatgactcctag

SEQ ID NO: 4501 - DNA, 756 bp, Xenorhabdus bovienii
  Coding sequence Name=Xb4151_4152.C443.gene17.dna; Position on contig =15928..16683bp; Strand=-
atggctgatcaatcgaaaaaaactacagattttggtttccgcaccgtagaaaaagatgaaaaacaaaatatggtggccgaggtatttcactctgtcgcttcgaaatacgacttaatgaatgatttgatgtcatttggcattcatcgtatctggaaacgtttcaccattgatgcaagtggaattcgccgtggtcataaggtgttggatcttgcgggaggaaccggggatctgacggcgaagttttcccgcatcgtgggagagaaaggtgaagtcgtactggcggatatcaacgaatcgatgttgaaagtggggcgtgagaaactacgtgatatcggtatcgtaggcaatgttaattatgttcaggccaatgcggaagaactgcctttttcagacaattactttgactgtattaccatctcttttggcctgcgcaatgtgacggataaagaaaaagccttgcgctctatgtgccgagtacttaaacccggtgggcgtcttttggtgctggaattctccaaacccatgctggcacctttgagcaaagtttatgatgcttattcgttccatgttttaccccgaattggccagatgattgtcaaggatgcggacagttaccgttacctgacagaatccatccgtatgcaccctgatcaggaaacattaaaatctttgatggaagaagcgggctttgaccaagtttcttacaccaatatgaccggggggatcgttgcactgcataaaggattcaaattctga

SEQ ID NO: 4502 - DNA, 1335 bp, Xenorhabdus bovienii
  Coding sequence Name=Xb4151_4152.C443.gene18.dna; Position on contig =16759..18093bp; Strand=-
atgctgattggcagtttaagtggattgctgggcggagggattttcgtctggctttctgttcaccagcgaattcaacagaaagagttggaactgcgtgaactgcatagtcagcttgctatcagccatgaaaagttagaacagtcccactattggcgtactgagtgtgatcaattaaatcaagaactgctggcacagcgcgaaatcaacagtgtacaggaagttgaattacgagaattaagcacacggcttgaagagagcaggctggccgcagaagaaaaacagcgtctattgatcaatagtgaacaacgcctcaatacccaatttgaaaatctcgccaatcgtatttttgagcagaatcggcgtcgtaccgatgaatacagccgccaaagccttaatgacctcctgatgccttttcgcgagcagcttgacgggttccgtagtcaagtacaggatagtttcggacaggaagctcgcgaacgccatactctgacccatgaaatccgcaatctccagcaacttaatgcacaaatggcaaaagaggcgatcaacctgacgaaagctctgaaaggggataataaaatgcagggcgattggggcgaaatggtgttggcacgtgttttggaatcttccggtttacgtgaaggatatgaatttcatacacaggtcaacattaaaacagaaaacggtgagcgctttcagcctgatgtcatcgtgcatttgccgcaggaaaaagatgtcattattgatgccaaaatgtcactgatcgcctatgaacgttactttaacagtgatgatgacacgcagcaggcacaagcgttacaggagcatataaactcaatcaaaggacatattcgggggctgagccggaaagattatcaacaattgcccggtttacggtcgctggattatgttttgatgtttatccccatagaaccggcttatttggtggcacttaatcaagcacctgaattactggatgaagcattgaaacataatattatgctggttagtccatcaacacttctggttgccgtgcgtaccattaataatctttggcgctatgaatatcagagtcagaatgcacgccttattgcggacaaagcaaccagaatgtatgacaagatgcggttgtttgtggatgatatgcaagggttgggacacagcctcaataaagcacaggagagttaccatctggcaatgaaaaaactggctgaggggcggggaaacctgattagtcaggctgaagggttccgtgatttaggtgttgatgttaagcgccctattgattcacagcttattgataaatctttccaatcattgcaggttaatgaatga

SEQ ID NO: 4503 - DNA, 531 bp, Xenorhabdus bovienii
  Coding sequence Name=Xb4151_4152.C443.gene19.dna; Position on contig =18234..18764bp; Strand=-
ttgagtttgcatgaaattatcgaactggtcacagacttcgtaaaagcccatgaatattgggcaatccccattgtttttctacttgcttttggtgaatctctggcatttatctccctgctgttgcctgcgacgatcattttattaggattgggggcgttgattggtgaaagcgggttaaatttttggccaatatggatagcggcagcagcgggagccttttttggcgattgggtttcctatctgtttggtgcccactacaaggacaatgtcggcaagatgtggccactgtcacgtcatccgcaaatgttagtgcgcggccatcgattttttgaacgctggggagtttggggtgttttcatcgggcgtttttttggtccattgagagctgttataccactggtagcgggtatttgcgccatgccgaaacgtcatttccagcttgccaattttgcctctgcgctgatttgggccttcggtattttggctccgggagcgtttggtttacgctggctggcagaatggatgggctaa

SEQ ID NO: 4504 - DNA, 783 bp, Xenorhabdus bovienii
  Coding sequence Name=Xb4151_4152.C443.gene20.dna; Position on contig =18842..19624bp; Strand=-
atgaccacaacattgctatcccatccttcattactccccttacatggtggcattaacttccgtgatttcggtaataagacgctgcataatggtgcaaaaattaaatcagggctgttattccgctctggctctttggacatgttgactgaaaatgatcagacttttttgatgagcaaaaaccttttccagatcattgattatcgtgatagcagcgaaattgaggataaaccagatcgagtgtggcgtggggcgaattatcatcatgctccggccaatccactctctaaggaagttgatgccaatctggaaaaattgggtcaggaacgtctggagcagtttgatgaacgagcattcatgctgcgtttatacgaattattgccaatcagcaatcctgcttacaaaaagctggctaatctattggtgcaaccagagaaaggcggaattttacagcattgcgcagtgggtaaagacagaactggcgttggatctgcgctggtgctgtttgctctgggagcagatttggatacggtaatggaagactatttagtcaccaacgttacgctggcaccgtatcgggaatatctcttgaatgaacatgcaaaagtcatgagtgaccgtgtgattgaaaaatttgcttatgtttattcagtgcaggaagagtttttactaacggccttaaatagtattaaccagcattatggcagtgtggatatctggctggaaaaagatatcgggctggatatgacagcacgtgaaaaattacaaagttattttcttgaataa

SEQ ID NO: 4505 - DNA, 756 bp, Xenorhabdus bovienii
  Coding sequence Name=Xb4151_4152.C443.gene21.dna; Position on contig =19753..20508bp; Strand=-
atgtctgatgtatttcatttaggtatcaccaaaagcgatctgcaaggagcgactttggctattgttccaggcgatcccaaccgtgttgaaaaaattgcaaaattgatggataaccctgttcatctggcttctcatcgtgaatttacgacatggcgcgcagaaattgacggaaagcccgtggttgtctgctccacgggtatcggtggcccttcaacgtcaattgctgtagaagaattggcgcaattgggggtgagtactttcctgcggatcgggacaaccggtgcgatccagccgcacattaatgtgggtgatgtattggtcacgacagcggcagttcgtctggatggggctagcctgcacttcgcaccaatggaattcccggcggtggctgattttgaatgtaccaacgcactgtatgcagcggcaaaagcatcaggatcggccacccacgttggtataacggcttcttccgatacgttctatccggggcaggagcgttacgatacatactctggtcgtgtcgtccgccgttttcaaggctccatgcaagagtggcagcaaatgggggtgatgaattatgaaatggaatcagccactttgctgacgatgtgtgcaagtcaggggctgcgcgctggtatggtggcaggggtgatcgtcaaccggacgcaacaggaaattccagatgtggaactgttgaaaaaaaccgaaagcaacgctttgggaatcgtagttgatgccgcccgccgtttgctgtaa

SEQ ID NO: 4506 - DNA, 99 bp, Xenorhabdus bovienii
  Coding sequence Name=Xb4151_4152.C443.gene22.dna; Position on contig =20818..20916bp; Strand=-
atgatttattggtttgaccacataaagcacttgcttagatgcattaataagcataaagcaatagtcatgttattaaataaagatagatgcaatatgtaa

SEQ ID NO: 4507 - DNA, 138 bp, Xenorhabdus bovienii
  Coding sequence Name=Xb4151_4152.C443.gene23.dna; Position on contig =20900..21037bp; Strand=-
gtggcgggcgaaaaaattatttccccaatatctcctgagccgatccacgaatggattgtgctacccactcagcatattgatgatttgatcaaaaaagcccatcgtaactcccttcttgttgatgatttattggtttga

SEQ ID NO: 4508 - DNA, 2295 bp, Xenorhabdus bovienii
  Coding sequence Name=Xb4151_4152.C443.gene24.dna; Position on contig =21069..23363bp; Strand=-
atgacagttttgaatcatacattaggttttccacgtatcggcttgaaaagagagctaaaaaaggcgcaagaaaattattgggcaggcaagatttctcaacaggaattgctggaaacaggtcgtgaattacgtgcacgtcactggcaacagcaaaaagaggcgggagttgatttagttccggtaggtgattttgcttggtatgaccaagtattgacgactaacttgctattgggcaacgtgccaccacgtcatcagaatgaagatggtagcattgatctggatacgctgtttcgtattggccgcggtcgagctccaacaggcacaccagcggctgcttctgaaatgactaaatggttcaatacaaattatcactatatcgtacctgaatttcagcaggggcaagaatttaaattgacctggactcaattactggatgaagtggatgaagcactggcattgggacacaaagtcaaacctgttctactggggcctgtaacttatttatggctcggcaaggtgaaaggtaaagccttcgaccgcctctccctgttaacggatattcttcctgtctatcagcaagtattagcagaattggcaaaacggggcatcgaatgggtgcagattgatgagccggcactggtactggaactaccgaaggaatggctggaggctttctcgacggcttatcaggcgctgcaaggacaggctaaattactgctgacaacgtatttcgatagcatcagccataatctggcgacgatcaaatcactgccagtacaagggctgcatgtcgacttagttgcagggaaggattcccttgatgaattgaataaatctctgccggaaacgtggttgctttcattgggggttatcaatgggcgcaacgtctggcgagcagatttgagtgctaaataccagcttgtggcatcgctggcaggcaagcgtgatatttggatcggcacgtcctgttcattgctgcacagcccgattgacctgaacgatgaaaccgggctggatgaagaagttaaaagctggtttgcctttgcattacagaaatgcgcagagctgtctttgctggcacaggcactgaatgcaccggaaggcagcaaacaggctgaactggatgcttacagtgcgccaatccgtgcacgccgtagttccacaagggtgaacaatccgacggtgactgagcgcatcacggcgatcaaaccacaggatagcgagcgtaatctggtttatccagaacgagccaaactccagcgtgaacgttacaatttaccgttgtggccgaccacaactatcggatcattcccacaaacaacggaaattcgtagcctgcgtctggatttcaaaaaaggtcgtgtggataacacgcattatcgcaccaatatttctgaacatattaagcaggcgatcaatgaacaggaaaatctgggactggatgtgctggtgcatggtgaagccgaacgtaacgacatggtcgagtatttcggtgaacattttgatggttatgtctttacccaaaatggctgggtacaaagctacggttcccgttgtgttaagccgccagtaatcattggcgatatcagccgtccggaagccattactgtaaattgggcaacatatgcacaatccctgacagataagcctgtcaaaggaatgttaacagggccggtgactatcctctgctggtcattcccaagggaagatattagccgcgaaacgattgctaaacagattgcactggccttgcgtgatgaagttgatgatttacaaaaagcaggtattggtatcattcagattgatgaaccagcactgcgtgaaggtttgccgctgcgtagggaagaatggcaggaatatctggaatgggcggtggatgctttcaaactgagtgccgcgattgcggaggatgatactcagatccatacccatatgtgttattgcgagttcaatgacatcatgctttccattgcagcactggatgcggatgtgatcaccattgaaacgtctcgttcagatatggaattgttggattcatttgaagatttttcatatccgaatgagattgggcctggtgtgtatgatatccactcacctaacgtgcctagtgtcgaatggattgaagcgttgctgcgtaaagcggctgaccgtatcccagtggaacgtctgtgggttaacccggattgcggcctcaaaacccgtggctggactgaaacccgtcaggcactggcgaacatggtcgaagcggcgaaacgtctgcgtgcttccgtgaacaatacttccgtaaataactaa

SEQ ID NO: 4509 - DNA, 957 bp, Xenorhabdus bovienii
  Coding sequence Name=Xb4151_4152.C443.gene25.dna; Position on contig =23471..24427bp; Strand=+
atgatcgaaataaaacatttaaaaacactacaggcattgagtcattgcggttcattggctgcggctgcaaatcatctgcatcagacgcaatctgctctttctcatcagttcagtgaactagagcatcggctgggattcaaactcttcattcgcaaaagccagccattgcgccttacgcctcaaggggaagtgctgttaaaactggcggggaaggtactccctctggtgacggcttccctgcgtgaatgcagtgaaccggaagaaattaatctgcgcattgccattgaatgccatagctgtattcagtggctgacgccagcactgaagcgttttagtgaaagctggccgcaggttagtgtggattttaaatccggtgtgacgtttgatccgcagcctgcactgcaacagcgggaactggatattgtactgacctcagatattattgcagacagcaagctgaactatacgtcgctgtttgactatgaagtgaaactcgtgcttgctccggatcacccattagcaaataaacgcgatatctatccacaagatctcgctcccgaaacgctgctgatttatcccgtccagcgccaacggtttgatatctggcggcggttcctccagccagcaggtgttaccccgacattaaaaagcgtcgataatactctgttactgatccagatggtggctgctcgcttaggcattgctgcattaccccattgggcagtagaaacattcgaaaggcaggggctggttgtgacaaaaacgttgggagaaggattatggagcagattgtatgctgcctgccgagaaggagaacagcaccaacctgccattaatacatttattcgttctgcgcgccagcacgcggtggacaatttgccgtttgtaaaacgggtttcaatatccaacggtgatgcacccaaagagatgcaacaatcaggctgcttcctatggtaa

SEQ ID NO: 4510 - DNA, 900 bp, Xenorhabdus bovienii
  Coding sequence Name=Xb4151_4152.C443.gene26.dna; Position on contig =24312..25211bp; Strand=-
atgtggctgttaacgatcacaacttttttgtgggctgcctcattcagcctgattggtgcttaccttgctggtcaggttgatagctggttttccgtgtttatcagagttgtgctggcggccttggtattcctgccgtttttgcgctggcgtgggttatcgctgaaagtgatctcattgtatatggtcgtgggagcctgtcagcttggcgtgatgtatttgtttgtatttcatgcctaccactacttgactgtcgctgaatttttgctgtttacggtgatgactccgctgtatgtcacactgatatatgatgtgatgggacgtcagcgattgcgttggggctatgcgatgagttctttgctggcagtggctggcgcagcgattatccgttatgaccgattgagcgaatctttttggattggtttgatactggtgcagttggcgaatattttctttgcgataggtcaggttggctataagcgtttgatggaagtgtatccgataccgcagcgggtcgcgttttcgtggttctatctgggggcttgtgtggtcgcaaccattggttggctgctgtttggtgatccatataaattgccgacaacacaattacaatggggcgtcctgatctggttaggtgcaggcgcttctggcattggttattttatgtggaactatggcgcaacccaagtggataccggaacactggcgattatgaataatatgctggttccggccgggttgttggtcaattttttaatttggcagcagcatcctgattggctgggttttaccataggaagcagcctgattgttgcatctctttgggtgcatcaccgttggatattgaaacccgttttacaaacggcaaattgtccaccgcgtgctggcgcgcagaacgaataa

SEQ ID NO: 4511 - DNA, 1650 bp, Xenorhabdus bovienii
  Coding sequence Name=Xb4151_4152.C443.gene27.dna; Position on contig =25215..26864bp; Strand=-
atggaaatattttttactatcttgatcttgattttggtggtgtcagtttcaggtgttcttactaaaatgatcccgttccgcattcccttgccgatagtgcaaatagctatgggagcactactggcttggcctcattttggtttacacgttactttcgatcctgaattattcctcgttttacttatccctcctttattatttgttgatggctggaaaacaccgaccagagaattttttcaacatgggcgtgaaatagtcattctggttttattcttggtattagtgacggttgtcggtattggctacttgatttactggttgctgccgggtattcctcttattgctgcttttgctctggctgcggtgctgtcaccaactgatgcggttgcgttgtcatcaattgttggaaaagggcgcatcccgaaaaacatgatgagtgtgctggaaggtgaagcgttgatgaacgatgcttctggtctggttgcactgaagtttgccgtggcaattgccatgggaacgatggtatttacggtcactggcgccacaatagagtttttcaaagttgcgattggtggtctgctgtccggtattgccattacatggctgtacagtaaatcgttgcgattgatgagccgctggagtggcgatgatccagcaactcaaatcatgtttatgatgctgctgccattcgcttcctacatgattgctgaacatatcggcgtatcgggtattttagctgcggtggctgcgggtatgactatcagtaaatctggcgtaatccgcaatgcacctctggctatgcgactgcgtgccgataacgtatggggaatgctggcctttgtctttaacggccttgtatttgtcatgctggggctacaattgccgggtatctgggaaacgtctgtcgagcaggctgaacttgatccgcaagttgaaacgtggatgctgtttgctgcggttggcatcatttatgtggcgttggtattgctgcggttctgttggttatggttgatgaaaaatgccagcaaggtgttaatgaagaaaaaaccgctggaatttgcttcttacactatgcgtgaattgtgtctggcgtcgcttgcgggtgtacgtggtgcgattacgcttgcgggtgcgttatctgtcccgcttttcttgccggatggagatccattcccagcgcgttatcagttgattttcatcgcagcgggcgtgatcctgttctccctgtttgtcggtgttgttgtcctgccactgttgctgcgtggtatgaaagtgggagataagcaggcggatatcaatgaaatcagaatggcgaaagcagcaatggctgaagttgcgattgtcagtatgaataaaatggaagagcgcttgtctgccagcaccgaagaaaaactggatgcagaggtagtgagtgaaattgcttcccgagtcacgggttatttgcggcgtcgtaccgtgggtaaagatgaaatcgaacataacttgctggttgaggagttggaacgacgtttccgtttgacggcattaagggccgaaaggggagagctgtatcatctacgtgcaacccgtaagattagtaatgaaacactccaaacgctgctgcatgatttggatttgcttgaagcattacttgtggttaaagatcaataa

SEQ ID NO: 4512 - DNA, 1347 bp, Xenorhabdus bovienii
  Coding sequence Name=Xb4151_4152.C443.gene28.dna; Position on contig =27127..28473bp; Strand=-
atgtctggcatgcaggcaccaactcaatgcaaactcgataagtattttaagattactgaacgcggaacgacggtacgtcaggaaattttggctggattgacgacatttctggcgatggtgtattccgttatcgttgtgccgggcatgctggggcaagccggatttcctcatacagcggtctttatttctgtatgtttggtgacgggtatcggctcattattgatgggattgtgggttaacctgccgatggcaattggctgtgcaatctcgctgaccgcatttacagcgttcagtctggttttaggacagcaggtgagtattcccgtggcgctgggtgctgttttcctgatgggatgcctgtttacggtgatttcagtgacggggattcggtcttggatcttgcgcaatatgccaatgggaattgctcatggaaccggtattggtatcgggctgtttctgctgctgattgcggcaaatggtgtggggatggtgattaaaaatcctcatgccggtttaccggttgcttttggctcattgactgcatttcccgtaataatgacgttattaggtctggcggggattattggtctggaaaggaagaaagtacccggtggtattttgttggtcattatcgttatctcaattatcggcctgatttttgatcccgcagtgaaatatcaaggattttttaagctgccaacgttgggagaagatgggttgtctctgatgtttagcatggatattgtgggagctttgcagcctgtagtgttgccgagtgtcttggcattggtgatgacagcgatatttgatgcgacagggacaattcgagccgtagcagggcaagctaacctattggataaaggcggccagattatcaatggaggcaaagctctgacggctgattccgtaagcagtatttttgcaggcgcgatgggttcttctcctgctgctgtctacattgaatccgctgcgggcactgccgccggaggcaagacgggcttaaccgccgcggttgtgggtattctgttcctgctgattttattcctttctccgttgtcgtacctggttccggcctatgcgacagcccctgctttgatgtatgtcgggctactgatgctgagcaacgtgcggaagctgaatttcgatgattctgtcgaagctatgtcaggattactgtgtgcggtgtttattgtactgacttgtaatatcgtcaccggcattatgctagggttcagtgctttggttgtcgggcgagttttctctggtgagtggcgtaaactgaatatcggtacggtgatcattgctatcgtgctagtgatattttatgccggaaattgggctatctaa

SEQ ID NO: 4513 - DNA, 270 bp, Xenorhabdus bovienii
  Coding sequence Name=Xb4151_4152.C443.gene29.dna; Position on contig =28592..28861bp; Strand=-
atgccacgtgttttgataaaatcaccatgtactaatttttctcgatttaaatggcacattttttcaattcacgtggcgcgctacatacacaatttgatgaacaggcttaaacaagtagatctttttagtgtgttctcagtacatacggagataactcacaacaaattttatgattatctcttgattctcatcccttattcactggataatcattcgcctcaaattctctctccatttttttatctgaaaagccaaacgattgcgtattga

SEQ ID NO: 4514 - DNA, 102 bp, Xenorhabdus bovienii
  Coding sequence Name=Xb4151_4152.C443.gene30.dna; Position on contig =28834..28935bp; Strand=+
atggtgattttatcaaaacacgtggcatatttagattcttttgtggtcggtaagaatcattttttctttaaccaagtggggataattttacaggaaagttga

SEQ ID NO: 4515 - DNA, 135 bp, Xenorhabdus bovienii
  Coding sequence Name=Xb4151_4152.C443.gene31.dna; Position on contig =28890..29024bp; Strand=-
atgctactgttttttttcacttcctgtacatttaccctgtctgtccatagtgatttttttaatgcaccgcaattgcggtgctttttttctcaactttcctgtaaaattatccccacttggttaaagaaaaaatga

SEQ ID NO: 4516 - DNA, 183 bp, Xenorhabdus bovienii
  Coding sequence Name=Xb4151_4152.C443.gene32.dna; Position on contig =29025..29207bp; Strand=+
atgctacaaagtctggtctaccagacaacttgcaaacacaacatcacaactacaaagccaaaagcttcaatgtatcactacagagttacttttcgttccggcttaggaagttgcgcacactatagggatttgctggtatatcatcaatggacaaattataatgattcggattacaaaaactaa

SEQ ID NO: 4517 - DNA, 921 bp, Xenorhabdus bovienii
  Coding sequence Name=Xb4151_4152.C443.gene33.dna; Position on contig =29260..30180bp; Strand=+
atgtctaaacgtttaccaccccttaatgcgttacgcgtttttgatgctgcagctcgtcatcttagttttactaaagcagcagaagaattatttgtaactcaggcggccgtaagtcaccagatgaaaagtctggaagactttctgggattgaaactttttcgtcgccgtaaccgttcactactgctgacggaagacgggcagagttactatctggatatcaaagaaattttcactgctatcaatgatgcaacccgcaaacttcaggctcgcagtgccaaaggtgcactgacggtaagtttgtcaccgagctttgccattcagtggctggtgccacggctttctggtttcaatcagagttttccgggcattgatgtcaggattcaggcggtggatagggaagaagataaattggcagatgatgttgatgttgcgattttttatggcagaggcaattggccaggcatgcggacagatcgtctctatcctgaatatctgctacccgtttgttctccctctttactgatgggggaacgcccattaaaaataccggcagatctggccaagcatactttgttgcacgattcttcccggcgggactggcaggcctatattcgccagcttgatatgcagcagcagatcaatgttcagcaggggccgatattcagccatagctcaatggtgattcaggcggcggtgcatgggcagggggttgcccttgccaataatgtgatggcacaaaatgaaattgatgcggggcgccttgtctgcccattcaatgatgttttggtcagcaagaatgcattttatttggtttgccatgataatcaggcagaattgggcaagattgcggcttttcggaaatggatcttgatgcaggccgcgagtgaacaggcaaggttaggatttatcactaacgaatga

SEQ ID NO: 4518 - DNA, 444 bp, Xenorhabdus bovienii
  Coding sequence Name=Xb4151_4152.C443.gene34.dna; Position on contig =30188..30631bp; Strand=+
atgtgtgaaggcgtatcacgtcatatatccagaaacaggagcggagcgatgagcagtcgtttcatgcttatttttgttggtatcagcggttttttgtatgtggcattgggggcgatgggtgcacatatgctggcacctgtcctgacgtcacgccaaatggaatggatccataccggcctgcaatatcaagggttgcatacactggtcatgatggtgctggctgctttactgatgaggcagccaacgaagccgtttggctgggcgggtatttttttcgctgcgggaatagtgttatttagtggcagtctttattgtctggcctttttaccgctaaaatttttggtttatctgacacccatcggtgggtttagttttctcattggttggttatgtatattaattggcgctctgcgtctaaggaaatcggcgcctagccatgaataa

SEQ ID NO: 4519 - DNA, 1098 bp, Xenorhabdus bovienii
  Coding sequence Name=Xb4151_4152.C443.gene35.dna; Position on contig =30624..31721bp; Strand=+
atgaataaagttgctttatattgccgccccgggtttgaaaaagagtgtgcggcagaaattactgataaggcgggtaagaaaggaatttacggttttgcccgcgtaaaagaaaacagcggttatgtgttgtttgagtgttatcagcatgatgatgcggatcgtctgatccgtgaaattccgttcggtgaattgatctttgcccgccagatggtggttgtgggtgaattgctcaaaaatttacctcaggaagatcgtattacccctatccttgggatgttgacgggggttattgaacgtgcaggtgagctgcgcgtagaagtgccggataatgatgaaagtaaagagttgatgacattctgccgtaagtttacggttccgctgcgtcatgccatgcgtcaggaaaaattcttgctggcaaaggaaagtgctaaccgcccggtgattcatgttttgtttattgctccgggctgttgttacgtcggctattcttacagcaacaacaattcccgtttttatatggggatcccccgtctgaagtttccgtcagatgctccgagccgttcaacgctgaagctggaagaagcttttcatgtattcattccacatgacgagtgggaagaacgtctgggcagtgggctgtatgcagtggatcttggtgcttgtccgggaggctggacttaccagctcgtgaaacgcgggatgatagttcatgcggtagataatggcttgatggctgatagtttgatggacaccgggcaggtgaaacatcatcgtgtggatggcttcaaatttgaacccacagtgaaaaatgtttactggctggtttgtgacatggttgagcagcctgctaaggttgcccatctcatgacagactggctagtgaaaagctggtgtcgtgaagccattttcaacctcaagttgccgatgaaaaagcgttatgaggaagttgctcagatcttgcagaagatagaacagcaactgaaagaaaatggagttaatgcccaaattcaggccaagcacttgtaccacgatcgtgaagaggtcacggtacatgttcgtcgtatttggtctgcatatgcaatgacccgggatttttaa

SEQ ID NO: 4520 - DNA, 1431 bp, Xenorhabdus bovienii
  Coding sequence Name=Xb4151_4152.C443.gene36.dna; Position on contig =32039..33469bp; Strand=+
atgacctcaaagaataaatatacctatgtggggttatctgattccaagtccgttcaggatgttaatgcacttctcacagcctacgttccaaattccgatccgggtattcgtgtcgcacatacaccgctgggaaataaagctcccgatgaacttgtacgaaccaattatcattggacgaataaagtcggctcttccggtgcagtggaattatcatatcactttctagaatctgctccttccgtgatgccaagatttggtattgctggattcagttcctttaatgatgagcagaaagaggccgcactattgtctttacaatcgtggtctgatgttgccaatgtaaaatttaatgaagtcagcagcctttctaaagccaatattacttttggtttctttgattatagtataactgacgactatgcgtttgcgactttaccaaaagggcagaatacgacttattcctggtatagcgcggagagtcgtactttcatagacaatgacattggtgtgaatggctatggccgccagacatttacccatgaaatcgggcatacgctgggtctggatcatcctgccgagtacgatgcttctgatgcggtcagaccaacctatattagtgtgggggagtacttcgaagatagccgtgcctataccgtcatgagctatttcagtgaaaaatacaccggtcaggactacaaaggagcattctcatctgccccactgctgaatgatatctccgccattcagcagttatatggagccaatactgaaactcgtacaggtgatactgtatatggtttcaactccaataccgaccgtgatttcatgactgcaaccaatgccaaaagcaaactggtattcagtgtctgggatgcggatggtaatgatactttcgatttctccggttttactcagaatcaacgtattaacctgaatgaaggggctttctcggatgtcggtggcttgaaaggcaacgtatctattgcccgtggcgtaaccattgagaatgcgatcggtggcagcggcgatgacattctggtaggcaacagtgctgataacgtgctgaaaggcggcgacggcgatgacatcatttatggtggcttgggcggcgatgacctctggggtggcgcaggcaaggatacttttgtttatctgaatggcaaagagtcactgaaaggcaatcctgactggatccatgattttatttccggtgaagacaagattgatctctcagactttaactttggtggtaagggtgatatcaaatttgttgattcattctctggtagggcgggtgaagtcctgctgacttacgacaaagtgaccgatataaccgatatgtctatcagccttggtggtgacttagccagtcatgattttctggtgaaaattatcggtcagcctgtagctgaagctgattttatcgtctaa

SEQ ID NO: 4521 - DNA, 360 bp, Xenorhabdus bovienii
  Coding sequence Name=Xb4151_4152.C443.gene37.dna; Position on contig =33611..33970bp; Strand=+
atgttttctctttttttgattggaggatgtatggcgagtagtttgagacttcctgaaccggctgaactgaaagggttatggcagctatcagatggcaatcaggtatgcagtattgaattaacggatacccgtttgcctgaggggtcaatttgggcgctgaaaggtgattcttgcctgaccgaactgatggggaaccctgtagagggctggcgtcctacacctgatggtatcactctgactgacgatgatggcaatagtctggccttttttggccatgagtccgagcaatgggtggcatacctggttgatgggcgggaactcgttatgacattcagtggcacgcattctgtgacaaagtaa

SEQ ID NO: 4522 - DNA, 1626 bp, Xenorhabdus bovienii
  Coding sequence Name=Xb4151_4152.C443.gene38.dna; Position on contig =34156..35781bp; Strand=+
atgttggttccctctatttatatgcttcaggtatatgatcgagtcctgccatccagtaatgaaatgactctgctgatgctgaccctgatcacgctcggcatgttcgctattatgggcgggctggaatatatccgtagcatggtggtgatccgcatcggcagccagtttgatatgtgcctgaaccagcgtgtttataccgcgtcgtatgagtccaacctgaaaaatggctccaccgatgccgggcaaatgctcaatgacttggcaactatccgccagttcctgacgggcaatgcgctgtttgctttttttgatgtgccttggttcccgatctatctctgggttatttttctgtttagcccgtacttgggactgctggcgctggttggggcgatcattttgatcacgttggcggtactgaaccaatggctgtctcagtcgcctttatcggaagcgagtcatctctccctgcgctctgccaatcttgccagtactaatctgcgtaatgcggaagtcattgaagccttgggtatgttgccggcactgcgtcagcgatggtttagcctgcatgagcgctttctcaatttccagcgtattgccagcgaacgggcagcatccatcaccgcactgaccaaaacagtgcgcatggccttgcagtcgttgatcctcggtttgggaggctggctggcgattgaaggcaatatcacgccgggtatgatgatcacgggttctatcttgatgggacgggcattgtcgccgattgagcagttgatccaagcgtggaaaagctggagcgccgctcgtctgtcatggcagcgactggataaattgctgaaggcgcagccagaacgtaaaagcggtatgtcactgcctgcccctaaaggtattttgttgctggaaaaagttgccgcaataccaccgagtaaaacacaggccagacaaacggcggggaatcataaacaggttttgcaggatatcagtttttccctgaatgccggcgatgtgttgggcgtgattggccccagtgcgtcggggaaatctacgctggctcgcctgctggtggggatttggccgtcacaggaaggtgttgtgcggctcgatgatgccgatatttaccaatggaacaaggatgaactgggggcatcgataggttatttgccgcaggacatcgaactatttggtggcacgattgcggaaaacattgcgcgttttaatgacgtggatcctgaaaaagtcattgaagcggccaaaaaagcgggtgtccatgaactggtactcaatcttgaacagggttatgacacggtgattggcactggaggaatgggattgtccggtgggcagaagcagcggattgggctggcacgggcattgtacggcaatccgtcgctgctggtgctggatgaaccaaattccaatctggatgatatcggtgaaaaggcgctgagtcaggcgattacgcaattgcgggaacagggcaaaacagtggtagtgatcacgcatcggccttctttgctctcacaaacaaacaaaattttgctgttggtgcagggaaaaatgaaaatgtttggcccatctcagcaagttatggcggcgctgtcgcagtcaaaaacagtcgaacgtgcctcgtaa

SEQ ID NO: 4523 - DNA, 1338 bp, Xenorhabdus bovienii
  Coding sequence Name=Xb4151_4152.C443.gene39.dna; Position on contig =35854..37191bp; Strand=+
atgtcctatcagaccaacgcaaaaagtgcgaaaaatgatgaatcgggattattgccgctggatgcgaatcgctacctgcggctgggctggctggtcatcggtattggcctcttggggtttttcgtctgggcggcctttgccccgctcgataaaggtgttgcttcctccggtattgtggtggtggatggcaaccgtaaaaccgtgcagtcgccagccaatggcatcatcagacaaattctggcatcggaaggggaacaggttaaagccggacaggtactagtgcagctcagtcaggtgcaggttaatgcccaaattgactccctgaaacagcaattgcataccactctggcgacggaagcccgattgctggccgagcagcaaggactggaggtgatttcctttccggctacgttgtgggatcaacaatcggaaccacgcattaaggatattctggtattacagaaacagcttttcctgtcacgtcgtgagatgctgagaagtgatctggcggggatgcagcaggctgaagaggggctgagttttcagctcaaagggttgcggaacgcgctgacaaataaacagcagcagcaggtttcacttaaagagcaagtgaccaatctgcggccgctgaccgaagagggttactttccccgtaaccgttatctggaattgcagcgcagtcaaagtgagttaagtggcagcatggccgagatggcgggacgcattggtcagcttgaaaaacagtgtcaggaaacccggcagcggattatccagcggcaggcagattatcaacgtgaagtccgtagccagctttcggatgtgcaggtgcaggccaatgagctgaaaaacaagctggaaacaactcagtttgatttatcccatacctcaattaccgccccggtgagtggctcggtaatggggctgacagtatttacccaaggcggcgttgtggcttccggggaaaaattgatggaaatcttgccagcccagagtgcgttagaagtcgaagcgcgcctgatggtacatctgattgataaagtcgcaatggggcaggatgtggatttgatgttcaccgcattcaatcagaaccagacgccgaaagtgacaggcaaagtgacagtgatctccgccgaccgattggtggatggggtgacaagagaaccttattaccagatgcgggtcagagtgacaccagaggggatggcacaactggcagggctgcatatcaagccggggatgccggttgaagtcttcgttaaaacgggttcgcgatcactgttgagttatctattcaaaccattgatggacagggcgtcaacgtcactgattgaggagtaa

SEQ ID NO: 4524 - DNA, 1383 bp, Xenorhabdus bovienii
  Coding sequence Name=Xb4151_4152.C443.gene40.dna; Position on contig =37197..38579bp; Strand=+
atgttcagatcttatagtgttacagggcgtgtcctgtttttaccgttgtttctgctgatgttgttttcaggtacggttcaggcgctttccttaacggaggcttacgctctggcactgcaacacgatccgacgtttcaggcggcgataaaagcgcaggaagcggggcaggaagagaaaaaccttgggcgggcggaattactgcccaagctcgcttttaactaccaatatgttccccagaattggcagaaaatggagtcctcttcttcagcttcagggcaaaggggaaatatgatcacggaaagtcgcaaccgccagtatcacagttacagtggttcgcttgtattgactcagccgctggtggatttcgaggcgtgggcgcgttacaaaacccgtcaggcctacgtgctgatgagtgatgcccgttttcgggtagacacccaacaactggcagtcagggtagtaaacagctatgtggatgtcgcttatgcgcaggacaggcaggcgcaggttgcccagcagcgcagggcttatgaagaacaactggaacgcaatcagaaattgtttgcttccggtgaaggcacacgcactgatgtggcggaaacccaagcccattacagtcaggttgtggcggatgagttaactgtcaaagatgaactggatgcggcaatccgtgacttgcaattgctggttggtatacctttaccagacgatttgccggtcaatcgcctgtcacctgtccagaacttcaagatcataaaactggcttttgcacattatgccgattgggagcagatagcattgagccagaatccgcagttggcggaggctcgccagaaagtggccgttgcggctcaggacattgagcgcaatcgggcaggttatctgccaaaactggagttatatgcttcccataccgaaaataaatccagcagcgataacatcgtcgatcaaaaataccgtaccgattcaatcggcttgcgggtgtcgatgaatctctataatgggggaggaacgtcggcggcagtgcgtcaatcagcagcgaattatagcaaagccaaatatgagatggatgccgaagcgggagaaaccctgaatgcgctgcgacgcaattataacgcctgcatgaacggcgagaagcggatacgtgcctatgaatcggcagtggaagcggctgaattacaggttaaagcaacgcagaaaagtgtggcactggggcagcgggttaacgtggatatcctgaatgcggagcaacagctctacatcgctcgtcgtgatctttctcaggcgaaatatcaatatatgaaatcctggattggattattgagtgaagccgggcaattgaatggagagcatattcaattggcttcgggatattttgagtga

SEQ ID NO: 4525 - DNA, 114 bp, Xenorhabdus bovienii
  Coding sequence Name=Xb4151_4152.C443.gene41.dna; Position on contig =38637..38750bp; Strand=-
atgaagtttaaagccataaaacccgcctgtacttgttttccctcgctatgcgacgccttcaaatacgcgatgacggggaatacggaggttatgacaaacagcaatttgggttga

SEQ ID NO: 4526 - DNA, 588 bp, Xenorhabdus bovienii
  Coding sequence Name=Xb4151_4152.C443.gene42.dna; Position on contig =39054..39641bp; Strand=-
atggtaataaaaaaagcacttcttgctaccttagccgtctctggcgttatgtatggctcattggcttatgcggattcgcatactgtcactgtaggttatgcgcaaagtaaggttcagaattttaaagatattcgcggggtaaatttgcattaccgttatgaatgggattctccagtcagtattattggatcgtttactcatatgaagggcgatagagattataaatttagttttaaacataatggcaagaattatactggagaggatagtcttgatatgaaatattattcactaatggcaggccctgcttaccgcatcaatgactatctaagtgtatatggtttgcttggttttgcacattcaaaagctgatgcaactgaaggggcttatcatctacgcaacacagtcgaagttgaggccagtaaaatgaatagaaaatcgaccaacttcgcctatggtgctggtgtagaagttaatccgatacaaagtctcagcctttatgccggttatgaaggcgcatcagtaaaatataatgataaccgtgaggaaattaacgggtttaatcttggtgtaggttatcgtttttaa

SEQ ID NO: 4527 - DNA, 120 bp, Xenorhabdus bovienii
  Coding sequence Name=Xb4151_4152.C443.gene43.dna; Position on contig =39971..40090bp; Strand=+
atgatgtcttctgattcagaaaagcgtcaaactgcttttcccagatatttaattaaaaggagccattgcatcagtgtagataaaatcgccactacttttgattggcagcttctaacgtaa

SEQ ID NO: 4528 - DNA, 1275 bp, Xenorhabdus bovienii
  Coding sequence Name=Xb4151_4152.C443.gene44.dna; Position on contig =40135..41409bp; Strand=+
atgaaattagaaactctatccattcatgcgggttattcgccagatcctgccaccaaagcagttgccgttcccatctaccagacaacgtcttacgccttcgatgatacccagcatggggctgatctatttgatttaaaagttgaaggtaacatttactcccgcatgatgaacccaaccaatgatgtgttggaaaaacgcattgcggccttggaaggtggcattggtgcgctgtctgttgcttcaggtatggcagccgtcacctatgctatccaagccattgcccaagcgggagataacatcatttctgtggcaaaactgtatggtggaacctataacgtgatggcgcacactttcccaagcatagggattgagacccgtttcgttgatcacaacgatatcgcagccatcgaagcattgattgatgagaaaaccaaagcagtatattgcgaatccatcacaaaccccggtggccatatcattgatatccaagcaatggcagatgttgcccataaatatggtatcccgctgattgtcgataataccgtcgcaactccctacttatgccgtccgtttgaacatggtgcagatatcgttatccattctctgaccaaatatatcggcggtcatggcaccaccattggcggtattatcgtcgattcaggcaaattcccgtgggcagaacatcaagatcgttttgctattctcagcacaccggatgcgtcgtatcacggaattatttataccgaacattttggtgcagccgcctatatcgcccgctgccgtgttgggccactgcgcagtactggtgccacactttcggcattcagtgcgttcctgatcctgcaagggcttgaaacattagcgcttcgcatggaacgccatactgaaaataccttgaaagtcgcacaatacttgaatgagcatcctcaagtatcttgggttaaatacgccggattgcctgaacacccagagcatgaactggcggtacgttacatgggggggaaaccttcgtctgtgctgtcattcggtatcaaaggagaagaagaagctggcacacgtttcattgatgcactggaactgatcgtgcgtctggtcaacatcggcgatgccaaatctctggcctgccatccggcatcaaccacacaccgccagttaaacgatgcagaaatggtaaaagcaggggtatcacgagatttgattcgtctttccattggaatagagcacagcgatgatattattgccgatctttcacaggcgttagatgccgcaaaatag

SEQ ID NO: 4529 - DNA, 975 bp, Xenorhabdus bovienii
  Coding sequence Name=Xb4151_4152.C443.gene45.dna; Position on contig =41492..42466bp; Strand=-
atgaatttcattccagattatcatgatgtggtagaagcgcattcccgaataaaaaaatatatcaataaaacccctgtttttacgtcaaggactgttaaccaactcttcaatgctgaagtctattttaagtgtgaaaattaccaaagaatgggagcattcaaatttcgtggagctatgaatgcactatatcaatttagtgatgaacagaaaaaagcgggagtcgttactttttcgtctggaaatcatgctcaagctatttctttggctgctaatttactcaatattcctgctactattgttatgccacaggatgctccgaaggccaaaattgcagcgacaaaaggttatggtggtaaagtagtaatttatgatagatatactgaagattgtgaggaaataactcgtaatttagcgaatcagtacggtttaacgtttattccaccttacgatcatccacacatcattgctggtcaaggaacatcaactaaagaattgtttgaagaagtgggagaattagatgccttgttcattcctcttggtggtggaggattattatcaggttctgcactttctgctgttcatttttctccaaaatgtcggatttttggagtagagcctgtagcaggtaatgatggtcagcaatcttttaaaaaaggtgaaattgttcatattgcaacaccaaaaaccattgcggatggagcacaaacacagcatctaggaaaatacacttttcctattattcgtcatctggttgaagatattctagttacttcagatgatgaattgattgatgctatgtactttttagcagaacgaatgaaaacagttgttgaacctacagggtgtttagggttctctgctgcaagaaaaatgcgagaagagttaaaagggcaacgaatcgggattattcttagcggtggaaatattgatatggaacggtattctaactttttatctaatatcggtaaaatctga

SEQ ID NO: 4530 - DNA, 702 bp, Xenorhabdus bovienii
  Coding sequence Name=Xb4151_4152.C443.gene46.dna; Position on contig =43080..43781bp; Strand=+
atgagagaaaatgttttaatgactcaaattcaatgctatctcaacaatacatactgtttcctctccactggagaagtcatcgccaatggttctgatgaatggggacagtggattgctctaaacaacaacatatttcatccacaaggcggggggcaacccgctgatattggctgggtaaataacatccccgtgaaggttagaaagcaggctacagggcaggtagtcgtgtatccggaatccgcacttcatgccccaccaggtgcacaattgaactcaaaactatcagaagaggctcgtatatgtcatgcagcgctacacactgctggtcacctgctgaactgggaaatgcgtcaatatggctggatggcaatcaaaggccaccactttcccggagaatcacgcgttgagttctctcctatgggctccagtgccataccctccgatcaactatctttacaaaatatcgaaacaactatcaacactagactgcgtgatggcgggcaagtaacaacttggtatgaagcggatacccggctgtgtttaattgaaggtactgaacccatgccctgtgcaggcacacatgttgataatctgaataaaatcaatgaatttactattaagtcggtcaagttcaaaaaggaaactctacgtatcagctacgacgccagccatattattttaaggactgacaatgtctcatga

SEQ ID NO: 4531 - DNA, 918 bp, Xenorhabdus bovienii
  Coding sequence Name=Xb4151_4152.C443.gene47.dna; Position on contig =43771..44688bp; Strand=+
atgtctcatgatgcattacccttatcccgtaggcgtctctatctgctggatctgggactactggctgttgccctttcttggggcgccagctattcgctgatgcaattgatcattcaagccggagtgactataccgttatttttgatgctgcgctttgctctggccgtaccttttatgttttttggcactcgaatacgcctgcataacatcaaacccggagaaattattaatggcctgatattcggctgcctgctgtacgccatcctgacgtttgaaaccttgggagtaaagtacactacagcgtctaatgctgggttccttattgccttgtctgtcgtcatcgtccccttttttgaacgtatattgggcaaacgtaagcaaagtaagtttatttactttacctgttttatttctttagtcggcggtgggatattaagtttttccaatacagacaactttggctttaataacggtgactggttgatcctgcttgcagcgctgattcgcggtttccaaatctttatgtttggtaagcagacatccggtaaatcctactcattagttaatatcaccctgattgaactggtgacagtctccgtacttggattagcctttgttttaatgactgattcagcatcattgctcctcattccaaccatcacattcaatgtttggggatatattctgtttctgagtttgctcgcaactgcttttgcttttctgatgcagctttatgcagcaaacatcaccagccctactcgggttggcctgatcttgtcattggagcccgggtttgcagccctgtttgctgtcacaattatgggagaaactatcggtattttgcagggcttcggcggagccattattgtctgtgccgctctgctaggacgtatcgtggaaggaaaacgctatgagtaa

SEQ ID NO: 4532 - DNA, 462 bp, Xenorhabdus bovienii
  Coding sequence Name=Xb4151_4152.C443.gene48.dna; Position on contig =44763..45224bp; Strand=-
ttgtctggtgtatccaaggccgcactatctcaattggagtcgggcaactctaatcctcgaattgatacgttagatgctattgcaattgcgctacgtcttccgctgggagatttatttggcagcaataatgagcgctacccctatctggaaaaaaagattccaatgaaggatacatattcccaagtgatgaagtttcgtatcggcttggggagtgttgctgaaatatggcatttacaaatgaatccaggggttattattagtagtcccgctcatacagtagggactcatgaacacattatgattcatgatggtgtattaatgttacgactttcaaacgatgaaagtgtgatattaaatcccggtgacttttatgcattctctggtgatgtcatacattcctatatatgtattgatgttgccgttagtgcaacagtagtcatgtcttattcaattcaaagttaa

SEQ ID NO: 4533 - DNA, 408 bp, Xenorhabdus bovienii; identical to SEQ ID NO: 702
  Coding sequence Name=Xb4151_4152.C443.gene49.dna; Position on contig =45298..45705bp; Strand=+

SEQ ID NO: 4534 - DNA, 402 bp, Xenorhabdus bovienii
  Coding sequence Name=Xb4151_4152.C443.gene50.dna; Position on contig =45714..46115bp; Strand=+
ttgctcacggatggacagggcttgccattagcgattgccgttgcgcccgctaatattcatgatatcagacttgttatagccaccctggacggtttacagacaggacgccggggttatggaaccaaactccatcgggataaagcttatgaggcggaatggctggaaaaagaattaaaaacccgtggatacgtcccctgcatacaatcaagaaaagaagaacaagatgcgctggccgaacaagaggattttaaagtgaaccgttgggttgttgaaaggacacacagttggcttaatcgttttcgtcggattctggtccgttgggaaaaacgggttgaaaattatgaagccatgcttcatttggcttgtagtttaattgtctggaatataatcctattgggatag

SEQ ID NO: 4535 - DNA, 126 bp, Xenorhabdus bovienii
  Coding sequence Name=Xb4151_4152.C443.gene51.dna; Position on contig =46104..46229bp; Strand=-
atgaataatactcaacaacaagatagagttaagaaaaattgtatagatattggtaacaaggtaaaacgattgcgtttagctagaaatatttctttaaacgaactgtctaagagcctatcccaatag

SEQ ID NO: 4536 - DNA, 1401 bp, Xenorhabdus bovienii
  Coding sequence Name=Xb4151_4152.C443.gene52.dna; Position on contig =46561..47961bp; Strand=-
atgtctacgtttactcgtttacaaaaacgtttatcccgtcagggaatcgaaacccagtacgaaaataatatctatcgtttcaataaagagcagattgaagctgaagttctactgcctgaatccttgccgttggaagaaaaggccgtacagcaattacttgaccttgcttccgttcacgtacccggtagcgacgcgaaagtgtgtcgtaccagagcgacaccggattttcatccgggagcggtggcgccagtgggctgtattgtggcaacgacagaggatctggtgatccctgctgctattgggacagacatcaactgcggtatgcgcctgctgacaacgggtttgagctatgcagaagcgaatagccaaaaagaagccttgattcagcagctaaaaaataccctattgatggatcaacgtgatgtacccgtcactccaacctcattcagtgccttgtttgacgaagggctggcggcatggttacaggaattgccccaacagggggtctggcaacaggccgatttcaagcgcatgcatactgaattaaacgcgatactgagtactcaggcagtacaggcgcatagccgatacgcacctgaagcctttttcgagcaccgtgaaattatccgtccagccagcttgggtacagtgggttcaggcaaccactttgttgaactgcaaatcgtcgatactattctggacaggcacgcggcatacgcggcaggtctgcatgaaggtgaggtattgatgatgatccacactggttcacgggatgtgggcttttacatcggtcagcgttgggtggataaagcgagagctttatggccggttacggcaaaatatccatcttctggcctgtttggtctgacagatgaacacgctcaggaatattttctggcgatgggctgtgcggcgcgttatgcgtgggcgaatcgcattgttttgacggaactggtgcgcgcggcttggaaacagatttttgggcaggataaaagtaagctgattgtggatctctcgcataatattatctttcctgagcagggtatgaacctccatcgcaaaggtgccacacctgcacgagctggggaattggcgttaattcccggctcaatgggggattattcttaccttgtattggggaaaggcaatgaagactggctgtggtcgtgttcacacggagccgggcgttcgatacgccgtcaggcaatgcggaataaagtgcctgatctacaaaaaaatagtcgattgccgtggcagtgcatcactttgaaaagtgatcgcctgcgtgaagaagcgcctgaggcttataagccaattacgccggtaattgagattcaagaacaggctggattaattcagcccgttgcaagggtcaggccgtggatcacgttcaaagcttga

SEQ ID NO: 4537 - DNA, 210 bp, Xenorhabdus bovienii
  Coding sequence Name=Xb4151_4152.C443.gene53.dna; Position on contig =48004..48213bp; Strand=+
atggggaagaagtgttgtttttcctgcagcagctcaattcaggaagattttagcggcgttactctatccatgaattctgagattgtaaaggcctttctgataccgacaaaaaatcaccgtaacccccccaaattatgtatttcgtttaataaggtaaattaccaccagaatgactctagcagacagattcacattttatttaatggttga

SEQ ID NO: 4538 - DNA, 1425 bp, Xenorhabdus bovienii
  Coding sequence Name=Xb4151_4152.C443.gene54.dna; Position on contig =48383..49807bp; Strand=+
atgaaaaggttttttttagtgtttgtacttacgttatttttgtcaggttgtggtgatgctgacgaaggttattatcttatcaaaaatattgacgtcatttttgatgaagacgaagggcttgaggatttcaaggaattaattgcaaagaaaatcaaaggagaaaaagattatatgtatttttttctgactcctgatgaggccagctactttaccggtgttaaaccagaaaaaacagcgatcaaggataacaggcttgagattggccatgacatgcttactctgaaaaacacgttttcaggtgtcaaactagttggtgataaaaagagaatctgtggtttttacaattgtataattacctttgaattagataaagttaaacaaaatgataaaagacttcttgatatacaaaataaattcaaagagtcagaaattaaaaaacaaaaattatatgctgcacagaaagaaaaactggctgaacttgtttttaaggatttctttggtcagttaacctatttagacgattttagtattaaactcgagccgatagaatcaggctctttaaatgaaattaattctggtatatattttcgtaacatgggtggattacgtattgatttggagagtgaagataatacaatttataatttcaaaaatcaaaacagtcaacttattggtgaattatttattattaaatccctcaaagataaattcgattattcatcatggttagagatacaagatgaaatattatatcaagataaacagggcgctatttactacaatatgcacggtgaactggaagcagtttattatcaatacgatgaaaaatcccaacattattttatcggtcttgctaacgcacctaaattagaaaccataaaaaaatcctatattatgctacgtactatggatgagcagtaccgaggagaaatcgccaatatacaggatgtttctctatctcaaactgactttgaaaacaaatacggaataaaaatatccgatagttttgacagtcaagaaatccataaggttcttatcaaaaaaatgaatgataagttggctgaaactaaagatttttccaaagataaagattggttcaattccatattggtaaggtttccatcagaatcatttagctccaaaatttatttttattttcatccaaaacctatgaaaaaagttatttctgaatttaagaataaataccctagaggaaaatggattgagaatgtttttgtttacaatatttctccatcttccgaaagcggctatagttattttattaaccataatggtatggtttatgagatatttgtggccactgatattcatagcaccgtcgaacgaatggctttcctcagcgtattacgtcatttagatcctactaagctgcaagggtactcaccttcaaagctgcgaccttaa

SEQ ID NO: 4539 - DNA, 156 bp, Xenorhabdus bovienii
  Coding sequence Name=Xb4151_4152.C443.gene55.dna; Position on contig =49921..50076bp; Strand=+
atgttgaacaccttgccctctccccgttttgcgagcatgatcgcaatacctttacccgttagtcagaaagcccacatgcttacgatcaagaaactgcaaaccgctatctcaagcctttcggtatggcgcaaggggggatcaacgtgcgccacataa

SEQ ID NO: 4540 - DNA, 276 bp, Xenorhabdus bovienii
  Coding sequence Name=Xb4151_4152.C443.gene56.dna; Position on contig =50043..50318bp; Strand=+
atggcgcaaggggggatcaacgtgcgccacataagccattattactgctgtatgtactttctcaataccaaaaaaagcatgggcgactgtttaactacggggaagaaatccaccagccattactggagttactcaacaattttgggccaaagcgcaaaaaccattatccaaccatgccattctggcggttacgcggcgatgggttctgggagttgcagaataccgaacgctgcacaccccaaaaaggcaataaagaaccaccaaagcgcgagttga

SEQ ID NO: 4541 - DNA, 486 bp, Xenorhabdus bovienii
  Coding sequence Name=Xb4151_4152.C443.gene57.dna; Position on contig =50216..50701bp; Strand=+
atgccattctggcggttacgcggcgatgggttctgggagttgcagaataccgaacgctgcacaccccaaaaaggcaataaagaaccaccaaagcgcgagttgattgaatatggcgtgataggaggattcgatatgggttcaattggtcttgacgatagtatgaagttaatcgtttcaaaaggtattaatggcggccagatggtggagcagcttttctggaattttgccgatcagccaatcttgctccctcagcaaaaagaatattacccgctggaagagttcgtcatttggcatcgcagccaagtctttaagcaacaatccgcacagattaaaaaggggagccacccgctcctctgctattcagactgttgcaggttattgacccgctttcagtttctggaaatagttttcgtacaggatattggcgttgccaacatcgctctgccattcccctttctggataatggcttcatcaggatacagtga

SEQ ID NO: 4542 - DNA, 1053 bp, Xenorhabdus bovienii
  Coding sequence Name=Xb4151_4152.C443.gene58.dna; Position on contig =50591..51643bp; Strand=-
atgaaaaagtggttctatctgctagccgctgggatgatggcatttagcattggttcggtgaatgccgctgccgctgatgatggcaaaacgctgtatttctacaactggactgaatacgttccgcctggtttgctcaaccagttcaccaacgaaactgggattaaggtgatttactccacctatgaatccaatgagagcatgtataccaagctgaaaacctataaagacggcgcttatgatttagttgtgccatccacttactttgtctcaaaaatgagtaaagaggggatgctgcaaaagattgatacgagcaaactcagcaatttcaaaaatcttgatccgaatctgctgcataagtcttttgaccagaataacgaatattctatcccctatatttggggagcgacggtcattggtgtcaacagcgataatatcgatccaaaaaccatcagctcttgggccgatttttggaagcctcagtatcaaagcggtctggtgctgactgatgatgctcgtgaagtcttccagatggcattgctgaagctgggctattccggcaatacgaccaatccgaaagagattgaagcggcttatcaggaactgcaaaaactgatgccaaacgtactggcattcaactctgataacccagccaatccatttatggaaggtgaagttgatttaggtatggtgtggacaggctctgcctatgtagcacgccagtcgggaacaccggttgatattatctggccgaaggaaggcggaattttctggatggatagtctggcgatccctgccaatgccaagaatgttgatggggcgatgaagctgattaacttcctgttacgtccagagatcgcggcacaggttgcacaaaaaatcggttatccgacgccgaatctggcagcgaaaaaattactgccggcagaaatcacgggagacccgtcactgtatcctgatgaagccattatccagaaaggggaatggcagagcgatgttggcaacgccaatatcctgtacgaaaactatttccagaaactgaaagcgggtcaataa

SEQ ID NO: 4543 - DNA, 141 bp, Xenorhabdus bovienii
  Coding sequence Name=Xb4151_4152.C443.gene59.dna; Position on contig =51597..51737bp; Strand=-
atgaaatgtcgcttctataatagccgcttttcaaaggataggttcactctgggcctatacatgactaacgcaccaactgtgagggaaacactgcatgaaaaagtggttctatctgctagccgctgggatgatggcatttag

SEQ ID NO: 4544 - DNA, 780 bp, Xenorhabdus bovienii
  Coding sequence Name=Xb4151_4152.C443.gene60.dna; Position on contig =51864..52643bp; Strand=-
atgatcggacgcctgttgcgtggtggtttcatgaccctcgtttatgcttatttgtatatcccgatcgtgatcctgatcgtcagttcgtttaaccagtcacggttcggtattagctggcagggttttaccactgaatggtataacctgctgttcaacaatgacagcttgcttcaagcggcgggacactccctgacgatggcggtcacttccgccacatttgccactctgattggttcactgacggcggttgccttgtaccgttattcgttccgtggcaaaaagttcgtgagcggtatgttgttcgtggtgatgatgtcgccggatattgtcatggcgatttcattgctggtgctgtttatgctgctgggcgtttcactgggattctggtcactgctgttttcgcatatcacgttctgtctgccatttgtggttgtgacggtttattctcgtctgaaagattttgacgtcaaaatgctggaagcggcgcgggatttaggggcgggtgagttgaccattctgcgtaaaattatcctgccactggcgatgccggcagtgatggcaggttggctgctcagttttaccctgtcgatggatgatgtggttgtttcctcattcgtgacggggccaagctatgaaatcctgccccttaagatttattcaatggtaaaagtgggcgtttcgccggaagttaacgcattagcgactattttgctggtaatgtcactgatattggtgctgttcagccagtttattatgcgtgatcgtactggcaaagcttaa

SEQ ID NO: 4545 - DNA, 831 bp, Xenorhabdus bovienii
  Coding sequence Name=Xb4151_4152.C443.gene61.dna; Position on contig =52671..53501bp; Strand=-
atgaagaagacgcgtaaattattccagaatatcgtcatcacgggcatggtgtcttggctgatgctgttcgtctttatgccgaacctgatgatcatcggaaccagctttctgacccgcgatgacgccaatctggtacagatggtattttcgctggacaactattcccgcctgttcgatccgctgtatgccgaagtcttgctacactcgctgaatatggctatcgtcgcgacgttatgctgtctggtgatcggctacccgttcgcctttttcttggctcggatgccggagaagctgcgtccgctgatgctgttcttgttgatcgtcccgttttggacgaactctttaatccgcatttatggtttgaagatgttcctcagcactcgtggttatcttaatgatttcctgctgtggctgggaatagtcgataaaccgctgcgcattatgtatacctccgaagccgttgtgctggggctggtttatatcctgctgccgtttatggtaatgccactctattccagtattgagaaattggataaaccctgtctggaagccgcgcgtgatctgggggcgggaaaattgcagacgtttatccgcatcattatccctttaacgatgccgggtattattgcgggttgcctgctggtactgttgccggcaatggggctgttctacgtggctgacctgatgggcggggcgaaaaacctgctgatcggtaacgtgataaaaagccagttccttaatattcgcgactggccgtttggggcggtaaccagcatatgcctgacgctggtgatggggctgatgctgctggtttacctatcgtgcgcctaa

SEQ ID NO: 4546 - DNA, 1116 bp, Xenorhabdus bovienii
  Coding sequence Name=Xb4151_4152.C443.gene62.dna; Position on contig =53485..54600bp; Strand=-
atgactgagaatacctctctgacaccactcgttgaactaaacaccctgagtaagggtttcgacggcaaacaagttatttcacagctcgatctgattatcaatgatggcgagttcctgaccattcttgggccatccggttgcggcaagaccactgtactccgtctgattgccgggctggaagatgcggatagcggcaaaattttattggaagggcaggatattactgatattcccgccgagcaccgtcacgttaatacggtgttccaaagttacgcgctgttcccccatatgaccgtatttgaaaacgtcgcttttggattgcgcatgcagaaaacaccggcaaaggagattgccccgcgtgttgaagaagcgttgcgcatggtgcagcttgaagagtttgcccagcggcgtccggctcagctttctggcggtcagcagcagcgcgtggcgattgcccgtgcggttgtgaacaagccgaaagtcttgctgctggatgaatcgctgtcggcactcgactataagctgcgtaagcagatgcaaaatgagttgaaagcacttcagcgcaagctcggcatcacttttatcttcgtgacccatgatcaggaagaagcgctggtgatgtcagaccggatcgtggtcatgcgtgatgggtacatcgaacaggatggcacgccgcgtgagatctacgaggagccgaaaaatctgttcgttgcccgctttatcggcgaaatcaatatctttgatgccaaggtgcagcatcgcattgatgagcagcggatacgcgctgacgtcgaaggccacgaatgtgatattttcacttcgttgcccgtcaccgccggacaaatactgaaagtgttgctgcgcccagaagatcttcgggtcgaagagatcaatcatggcgagcaggtgtcgggtctggttggttatgtgcgtgaacgtaactacaagggcatgacgctggattcggtggtcgaaatggaaaatggcaaaatggtcatggtgagcgaattctttaacgaagacgaccccgatgttgaccactccctgaaccagaagatcgcggtcacttgggtagaaagctgggaggttgtgctggtcgatgaagaagacgcgtaa

SEQ ID NO: 4547 - DNA, 165 bp, Xenorhabdus bovienii
  Coding sequence Name=Xb4151_4152.C443.gene63.dna; Position on contig =54661..54825bp; Strand=-
atggagtgcgatgttatcatttatgaaatgataacaaaaaatgacatattgttattgtttcggctttcaatttcagcttactgcgtttattatgcgcgcttcgtaatttcaaccggcgctactggtttgagcttcagcggagaaacgatttttcctgctggctga

SEQ ID NO: 4548 - DNA, 252 bp, Xenorhabdus bovienii
  Coding sequence Name=Xb4151_4152.C443.gene64.dna; Position on contig =54806..55057bp; Strand=+
atgataacatcgcactccatgttgtacccagtctacacgcctggaaataatttcctatcgggcattttacaatcacttttaattttctttactttcaataagatccttcagacacgaaaacccgctcttccctccattaaaactcacttgaaaacaccgtttatgctactctgccacacttccggcgttatacaggccctgctatcttttctttccccctcgacaaaaacgcgccatccgattcttttttga

SEQ ID NO: 4549 - DNA, 177 bp, Xenorhabdus bovienii
  Coding sequence Name=Xb4151_4152.C443.gene65.dna; Position on contig =55333..55509bp; Strand=-
atgttcattgtgttgtgctgcaccgcgttatcaggcgcagaattgccgatgataatcaccagctctgcgttgttcacgtctgtgacaaaggaagggccgtgttggtggcgatggtcatcaatactccaacgagttgctgttgtcccatgtggaatggcaatgccgttaccaagatag

SEQ ID NO: 4550 - DNA, 222 bp, Xenorhabdus bovienii
  Coding sequence Name=Xb4151_4152.C443.gene66.dna; Position on contig =55809..56030bp; Strand=+
atgcagatagagtcacgctatgaaaaagtgactatcaatcagatagtagatcgtcgttcatcatcaaagcgtcccactggtatgttgtcaaatcttgacatgaatggtatgaatactctacttggtgaaagggtaatggatcgtatgcgtcttggtgatagcctatgggttatatttaattggggcagttatcgtagtcgtattaaaggaaatgaatactga

SEQ ID NO: 4551 - DNA, 1614 bp, Xenorhabdus bovienii
  Coding sequence Name=Xb4151_4152.C443.gene67.dna; Position on contig =56117..57730bp; Strand=-
gtgtgcaatagtattatagaatttctggatgaaaatgagataacagaacatcctgactattatataagtaaagcgattttagcaagagagaatagagagtatataactgaaaggcagtcggtgcttcatttactattcttcatagaaaaaaaacctattcttataagtgaactcttgaataaaatagatgatatgaatcttacagataaaacacaattccttctcgggataaataaatcaacatctattttacatccatatattagaactattattacttttatcctctcaggcactaagcagcagataaattcttactttaattgttttctgggacgttctccaaaatatggtgagataccgccattccctgccgttgatactttatctattgatatcttgcttaatttctatgaagcaacacatagattcttagtcaacacctcttcagggctagctattcttgaaaagatgacgaaacttatctatgcagttgcaaaagaaaaatctagtcaaagtgtgcttttctttatgtcatattttaatacagatataaacccccgttatgctatagatatagcaaatactttctttgatgcggataacatttcattagaaaatagtgtgtatactcaatctttggcatataacacagctttaactgcaacaaaaattggagatatcagtgaagcagaacactggctggattatatcgatgatgatgataaaaagaatagaattatatcgatcgtcacagaaatagataaaaaacaaaatgcaagaaaaaaacacccattaaatccgaagaatattaaaataaaaaacattaacgaaattgaaacgcttgatcttatatcaatttgttcatttcttgatggttgtggtgatgattggggttttaaagaactctatcgatcaggtagttacatttttccatcaaaaatattgacaactgagatgtttaagtcgctagctgtcaaaggaataataactctaactcaacaggattttgataacattgaaaacaaattactcaatgattttgaccatattgttaataattttaagttccatttaaatgttatagggattattgataatagaaagatctccattaagatattcctagaggagatagatagaagaaaagataaatttgatgcgtcctttgaaatgtggaaggaaatttctactggatattttcatgacgcaatggagtattatttaggaaatataagagatagttggtcaaatgagttcatgctcaatgaaaaaactattgaaagactctcgactacgtgtttgagtgcaaaagatctctcttatatagcaagttcatctgttaggtattccgcaggacaacatgccattaaatatacacaaagcaatagacacacctgcaatactttaattagcagtattaataaaaatattgactgggttgaaagcgataaatttctaggaaaagcgtaccctagaggcaaaaaacagccagttctatcctctgaaaggattatcgagcatattactaatattaatccagatgatttatacaacaatgtaccaaaattgacagaaccagtcatcaaagatgaaactgaaagtgataaataa

SEQ ID NO: 4552 - DNA, 138 bp, Xenorhabdus bovienii
  Coding sequence Name=Xb4151_4152.C443.gene68.dna; Position on contig =57757..57894bp; Strand=+
atggataaatggattctttttttttgtatttttcctttttttgtttctcatcgactaagcctctgttttatgttgatctatgattacattaatcataggttattcatttgtgttttttatttgttttctgtaaattag

SEQ ID NO: 4553 - DNA, 186 bp, Xenorhabdus bovienii
  Coding sequence Name=Xb4151_4152.C443.gene69.dna; Position on contig =57959..58144bp; Strand=-
atgataatacacgtccgtgcagaaagttttttccattcgttagaagttgaatttatacatggtgaaagcttcgcgatacgaatggttatgtgtcagacagtttttgactatatagaaggggattataatcgtcggtgttatcacaacgctaacagtggtctcagtcgagaatcatttgagaaatag

SEQ ID NO: 4554 - DNA, 171 bp, Xenorhabdus bovienii
  Coding sequence Name=Xb4151_4152.C443.gene70.dna; Position on contig =58146..58316bp; Strand=-
atgaaggtacaactggcctgtgatgcactaattatgtgctttggctacataaacgccaaagtatgtgattgtgtacgctggcagaggaaatcaatactggtcggaggattattaggcattattgataaaaggtatgacttgcattgcagtatgagtgctaaagcctgctga

SEQ ID NO: 4555 - DNA, 156 bp, Xenorhabdus bovienii
  Coding sequence Name=Xb4151_4152.C443.gene71.dna; Position on contig =58488..58643bp; Strand=+
atgaatgatttgactcacttagcatcgtgtctactaatagtcgataaaatcgtcattctagaacagcctcttagtcatgaagaagtcattgaaacagcggaaaaagtaaaagcgacgtttcttaaactggtagtagaaaccatttctcgcttctga

SEQ ID NO: 4556 - DNA, 240 bp, Xenorhabdus bovienii
  Coding sequence Name=Xb4151_4152.C443.gene72.dna; Position on contig =58883..59122bp; Strand=-
ttgatattacatcacttatgttttttgttggtactcaggtggccttatttgccacctgagcttgctatattaccgcgggagcttgccgatcactacgaatgtcatacgttgtggctgatactaatcgtgataataggctttagcctgctcactagacgcgtggcgcactgtaccaagggagacaatcgggtctcgttcggtcggctacgtgatagcgcaattgctctcattgttgattga

SEQ ID NO: 4557 - DNA, 321 bp, Xenorhabdus bovienii
  Coding sequence Name=Xb4151_4152.C443.gene73.dna; Position on contig =59136..59456bp; Strand=+
atgaaaaatacaacaacacctacgctggaaggtcataccatcacggaatatctgggtgtcgtcacaggggaaacgattcttggggtcaatattattaaggatttttttgctggggtgagagatatcatcggcggacgttctggcgcttatgagaaagaattgaaaaatgcacgggaaatcgccttcgcggaaatgaatgcacaagcccaagcgctaggagccaatgcggttgtcggtattgatattgactatgagacggttggtaaaaatggcggcatgttgatggtcactgtctcggggactgcggtgaagattgtgtaa

SEQ ID NO: 4558 - DNA, 177 bp, Xenorhabdus bovienii
  Coding sequence Name=Xb4151_4152.C443.gene74.dna; Position on contig =59510..59686bp; Strand=+
atgtggcatccaaatattctttccaacaattattacatttcattttcctgcgcattaactgtaccctgccaccgacagagcataaccgcgaaggctgaaacgaatggacgaagccgtgcggatcgcaatggaagagtgaggtgcgttatcagtgttttgctgattataaatggataa

SEQ ID NO: 4559 - DNA, 279 bp, Xenorhabdus bovienii; identical to SEQ ID NO: 890
  Coding sequence Name=Xb4151_4152.C443.gene75.dna; Position on contig =59897..60175bp; Strand=-

SEQ ID NO: 4560 - DNA, 291 bp, Xenorhabdus bovienii
  Coding sequence Name=Xb4151_4152.C443.gene76.dna; Position on contig =60167..60457bp; Strand=+
gtggctcatgtttttggcgatcgcagtcgaaaaacgttagacaagctgcttaccctcttatcttcctttactattcggttttactgcacggatgactatgttgtttatgacccacttcccgaggaagagcacttgactggaaaggcgtttattcagcgtatagagagaacgaatttaacgcatcgtacccgaatcaaaaggctgaatagaaaaaccattgggtattcaaaatcggaagaaatgcacgataaagtgataggaacctttattgaacgtgaacattatttttaa

SEQ ID NO: 4561 - DNA, 180 bp, Xenorhabdus bovienii
  Coding sequence Name=Xb4151_4152.C443.gene77.dna; Position on contig =60563..60742bp; Strand=-
atgatggtctggggtaatggttttttcgcgaagacaatgataccagagcatcatgctgttcaaattctcctcataaaacgtcaacagcccctagtaacatcacgttttatgggcgacaggctgcaacgaaaggatctcttgttacttgtggaaatcattcgggtaatttttctatcgtag

SEQ ID NO: 4562 - DNA, 528 bp, Xenorhabdus bovienii
  Coding sequence Name=Xb4151_4152.C443.gene78.dna; Position on contig =60741..61268bp; Strand=+
atgccaagaacaatgttatcaaaacctttatggaataagctagctgtattgatgcaacaaagtggatatgtatatcacaaagaagaacattatctgactttcgagaggatcctttaccggatgcgaacaggctgtccctggcgagatgcccccactgaatttggcaaatggaacaccatttttaagcgctttaatgatgggtctaagaaagctatttttaatttattattcaaattattatctgagaatacagatacagaatggttgttcattgatggcagtattgttcgggctcatcaacatagttcaggtgccgcttctgtggaagatgaagccattggtaaaagtcggggaggactttctaccaaaattcatttagccgtcgatagttacggcttgcctgttcattttgaattatccgggggacaagtgcatgacattgttcatgcggaaagtttagtcgaacaatcgcccccttcggactttgtgatagcggacaaaggttacgacagcggtcattccttatag

SEQ ID NO: 4563 - DNA, 120 bp, Xenorhabdus bovienii
  Coding sequence Name=Xb4151_4152.C443.gene79.dna; Position on contig =61553..61672bp; Strand=+
atggcccctcctgaaggcctggtgcattccactagctggtcctcgccagcactaaagaaatttatcctatgcaaaacaaaaaacgatgggagccagactggtttctacagtcactcctga

SEQ ID NO: 4564 - DNA, 516 bp, Xenorhabdus bovienii
  Coding sequence Name=Xb4151_4152.C443.gene80.dna; Position on contig =61621..62136bp; Strand=+
atgcaaaacaaaaaacgatgggagccagactggtttctacagtcactcctgaacaaccatatcgacaaactggtagagcactattcctgcctgcgtgcattccgaacagatctattttaccaggatcataccgctaagtttttcctgcgagattatcggcaactcgaagcggtggtcggtttcttctgggttatcgaatggactgaagatcatcactaccatgcccatgtcgtgttctggctggatggtagcaaaactcagaacacatatccctgggctcagcaagccggtttgcaatggagcgatatcactgaccgggatggctggtatcaccgatgcgagtttaaagagcattacgaggccgatatcaatatcccggtacgttacagcgatccgggcagtatcgccaatatccgacaggtactggcgtatatgaccaaaattcagcagaaacatggcctgctgctgtacggctgcaatgaagtccccgggcgcccacgcagaattgatttctga

SEQ ID NO: 4565 - DNA, 1227 bp, Xenorhabdus bovienii
  Coding sequence Name=Xb4151_4152.C443.gene81.dna; Position on contig =62480..63706bp; Strand=+
atggcatccgcgttaggttggcttgatcacgatgcagacacacaggctaaaacgttaaatattcttgcgctctttcaacaaaaagagagccgtgatgaattgggtattggctcgatccgagatagttttgctgaacagttatttccaggaaccagcaccatccagacccgtttacgctacatgctttttgttccatggatctatctgcgcctcgagaataaacgcatacccgccgcaaactttggtactcaggccgaccgtgacgaacgcgccttaattatcacactctcccggctcgaagattcggccggtacatttggtaaaaactcacgcgagaagcttaaacgcttgcccagctccgtttactggtccgggctgcggcgctggggtattcgcgagactatgtggtcgcaggaagaatatcatcggcgtgtggatgaattgtatcgcgaacgtacggaaatcagcgagcgagaataccttgaaaaaaatcggggtgatatgggcgacacaagcgcgtataaaccagcccagagctggcactccagcctgcctgcgccaccgcccaactttcctaatgatgcaacgtttgcactaacacgccaggaagccagctttcttcgcgatcgtattcaattgtcatgcaaaggcagtctgttggcctggctgacgctgcatagcgaaccggcagatgtgagttcaccatgggaacaccctgattacgcgaggttcccagatgaactcaaggaactgctgactcacgcgcggcttttttcttatacgatgcacggtgcagccctgctttataactatttgctcgccaaagagcgttcagataacgaccttctgtctcaacacaataacaacttcgtcgactggtttactgcactcccacgtaaggaaatcgctacctggtcgctcggccgcatgtgggaactcaccgccgaaccgggctatagcattagcctaaaaacccgccgctttgtggaacagtggattgctcttatccaacagtcccctgtgacattactcaccagtaaagaagcttgtgatctaatccgtgctcgcgaaataaccctcaaaggcccacgttcgcgcttcaaaaacagacgctctctggagcaatggagtggctatgccggaaccctgcggctggtttaccgctggcataacgtccaaatagttcttaaggatctggcgcacggcctcaggagagaagaatgctaa

SEQ ID NO: 4566 - DNA, 1797 bp, Xenorhabdus bovienii
  Coding sequence Name=Xb4151_4152.C443.gene82.dna; Position on contig =63700..65496bp; Strand=+
atgctaaatcccaacaatcgcagcttatatacttcggcactgacttctcctcccggtatggtgtttgacgaagccatagctacaagcttctcactcgacccggcatttttactgcaggcaccggtctatttggctttcacagcaaccgacagcaatcgcgctcaggatccgctatccatttttgaagccattcgtcgttattccgaacgtatcacggtatacgttcaaaaaggccgcattcaagttcccacaaagctcaagcccaaccctttgttcgggttgcttgaagatatgattgttgaatcaaaagccaaaggccgcggggtctttcaccccaaaatctgggcgattcgttttatcaatcctgaaacagacgaagtcatgtatcggttggtagtactgagccgaaatttaaccactgattcgtcctgggacctctctttgcagttggacggctaccctgtaaaacgtaagcaaagtgccaataaagcactggtgcatttattctccgtattgcccaaacgggcgacgggaaaaatggcgaaacatcgccggaagcaggcgcagcgcttcgcagatgaactgttgtatattgaatgggaatgtcccgctggttttgataaagtcgcgtttttcctgcccggagaaggttacgaatggaagccacccgaagcggatcgtgcggtggttatatcaccgttttgcaccgatgaggccctgcgccacatcgtggaacattgccaacaagctgatgccctgatttcaagacctgacaccctgctcgccttgagtaaaaagacgctcaaccttttcacgcgccagcttcatcttgacgacgcagccgaagggcagatgcacgacgagagctcacctgatgagatcattgcctccggtctgcatgccaaagcgtatctatttgaaaatggccgagacagcgaactggttctgggctcagcgaacgccaccagcgcggcgctactggggaaaacaaactgcgaaattttagtctcgctcaagggtaagaaaaagcacacgggcactattgatgacctccttagcagcgacgggatgggaagctatctgcaagatttcgaccctgcccagccgtttgagcccgatgccctgcgtgtcaaagcagaatgccatcttgaacaggcgcgtacgttgcttgctgaagctacattgagtcttcatggtcaccccggtcaaaacgaccaaagctgggcattgtggcttattggcgagattcctaagttaccgggagttgtgcaggcaacagcatggcccataacggtatcagaagtgttaagctgcaatctacaggacccgaataaggagaataaaagagaactcggagagttttcagtccaagcaattaccggactgacagcgttttcccttaaaacatcgcacccagacgtatcgctcaggttcgttctcaatctgccaattgattccttaccccccgatcacaacgcaatgattttacaaagcagcatgcggaatcaggattttctacgttacttgttgatgttgataggtgaaacggggcatcaatccttctttgccgaaaataccttcggtgatggtcatttctttacagggctagccaatggagaggaattcagcgttctggaagagctgacacgtatctatagccgcgaacccgaacgtttaaacgatatcgccgcgctggtggaaaatatgcgaaaagggaagaacgacatgattccgcaagattttcttgctctgtgggccgtatttgaatcagccatgggaggacgatatggccgataa

SEQ ID NO: 4567 - DNA, 3150 bp, Xenorhabdus bovienii
  Coding sequence Name=Xb4151_4152.C443.gene83.dna; Position on contig =65486..68635bp; Strand=+
atggccgataagcatcccagtattatcgccccactaacgggattgaaagattttcagcaacgcactgtgaattatgtttttcagcaattttacggtgatagacagcaaaatcgctttttggtagctgatgaagtgggtctgggaaaaacgatggttgctcggggcatcatcgccaaaacaatcgaacatttgcaggataaagtcgaccgtatcgacattatttatatctgttcaaatgcggccatcgcaacgcagaatatcaagcgcctaaacgtcagcaatgaaacgcagttttcacactcaacgcgactgacattcctaccaaaacaggtacggtctctgcgcaaaaacagaattaattttatcagcctgacgccgaacaccgcccttgatcacacccgcagccgtggaggtcataaagaagagcgcgcgatcctgtatcgcattttgtacgatttaccgctggctaaaggcgagcgtcgtgaacgtttacgcatggggatgcttaacctgctccaggcaacagctagccgacatggctggtgttccgcagttgaccagctttctgtcgacgacattgacagggaactagcaaaggattttcgtcgcaaggtgttagacgatgccgaactgtatgatctgctgaaggaggggtgcgaatatttcgccgatgacgatgaggacagcgagacgcacaattctgaactgcgctacgcactgatcggcaaactcagaagcaaactggcttctgtgtgcttatctgcgctggaacccgatctggttatccttgatgagtttcagcgatttaaagccttgctagatggtgatgatgaagctgcattgctggcaaaggcactctttgaacagccggacgtacgcgtgctcttactctcggcgaccccgtataaaatgtttaccctcgaccaggaaagcgaagaggataatcattacgccgactttatccgtacattgcagtttttgtataacgatgacagtcaaatcaaagatattcagcagcacttgctcgatcaccgtaccgcgttgcacacctcagaaaacgcagcggagacaaaaaatgcacttgagcacgctttattacaggttatgtgccgtaccgaacgggtaacgatgacacaaaagctagatgcgatgacgaaggaagtcttgcaaccagcaatcattacgcccaccgacctttatcacgctgcggccgttgatggcgtagccatggaagtgcaagctcgcgatatcctcgaatactggaaatcgatgccttatcttttcaatttcctaaaacattacgaattacgtacccttatagataaggcactgaaatctccttcagatacgttgcgtaaactcgttaaatcagcaaaacctcacttgctgacgaaaaaaaagcgggaacactaccagccattagatgctgcaaatccacgaatgcggatgctgtttgaagatacgctggataaaggtatgtggcagcttttgtggatgccaccttcactgccttacacaacaccaaatggggtgtatgccaacaaagagagtctgaccaaaacgctggtcttttccgcctggagcgcagtacctaatgcgattgccactgtctgctcttatgaagctgaacgacgaatggttggtgctgctcccctgattctacacagccagttcaaaaaaaaagtaaaatcgctactcaattttgcaaaatcatcgaaagatggccgcctcaccggaatgcccgttatagcctggatgctaccgtcaccaacacttgcccgccatatcgatccgcttgaaattgctcgccaaaaccccggtgagccgctgagtgtaaaggccgtgagagcaattgcaacggtgaaatgtgaagcgctgcttgagacactgcccaatggcggaccggggtctcgtgcggacgaacgctggtactgggcagccccggcgttgctggatgcccgtaccgaaacgccagactggtggctgggcgaacatggctggtataccgggccatcccaaaatgaccctgccgaaaacttccaggaacatatcgaccagtttgccgaggtggcaaatggtaagatatccctcggcccacgtcctgacgatctggcagaggttctctgtgacttcgcgcttgccagccccggaacatgtgccctccgggcgctcagccgtatcgacacaggcctggcaaccgattcggctgagatattgtccgcagcagcgcagatcgcttcaggatttcgttcgctctacaaccaggcagagagtatttcgctactacgcggctcaggcgatgacacttactggcggctgacgctgcgttatggcatcgatggcaacattcaggccatgctggatgagtatgttcatacactgctggagtcgatggggttgcagcatgaacccgccgaagcgcaactggcggctattgcaccccgtattcaggctgtggtttcactgcgtaccacgcaattgaacgttgatgagctcaagacgaaaggcggtaattatacttggagcgatttgtacacacgctgccgctttgccttacgctacggccaactgcgggacgacacggatcaggccgtcgcgcatgcagagtcggtaaaagatgcgtttaactccccctttcacccctttgtattggcttccacttcaatcgggcaagagggactcgattttcacacctggtgccacgcggtgatgcactggaatcttccgtcaaacccagtcgatatggagcagcgtgaaggacgagtacatcgttataagggccatgcggtaaggaagaatattgccgagcattatggtttgagtgcacttcattcgctggcagaaagtgcagatccatggacacagctcttcgcacttgcggcaagtcagcgcaaagcgggacagtcggatttgattccctactggatttttgaagaaggaacctctcgcgtcgagcgccgggttcccatactgccgtacagcaaagagagcattaagtttaagcggctcaagcgagaacttgcactctaccgtattgtcttcggccagccgcgccaggaagacttgctgttcggcctgaaacacattggcgatgagtctttaacggatttagcacagtggctcatttctcttgaaccaccaaaggtgtga

SEQ ID NO: 4568 - DNA, 963 bp, Xenorhabdus bovienii
  Coding sequence Name=Xb4151_4152.C443.gene84.dna; Position on contig =68594..69556bp; Strand=-
atgcgggtacaactgcgggtaacgtttgaagtggttgccagagactggcacgccagcaatcagaaatggtcggcatcgcatagcgctcgtgtattgaaaagtctcgaagataatatcttcgctgctatcggtaagcggaacattgcagaactgaaaacgcgagacctacttgtacccatcaaagcagtcgagtcatccggacgccttgaagtcgccgcccgtttacagcagcgtactaccgcgattatgcgctttgccgttcagagcggcttaatcgactataaccctgcgcaagagattgccggtgcggttgctacagcgaaaagacagcatcgtgctgctctggaacttaatcgcattcctgaattacttcaccacatcgatcactattctggcaggccgttaactcgactggcagttgaactcactttgttggttttcatccgttcaagcgagctgcgttttgcccgctggtcagaagtggattttgaaaaggctatgtggacgattccaggtgagcgtgaaccacttgaaggtgttaagcattctcaacgtggttcgaagatgcggactcctcatcttgttcccttgtcgcaacaggctctagcaattttggaaaagattaaaagcatgaatgggaatcgagagctgatttttgtaggcgatcacgatccgcgtaaacccatgagtgagaatacggtgaacaaggctctgcgagtgatgggttatgacacgaaaacggaagtatgtgggcatgattttatcacactacagagtgccggtaataccgatttagataacctagagcgaaatattcagggaaaaatccaacatacggataatccaagagaactggttgcaacagaattggctcttaacttgctaactgaacaaattgcatcatccgatgtcctcagtggatcacacctttggtggttcaagagaaatgagccactgtgctaa

SEQ ID NO: 4569 - DNA, 201 bp, Xenorhabdus bovienii
  Coding sequence Name=Xb4151_4152.C443.gene85.dna; Position on contig =69674..69874bp; Strand=+
atggtgccgaaggccggactcgaaccggcacacccgaaggcggttgattttgaatcaactgcgtctaccgatttcgccacttcggcactgaagtattcgagaagtactcggaaaacggaggtcattatacctgtcagaagtccattcgcaacacttatcctttcaatcttgttcaagtgtcgaaaaaaaaagcatatctaa

SEQ ID NO: 4570 - DNA, 159 bp, Xenorhabdus bovienii
  Coding sequence Name=Xb4151_4152.C443.gene86.dna; Position on contig =69952..70110bp; Strand=-
ttgttatttctttttcttaaacagcgcgatgacagcgccaataatgatacccacaaggatacctataaaaatatagccgataatagacatgattgtttacctcagagcggtatgttgttgtggaattatataaggtgtttaaaggttgtctattggtag

SEQ ID NO: 4571 - DNA, 1218 bp, Xenorhabdus bovienii
  Coding sequence Name=Xb4151_4152.C443.gene87.dna; Position on contig =70153..71370bp; Strand=+
atgaacaaacagttatataaactttttgctgtttcagccctgtcatgggcgctttcggcttgtgctgcccccgataatgcacaccagaataattttccgcaatcaggcaaaaaaaccacaaaatggcaagtttttgagggtaatgataataccaagaaaatggcctcatctctggtcgaccagtatgcacagtcaatctttgatgaaggtaatccgttggggatggcaatggtgattatcgataataatcaggtggtgcatcgcagtttcggggagacttatccggggagtggagcccgtccgcgacaggattcggtgatccgccttgcttcgataacgaaactgatgaccagcgaggtcatgattaagctggcgcagaaggaacgcctcaagatcaccgatccgttgcagaaatacacttatcatggtgtgcgtgtacccgattatgcgataactcaaccgatccgcctgtatcatctggccagccataccagcggcctgccacgagagcagccgggcggaaaatgggggcggccggtgtttatctggccaacacaatcaaatcgctgggcttggctgaaaacagcaggtatgaatgccgctcccggtacaacggcttcgtattccaatctggcttacgatttactggcggatgcgctctctaaagccacgggggaaccctatacccggctgctacaagaagagatcacccgcccttatcgcatgaaggatacgacactgacaccctctcgttcccaatgtgctcgtttaatggaaggggttaagcccagtccctgtctcagtaccatcgccgcagcaggcagtggcgggatttattcgactcccgtagatatgcagcgctggatgcagcagtttttatcctcccacaatcaattgaggaagaagaccgccagccgtgagcagggtatctattttaaacgtgaaaatctgacgtcaatcacaggaatggatgtcgcgggtcaagcagacgggatcgggcttggctgggtatatatggatgccaaaaaaggggtgccgggcatctatcagaaaaccggcggcggcggcgggttcaatacctatatggcgatgatccctgagcaaaatatcggtgtgtttgtggtgatgacgcgcaaggaacaaagcaagttcagtcgtgtcactaacggggtgaatgaattggtcgcagcactgtcacgaaatcatggaaagttatag

SEQ ID NO: 4572 - DNA, 1077 bp, Xenorhabdus bovienii
  Coding sequence Name=Xb4151_4152.C443.gene88.dna; Position on contig =71467..72543bp; Strand=-
atgtttggggtactggacagatatattgggcggactatcctgcaaaccattttgatgacgctgttcacgctggtgtcgctttccggcatcatcaagtttgtcgatcagcttcgcaaggttgggcagggggaatatagcgcgtttgctgctggcatctatacgctgttgagtgttcctaaagatatccaaatcttctttccgatggcggcgctgcttggagggttattgggtctgggggcgctggcaacacgcagtgaactggtggttatgcaggcttctggttttactcgcctgcaagtggcgggttcagtcatgaaaaccgcgatcccgttggtatttctgacaatggtgatcggtgaatgggtcgctccacagggggaacaaatcgcccgtaactatcgttcccagaagatgtttggtggctccctgatgtccactgccaaagggatgtgggcgaaagatggtaatgattttgtctatattaagagtgtagacaaggataatgccctgagagacgtcagtatctatcattttgatgacaacaaaaaactgctgtcagtaaaatatgcggctacggcggtgtatgatcaaaataacaggcagtggaaattatcgcaggttgaagagtctgatttacgtcagattggccggatcacgggctcacagcgtatttctgctgaatggaaaagcttgctgacaccggaaaaactgggcgtagtcgctcttgatccggatgcactctccattcgcgggcttcagcagtacattacttacctgaagcaggggcaacaagatgccggtcgttaccagctcaatatgtggaagaaagtctttgcccctctgtctgttgcggtcatgatgctgatggcactttcctttatcttcgggccactgcgcagtgtggcaatgggagtcagggtcattgcgggtatcagtacaggcttcatattttatgtcttgaatgagatatttggcccattgagcttggtttacagcatgccaccgctattgggagcgctgctaccgagtctgttattctttgtagtgagtgtttacttccttctgcatcgaaaataa

SEQ ID NO: 4573 - DNA, 1101 bp, Xenorhabdus bovienii
  Coding sequence Name=Xb4151_4152.C443.gene89.dna; Position on contig =72543..73643bp; Strand=-
gtgatcatcattagatatctagtacgggaaactctgaaaagccaaatcgcaatacttttcatcttattgctgatcttcttcagccaaaaattagttgaagtattgggtgcggcggttgaaggaagtgttcccgcaaatttggttctatccttgttaggtttaggtgtgccggaaatggcgcagcttattttacccctgagtctgtttcttggggtattaatgacgttcagcaaactctataccgaaagtgagattaccgtcatgcatgcctgtgggttgggcaaaggtgtgttggtaaaatcggccttgattctggccttgttcacatcaatgctggcggcggctaacgttctctggttcactccgtggtcttctaaataccaagagcaagtgttggcggatgcaaaagctaacccaagtcttgcggccattatggaaggtcagtttaagccttcccgtgatggcaacatggtgctgtatatcggtgacgtcaagggcaataactttgagaatgtgttccttgctcagctccgaccggtgaataatcagcgcccttccgtggtgattgcggatggcggccatatggaagagcgtccgaatggtaatcaggtcgcggtactccatcagggggtgcgttatgaaggcactgcactgatgcgtgacttccgcattaccgatttcaaaaattatcaggcggtgattgggcacaaagccgctgatattgatagcgataaagttgagcagaagacattctcccagctctggcacaagggtgacgaagattcccgtgcagagctgcactggcgcctgaccctgattgtgtcggtgctggtcatggcgctgctggtggttccattgagtgccgtgaacccgcggcaggggcgtgtgctcagtatgctgcctgctatgctgctttacctgattttcttcctgctgcaaagttccctgcgctccaatggcggcaggggtaaactcgaccccgcattctggatgtggttggtcaacggagcctattttgccttggcgctggcgctcaatatgtgggataccgtacccatgcgcaaactgcgttctcgctttaagaatcaaggagcggcctga

SEQ ID NO: 4574 - DNA, 162 bp, Xenorhabdus bovienii
  Coding sequence Name=Xb4151_4152.C443.gene90.dna; Position on contig =73582..73743bp; Strand=+
atgaaaagtattgcgatttggcttttcagagtttcccgtactagatatctaatgatgatcacgcttattacgcctgtgaaaacttgtctttttgcaggaaagtcgctaacttcgtcgtatatctaccatttatatgcatcagtttggcttccccattgctaa

SEQ ID NO: 4575 - DNA, 1509 bp, Xenorhabdus bovienii
  Coding sequence Name=Xb4151_4152.C443.gene91.dna; Position on contig =73924..75432bp; Strand=+
atggagtttagtgtaaaaagcggtagtccggagaaacagcgcagtgcgtgtattattgtcggcgtgtttgaacctcgtcgtctttcccctatcgcagagcaacttgacaaaataagtaacggttatatcagtgccttactacgccgtggtgaacttgaaggcaaagtgggtcaatccctgttgcttcatcatgttcctaatgtgctgtctgagcgcattttgctggttggttgcggaaaagagcgtgagctggatgagcgccagtataagcagattatccagaaaaccatcagtaccctcaatgagaccggctctatggaagcggtctgtttcctgaccgaattacacgtcaagggacgcaataactactggaaagtgcgtcaagcggtcgaaacagcaaaagaatcactctatgttttcgatcagcttaaaagcagtaaaaacgaactgcgccgcccattgcgtaagatagtgttcaatgtgccaacccgccgtgaattaaccagcggcgaacgcgccattcagcatggccttgccattgcatcgggtatcaaagcgtcgaaagatctggcaaacatgccgccgaatatctgtaatgccgcatatctggcatcacaggcgcgccagcttgctgacactgccgacaacctgaataccaaggtgattggcgaagagcagatgaaagagctgggtatgaattcttatctggcggtcggtcaaggttcccagaatgaatccctgatgtccgtgatcgagtataaaggcagcaaagacgccaatgcgaaacccatcgtactggtgggcaaagggctgactttcgatgccggtggtatttctctcaaaccaggcgaaggcatggatgagatgaagtatgacatgtgtggcgcagcttctgtttatggtgtcatgcgggttattgcagaactgcaactgccgctcaatgttattggtgtattggcgggatgtgaaaatatgccgggtggacgtgccttccgtccgggagacattttgaccaccatgtccggccagacagttgaagtcctgaacaccgatgcagaaggccgcctggtgctgtgtgacgtgttgacctacgttgagcgtttcgatccagaactggttattgatgtggctaccttgactggcgcttgtgttattgcgctgggcagtcactataccgggctgatgtccaaccataacccgctggcacatgaactgctgaatgcctcagaacaggctggagatcgtgcatggcgcctgccaatggctgacgaatatttcgagcagctcgattccaattttgcagatatggcaaacattggtggacgcgctggcgggacgattaccgcaggctgtttcctgtcccgctttacgaccaaatacaattgggcgcatctggatattgcaggcacagcatggcgttcaggtaaagccaaaggagcaacaggtcgtccggttgcgctcttagcacaattcctgttaaatcgtgcaggtctgaatgcggatgattaa

SEQ ID NO: 4576 - DNA, 297 bp, Xenorhabdus bovienii
  Coding sequence Name=Xb4151_4152.C443.gene92.dna; Position on contig =75290..75586bp; Strand=-
atgattacagagaatgggttacagaaaaatgatgggaaaagcgatacaaaagggtattgcagccgcaatacccttaattccgttgattcccttgatacctctagactacaccttttatgtcgaactattaggcgacaaaaagggggcaggggtattaatcatccgcattcagacctgcacgatttaacaggaattgtgctaagagcgcaaccggacgacctgttgctcctttggctttacctgaacgccatgctgtgcctgcaatatccagatgcgcccaattgtatttggtcgtaa

SEQ ID NO: 4577 - DNA, 465 bp, Xenorhabdus bovienii
  Coding sequence Name=Xb4151_4152.C443.gene93.dna; Position on contig =75593..76057bp; Strand=+
atgaaaaacgccaccttctatttattggaaaagctctcacaggaacaattatcgtcttctgatgaattacagccacatgaatggctggcatgccagcttgccgctgatcagtggcgggcagggaagcgggttctgattgcttgcgaaagccagcagcaggccgaaaaactggacgaagcactatggcagcgggagccaagtcaatttgtaccacacaaccttgccggagaaggccctcgttatggggctcctgtggagttgtgctggccgcagaaaagaagcaatgctccccgcgatattctggtaacactgcttcctcactttgcagactttgccacagctttccatgaagtgatagacttcgtccctattgatgaaaatctgaaacagttagcgcgcgaacgatataaagtttatcgtagcgtcagctttaatttgaccatggcaacaccgccaacctattaa

SEQ ID NO: 4578 - DNA, 2898 bp, Xenorhabdus bovienii
  Coding sequence Name=Xb4151_4152.C443.gene94.dna; Position on contig =76071..78968bp; Strand=+
atggaaaagacacccgctaatcaaacgcaatctgagccatctctcgataaaacctataatccgacagagatagagcaacctctttataaccactgggaaaagaacggttatttcaaaccgaatggcgataccagccgtgaaagtttctgcatcgtcattcctccgccaaacgtcactggcagcctgcatatggggcatgctttccagcagaccatcatggataccatggtgcgttatcagcgcatgcagggcaaaaacaccttgtggcaggcgggtactgaccacgcaggtatcgcaacgcagatggtcgttgagcgtaaaatcgcagccgaagaaggcaaaacccgccacgattatggccgtgacgcctttatcgacaaaatttggcaatggaaagcggaatcggggggtaatattaccaaccagatgcgccgtctgggcaactccgtggattgggagcgtgagcgcttcaccatggatgaaggcctgtcaaaagcggttaaagaagcctttgtccgcctgtatcaggaagacctgatttaccgtggcaaacgtctggtcaactgggatccgaaactgcgtaccgcgatttctgacttggaagtcgaaaaccgcgaagtgaagggttccatgtggcacctgcgctacccgctggctgacggcgccaaaactgccgaaggtaaagattatctgattgtcgccacaactcgcccggaaaccctgctgggggataccggcgttgccgttaacccagaagatccacgttataaggatctgattggtaaagagatcatcctgcctctgatgaaccgtcgcattcctatcttaggcgatgaacatgcggatatggagaaaggcaccggctgcgtgaaaatcacaccagcgcacgatttcaatgactatgaagtcggtaagcgtcacagcctgccaatgatcaatattctgacatttgacggcgatatccgtgacgaagcggaaattttcgataccaatggtgaatcttctgacgtttattcggctgatattcctgccgaataccgtggcatggagcgtttcgctgcccgtaaagcgattgtggccgaatttgaaaaacagggtctgctggtagaaaccaagcctcatgatctgaccgtaccttacggcgaccgtggcggcgtggtaattgagccaatgctgactgaccaatggtatgtccgcactgctccgctggcaaaagtggcgcttgaagccgttgaaaatggtgatatccagttcgtgccaaaacagtacgagaacatgtactactcctggatgcgcgatattcaggattggtgtatctctcgtcaattatggtggggtcatcgcatccctgcatggtacgacgctcaaggcaacgtctatgttggccgcgatgaagaagaagtccgccgtgaaaacaatctgagtgcggatattaccctgactcaggacgaagacgtgctggatacctggttctcctctggcctgtggacattctccactctcggttggcctgagcagaccgaagccctgaaaaccttccatccgaccaatgtgctggtcagtggcttcgacattatcttcttctggattgcccgcatgatcatgatgaccatgcatttcatcaaagatgaaaacggcaaaccgcaggttccattcaaaaccgtgtacatgaccggcctgatccgtgatgacgaaggccagaaaatgtcaaaatccaaagggaacgttatcgatccgctggatatgatcgacggtatttcgctggaaaatctgctggaaaaacgtaccggcaacatgatgcagccacaactggccgagaaaatcggcaaacgtacggaaaaacagttccccgaaggcatcgaagcccacggtactgacgccctgcgtttcacactggcggcactggcttctaccggacgtgatatcaactgggacatgaagcgcctgcaaggttatcgcaacttctgtaacaagttatggaacgccagccgtttcgtgctgatgaataccgaagggcaggattgcggtcaaaatggcggagaaatgtccctgtcactggccgaccgctggattctggctgaatttaaccagaccgtgaaaacctaccgtgaagcgttggatacctaccgttttgatattgccgccaacattctttacgaattcacatggaaccaattctgtgactggtatctggaactgtcaaaaccggctatcaacaaaggttcagaggccgaagttcgtgcggctcgccatacactgattgaagtactggaaggcctgttacgtctggcacatcccatcattccatttatcaccgaaatcatctggcaacgtgtgaaagtggtgaaaggcatcaatgcagataccatcatgctacaacccttccctgaatttgatcagacgaaagtggacgagctggcgctgaacgatctggaatggatcaaagaagccattattgcggtacgtaacattcgtgcagaaatgaacatcgcacccagcaaaccgctggaagttctgttgcgtgatgccaatgcggatgcacaacgccgtgtagctgaaaacctcaacttcattcagtcgatgggtcgtcttacttccgtcaccgttctggcggcgggcgaagaagcccctgtttctgtcaccaagctgatcaacggtacagaaatactgatcccaatggccggtctgatcgataaagacgtcgagctggcacgtttggataaagaaatcgagaagctggataaagaaatcaacgctattgaagccaaactggctaacgacggttttgtcagccgtgcgccggaggccgttgtcgccaaagagcgtgaacgtctggcaatcaaccatgcggcaaaagagaaattactggcacagaaagagacgattgctgcgctgtaa

SEQ ID NO: 4579 - DNA, 255 bp, Xenorhabdus bovienii
  Coding sequence Name=Xb4151_4152.C443.gene95.dna; Position on contig =79052..79306bp; Strand=-
atgccctcacaacgtttatgtagtttttatatattaaacaataaaccgaacgtgtcaacattgtcgatacattatagtttgttatccggtgttcgatttaagagtctgactgatgctatagatactggtatgtcttcagaccgttctttctttcatgtgatggcgggtctggcggaaatggagcgagaacttacagttgaatctatccgcgcaggacgggaaacagtcaaaaaacataaaattaagttcatataa

SEQ ID NO: 4580 - DNA, 246 bp, Xenorhabdus bovienii
  Coding sequence Name=Xb4151_4152.C443.gene96.dna; Position on contig =79311..79556bp; Strand=+
atgtcacaagttatcgttaaaaaatggggtaatagcccgtcagtaaggcttccggtttcaattatgaaagcagcgtctctgaacgtcgatgatactgttgaaattactgtagaagatgggcgtatcgtgattgtacctgtgcgcgctaaagaatatacgcttgatgcgttactttccggtgttacaaacgaaaatattcatgaagaaatttccttcggaaaaccaactggcaaggagctactgtaa

SEQ ID NO: 4581 - DNA, 339 bp, Xenorhabdus bovienii
  Coding sequence Name=Xb4151_4152.C443.gene97.dna; Position on contig =79658..79996bp; Strand=+
atgaaatcaaaatatgtaccagaagctggcgatattgtatggcttgattttgatccgcaagcagggcacgagcaagcaggacaccgccctgcattggttcttagccctgctatttataatggtcggatagggctgatgttatgttgccccatgaccactaagatcaaaggctatccttttgaagtaaaagtagaaggtgaaggtgaaggggatagtgcagtactggctgatcaggtaaaaagtttagactggcgcgaacgcaatgctaaaataaaaggaaaagtatcggcttccgtactttcagaggttaaagcaaaagctaaagcgttaataggctga

SEQ ID NO: 4582 - DNA, 135 bp, Xenorhabdus bovienii
  Coding sequence Name=Xb4151_4152.C443.gene98.dna; Position on contig =80031..80165bp; Strand=-
ttggcttattcagagtacaactccacatggcttttgtatgtaaaatggcctatacgttatgttgattatcattgtgaaaataggatattcccggataaggggttacctcagggaatggagtttaaagcactctaa

SEQ ID NO: 4583 - DNA, 114 bp, Xenorhabdus bovienii
  Coding sequence Name=Xb4151_4152.C443.gene99.dna; Position on contig =80138..80251bp; Strand=+
atgtggagttgtactctgaataagccaaccagtttaatgaacttcattcaagttaagccactgcatttaatattgcagtggctaggctgtattaacgcaacagccaatgaataa

SEQ ID NO: 4584 - DNA, 330 bp, Xenorhabdus bovienii
  Coding sequence Name=Xb4151_4152.C443.gene100.dna; Position on contig= 80229..80558bp; Strand=-
atgctattaataatagtaatgggattaattagtttcttattgagagtgactccatttttgatgaataacaataaatcattcaaagccgatagtttgtttattacatcgttggattatgctatttgttttattattggaactattatcgtcaatatttccttgaataatttatcactaagtgaattaattaatcagtttaatattaattattttatttctttagtcacgattgttttggcatatttcatcagcaaatatatgtgttcaatattaaaaatcctgtttttttcgctggtattttttatcgttattcattggctgttgcgttaa

SEQ ID NO: 4585 - DNA, 681 bp, Xenorhabdus bovienii
  Coding sequence Name=Xb4151_4152.C443.gene101.dna; Position on contig= 80558..81238bp; Strand=-
atggttgattctttacctgtctgtatctccttttttcttatctttgcttcgattggagcgttgtatcaacgtcacggcattccattaatggaaacgttggtcggttcgttgctgatctatgcggcaccattgcaggtggctgcggtagggtatcttgccgatggggcagtgctttctgttattattttggcattgctgatcaattttcgctttttcttgatggcaatggtgatgtcacaatattttcagggtattccgaagcggaatattttactggcgatgttaggattcagtgccagtacttataccgtggcgcattcacatatttccgcagagaatatcaagggtggaaaatcccagtttactttctatttgggaattgctataccctgttttgtcattacattttgtgccaccttactgggatatgtttctgcggaataccttaattatgaatccctctcgttatttctgatgatgctggttcccattcattttgcttctttaaccgccaaacgtgcaggcaaggatatgtcagtcatggcgacggttatgggggggttgtgtgcgccattgttgaatgaagtgaacatgaaattagtggatctggtgataccgattttgtgtggagtattcatcgcactatttgaacggaaaaccagaaaggatagatcatcgtga

SEQ ID NO: 4586 - DNA, 147 bp, Xenorhabdus bovienii
  Coding sequence Name=Xb4151_4152.C443.gene102.dna; Position on contig= 81259..81405bp; Strand=-
atgtcattttatagtaaaacctttatggccatatccttcatctttcaggttgctgccgcgatgcaacccgaaatctatcgggtatatattgctgatataaaattcgtcgattattctacaaatttaaatataggtgccaagtgctga

SEQ ID NO: 4587 - DNA, 774 bp, Xenorhabdus bovienii
  Coding sequence Name=Xb4151_4152.C443.gene103.dna; Position on contig= 81751..82524bp; Strand=+
atgaatataattctgaatatactactggcaactatcatccaattaggcatcacccaactggcttatgcaaagtccactcttgataatatccaatccacaggtgtattcagaatcgggacagaaggagcctatgcgcccttcagttatcatgatgcttccggcaagttaaccggttttgatgtggaaattggtcgcgaaattgctctgcgtatgaaagtaaaacccgaatttattgaaggcaagtgggatggtttgattggtggccttgatgccggacgttccgatgccgtcatgaatcaaattgctattacaccagaacgcgagaaaaaatatagcttttccctgccctatgtcatttctgaggctgtgctgattacccgaaaagataataacgacattaaaactttcagggatttaaaaggcagaacctcctcccataccctgactaataactttgcccagattgcccgccattatggtgcagaaattatcggaaccaatggctttagtcaggaagtggaattggtcagcacaggtcgggcagatgccactatcaatgataaactttcttatctcgactataaaaaacatcgcccggatgcaccggtaaaaattgtagcggccgataccaacgcagcacaaaccgccgtgctgctgcgtaaaagtgatcctgaattaaaagccgctgttgataaagccattactgaaattaaaaacgatggcacttatcagcagatttgggataattattttggcggagaggtggctgaataa

SEQ ID NO: 4588 - DNA, 984 bp, Xenorhabdus bovienii
  Coding sequence Name=Xb4151_4152.C443.gene104.dna; Position on contig= 82666..83649bp; Strand=+
atggcctataaacaactgaccgaaacagaaagatatcagattttcagcctgaaagaagccggtttttcacaacgggagatttcaaagtcactcaatcgaaacccatcaacgattagccgggaattgagacgaaatcgggaggcaaagaaatatacgcctgaacaagctcagcttaaggccgtagcgcgccgacagtgtgctacaaaagcagtaaaaatgaaaccagagatagaaatgtggatcaaacagttaatttggcaagatttaagtcctgaacaaacagtcggttatctcaaaagggaaaatataatatctttgcatcatgaaacagtttatcgattgatttataaggataaaattaatggtggtaatttatggcaacatcttagaattgcgaaaaaaccgtatcgtaaacgctatggaagttatgagcgcagaggaaaaattaaaaacagagtcagtattgataagcgtcccaaacttgttgataaaaagcagcgtattggtgattgggaaggagatactatcgtgggtaaaaatcataaaagtgcattattgacattagttgaacgaaaatcgttatttactatcataattaaacttgaaaataaaacagcagaaggggtcgcaaaagcggcaacaagacatttatcactgataaaacataaaattaaaacaatgacctttgataacggcctcgaatttgccgaacacgaactgatcagtaaaaatttagagacaaaaatttattttgctcacccgtattccccctgggaaagagggataaatgagaacacgaatggattaatcagagattacttcccaaaaggaactgattttaataaggtatcagagcgggagattaaccttgtggcaaaccgattaaataatcgtcctcgtaaaacacgagattacaaaacaccgaatgagttatttaaaggaatatcctctcatttacttcgtccattacggtgttgcgcttaa

SEQ ID NO: 4589 - DNA, 138 bp, Xenorhabdus bovienii
  Coding sequence Name=Xb4151_4152.C443.gene105.dna; Position on contig= 83969..84106bp; Strand=-
atgatggggtcatatattcttcctgtttatagggtggatagacatatttatacaacatatcagagcctatctgatcagaatagcgggtttagctacagagataggttgttgttcaaaaagtctttattttttgcatag

SEQ ID NO: 4590 - DNA, 753 bp, Xenorhabdus bovienii
  Coding sequence Name=Xb4151_4152.C443.gene106.dna; Position on contig= 84049..84801bp; Strand=+
atgttgtataaatatgtctatccaccctataaacaggaagaatatatgaccccatcatggctcagtttagcgctggattccctttggccgatgctttacgctggcctgacatttaccattcccctcacgctgattacattcgcattggggatttctttggggtttatcgtcgccttaatccgcctgtatgggtcaaagccactggttgcagtcgttcggttttatgtctggctgatccgtggtacacctttgctggttcaattgtttctgatcttttatgccctgcccagtgtgggcattacgctggaagctttcacctctgccgtcatcggctttactcttaatgtcggtgcttatacttctgaagtgatccgagcagcactgatttcggtgcctaaagggcagtgggaagcgtctcactccatcggcatgagttggtggcagtcactgcgccggatcgtactgccacaggcggcacgggtttctattccaccactgtcaaatacctttatttcattggtaaaagatacctcactggcttccgtcatcactgttccagagatgtttctggctgcacagcgcattgcagccgtcacataccaaccgctgatcctgtataccgaagccgctatcctctatttgctgttaagttcagtactgtcagcactacaagttcgtctggaaaagaaattctcccaacaattttcccaacaccgcagcagtaaggaagcgaaaaatgattcagctctctaa

SEQ ID NO: 4591 - DNA, 765 bp, Xenorhabdus bovienii
  Coding sequence Name=Xb4151_4152.C443.gene107.dna; Position on contig= 84785..85549bp; Strand=+
atgattcagctctctaacattgaaaaaagtttcgacggacaaaaggtgctgaaaaacattagcctgaccattaaagaaggcagcctgacagcattgatcgggccttctggcagtggaaaaagtaccctgctacgctgcatcaatctgttggagatcccacaggcgggtacattggaaattggcaaagaacagataaccttcaccggcaaagaacgcctgccgcacagggaaatccaacggttcagcctgcaaacgggcatggtattccagaattttcagcttttccctcaccttacagtgattgaaaacatcatagaagggctgatttatgtacaaaaatggccactcgaacgcgccagagagcgggcgcaggaattactgaaaaaagtgggtatgtcccataaggcagatgtctggccgaacacattatccggtggtcaacaacaacgtgtggctattgccagagcaatggctccctctcccaaagtgctgctctgtgatgaaccgacctcagcccttgaccctgaattatcgaaagaagtcgtttctgttctgaaacacttggcagaagaaggcacgaccatggtaatggcgacacacgatctgcgtctggccgccaatcttgcccacaatgttatctttctggaatcaggcgaaattgtcgaatcgggaacagcacaaaccatgtttacccgcccgaataagcaacgcactggcgagtttatctcaaccctgacggaaactttacctgattgggaaatataa

SEQ ID NO: 4592 - DNA, 774 bp, Xenorhabdus bovienii
  Coding sequence Name=Xb4151_4152.C443.gene108.dna; Position on contig= 85631..86404bp; Strand=+
atgaaagcattcctgagtttgttactggcgggtgccacagcccttacaatttccgcccccagttatgccggaaaggatctggacgcgataaaagcctctggtgtctttaaagttggaacagaagggacataccctccttttacctatcacgatcaggccaataaattaactggttttgatgtagatatcgcccgtgaagttgcacgccgcctgaatgtcaaaccagaattcatggaagtcaaatgggatggtttgattgcggggctggatgctaaacgttttgatgctgtgatcaaccaagtgggtgtcacacctgaacgagaagcgaagtacagtttctccattccttataccgcttcccaagtcgtattgattactcgcgataataacagtgatattaaaactttcgctgatatcaaaggaaaacgttcagcccagtccctgaccagtaactatgggcaactagcaacctctaatggggctcatttagtcagtaccgacggctttaaccaagccattgatttggtcgctacgggtcgtgcagatgcgacattgaatgatcgcctttcgtttctggatttcaaaaaacagcgtcctgatgcaccagtgaaaatcgtcgcccagcaagctgatgcaagcaaatcggccgttctgctccgtaaaggagatccagaactgatcgccgtcatcaataaggcactacaagacatgaaagatgacgggacttatgcccgtatttccgaaaaatacttcggcactgatatttccaaataa

SEQ ID NO: 4593 - DNA, 168 bp, Xenorhabdus bovienii
  Coding sequence Name=Xb4151_4152.C443.gene109.dna; Position on contig= 86346..86513bp; Strand=+
atgacgggacttatgcccgtatttccgaaaaatacttcggcactgatatttccaaataacctgcctctcaattcctcaatcagcggcgttttcatcacgccgctcatcaataaattcagcgaatttatcctgtttacttatttgttttttcaattaatatcaagctga

SEQ ID NO: 4594 - DNA, 504 bp, Xenorhabdus bovienii
  Coding sequence Name=Xb4151_4152.C443.gene110.dna; Position on contig= 86649..87152bp; Strand=+
atgactgcaacaacaacacaaaactacgtcattcgccccattactccacaagataataccggcattgctgccgttatccgtcaagtatccgccgaacatggcctgaccgcagaccgaggttttgccgtcgcagatccgattctggatacattgtacgaagtatacaaccagccacgcagcgcttactgggtcatcgaaatggatggggaagtcgttggcggcggaggcgttgctccactggctggcggtgatgatgatacctgtgagttacagaagatgtatctctcatcagtactgcggggaaaaggtattgccagacaaatcgtgaaacagtcgctggaattcggtatagaacagggttttaaacgttgttatttggaaacgactgagatcctgcaaacggccattaaactgtatgaaaaactgggattcagccatcttggtgagccactcggcaataccggccactgtgactgtgagatcaggatgatcaaagtgctataa

SEQ ID NO: 4595 - DNA, 432 bp, Xenorhabdus bovienii
  Coding sequence Name=Xb4151_4152.C443.gene111.dna; Position on contig= 87232..87663bp; Strand=-
atggcagacccacatgctttagaagaacagcgcgaagaaactcgcttgatcattgaagaattattggaagatggcagcgatcctgatgcgctttatattattgagcaccatttttcggcggaaaacttcgatcttttggaaaaagccgccgttgaagcattcaaactcggttatgaagtgacggatgcggaagagctggaaactgaagatcgtgttgtgctgatgtgctgtgacatcatcagtgaaagccgtctggatgctgaactgattaatactcaggttgagcagctcatgaatctggttgaaaagctcggtgtgaattacgatggttgggggacgtattttgaagatcccaatgcgcccgatgatgaagacgaagacgaagacgaagctgaagatttccctgagcaagacgaacgcaaacttcactaa

SEQ ID NO: 4596 - DNA, 132 bp, Xenorhabdus bovienii
  Coding sequence Name=Xb4151_4152.C443.gene112.dna; Position on contig= 87662..87793bp; Strand=+
atgccaatcccctccgtcatttggctgtcctgttgcgcattctcccatctttttcctgcgaaggatatagctatccaatttcgtcaaaaaggaaatacagaccgtgaactatggcatgacaaattgttttaa

SEQ ID NO: 4597 - DNA, 1014 bp, Xenorhabdus bovienii
  Coding sequence Name=Xb4151_4152.C443.gene113.dna; Position on contig= 87897..88910bp; Strand=+
atgaatccattttatcgacgcaatttactaagattacatgactatactccttcagaaattaatgtatttctgacactatcgagtgaattaaaatcgaataaaaaatcaggtaaagagtcgcctttactgtcaggtaaaaatatcgcgctgatttttgagaaagactccacccgtacacgctgtgcctttgaagtcgctgctcatgatcaaggtgccagcgtcacctatttaagctcaaatggcagccagattggacataaagaatccatcaaggacaccgcacgggtacttgggcgtctgtatgacggcattcagtaccgtggatatggtcaggaagttgtcgaaacgctggcgaaatacgccggcgttccggtctggaatggtttaacgaatgaattccacccgactcaactgttagccgatttactgacgatgcaagaacatagccagaagccactgactgaaatcaaacttgcctatttgggcgatgcccgcaataacatgggcaatacaatgctggaagccgctgcattaaccggtatggagctgcgtctggtcgctcccaaaacgtgctggccggatgcagcattgattgccgaatgccaaactctggcagaaaaaaccggcggcaggatcgccctgacagaagacattgcgaccggcgttaaagatgccgattttctttacactgatgtttgggtttcgatgggagaacccaaaacagtctggcaagagcgcattgcgctgctaaagccctatcaagtgaatatggatgtcattcaactgacggagaacccggaggtgaagttcctccactgccttcctgcgttccacgatgaagaaacaacgcttggcaagcaactggctgaggagttcaatctgtatggtgggctggaagtcactagtgaagtctttgaatcaaaacacagtattgtgtttgatcaggcagaaaaccgtatgcacacgattaaggcagtgatggtagcaacgctagcgaaagaacttagtttttga

SEQ ID NO: 4598 - DNA, 1074 bp, Xenorhabdus bovienii
  Coding sequence Name=Xb4151_4152.C443.gene114.dna; Position on contig= 88952..90025bp; Strand=-
atgccaagcagggaaaaccagatattacgacttatcaagcaagatccttttattcagcaacaagaaattgctgatattcttggggttagtcgttcatgtgtagcaggacacattatgaatatgaacaaaaaaggtcatataaaaggcaaaggatatatttttcctagccctaataatgcttatgctgtcacaattggcgcagccaatatggatttcaccagttatgcctctgaaaagttagtgtatgaagattccaacccagggaaaataatatcgacgccgggaggtgtcggaagaaacattgcacaaaatattgctgcactgaaaagtgaaagccatttcatttctgttgttggtaatgattataatggcaaggtattattcgaacaaacgaaactagctggtgttaatattagatatttccataaattagatgaagaaaaaacatcgatctgtaattccatcattgatgaaaatggcaaatgcatagtctctgttaatgacatggacattatggaaaagctcacgcccacattattatctcagtccgaagagttaatccgacgtgctagtgtattagtcattgactgtaatctgacagaaggagcattggaatggctatttaatcatgctggaaatgtgccgatttttattgataccgtttccacatttaaggcgactaagatccgccattggctatcttatatccacaccctgaaacccaatcgatctgaagctgaaattctcagtggaatagaaattgagacccaaaaagatgccgctatcgccgcatcctggttccatcaacaaggtgttcaacgtttaattttaagtatgggtgcggaaggtgtgtactacagtgaactagataataaatcaggctattcacgtgcgattaccaccagtgtgctcaatgccagtggagctggtgatgcgatgatggcaggtcttgcccactgttggttacagagtatgtctctggaagacagcattcgttacgcacaacgatgttctgcactcacgctgtcttcagaggatacttggatactacccaataagtcgtctataccttga

SEQ ID NO: 4599 - DNA, 129 bp, Xenorhabdus bovienii
  Coding sequence Name=Xb4151_4152.C443.gene115.dna; Position on contig= 90332..90460bp; Strand=-
atgtgtacagtttttgctgaacagaacagtttttcttgcttttccaataaatgtcacgaagacggacttttgccgcaattcaaaaaaatacctcatttctggtgtaaaaaacactcatttattcgataa

SEQ ID NO: 4600 - DNA, 270 bp, Xenorhabdus bovienii
  Coding sequence Name=Xb4151_4152.C443.gene116.dna; Position on contig= 90989..91258bp; Strand=-
atggaaattattcccgcacaactggctaagaaccagtttggtgatctgcttatgaaagttcagcgtgtggccgtggttatctctcctgaagagtatgatcagttcacacagctcaagttacagaatttaaaagccgttctggctgaatctattgcacaagctgatcgtggcgaattgcatagtattgatgatgtatttgccccgttcacggttgagtttccccgtagagaaccacattatttactaccgggaagtttcgactggtattga

SEQ ID NO: 4601 - DNA, 267 bp, Xenorhabdus bovienii
  Coding sequence Name=Xb4151_4152.C443.gene117.dna; Position on contig= 91266..91532bp; Strand=-
atgagcgcctttactgctccgttgctcctgaaactcccacctcccaaaatcgggtcagatatttgttccacaactccagcaatcgagtgcaagccgactcctgacatttcgtgcaatcgtgttctgaaaatgacactcaatatctggtcgagtagcctgtgggtgagatcctctcgggctactcgaccagttagttggctattttgcgtactggttgctctatacacttttagctataatagctatttgagccattttagacggtag

SEQ ID NO: 4602 - DNA, 255 bp, Xenorhabdus bovienii
  Coding sequence Name=Xb4151_4152.C443.gene118.dna; Position on contig= 91426..91680bp; Strand=+
atgtcaggagtcggcttgcactcgattgctggagttgtggaacaaatatctgacccgattttgggaggtgggagtttcaggagcaacggagcagtaaaggcgctcatcgaacttgatgtgatattgcaaggacccaaaatcgggcgtaatcacagttaccgtttaaaccctcagttcggctggaaaggtatggtaaataatcataaagaaactcttaccaatggcctgagtgtaattcagggcggccgtgcttaa

SEQ ID NO: 4603 - DNA, 465 bp, Xenorhabdus bovienii
  Coding sequence Name=Xb4151_4152.C443.gene119.dna; Position on contig= 91710..92174bp; Strand=-
atgattgaattaagagaaatgacaactgctgagtttgaattattccgcttactttttataaatgagtatgcattagacttagcttcaacacgaggttatccggcagacgtatcacttaaaaaagcctctcagttgattgatgtaacccaatcccaagcaacagagaaagtgataaacaaattctggtgtattgtgaaatcagatcatgagctgccagtgattggttatctatggatagaacttaaagagaaagctgcgtgggtttgtgattttagcttattacccgagtggcgtcataagggattaggtaaggcaactctggataaaatgaaaagtaatctcatatctatgggtatcacagaggtagggttgagagtcgctcccaataatccagttgctaaagcactatacgaaaaaagtggttttcatatcactgggtttaatatgtctaaaactctaagttaa

SEQ ID NO: 4604 - DNA, 624 bp, Xenorhabdus bovienii
  Coding sequence Name=Xb4151_4152.C443.gene120.dna; Position on contig= 92504..93127bp; Strand=-
atgttggttactgatgctctgctggcattcatcgttgccgctacattactcacatcaactccgggtttggacacggctctggttttaaggacagcggccgttgagggcggcaaaaaagccctgcacgctgctttaggtattaatgcaggatgttttatttggggcgcgatggtggcatttggccttggcacattaattgccgtctccgaacaggcatttaatattctgaaatggtgtggtgcgctttacttatgttggctgggtattcagatgattgtgcgtcccagccagagccttgcaggagaaaccgcttcctcccctgttaaaacgcagaactggtttatcagaggtatgctgggcaatgtgctcaaccccaaaataggcgtattttacgtctccttcctgccccagtttattcctcaaggacattcacccgtattatggatatttggcttagtgagcattcacatattactcggcacgatatggtcattattgctgatatatgccacccgcccgctttcccatctattacgtcgtgaaaatgttattaaatggatgaaccgtgcgacagggggattatttctgttttttgcgtttaagttggtgttgagccggagataa

SEQ ID NO: 4605 - DNA, 546 bp, Xenorhabdus bovienii
  Coding sequence Name=Xb4151_4152.C443.gene121.dna; Position on contig= 93150..93695bp; Strand=-
atggctcaagtcgataccaaaataagcaaatttttaagctatgtgttacgccatcaacctgaatctattggcctaacgctggataatgaagggtgggcagatatcggtgagctgattaaatgtgcggagaaacatggtaagcacttgaattatgcgctgatcgcaacgatcgtcgaaaccaatgataaaaagcgatttgccatttctgacgatcaaaaacgaatcagagcggtacaggggcattcaaaccaaaaggtcaatattagttaccaagcgcaagtcccgccgacggttttgtatcacggtacagccatccgttttctggattcgattttccagcagggattggtggcaggctcgcgccattacgtgcatttatcggcagatgaagccacagccattaaagtcgggcagcgtcatggcaagccggatatcctaaaaattaacgcccagttaatgcatgaacagggctttaaattccatcaggcagataatggcgtttggttgacaaaatcggtgccggtcaaatatataagcttcaattaa

SEQ ID NO: 4606 - DNA, 807 bp, Xenorhabdus bovienii
  Coding sequence Name=Xb4151_4152.C443.gene122.dna; Position on contig= 93739..94545bp; Strand=-
atggaagtaatggaaaagaaaacaacagcagttagctctgtcatgcgtacccgtatcaaacaggaattggctggcatagagaaaaggtatggcgtgcagatactgtacgcctgtgaatccggcagtcgtgggtggggctttgcctcacccgacagtgattacgatgtgcggtttatttatgtccatcccgtggattggtatctcattgtagaagcagggcgggatgtgatcgaactgccgatcagcgatgagctggatatctgcgggtgggaactgcgtaagacactaaagttactgaaacaggcgaatccaactttaatggaatggttagattcgccaattatttatcaggcagatccggccgctaccaatggattaaaaacgatggtgccgcatttcttttcgggtatcaaagcgcgctaccactatctttcgatggcaaagaaaaactttcgaggttatctgcaaggtgaagaagttcggctaaaaaaatacttttacgtattgcgcccattacttgctgttcgctggattgagatggggaagggcgtaccgccgattgattttgaaacgctggtggcaggtacagtcgatgatcctcaattgaaagcggaaattagtgatctattgcggagtaaaagattagcgaatgagtcagaatatggcctgcgtaagctgagggttcacgcctttattgaatcagaacttgatgaaacattgtctcgttgcgaactcaaggataagcgtgaacgcagctatgcactactggatgattatttaaggcgttgggtgatgaagcgagtataa

SEQ ID NO: 4607 - DNA, 1242 bp, Xenorhabdus bovienii
  Coding sequence Name=Xb4151_4152.C443.gene123.dna; Position on contig= 94563..95804bp; Strand=-
atgacaacgattgaaatgaaaaccaacgcttacaatttattgacgcaagaaaatggtgctcaaataaaaatgtggactaacggagtccctgttgatccgaaagccattacccaattacagaacacggccaagatgccttttgtattcaaacatctggcggtaatgccggatgttcatgtcggtaaaggatcgaccattggtagcgtgatcccaacacgtggagccatcatacccgcagcggttggtgtggatatcggttgtggaatgattgcagtgcgtacttccctggtggcatcagatttgccggatagtttgctgaatatccgccatgccatcgaagcggctgtaccacatggacgtactgtgaatcgtggtggtcgtgataagggttcttggcatcgcgcgccggaacttgtggatcagcattgggcgacgttggcggatggtttcaaatgtattaccgataaatacccaaaattactgaacaccaataaccatcagcatttgggaacactgggaaccggtaaccatttcatcgaattgtgccttgatgaagcagatcgtgtctgggtgatgctgcatagcggttcccgtggggtgggtaacgccatcggtaacttgtttatctcattggcgcagaaagatatgcagcagcatattgcgaacctgccagaccgtgatttggcttatttcgaagaaggtagtcgttattttgatgattacatggaagcggttggttgggcacaggattacgctcgccagaacagggaagtgatgatgcaccacgtgcttgaagctttgtcacgcgagatcccaaaaccgtttacgacacaggaggaagccgtgaactgccatcataactacgttcagcgtgaacagcattacggtgaggaggttttggtaacacgtaaaggtgcggtatctgcccgtaaaggccagatggggatcattccgggttcaatgggcgcgaaaagctatatcgtccgtggccttggaaacgaagaaagtttctgttcatgcagccacggagcggggcgtgtaatgagccgtactgaggcgaaaaaacgtttcaccgtaagcgatcaaaagcgcgcaactgcgcatgtagaatgccgtaaagacagcgatgtgattgatgagatcccaatggcgtacaaagatattgatgctgtgatggaagctcagtcatcgctggtggaaattgtgcataccctgcgtcaggtagtttgcgtaaaaggataa

SEQ ID NO: 4608 - DNA, 1575 bp, Xenorhabdus bovienii
  Coding sequence Name=Xb4151_4152.C443.gene124.dna; Position on contig= 95801..97375bp; Strand=-
atgatgaaaaaaatcaaattattgcagggacaaattggcttactggcaaaagagggtgaataccaacagattttaacggcgggtaaatatcgtttcatcgattggtttaacaagctgagactgacggtatttgaacttaatagcaacgaaattgaagcaaaactggcagaacacttgcgccagtaccatacggattgggttgctcagcattgtgatgatattcagcttactgaagatgagatcgggctgctgtatgaacatgatttactgaccgaaatcctgccaccagcgacgcgtcgtttatattggaaaaacggtgatcagcgccggattgaagtatgcccaaccacggaacaagaggtttcctcacagttggtttctctattacagccttcaaagatacgtaaacgcaatgtgaagggattggaaagtgtgctgattactcaaattccggcatggcatatcggagttttgaaaagcgatggcatcgtgcagcagttgttgcagccaggcctaaaaggttattggcgctttggtcacgatatttctgtagagcttgtcgatactcgttcatggccacaagttgaagaaagtttggcggagtattttcgccatcagcatattgattgggtagaacagtattgtgatgaaatccagattgctgatgatgagatggggctgctgtatgaacacgacgtattggtggaaattctatcccccgcgacccgctacttatattggaagaacggtaatccacgttgcgttgaggtacttaaggcctcggaactggaggtttcctccgagctagcttctgtgctggtgtcttctatggtgcgtaaacatagcgtgaaaggcatagatagcgtattgattgctcaagttccagcgtggcatgtcggcattttgaaagttgatggcgtggcgcagaagttattgcagcccggccaggcgggttattggcaagttggtcatgatgtgacggttgaaattgtcgatacccgattacaggcattggaggtgggtgggcaggaaattttgacccgggacaaagtgaacttgcgcattaatttatctgctaactggcgttatcacgacgtgctgatggcttacgagcaattgagcgagccagtggcatatctgtaccgcgaactgcaatttgctttgcgtgaaatggtgggaacccgttcattggatgaattgctggaagataaacaggcgattgatgaactgataaatgaaaaagtccagcggataacagcgggttttggtttagaagtggtctctctcggtgtaaaagacattattttacccggcgagatgaagactattctgtcgcgggtagtagaagcagagaaagcagcacaggccaatgtgatccgccgtcgtgaagaaactgcggcgacccgttcactgttgaataccgcgaaagtgatggaaaacaacccgattgctctgcgtttgaaagagctggaaacactggaaagcatcgctgaacgaatcaatcaaatttcggtatatggcggtttagatcaagttctgaatggactggtacaaattaaaggagaacaaaaatga

SEQ ID NO: 4609 - DNA, 507 bp, Xenorhabdus bovienii
  Coding sequence Name=Xb4151_4152.C443.gene125.dna; Position on contig= 97278..97784bp; Strand=+
atgaaacgatatttacccgccgttaaaatctgttggtattcaccctcttttgccagtaagccaatttgtccctgcaataatttgatttttttcatcattgttattttccttttttatattcccttcactcggaaaaccgaacatcagggcgaaaccaaggggggaacacatcggtactcaaacagcggtagctcagtatcctgcccttggctcagcgacatcagccgggtcttcagaatggtggctctcgacgggcagccacagggttttacttctacgttttattttgtgttttaccgggaaagtaaaagaccatatcccttatatggagtgaacctgggactcgaacccaacgtaaccctatgttgttcacgaaatgtctttctactgacggaatacatgtggcgcaatgacctcatgccatcacccatgtaccggctgggtttaaccccatgctatttcagtgtgcggacatacgagttattgccaattgcatgccaactttga

SEQ ID NO: 4610 - DNA, 1578 bp, Xenorhabdus bovienii
  Coding sequence Name=Xb4151_4152.C443.gene126.dna; Position on contig= 97927..99504bp; Strand=+
atgaaacgcagagttgtcattgggattttgggtacgaagttggatagacggggcaaaaaggccaatcgctggacaaaatggcgccctacgattggtatgtgccagcaagcggagttgccgattgacaggctggaactactctaccaaaccaatgattatggtttagcacaaagagtgaaggaggatatcgcagagacttcgccaaaaacgaaagtggttttgcaagagctcaaaattgaagacgcgtgggattttgaagaagtctataccgctcagcttgattttgccgtgcgttatccttttgatactgaaaatgaagaatatctggtacatatcacaacaggcacacacgtcgcccaaatttgctggtttttgctgaccgaagcccgttacctgcccgcccagttgctccagacttcccctagaaatggcgatcgtgagagccatcctgaaggcaactacaccattatcgatttgaatctcagccgctataccaccctgaccagccgttttttgcatgaacagcaggaacaggtcgcatttctgaaatcgggtatcgccacgcgcaatgctaattttaaccgcttgatcgaccaagttgaacgtgtcgccttgcgttcttccgccccaattttgctgacggggccaacaggtgcaggtaagtcttttctggctcgccggatctatcagttgcggcaatcccgccatttgattcaaggccgttttgtggaagtaaactgcgcgaccctgcgcggtgataatgcaatgtccacactatttggtcatgttaaaggagcgtttacgggtgccattcagccgcgtacagggctactgcgtgaagccgatggcggcattttgtttcttgacgaagtggcagaactggggttggatgagcaggctatgctgctaaaggctattgaagagaaaagcttcctgccttatggttctgataaagaagttcacagtaattttcagttaattgccggtactcaccgcgatctgcacacttgggtggtacaagggaaattccgtgaagatctgtacgcccgtatcaatatgtggacttaccaactccccggtctggcgcagcgtcgtgaagatattgagccgaacattgagtatgaacttgcccgatatgcacagatgcagcagacacaggttcgcttcgataaggaagcgcgactgatttacctgcattttgcctgttcagaacaggcgcaatggcggggcaacttccgtgagttaggcgcatccgtcacacgtatggcaacattcgccgaaaacggacgcatcaatcagcatttggttgaagaggaaattacgcggctcaaacagaattggcaggataatgggctttcttccctgctgccgaatcatttgccggaagttgatctgtttgaccgccaacagttggaaacggtcattaaaatctgccgtgagtctgccagtttatccgaagcgggccgcaagctgttcgccgtttcccgccaacaaaagaagcagcccaatgatgccgataggttacgcaagtaccttgcccgattcggtctgggctgggatagcattcaaaatgattag

SEQ ID NO: 4611 - DNA, 915 bp, Xenorhabdus bovienii
  Coding sequence Name=Xb4151_4152.C443.gene127.dna; Position on contig= 99517..100431bp; Strand=+
atggaactgaaatttttaggcaccagcgcgggggttcctacgaaagagcgcaatgtcaccagtctggttctggatttacggggtatccgcaatgcgctgtggatgtttgattgtggtgagggaacacagcaccagatcctcaactcctctatcaagatcccgaaactggagaagatttttatcacccatctacatggcgatcatatctttggcctaccggggttactgtgcagccgttcgatgggcggctccaccgatcccgtgacgctatacgggccaaagggaatacggcagtttgtagaaaccacattgcagttgagcggctccttcctcacttatccactggatattgtcgaagtgcaatccggactgctgtttgatgatggcgagttgaaagtcacggcttacgcccttaaccatcgcgtggaatgctatggctatcgcattgaagaacatgacaaacccgggggtctaaatacccagagacttaatcaggataatattccccgtggctcgtggatgcagaccttaaaacaaggaggtacagtgacattagaagatggccgtacggtgtgtggcaaagattatctgggtgcaccgatttccggtaagtcgctggccattttcggcgatacgacaccaacgcccgaagcactgaagctggcggccaatgttgatgtgatggtgcatgaaattacgctggaagatgcacttgccgaaaaggccaataacaatgggcattccaccacaaagcaagcagcgacactggcgcgcgatgccaaagcaaaacactttatcgcaacacatatcagcggacgttatggtatagaagattgcccgcgattattagcggaatgtcgggaaatattccccaataccgatttggcagaagactttgcgatatttatagtttaa

SEQ ID NO: 4612 - DNA, 198 bp, Xenorhabdus bovienii
  Coding sequence Name=Xb4151_4152.C443.gene128.dna; Position on contig= 100371..100568bp; Strand=+
atgtcgggaaatattccccaataccgatttggcagaagactttgcgatatttatagtttaataaagcatcaatttgcacatttgatactcttatcaagatcaaatgtgtttacccgacaacgatacaaagctttccttagatccagtctacgaataatatttaaaatagtagtttcatattttaatatatttcattaa

SEQ ID NO: 4613 - DNA, 1221 bp, Xenorhabdus bovienii
  Coding sequence Name=Xb4151_4152.C443.gene129.dna; Position on contig= 100920..102140bp; Strand=+
atgaattcaatcataaaaacagatattaaagaaagtatgtataatatttttacagaaaacacagataatatctggtctgactggcttgatgaaaaagaattaaaaaagctgacagatcaccctgtactccagtcatttaatgatagtacagctagtgaagaaatgttaaaaacattcctaattcaacattgctactattctcgtcattttacacgttatttaatcgcgcttataagtaaattagacgtatttgaagatataaaagatcttcttcacaatttactggaagaaatgggattagaggatgaaaacaaaatcactcatgctgagctttttcagagaacattgaagactgtcggtgctgatatcaatagtcaaaaaccttttgaaaatacaaccgctatggttgacgctatgttttctttctgtctttcagatgatccgttagaggggctgtcagccatgtgccttggcgcagaagctatcgttcccttaatttataagcccgtattaaatcgtttaatgacattgaattacaataaggatgcaacagaattcttcacactccatattgaagaagatgaagatcatgctattaaaatgtttgagatcatagatagactcactaggcaggacgaatcattacgcctcaaagccatcaatattggcagtgaaatgataagaaaacgcgtcaaaatgctggatagtgtctgggaaagtgaaattgttcgtaagaacaatgtagaaaaggccgacttaaataatcaaaaaaatgatctttcctttaattcttctgatttttggcgtgtcaaccacaaatcaacaccttctattcctgagaaactaattcataaaaacgtcattaacagtcatagtcatggtgaaaataaattttcagaagaaagaaaacataaagtcaatatcgtcaatttgcccactaaaacaatcagtatgacattaggtcatcttgaacccggacaatcgacgaatctgcaccgacataattatgaaactgtcatctatatcattgaaggggatggcgtatcaaaaataggaaataatgatgttgcttggtcagcaggagatgccatttatatcccatcctgggtagaacataaacatagcagtgtgaatcagaatcaatgcctttatattgcttgtgaaaatgctcctttattacaaaatattggtaacatcgcacttcgtgaagaattagaataa

SEQ ID NO: 4614 - DNA, 1611 bp, Xenorhabdus bovienii
  Coding sequence Name=Xb4151_4152.C443.gene130.dna; Position on contig= 102163..103773bp; Strand=+
atgtcattagccacattttctacatttgaagctattgctagcacaactaaatcaataaatttagcgcaacgatttgtcatggaaaactcgtctcttgataaagactgttttatcgggccagacggctcattgagttattcccagcttgcattttttgtccaaaaaagtgcttctgctatgtcgttaaaaaaaatagaaaaaaatacagcagtcatcctctgcctcaatgacagccgggaattagctattattttttttgccagtttagcaattggagcgttaccggtcgttattaacccgaaattaccggctaatactcttgattacatactgggggaatttgataccccttttattttcctcgatgaggataatcaaatatctattgcagctgaagcgaaagaaaatactatccgtattaaaaggagtgccgatctttcggcattctgtgattggatgcctgaaaacaccaatgataaatggcatgattttttggaaaaaacccattttgagcctgctttcattcaatatacctcaggatcgactggaaaacccaagggagtgattcacagcgttacatcaattttgtcttcctgtgaacatttttctaaacatcaattaggtttaactacaacagacattatctattcaacaccaaaaacattttttggttatggtatgggaaataccctatttttcccgctatttatcggcgccactgcaattatagatagcctttggccttcaataacaagggttacggataatattaaacaatttcaaccaactgttctgttggcggggccgatgatatttcgtttattacttgaagatgatgaatttaaacaaaattgccatcttcgtctggtcgtttcttctggctcaatgttacctgcacctctaaaagaatcctggtttcagcggctcaatatagtgatacatgatgcatttggcgcgactgaaacatgccatgcttttgcgacaacttatggtcatccatcccgatcaggaagcattggaaaatttattgccgggtgtacaggaaagattgttgataaagatggaaaaaccgttccggctggggaaactggcgtgcttatgctgagttcagaatccttagctctgggatattggaataaccatcaagatacaaagatcaagttttccaacggttggtatcgcactggagatctattttcgcaagacgacgaaggattcctttattatcacggccgtgaagatgaacagttcaaggtattaggacgctggttggtgccggtagaaatagaaaaactcgtccattccgcttttccagaaattggtgatgcatttatgatcccttggatggatagtatccaagaatgcagacctgttttatgtctgaaaacttcttccagtgaatttgaagcaatcagccaacagatagccaattttatcagccaccaagtagaaagttataaacatccctatgtttatctcaatttagaacaattcccactgaatggaaacggtaaaattgatcgtaagtcgatgatcgaaatagcacgccaaaaaattactgaccaaaatatgtcttctcatcctcggagaattaattatgctcaatcttaa

SEQ ID NO: 4615 - DNA, 1503 bp, Xenorhabdus bovienii
  Coding sequence Name=Xb4151_4152.C443.gene131.dna; Position on contig= 103760..105262bp; Strand=+
atgctcaatcttaatgaatttcttgcttatggtgaagaaggatataatttggtgccagtatggaaaaatatcaaaaaaacacagatatctcctattagcatttacgaaaccttagctaacaaaagctatagttatctttttgagttatctgaaaaatatgaagataaatatagagcaacctattctattgttgggcttccatgtcatcaacggatcgaaattaaagattattcaatcaaagtatttgacgaaaataatgctcagactcatataacagatattcccccactggatgctctgcggcaaatactgacaagctatcgtgtaccaaaaattgatcaattacccaattatgctggtgggttgtttggttattttggctttgaaaccacacggctcatcgagcctaagctccaagccaatacacgtaaaaaaacattagttgatttaccggacatattacaaatagtcagtcaagaattgatcgttgtagatcatataaatgatctcatctatgtcattgtccatgcaaaaccaactaaatctcaaaattttactgatgcaaatctaagaataaaccagattatcagtgaactggaaaagatcccctatcaacaacaggctaacttcagtccttctactaccactgatagaacgacttggttcaaggacatggagtctcattttccacagcatgactttcaaatggccgtcaacaagatcaaggagtacatcaaggcaggtgatgccatgcaggttgttttatcccaagccatgtcccgaccattaaaagccaatgccatacagctttatcaagcactaaccagtatgacaaacacaccgtactgttatttgatgaatgtcgaagatagccatattgtcggcgcatcccctgaaatgatggtctccctgcatcaaaacaaattgatcagccatccgatggcaggaactcggcatcgtggcatgaaccagcaagaagatgatgcactgaaagccgagctacttgcagataataaagaaattgccgaacacattatgcttgttgatctggcacgcaatgacattggacgcgtagctaagacaggcagtgttacggtcaataacctgttaagtgttgagtatttctctcacgttatgcacatagtgtcggaagtatccggtgaaaaaatggatggtatcgatgaaatagacgtcatcagcagcacttttccggcgggaacactcagtggagcacccaagatccgggctctggagatcattcatgaattagaaccctatggcaggggcgtttatggtggttgcttaggttacatcacttggaacggcgatattaatctctctatcaccatccggacagggttacttcatcagggacaactgtatgtacaggccggtgctggaattatcgatgcttccagagcggaacgtgagtggcaagaaacgatcgaaaaaaatagtatgatgatgcatgcagcatatcaagcagagcaattttctttatga

SEQ ID NO: 4616 - DNA, 597 bp, Xenorhabdus bovienii
  Coding sequence Name=Xb4151_4152.C443.gene132.dna; Position on contig= 105283..105879bp; Strand=+
atgtatttcattatagataactatgactcctttacttataatattgcccaatatttgggtatgcttggtatagaggttttagtcaaaaaaaatgatcgaattaccttagaatatatcgaacaacataacccgactggattaattatttcacccggcccttgtaccccgaatgaagcaggaatatcaacacttgccattcaacattttgctggaaaaattccaattttaggtatttgccttggtcatcaatgtatagcacaagaatttggtgggaaagttctcagagccaataaagtgtatcatggccatacttcaacaatcacccataatgataaaaacttatttgccaatttaccccaagatattaaagttggttgttatcattcattggtagtagatgacttgccggaatgtttaaccgtgacagcaaggtcatgtgatgaatacaatgacattatggcactcaaacataatgattttcctatatatggagtacaattccaccctgaatctattctctctgatttcggactggatatgcttaaaaatttcatcaagataacacaagaatggaagccgatgaatagaatacaataa

SEQ ID NO: 4617 - DNA, 141 bp, Xenorhabdus bovienii
  Coding sequence Name=Xb4151_4152.C443.gene133.dna; Position on contig= 105920..106060bp; Strand=-
atgaataaagttaccggcaccaatattttccgaactaataattttttttatttcttctggcgtaatcattggtcaatatttcctttaagatcaatgtataaaatgatttattacattatgattatttgtaagactatataa

SEQ ID NO: 4618 - DNA, 1617 bp, Xenorhabdus bovienii
  Coding sequence Name=Xb4151_4152.C443.gene134.dna; Position on contig= 105992..107608bp; Strand=+
atgattacgccagaagaaataaaaaaaattattagttcggaaaatattggtgccggtaactttattcatcacctaaataactattttagcgaacgagaaatgagtccaaaaataacatgtgatgtaccaacatatgataatccagaagaagaaaaatcacagtttgaaattaatgatcttgttaagatatcagatcagttgtcaggggcttatattgcactaggcgtccaaaaacgggaaccagtggcattatattttgatgatactattgactatttaattcattttattgcactgaacaatataggctcgtttcctatttttgtgaatggcgatctcagtagtcatattgctatgtcgtttatgcagaatagcggaacaaaatttattatttcaacggaagaaagaattcactcactgggtgataaagctgctggcatccagtttgttactcccaatgaattgaatttattaaaaaaacccatttcaagatattaccaacatcatgcaaacgatattattctgttagggcatacttccggcacaaccggtttgccaaagccagttatttttacccatgaatctatgtttcacggtattttgaaagaagtcgctaagcaacgcggaaaacaaatattatccatgttcccgcactctcacggagcctctatgacattgatcatgttgacattgacacgaggtgcggcaatacatattcaatcaaagaaaaccgcttttgacattttagattccattgaacaaattaaacctgacaccgttgctgcttttcccaaaatatttgttgatctatgcagagaagacctcgatgactgggatcttaattctatttcccactgggtttccacaggtgacgcgaatcacgaaccccatatacgaaagttgatttcttatggtcatcatttcgttgatggcaaaaaagcgcgtggatctttcttcatcgacaatcttggctcttcagaattcgcatttgccatgttcagaaatattcatcaaccaaaaacagacagatatgatcgttgtattggaatacctttttcctgggttgatgctgccatacttgatgcagacggaaatgttctccccaataaccaagtcggtatgttgggcgttatttcaaaatcagtaaccacgggttactggaataaccatctcctgaccgagaaaaaccgggttaatggttattggttaacaggtgatttggtttaccgtaccaacgacggtttcttttaccacgttgatcgtacatcagattggattaagactccccaagggccactttacagtacccaatgtgaagagtggctgttgaaaaatatcgatagtatttttgatatcagcattgtcgctacctccctgcccaatggcgatcaacagacaacggctatcgtcgagctgaaagcagggcacgaaatttcgccggccacactgttacaaaacatcaacgcctgtcatcaggaaaaacaatggccattgatcgacaatattgtttatcaatccgctgacaacgatctcggcgtcacagggaaaaaactcaaaagaaaaatcagagatcgtatgcctgaagataattcaatggtaactgaagaaggaaattaa

SEQ ID NO: 4619 - DNA, 732 bp, Xenorhabdus bovienii
  Coding sequence Name=Xb4151_4152.C443.gene135.dna; Position on contig= 107610..108341bp; Strand=+
atgaaaacttgcttaattacgggtgccaacagaggcatcggatttgaaattgcgaaaaaattgggtgaacgaggccatcgggtaatactttcaggccgtgatatacctgcgcttgaacatagtgtttcacaattgacccaaatgggaataaccgccgatttgcttcatttggatgtcacagatccagaatccataaaatctgcggcaaatttactgctcagcgccaatacgacccttgatgtactgattaataatgctggtgtttttctggattcaatccaaaaacccagcgaaacctctctggatgacatccataaaagtctgacggtcaatttggttggcccctggctcgtcacccaagcatttttacccttactcaatcgttcagaagaagctcgactcatttttatatctaccgatcttgccgcgttatcccaagctgctgacccgcattcaaaatataacagaatcgaaggtccagcttatcgagcctccaaagccgctctgaacatgctcgcgttacaatgggcgaaagaatttcgtgattcgaagatttctgtcagtgtatgcagcccgggttggtgcagaacgggcttagatagccaaattagttcagaacaggcaccaaattctgctgccgaaggtgctgatacggttgtttggctggccttagataagggcagagaacaacacggccatttttattcagctcgccagactattgattggtaa

SEQ ID NO: 4620 - DNA, 1380 bp, Xenorhabdus bovienii
  Coding sequence Name=Xb4151_4152.C443.gene136.dna; Position on contig= 108358..109737bp; Strand=+
atgtatggagataacatcatgacaataaatgaaaatatcgatatcaccgttcagcaaactgaaacagcgtcctatatagacaatctggttgttcagggaaaaatcgcccaaaaagaattggaaaaacagtcagatgaagatattgataacgttcttcaccatttggcaaaaatattttccactcactgccgggaatgggctgaaaaagagcttgctgtgacccgtatcggcaatgccgacgataaagaacacaaattagctttggtagtgaaccaagtatttaagggattatatggcaccaaaacccatggtcgtcttggtggaacccaaaggcttattgaatatgccagtccagttggattgatctttgccgttgtcccattaacaaatccgattccaaactcgcttttcaagatcatgctttccatcaaaactcgcaacgccatcattttcagttatcccggtaaaactggcaaattggcagatgaatttattggtctggtacaacaggttcttaccgagcacggattgcccgtttcattggttcaagtctgcacgcctccaagccatgataaaacccatatgctgatgcagcaccccggtgtagacatgatccttgcgacaggaggaagaaatctggtgcatgcggcttacagttctggtaaacccgcgtttggcgtagggcctggcaatgtccctgtctatatcagccgttccgctcacattcagaaagctgccgccaatattgttaatggcaagatatatgataacggcatcgtttgcggctcagagagcaacctcatagtacatcctgcaagcaaaaatgacctgatctcggctctggaagccaatggtgcggcaatcttgacaagcagcgaagttgagcaggctatccagacgttatttaatccagaaacccagtatgtaagccgtgaaaatattggtgtctgcgcggcatctttggctgctaaagccaacatttcacgcacttatcccattaaattgcttgttatacccgcagaaataggcaggcatgattttctcagcaatgaaaaaatggcgccagtacttactctatatactgctgatgaagaaaatggagtttctcttgcctattcgttgatttgtaacgagggagcagggcatacggctgtaatacacagcgaagatccagaagaaattcatcaattttcaaccgtcatgcctgccggacgcattttggtgaatacatcagcaacacagggcatgctcggggaaaccactgagctacctgtatcattcatgcaaggcagtgggacttttggccacaatcattcaaccgatccgatcatctggaagcacttagtcaatatcaaacgtgtcgcacacggcctacactga

SEQ ID NO: 4621 - DNA, 1116 bp, Xenorhabdus bovienii
  Coding sequence Name=Xb4151_4152.C443.gene137.dna; Position on contig= 109783..110898bp; Strand=+
atgaagatacagtgtattggtgcaggccccgcagggttagtgttttccattctggcaaaaatgcaggatcataaccgtgatgtcgttgtatacgaacgtaacttatcaaatgttacaacgggttgggggcttgtactttctgagccgatgttacagcagttagccaatatcgatcccagtattgttgaacagctcagacctcatatttcaacattaaaccatattgatatttatataaaagaaaaaacgttccgttcatctggataccaattccttgcgatcagtcggttagaaatgatcaatacccttaggaaaaaggcactggatctgggtatcaagattaattacgactcttcactgaatgctgaagatcttattaacctccccgctgatttgactgttattagtgatggcgccaacagtaagataaggcatcagttaaaaaatgaattcgacactaacattaatgaaggaaagaacctatatttatggttaggaacttcacatctatttaacgatacctttaactttattttcgagcagacagaaacgggttggttttgggcacattgttacaaatttgagaataatcattctacatttgttgtcgaatgtactcatgaaacttgggtaaaaacaggatttgcacatatggatgagaaacaaaccattgcatttcttgaaaaggtctttcaccgacatttatgcggccatccattgcaaatcaatgatacgtgccgtgaaaaagcctattggcggcgttttgttacaccagtcagcaaacactggtctcacgataaaaaagttttattaggaaatgcagcgcattccgcccacttttccattggttctgggactaagctagcaataggtgatgccattgctctggcagaaaatctgaaatcaagcaataaactggactcagcctgctttacagattatcagcacaatcgtcaaaatgaatcatctaatttacatattgcagcacaaagttctcaatcttggtttgaaaatgttgaatcattaattgaaaatgacccattagaattctctatatctttgcttttgagaagtggtagactatcacgcgatgaactcaccataaacctgttataa

SEQ ID NO: 4622 - DNA, 423 bp, Xenorhabdus bovienii
  Coding sequence Name=Xb4151_4152.C443.gene138.dna; Position on contig= 110974..111396bp; Strand=+
atgaattacgcaaaaatttcacctaaaataatgaaccctctgtataaatgttatgatgaaatacagaaatgtgaattagaccaatcacttattcttttggttgaaatgcgaacctcacaaattaacggctgtgcttactgttgcagactccatgcagaaatggggcgtaaattaggtattgaggaagaaaagctggataagttacccggttggtttaactcccgtatttacaatcaaaaagaagtactggcactggaatggtgtgaagcattaaccattggtcttagggacaaagatcttaatgatcttagagaacgtcttgaagaattattttcagaaaaagaacttgttgatctgacctcagccatatcagtaatgaatgccttaaacagaatggcaataagcatcggtgatcacagctaa

SEQ ID NO: 4623 - DNA, 444 bp, Xenorhabdus bovienii
  Coding sequence Name=Xb4151_4152.C443.gene139.dna; Position on contig= 111509..111952bp; Strand=+
atgttaaacggaactcaattaagatacgcggctttaatcgcacgttattcacttgcgattgcatatctggtcgcagtagctgacagatttggtttatgtggtgaatatggagatccacagattacgtggggtaatttcacggtattccttggcgttgttaagcatttgaccccttgggcacccgattttatgatccctatttttggttggggagccactattcttgaagttgctctacccatattcctaataataggttttaaaatcaaagaaaccgctttagtcagcgcagccttgttgttaatttttgctgttacaatgacaacgactggcttacttaaaagcgtgtttgactatagcgttttatctgcattttcctgttcacttctactctactgttttgaaaaattcagagtgagtgaagataaaaagcaattaaattaa

SEQ ID NO: 4624 - DNA, 738 bp, Xenorhabdus bovienii
  Coding sequence Name=Xb4151_4152.C443.gene140.dna; Position on contig= 112330..113067bp; Strand=+
atgatttttaatcaaaaagaaatgaatataattcaagccagggatttcatgaatgaaattttggtgtcaaaaacaacaacaaatattttaagacaaatgatacaaaaagatacagttatcaaaagccctattggaacttatgttggaattgaatcttttatagcactattgaaaatttggcacagagcctttcctaatttggtatataaagaaaataacctttacgttcataatgaaaatattattattgattgggaagccgaaggaaaacatcttggtgaattttattcaatttctgcgacaggtaaacaggttacttgccagggaacaacagaaattgttatgaacgatggaaaaattatcgattaccatacaaaaataaatattcaaaatattatttcacaacttataggtttaccctgctctccaacacttgatataagaaatatcgaaatatataatttaattaataatatattaggatatcagttatcttgcagacaaatagaatgcctctctctttccactctgaatacatcaattaaagagatagcaagattattatctatagaaagcaacacagtgaaaacgcacttaaaaagggctttcgaaataatcggtattagcaataaaaaaatgcttatggaatttattattgaacgccaagcaattgaaatactggttcgattaggcttatttttaagagttcaaataaaaagaaataattatttcgaataa

SEQ ID NO: 4625 - DNA, 129 bp, Xenorhabdus bovienii
  Coding sequence Name=Xb4151_4152.C443.gene141.dna; Position on contig= 113087..113215bp; Strand=-
atgagtattgatcaggaatttattattaatttttgtactactgcgtggtatcgatgttatgattggcataactcagtccgatcggtgcttttagtttggcgattaatcagaacgccccatttggattga

SEQ ID NO: 4626 - DNA, 747 bp, Xenorhabdus bovienii
  Coding sequence Name=Xb4151_4152.C443.gene142.dna; Position on contig= 113552..114298bp; Strand=-
atgaaaacatatatttttgatttagatggaaccattattactaatggacaaccaatacataatgtgattgccgaaaaaataaaacaattatgtagtagtggttcagttattttcgcatcagccagacctatcagagatatgctaccgttgctaccgcatgaacttcataattgtcttatgattgggtgtaatggagggatggcttggcagaatggtgattttttattttcacatagttttaatccagaacatttttctagagttattgcattcttgaaagaagaaaagataccatacgttattgatggagtatggtatttttctgtttctgaaataaatcatgatttccacaactatatgaggacattatctacttatgagaaagaagaaaaagagctattaagtgaaaagataacaaaaattttggtattagatggagaaagcagaactaaaatcgatcgatttcttgaacgtgaaggttttaaatacaatattaaccatcataaggcagataacctatttgatataacacctcaatctgaagataagtaccaatccctctgtaaattgggtgtcgatttcaataatgctatagtttttggtaatgatgaaaacgattacgcaatgcttgataatgcaaaaatttcagtttttataggcgcaatgaaagattaccctaacgcaaatttttattgtcgtacagaatatattccatctatattaggtgaggtcactgattcattttaa

SEQ ID NO: 4627 - DNA, 171 bp, Xenorhabdus bovienii
  Coding sequence Name=Xb4151_4152.C443.gene143.dna; Position on contig= 114643..114813bp; Strand=+
atgaatgctatcgtgagtataatgcgcgacgatttgctgggagaaaatatgaaatactgcaccacacacgatgttacaaagcatcaagctaacgaaaaactgcctgctggcagcttgggcgcattatttttcccattgcaaaaccgatcattgaaaaagcccctcatttga

SEQ ID NO: 4628 - DNA, 942 bp, Xenorhabdus bovienii
  Coding sequence Name=Xb4151_4152.C443.gene144.dna; Position on contig= 114869..115810bp; Strand=+
atggctaatccgttatatcgcaagcatatcatttcaattaatgatctgagtcgcacggatctggaattggtattgcagacggcagcagcattgaaagccaatccacagactgaattactaaaacacaaggcgatcgcaagctgcttttttgaagcctctacacgcacccgcctctcttttgaaacagccattcagcgactcggcgcttccgttgtcggttttgctgatagcaacaatacttccttgggtaaaaaaggggaaacactggccgataccatttctattatcagccagtataccgatgcaattgtgatgcgccatccacaggaaggcgccgctcgtcttgcttctgaattctccggccatattcctgtcattaacgccggtgatggtgcaaaccagcacccaacccagactctgctcgatctgttcaccattcaagagactcaacacaagctggataacctgaaaattgctatggttggtgatttgaaatatggccggactgtccactcgttaacacaggcactggcaaaattcagcggcaaccatttctgctttatcgccccggatgctttggccatgccaagctatatcctgcatatgctggatgagaagcaggtcagctacagcattcaccataattttgaagatgtcatgcctgaactggatatcctctatatgacccgtgtgcagaaagagcgtcttgacccttccgagtacgccaatatcaaagctcagttcgtgctgcatgccgctgatctggttaatgttaaagagaatttgaaagtgctgcatccactgccacgtatcgatgaaatcaccgtagatgtcgataaaaccccttatgcctactatttccagcaggcaggtaacggcattttcgcccgtcaggcattgctggcactggtattgaatgaaaatgtcgtcatagaaaaatga

SEQ ID NO: 4629 - DNA, 2319 bp, Xenorhabdus bovienii
  Coding sequence Name=Xb4151_4152.C443.gene145.dna; Position on contig= 115951..118269bp; Strand=-
atgaaattcaaatcaaaaatagaaccttatcactccgcagcgggtggttggggttcactagaggcaacaacacgttttgtttttgatagtaaacaagccttaaaaaatatggttaacctgatgcgcatgaacaaagccaaaggctttgattgcccgggatgcgcgtggggagatgacaacaaaagcctgttcagtttctgtgagaacggggctaaggcaatgacttgggaggcgactcgccggcatgtcgatcaggcattttttgcggcttatagcgtcagtaaactctaccaacagagtgactacttccttgaatatcaggggcgggttgttgaaccgatgcgttataaccatcagacggatcactatgaaccgattagctgggatgatgcttttaccttgatagccaaacacattaaggcgatggaaaaccctaatcagctagagctgtatacatccggtcgagccagtaatgaggcgtcatggctttatcagttgtttggccgcgtgttgggaacgaataactttcccgattgctcaaatatgtgccatgaagccagtggttacggcctgctgaaaagtttgggtgtgggtaagggaaccattcggctgaatgattttgatcatgctgatgccatcttcgttttcggccagaatcccggtacaaaccatccacggatgttacacagtttacgccatgcggctgaacgcggcgctcggatcgtcacctttaataccctacgcgaacggggtttagaacgttttgccgatccacaaaagccgctcgaagtgattaccccaaaggcaggcgctatcagccatcgttattatcagcccaaacttggcggagatatggcggtggtcaggggaatggtcaaggcactgttagaaactcacaacgcatttctggcggctggcaaatcaggtatttttgatctggaatttatttcgactcatacggaaggtgtggacgcttatttgcaagaagttgcagtaacggaatgggcatttattgagaaccaatccggtctgacgcaggcacagttacgtgaggcggccaccatttatcagcatgcggatcgggttatctgtacttgggcaatggggataactcaacataagcactctttggatactgtccgtgaaatcgcaaaccttcaattgctgtttgggcagttgggtaaaagcggtgcggggctgtgtccggtgcgtggtcacagtaatgtgcagggtaatcgcacgatggggattaatgaacaacccacgaaggctttccttgatagcatggctgaacattttggtttcgaaccccctcgcgcccacggtcatcatgttgtgaaagcattgagtgccatgctgcgtgatgaagtaagagtattgattgctctgggaggaaaccttgcggcggctgcgccagatagcccgcgcacagaagaggcgcttcggcactgtgatcttacggttcatatcagtacaaaacttaatcggagtcatcttattaccggtaaaaaagaggcgcttatcctgccggcgttggggcgtactgaacaggatattcagctcagtggagcgcagtttattacggtagaagactctttcagcatggtgcatgcctcagaagggctgaacaaacctttatttgatactcaacgttctgagacggcgattattgcgggcattgccaatgcagttgtaggaaatacagcaacgattaactggttagaattagccgggaattacaataaaatccgcgatcacattgctgcgaccattccggggtttgctgattttaataaaaaatgtgaacagcccggcggtttctaccttggtaatgcagcggcggagttacgtttttctacaccaagtaaaaaggcgcagttcagtgatgcttcactgccggaaagtctcttcccgcaactgggcgaaacagacgttccgtttactctgcaaaccttacgctctcacgatcaatataacacgactatttatggcttggacgaccgctatcgtggggtttatggtcagcgggaggtgctctttatgaatccagaagatattgctttattggggtatcaagcgggggatcgggttgatatcgagacagtatggaatgatggtattgagcgcaaagtgtatggttttaaactggttccttacgccattccatgcgggaaccttgcggcctattacccggaaaccaatccattagtgccgatggatagtattggcaatggtacgggcacaccaacatcaaaatctgtgccggttaaattatcactgactgagataggtgaagcggaacctcagcgccttgtataa

SEQ ID NO: 4630 - DNA, 210 bp, Xenorhabdus bovienii
  Coding sequence Name=Xb4151_4152.C443.gene146.dna; Position on contig= 118442..118651bp; Strand=+
atgatccattgtgatacttattccgttcttaggcaacggaaaaaccgatctattgctattgagagtacgatgtcagctcctcaaattaaccatactatttctattggtaattttataggcaactgttttataactgactacgaatttgggatgattttcgtgatgcttacgataacgattgagacgtttaggcctcaaggcgttacttaa

SEQ ID NO: 4631 - DNA, 1218 bp, Xenorhabdus bovienii
  Coding sequence Name=Xb4151_4152.C443.gene147.dna; Position on contig= 118829..120046bp; Strand=-
atgaacaatactttaattacctctgataattcattaatgctttgggcctttattatgattgcggttgctgtggcaattatggtagagcagcgataccgatgggcatctaaaatacccggtgcagttatcgcactgatcattgcagtattcgcgtctaacttaaatatcattccgacagaagctcctgtttacgatgcagtttggggatatatcgtgccattagcaatccccttgctgttattcaaaaccaatttacacagtattatcaaagaaagctggcgattactgatcttatttttgatttcttccgttgccacgatgattggcgcgatagtttctttccggctttttaaggagcatatcccggaactggataaaatcagcggtatgatttcggcttcatatacaggaggtggggtcaactttgcggcaatggccgccaaactggaaccttcccaaagtatgacggcatccactatcgtggccgataatatgatgatggcaggttactttattatcctgatagcattatctggctggacagtagccaggaagttctggggcagtcctcatactgacgcgatagataacgatccagacttggataaatcccagacttttgcagccgcttattggaagccgaaaaatatcgctctgaaagatatcgccttatcgctggcatggtcgatttttatcgttgcgctgtcatttcagttatctacatggctaaaagccctgctggggcaaccaaacagtatttatcaggaactgcttttcagtttgatatccgataaatacctgatccttacaactgtgacgtttactctcgtctcgatctttaaagaaacattcagcaaactgaatggcacacaggaattggggacttacgctatttatatgttctttgtcgtgattggcattccggcatcaattgaagccatcattagccatgcaccactgctgtttgcttttgtttttgtaattgccatgatcaacctgttactgacctttgctgcgggaaaagtgtttaaatttagtctggaagagaacattctggcctgtaacgccaatatcggggggccaacaacggcagccgctatggcaattagccgcggctgggtcaatctggtcggcccgattatggtgattggtacagtcggttatgtgattggcaactatgtggggacttttgtgtactttattgtggggcggatgtaa

SEQ ID NO: 4632 - DNA, 732 bp, Xenorhabdus bovienii
  Coding sequence Name=Xb4151_4152.C443.gene148.dna; Position on contig= 120120..120851bp; Strand=-
atgtttctatctattgctatggaaaataacaccgtggataaaatcgctgttgaaaaactttttgattgggaagtaattaatggaatgcctatcaatgaatgtcatgaacctttagagataattactgatacagataaattaagacagcaatctgcttatttttttgctggtataaaaggctccattgaatattgcaccgtaagagaaaatgtcgcccgaaaattagtgattgcatcacagctgctacctcctcatttagggcttttggtattagatggctggcgttcacgggaaactcagcaggcattacaggagcaaacacagataaaaatagctgaccaatatcgccatttatctgttgaagaacaaaaggcacttttgcagcagtttgtggctcctgcgcctacggaacagcaccaaatcagtccccatctgacggggggatccgtggatgtgacgttatttgatgtggcatctggcaagcccctgtttctgggaactgaatttgacgaagtgactgagctgtcttatacggcggcgttagaaaaagaacccgaaaaaaatatgccggccattttatatcgtcggttattgtataacgccatgattcaggttggttttactaacttacctacggaatggtggcattatgattacggcaattccctgtgggcattttataaaaacgatattgccatttatggtgctgtggatggaacgcgaaacagataa

SEQ ID NO: 4633 - DNA, 138 bp, Xenorhabdus bovienii
  Coding sequence Name=Xb4151_4152.C443.gene149.dna; Position on contig= 121128..121265bp; Strand=-
atgaataccgttcaggtattcctcctccggatattaggggatcaagggcatgtacctattctgtcacataagatttggcatttcaccctgcataaatcggtctttgacgcatccagcgataccttgtttgagctgtga

SEQ ID NO: 4634 - DNA, 465 bp, Xenorhabdus bovienii
  Coding sequence Name=Xb4151_4152.C443.gene150.dna; Position on contig= 121274..121738bp; Strand=+
atgacccaagaccatcaattacaagtagaagctattaaatgtggcaccgttatcgatcacattccggctcacatcggtttcaaattattgtctctgtttaaactcacagaaacagagcagcgcattaccattggtttgaacctgccttccaatcaactcggcagaaaagatctgatcaaaattgaaaatacctttctcacagagcagcaggcgaaccagctcgcgatgtatgctccccatgctaccgtcaataatattgaaaattacgaagttgtgaagaagatacccatcaatttgccaaagcagatagacaatgtcctcgtgtgtccgaacagtaattgtatcagtcacaatgagcccgttgagagcagcttttatgtcattccaaccgccgatgatgtgatagtccgctgcaaatactgtgagaaggaatttgaccgtcaggcagtcattaacaacgactag

SEQ ID NO: 4635 - DNA, 387 bp, Xenorhabdus bovienii
  Coding sequence Name=Xb4151_4152.C443.gene151.dna; Position on contig= 121882..122268bp; Strand=+
atgtcacgttccattcataccgagaatgcaccagcagcaatcggcccttatgttcagggtgttgatctgggcagtatggttatcacttccggccagatccctgttgatccaaaaaccggtgacatccctgaagacattactgcccaaactcgccaatctctggagaacgtcaaggcgatcatcgaacagtctggtctgaaagtggctgatatcgtgaaaacgacggtatttgtcaaagacttgaatgacttcaccaccgtaaacgcagcttatgaaacgttcttcactgaacataacgcgccattccctgctcgttcatgtgttgaagttgcccgtctgccaaaagacgtgaaaatcgaaatcgaagccattgcggttcgcagctaa

SEQ ID NO: 4636 - DNA, 432 bp, Xenorhabdus bovienii
  Coding sequence Name=Xb4151_4152.C443.gene152.dna; Position on contig= 122393..122824bp; Strand=-
atggaattaaatgaaaatttcttaactattcgtcgatatctcgccaaacaacatgtcttcactctctgcacttcctcatcacaagatctatggtgtgcgagttgcttctatgcgtttgatgccgatagtatggcattctggtttatgaccgaaccggatacccgccacggccagatgatgcagcaaaatccagtagttgccggcactgtcgcagggcaaacccgtaacattgcccaaatcaaaggtattcaattccgtggtgaaatcacaccgctgacaggcgaagccgaaactcttgccagagcacgttattgccgtcgttttcccgtcgccctcgctgcaaaatcccctatctggcgactcagcctaagtgaaataaaaatggtggataacacccttggttttggcaaaaaactacattggcaacgttaa

SEQ ID NO: 4637 - DNA, 252 bp, Xenorhabdus bovienii
  Coding sequence Name=Xb4151_4152.C443.gene153.dna; Position on contig= 122941..123192bp; Strand=-
atgaaatctgtaaaatatatcgtctgtattttggcattaagtgctatttcatttggctctatggctgcaactgaagtgcaatatgctaaaggagagaaggttggggttgtttcagttactggtgcagagacactggatagtctgactgctgagttatccaaaaaagctgataaagcgggtgcatcatatttccgtgttatttcagcaaatggtcagaataaactcagtggagttgctgaaatctataaataa

SEQ ID NO: 4638 - DNA, 402 bp, Xenorhabdus bovienii
  Coding sequence Name=Xb4151_4152.C443.gene154.dna; Position on contig= 123412..123813bp; Strand=+
atgaatgagtttcataggataataaaagcatgcaaattatttaaaataaataatgatatgaaatcaacccactggtatctctatctgataagaactcgaaacaattctctgtatactgggattaccacagatatcgcccgtcgatttatgcagcacgtgtctggaaaaggtgccaaagccttaaaaggaaaagggccattaacattggtctaccacagtttggtggaagatcaaggcatggccctgaagttggaatatcgcgtgaagaaactcagtaaaaaacaaaaagaaaggctgatcactctccaacctgtctgtatagcaacctatttgtccgagatgttggtgccaaaaatagctcagtcagtcatcactcatgatcaaaatggtcggaatacgtaa

SEQ ID NO: 4639 - DNA, 504 bp, Xenorhabdus bovienii
  Coding sequence Name=Xb4151_4152.C443.gene155.dna; Position on contig= 123782..124285bp; Strand=-
atgttaatcagggtcgaaattccggtcgatgccatgggtattgatcgcttgttacgtcaatcctttgagacatcggcagaagctgagttagtttatcgattgagagaagatggtctgttgacgttgggtattgttgcgactgacgatgaaggttatgtgattggctatgtcggtttcacatctgttgatgtcaatggtcaggatcatcaatgggttgggctagcgccattagcggtggctgaaccgtaccgtcgtcagggaattggtgaaaaattggtttatgaagggctggatagtctaaatgaatttggctatggcgcggttgttgtattgggggagcctgcgtattaccgccgttttggtttcaggcttgccaaagaataccaattgcattgccaatggccagagtgtgaggatcacttccagatatacacgttggcggatgtctcactggaagattgtcacggtctgattacgtattccgaccattttgatcatgagtga

SEQ ID NO: 4640 - DNA, 381 bp, Xenorhabdus bovienii
  Coding sequence Name=Xb4151_4152.C443.gene156.dna; Position on contig= 124279..124659bp; Strand=-
gtgttaggtaaaatccactcccatttagtcagtcaagagccaacattactgcgtctttcattgaaggtgactccttttgctttaccgcatcaggtgctggaacaactgcttggctggcagttccacggggtattggctgagggagaactggcgtttttggagtctcgcagggaagatcctgatacactgttttttcagcatcgtttaaggattgaaggaaatacagaattgggactgcatgtgaaaaatttggtggatgccattaggctgggatccatgccatccattctccgcttgggtttattgtgtctggctgaatttatcaaagcgggacaaaaagagggcgttgatcagcacgatcgcgcattatcgtcatgttaa

SEQ ID NO: 4641 - DNA, 1173 bp, Xenorhabdus bovienii
  Coding sequence Name=Xb4151_4152.C443.gene157.dna; Position on contig= 124707..125879bp; Strand=-
atgatcccaatattaatatctgcattaacatctggtgtatcaatggcagttttttttactgccatctcttggtttgtagagggaagttttcattcaacaacgttagtatctgttgttctttcgtcaggttatatattgactttttttattctgccaaaaataggtttttttattgattcaaactctgctaagaaagcgttaaataatatttatattctaggtcttttaaatagcgttgtttttttatttttaacaaatataaatttgaatgaaattgttcttatagccaccgttattatacttacaagtatatttacattcattcgttcatccgatcaggtaataagagcaacttacataaaaagagttgtttctagcgaagaactttataacgctaataaaaaccttgaattaattaggcagggaattacttttctgtctggcggtgtggccttctttattttagaagataaatcgataagtaatgtctgtattgtaagtattttttgtttttctatttctatatttataaatgtttgtgttaaaaaagataatacagataaatttgatcgtgttattgaaaataatagtagaattaaaaatacttataaaataggatatgatttctttaatggtgaagtaaaaagacacgttgttctgttgtcaatatttccatatatttgtgtcgtatcattaaattcaatataccctgctttgtttaatgttataaattctcagatacagtattacgcgctgttagttgttccatatggggtaggggctataatgggtagtttgattggctcaaagcgatcatatttgtcactaaaaaataactatatcatattcggaactatctctataataggtctttttttacctgttttttttaatcacctttattctgtttatttgtgtctttttctaattgcgttaagtcactcacgtattcgggtaataagaaatacaattattatgaatgaagcaggtaatcaaattctaggaagattattatcattcaatgaaatgatatttatcactctttctgttggattgagtgtattgctgggtgtattgtctgattttctaggtttttgggttgcatggtttatggtgatttttttgaatgtgactgtgttattttttatccttctttcgaaggataaaaaatag

SEQ ID NO: 4642 - DNA, 990 bp, Xenorhabdus bovienii
  Coding sequence Name=Xb4151_4152.C443.gene158.dna; Position on contig= 125881..126870bp; Strand=-
atggctagtaagaattatttagaaacacctaaatttattcataatttatggactcaaaatgaagacgatgaatattacttgcgttttaccaaagggttatatgaagtagacaaaaatgatgcaagagattttatgacaatacgcggatattgcactgggaataatacaataacagatattcatgaaaaaacaggaatgccaaaagatagaatagttgacataatttcatctcttcatgaaataggaatgttaaggaatgaagaaattgtcagtgaagaaaatttttttgataagatcattattgcctgtgagatgtgggcagagcaaatagaagagacacatttattcaataagtttttatatggtgacgtgagctataatgtcttgctaggttttatgctggaaaactaccattatattaaattatttccggaaacaatatcttctgctataaaaaacacgacaaatgagagtgtgaaaaatatattggaagagtatcggttacaggaagctggacatgaaatatttatgttgagatgtttattaaaaatgggaatgagaaaagaggaagtagaaacgtcgattcctttagtctcgacttcaaatcttattaatatgatgaaatatttgtttggtaaatatcctgaatctgtatttctggtggcaaaagttattgaatctcatgattatgatgaaaatgaagtaaagattgctattgataatattaataaaacgtataaccttaaacaaggtacgctggaacctttctttgagcactctaagatagattatgaacttgggcattctcagcttctggaaaaagctaaatcactaattaatttcaatgatgttgataaagtttcatatgttctaaatgcaattcatgatattaaacatgctattgacttgcaatgcttagaaatagaggagtattatacaaagcaagggaattatatacctcgacaacgagtagactatttcggtgtttaa

SEQ ID NO: 4643 - DNA, 189 bp, Xenorhabdus bovienii
  Coding sequence Name=Xb4151_4152.C443.gene159.dna; Position on contig= 127094..127282bp; Strand=-
atgaggaattgcgtaatattccatttcgtatcaggaattttttctaatgaaatttataaaataaagtcattatttgtttttattatttatttaaatgatttcactaattctgattattatatatttaatagtgatgctgtttttaatataagcattacatttgtttgtgatctgtatcttaaattttaa

SEQ ID NO: 4644 - DNA, 1176 bp, Xenorhabdus bovienii
  Coding sequence Name=Xb4151_4152.C443.gene160.dna; Position on contig= 127395..128570bp; Strand=-
atgccattcgtgatatacgtattttcgctttgtgcattcgcgatagggtttacggagttcatcactattgggctgatatcggtgatgtcagcaaatcttgacgcagatgtaaccagtatcgggttaacggtgacagcctatgcattaggtgttgtgatcggggcacctattttgacggcactggcatctaattggtcgaggaaacgcttacttcttaccgcaatgttggtatttactattggaaatctgatagcagctgcatcagcaaatttggctcttcttttagctgcacgtttgttatctggtttggcacacggggtcttttttgctgtggcttccggtgttgcgactcggctggttccatctgaacgtgccggaacagccctcgctttggtattcggtggtgttaccattgccatgtctttaggggtgccggcaggaacttggcttggtagtatattggattggcgagtgatatttttaattatctcagcctgcgggttgctgggaacgcttggtattggatttaaaatgccaaaagatgccggagaacagattgtgaagacatctgctagctggcgccatctaaccatactttttgatcgacgtttactggcaggggcgagcgttccaatgctttcctataccgcttcttttgctttgtacacctttattacccctatactactgagtattacaggggtaagtgttgaaacagccagtggagtattgcttgcttatggtattggtgctgctgttggtacggtttggggtgggcgattgactgatcgacaaggaatggatctcgcatcactgattcttcttgtcggtattgcggttgtgcttgccgctatgagtttcagtctgacccattctctactgatgattggcttgacggctctactcggattggccacttatggagcaattccgccattgcagtcaaggatactcatgctggcgaaacgtcacacaccctatgcaatggatatcgcgtcaggaatgaatatcgcggcttttaatgctggggtcgttttaggctctgtgattggtggcgcgacagtacgagagtggggattagaaacattaacatggataggggcagtgacgggtgtattggctatcgtatcccttgtctggcaaatggttattccatctatgcgtgagcaacgctga

SEQ ID NO: 4645 - DNA, 138 bp, Xenorhabdus bovienii
  Coding sequence Name=Xb4151_4152.C443.gene161.dna; Position on contig= 128509..128646bp; Strand=+
atgaactccgtaaaccctatcgcgaatgcacaaagcgaaaatacgtatatcacgaatggcattaaaaattctccttatacgctcaaaacgcgccaacctgaattcaaagtaagtcaccagtatcaggcttccatttag

SEQ ID NO: 4646 - DNA, 909 bp, Xenorhabdus bovienii
  Coding sequence Name=Xb4151_4152.C443.gene162.dna; Position on contig= 128695..129603bp; Strand=+
gtggtacttcgtaaccttgaagatctaagtgtatttatcagaatcatcgacacaggcagtttcactgctaccgctcaagccttgggactgtctcccaccactgtcagtaaacagattgcacgtctggagaaaaatcttggcgtagttctctttgtacgaagtacccgttcattgcgcattactcctgaaggcaaagcaatcgctgaaaaagtgagggcggcgctgacactggtggaagaagcgactgaaattgccaaggatggaagtgaatctctcacaggtttgattagacttaccgcgccagtaccgcttggtcgaacttatgtcgcggcagcaattgcagagtttagaaaaaaatatccatcagtaggattcatcttgcatttgacagataaaattgttgatctttataaagttgagatggatttagctatcagagtcgcaaatttaactgattcaggtttaattgccagacgcttaacagataacaaacgaattttagtcgcatcacctgattacctcagactgcatggcgaacttcagcacccagaagagctgattaaccatcattgcctgcttttttccgcctccggaaataagagtacaatatggtcactacacgataggaaaggcactaaagctatctcactctcaagtgatttaatcgctaataatggtgatgtcttgcgaacttggtgtacggcaggtttaggtatagcactgcgagaaacatgggatgtagtcgatttaattcgcgcaaaaaaactcatccagatactgccggaatggcaagaagaaacctcgccaattaatctagtgagagccgggaaacggcctgttccgcagcgtatcaaaagcttcatcgagtttctcaccgaggaatggagaattcccccgtgggaaaaatag

SEQ ID NO: 4647 - DNA, 786 bp, Xenorhabdus bovienii
  Coding sequence Name=Xb4151_4152.C443.gene163.dna; Position on contig= 129652..130437bp; Strand=-
atgaatataaatttaaaagggaaaattgcattagtaacaggttctacagcagggattggattagctattgctcagggtatgcataaggctggtgcttctgtcattttgaatggaagaagtgaagagaggctcatacaggcggttaataaatttaactgcttggatcgcgtttttactgtagctgctgatgttggcaccaaagaaggctgtgaactcattaacaaaaattttccggatattgatattctggttaataacgccggaattttttctcctaagccaatttttgaaattagcgatgatgaatggattaattattttaatattaatgtcctaagtggaattcgtctggcacgttcatacattccacttatgattgggaaacgatggggacgtgtggtattcatctcaagtgagtcagccttacaaatcccggtagaaatgccacattatggcctgaccaagacggctcaagtcgcagcagcaagaggattcgcacaagctgctacaggaacaggagtcactgtcaacagcgttttacctggacccactgaaagtgaaggggtagagcgatttgtcagagaacttatcacggacccaacactttcaatggaagaagcaggaaaacgctttattgaaacagcacgtcccgcatcgttgctgggtcggttagccactgctgaagaagtcgccaatgctgttctctttttagcttcaccactcgcttctgcaataacgggtactgccctgcgtgttgatggtggcgtcattcaaagtattttgtaa

SEQ ID NO: 4648 - DNA, 789 bp, Xenorhabdus bovienii
  Coding sequence Name=Xb4151_4152.C443.gene164.dna; Position on contig= 130492..131280bp; Strand=-
atggagcgtagtttagcgggtaaagcagtaatcatcactggggcaggttcaggtattgggcttgctgctaccacggaatttttaaatgcgggggcgtatgttataggagcggatattaaccttgagaaactttatgagttgcagagaggggaatacctatttccttatcagtttaatgtcagagatccctcagatattgatggtcttatcaatacagccatcagccaatttgggaagatagatatcctgattaataatgctgcattagtagaaccgaggaaaagttttcttgatgtaaccgatgacgactggaattctacaatcgaaaccaatctgcttggttacatccgaatggctcgcggtgtactaccttatatgtgcaatcagaaaaagggtattttactccatatcgcttctgaagcagcattaatgccaaatttgattctccctgattacagtatcttgaaatcttcagttctaactctgtctaaggtgatatcaagggagtttggaaaatatggcattcgatctaatgttatttctccagcttttattcatacctctatctacgataaacctgaaggattgataactcagcttgaacaaaagtataaagttggacgtgaagaagcattgcaacgttatattgaagaagttgatatcgctgttggtcggttagggcaacctgaagaagtggcggttttactcttatttttggcctcagaatctgctgcattcattactggggcaaattatttagtcgatggcggagtgactccttttatctaa

SEQ ID NO: 4649 - DNA, 234 bp, Xenorhabdus bovienii
  Coding sequence Name=Xb4151_4152.C443.gene165.dna; Position on contig= 131270..131503bp; Strand=-
atgcgtaaagatgaacactttgatccaattcttatatccaccgggcagcatgatgagatgttatattttactctttcggtagcggcggcggacttcaatcaagatggaaagtttgacttcgcaactattgcctattcggtgccaaattattttgtcgcaaaacaagcacgaatcgttgtacatattaaccagatcaaacgagatgttgctgtaggagatactgatggagcgtag

SEQ ID NO: 4650 - DNA, 132 bp, Xenorhabdus bovienii
  Coding sequence Name=Xb4151_4152.C443.gene166.dna; Position on contig= 131744..131875bp; Strand=+
atggtgacatttctcaggtttgaagtatcttataaattatttttcaaaaaaatcgatcacctgaaaggaacttcgtccagttttacgggctactcagtaatccaaaatcactcaacggatcgcaagttatga

SEQ ID NO: 4651 - DNA, 594 bp, Xenorhabdus bovienii
  Coding sequence Name=Xb4151_4152.C443.gene167.dna; Position on contig= 132652..133245bp; Strand=-
atgagaaaatatataacacaagacgaatggaatcgtgttttttctgtattaaacaatggtacaaataaagagcgcgatcagtgtctgctatacttaacttatattcatggcctacgtgtgagtgagttgacttcattaaaagtctccgatatcgatatcgcagggaaaaccatttatataaagcggttaaaaaatggattttcgacaacacaccctatctcaaaaacagaaaaagaacttatcttaaaatggcttaaaatcagaaataacaactcggtatattgcgcttctttgtggctgtttccttcacgaaaaggcggaaaattatcacgtcagtgggttcatgttttaatggggcgatacggagaacaggcgggtttatccattaggttgcacccacacaagttgcgacactcctgcgggtttgaattggctaatcaaggattagatacccggctgattcaggattatttggggcatcgtaatattcgtcacaccatgcattacactgccagcaatccagaacggtttcagaaagcctggcagcagaatcaacaattgaaaattgatagtggtaaatatcctgccccttga

SEQ ID NO: 4652 - DNA, 219 bp, Xenorhabdus bovienii
  Coding sequence Name=Xb4151_4152.C443.gene168.dna; Position on contig= 133488..133706bp; Strand=-
ttgttttcatttaccaatggcagacagcccaattttgtctatgaattgttctatttgacgcataggttaaaattattttttatctctcacgatcaaacaacgagtattgcgttatttttgagattaaaaaatagacacaaaataatattgctaatttattatgtaagtctgactacactgttcattgctttttataattatttattgtgctttttgtga

SEQ ID NO: 4653 - DNA, 2988 bp, Xenorhabdus bovienii
  Coding sequence Name=Xb4151_4152.C443.gene169.dna; Position on contig= 134136..137123bp; Strand=+
atgcacagaaaattcgataagtcgtggccacagaatcagtatcctttgctgaaacgaatggcttgggcgaacattatcatccaactggcgtttccagtagcaggtacatttactcccattatcgccgcagccaaaacgcatacgacttctcacgatcaacaattgacggcactaccgataaaaccttatatcctgaaatccggggaaacgatcgatttaatagctaaacgttatagcctaaccgtcgatgatctaaaaaaaatcaatcaattgcgtacctttagcaaacccttttcaacattgggtatcggtgatgaaattgatgtaccccgacctcgcctcaataaatttctgccttgtaattattctccgttagacgaatctgacagcaaagatgagacaaatagccgtctgtctaatgccgctattcgcgttggcgatgtgttgaaaagtaatgacataagcaatagcgcaaaaattcagttaaacggtctcgcagtcagtgaagtcaatcagcagattcagaattggctggggcactacggcaccgcacgggtacagataaatataagtgatcggggtcgattagatggcagtcagcttgatatgctactccccctgtatgatacaaagaaccaactgacgttcacccaattcggcctgcgtcggctggataaacgcaataccatcaatctcggtgttggacaacgccgtttctttgacggcggaatgctgggatacaacgccttttttgactatgactttaccggagagaatacccgaatagggcttggtgctgaatatgcccgcgattatctgaagctgggtgctaatggttactttcgcttaagcaattggaaagaatcccctcttctgaccgattacgatgagcgcccggctaatggctttgacctgcggattcagggctatgtacctgctttgccacaactcggtggcaagttgatgtatgaacattacttcggggatgaagttgggttactcaatcaaaatcatcgccagaaagatccttctgccttcaccgtaggaattaattatacgccgatcccattgctgactttcggcattgatcggaagcaaaatacttccggtggtggagaaaccctgttcaatatagagttgaactatgaaataggtacaccatgggagaagcaaattgatcccgatgccacggatttcaagcgcaccctgcaaggcagtcgctatgatctggtcgaccgcaataaccagattgttctggaataccgcaagcgtgaagttatccatcttacaatggaccgtctgattaccggacatgctggtgatatcaagccgcttcaccttaccgtggtcagtaaatatggtctgaaaaatattcagtgggaagccgtaaacctgtttgccgatgggggtgagatcgagcgccaaggcggttctcattatctgctgactctgccggaataccaccatcagggcaacaatacttatattctcagtgccgtggcctatgatgagcacggcaatgcttctcagcgggtagaaactcaagtacaggtgctgccagccgcagtacgtgacaataagtccactttcacagcaaaagataatgaactgctggctgatgaccgtgccaccaccatgctgaaattaaccttagaggataaagagggtaagccaatccgtgatgttgccgacgatatcaaatgggttactaatcagttgggtggagaaggcagcgatccgacgatcggaaaaataaaagaaactcaaccaggtgtctatgaagccatactcacggctggaaaaaaaatagggatactaaaaattacgcctgaagtggatggagttcatatcaaaccattaaaaatcacatttgtgcatcctgacgcaccgtttgtcaaaaatctgactattgttggtaaattggagatcgggcaaaaattgagtgcaacttatacttttaaccctaatgggggcgaaaaagtggataaatcccgctatgtatggggtgacaaaggtaatatcgatattactaacagtcatacgatcgtcgaatcaggcaagctccctaactatacattggaactgtcagatgctggccgggtaaaagccgttgcagtgcaggcacaaaatggtcttggactcatcgggaatactatgattgttaataccagcatgagccaagagagtggcaaccgtactcacggcggcagtgaaggcggaaaagtcagagggattgcggatgatatcgctgccacagtgaatactgataatactaaaaaaagcaacacaataactttgaccgtacagacattcaatcacgggcaacccgtcagaaatgtggccgttgaggtgcaagcgacccaagcaataaaccgccagaataaacctcagacgattaccgtgctgataggcggcaaacctgctctttatcaaggcgtgacagatgagcagggcgtactgtctattcctatcaccgatccaaacgggaacggtgtaaaaacttcttttaagataacagcatatggttctgcaaaacctaaaactcaggagctcatctttaccgtcccgaccagccccgatacccctctggcaaacttttggggacatatgtccgaatcagtaatgggtgccaatggcgctgtctttatgcgccctcagttgcaagttgaactgaaaggaaagatgaaagggttggccacattttttgaaagcggtgagatatggccacgtcgggtttacaaaggcgctgaatggtactgcggaaaaatacatgccaatttgccaacacaagaggacttacagagcctgtatcgtgcatattcggcaaatgaaatgcacgatctgcacggctggccacaacatcgctcttatcgttcttcaacgcctgcagagggtaacaaagtgcatattgccgtgaatatagacaatggatttgcacatcccattgaggacaacattgtcagcgattatgtcatttgtcgtcagtaa

SEQ ID NO: 4654 - DNA, 1698 bp, Xenorhabdus bovienii
  Coding sequence Name=Xb4151_4152.C443.gene170.dna; Position on contig= 137299..138996bp; Strand=+
atgcatgaatttaatcttgttttgttactacttcagcaaatgtgtgtctatttggttatcgcctggctgctgagtaaaacgcctctgtttatccccctgctgcaagtttccgttcgcttgccacataagctgatgtgttatgtcattttctccattttttgcattatggggacgtattttggattgagtgtcaatgattccatcgccaatacccgcgccatcggtgctgtactgggtggctttctcggcgggccggcggtcggggctatggtaggattcaccgggggattacaccgctattcccttggtggaatgaccgcgtttagttgtatggtgtccactattgtagaaggcatactgggcggccttgtacacagttatctgatgaagcggggacaaatcaataagctgctgaatccgtggactgccgccatcgtcaccttcctggctgaatgtatccagatgagcattatcctgctgcttgccaatccgttcagtgatgctcttaagttggtgaaaaatatcgccgctcccatgatcattgccaatagcatcggagcggccatgttcattcggatactgctcgacaggcgcgccatctttgaaaaatataccagcgccttttctgcccaagccctgaaaatcgccgtctgtacagaaggaatactgcgtaaagggttcaatgaggataacagtatgcgcgtagcaaaggttatttatcaggagttagagatcggggcggttgcaatcaccgacagggataaattactggcgtttatcggcattggctccgatcaccatttgtctggtactcccattgtttccgagcaatcacaccgtgcgatagaaaataatgaagtcgtgtatgccgatggtaatgaaacgccctatcgctgctctctcagcccaatctgtaaactcggctcggctttggtgatccctttacggggagaaaaccaacaggtgattggcaccatcaaactttatgaagctaagaattgtctattcagttcaatcaatcgtacattaggtgagggcattgccagcctgctttctgcccaaattcttgccggacaatacgagcggaacaagcaatctttgctgcaatcagaagtaaagctacttcacgcgcaagtaaatcctcactttttatttaatgccttaaatacgttacaggcggtgatccggcgggatagccagcaggccgggcagcttgtacaatatctttcaacatttttccgcaagaatctgaaacgaccagaggaaattgccacgctggaaaatgagatagagcatgtgaatgcttacttacaaatagagaaagcccgtttccgtgagcgtctccagattgccatagcgatacctgaatccctgcgctgcgcaaaattgcccgccttttccctgcaacccatggtagaaaacgccataaaacatggcacttcacagttactggatacaggccgagttactatccgagcccatcagaaagctaatttattactggttgagattgaagataatgcaggactttattgtctaaaaaaaataggggatggacttggaatgagtctggtagataaacgtcttcggcttcgctatggtgagcgctatggtatgcgtgttgattgccaaccagaaaaatttacccgtgtcattttatgtttaccattggaaaaagaaactgacaaagcagtgtaa

SEQ ID NO: 4655 - DNA, 720 bp, Xenorhabdus bovienii
  Coding sequence Name=Xb4151_4152.C443.gene171.dna; Position on contig= 138999..139718bp; Strand=+
atgaatgtattgattgttgatgatgaaccactggctcgagagaatctgcgttacctgctagaagaggaaacggatattcaaatcatcggtgagtgtgccaacgcggtggaagcgattggtgctatccatcgcctgaaaccggatgtggttttcctcgatattcagatgccccgcattaccgggcttgaaatggtggggctgcttgaccctgagcatcgcccttatattgtttttctcacggcctttgatgaatacgcagtgcaagcctttgaagaacacgcgtttgattatttgctgaaaccaccggaaaaggagcgtctgagcaaaacgttgcagcgactgcgttcaggctatcagaagcaaaatctggcagatctgcaacaggaagatgaaccgcttaaatatattccctgtacagggcacaaccggatatggctgatgcagttagatgaggtgctgtatgtcacctcacgcttgagtggagtttatgtgatgagcgccaataaacaggaaggttttaccgagttaaccctgcgtacgctagaaacccggacttctttgactcgctgccatcgccaatatctggtcaatatgactcatttgcgggaaatcatttttggagaaaatggacaggcagaactggtgttacgaaataatgagcatatcccagtcagtcgccggtatttaaaaccactaaaagaagttctggggttaaattaa

SEQ ID NO: 4656 - DNA, 1989 bp, Xenorhabdus bovienii
  Coding sequence Name=Xb4151_4152.C443.gene172.dna; Position on contig= 139824..141812bp; Strand=-
atgaccactgagactgaaatctcttttgctgatttaggtttatcagcacctattcttgctgcattgggagacatgggctatgagaagccttcccctattcaacaacaatgtattcctcacctgttaaacggtcgtgatgtgctgggtatggcacagaccggtagtggtaaaactgcagcatttagcttgcctttgctgcacaatattgatgctgagcttaaagctccacagatccttgtgttagcgccaacccgtgaactggcggtacaggttgctgaagcatgttcagagttttccaagcaaatgcgtagcgtaaatgttgttgcactctacggtggacagcgttacgacgtgcaattgcgtgcactgcgtcaagggccacaggttgtggtaggcacgccgggtcgtctgttggatcacctgaaacgtggtactttggatctgtccaacctgaaaggtctggtactggatgaagccgacgaaatgctgcgcatgggctttatcgaagatgttgagaacatcatgagccagatccctgctgagcaccagactgcattgttctcagcaactatgcctgaagcgattcgtcgtattactcgtcgtttcatgaatgatccacaggaagttcgtattcagagcagtgtgacgactcgtccagatatcagccaaagctactggtctgtacatggcgtgcgtaaaaacgaagcgctggtacgtttccttgaaacagaagattttgacgctacgattattttcgtgcgtaccaaaaatgcaacgctggaagtagcagaaaccctggaacgtcatggttataactctgcggcattgaatggtgacatgaatcaggcgctgcgtgagcagacactggaacgtttgaaagacggccgtttggatatcctgattgcgacagatgtagcggctcgtggtctggatgttgagcgcatcagtctggtcgtgaactacgatatcccaatggatgcggaatcatatgtacaccgtatcggccgtactggtcgtgctggtcgtgctggccgtgctctgctgtttgttgaaaaccgcgagcgtcgtctgctgcgtaacgttgaacgtaccatgaaactgaccatcccagaagttgaactgccgaatgcagaacttctgagccagcgtcgtctggagaaatttgcggctaaggttcagcagcaactggaaagcagcgatctggatcaatatcgtgccctgttgtctaaactgagcactaacgatgagctggatatggaaacgctggcagcgtcattgctgaaaatggcacagggtgagcgcccactgattctgccaccagacccagttcgtcgtcctcgtcgtgaattcaatgatcgtgatgaccgtcgccgtgatggtttcagcagtcgtgaaagaaatgacagaggtgacagaaacgaccgtggcgacagagctgaccgtggcgacaaaggtgatcgtccgcgccgcgaacgccgtgatgtgggagacatggaactgtaccgcattgaaataggtcgtgatgatggtgttgaagtgcgtcacattgttggtgcaatcgccaacgaaggtgatatcagcagccgttatatcggtaatatcaagctgttcgctactcactccaccattgagctgccaaaaggaatgccgggggatttgctgtctcacttcacacgtacccgcatcctgaacaagccactgaatatgcagttgatgggtgatgcacaaccgtttgaacgtcgcgaacgtcgtggcggtggtagtggtcgcactggtaacggtagcaacgctagcaatggcggtaatggtagcactggcggtaacggtagcaacggtggtaatgcaccacgtcgtgatcgtgagggttttggtaatggtggtcgtcgttttagcactgaacgccgtggcgatcgtgttaattcccgtggccgcagtggtgatgagagcaatagcgcaccacgtcgtcgtcaaaacagcggcaacgcataa

SEQ ID NO: 4657 - DNA, 885 bp, Xenorhabdus bovienii
  Coding sequence Name=Xb4151_4152.C443.gene173.dna; Position on contig= 141983..142867bp; Strand=-
atgaattcttttctgcgctggtgttatgttgcggttatctttctccttgtgggatgtggcagcactggatggcgtaaaaatgaaatgattgctattccattacaaccgacattgcaacaagaggttatcctggctcgtatggaacaaatacttgccagtcgctctcttacagaagatgagtatgcacagcttttatatgagagaggtgtgttgtatgatagcctcgggctgagggcattggcgcagaatgatttttcagtggctttgtctatccgtcctgatattcctgaaattttcaattatttagggatttattttacgcaggcaggcaattttgatgctgcctatgaagcgtttgattctgttttagagcttgatccaacttacaactacgcgcgaatgaatcgcggcattacactgtattatggtggccgctatcgtttagcgcaggatgatctgcaggcgttttatcaagacgatccaaatgatcccttccgttcgttgtggttgtaccttgtggaagataaaatcgatcccaaggttgcaatgaccaatttgtcacgccattttgacaaagcgaaccgggggctatggggctggaatattgttgagttctatttaggcaaaatcagtgaaaaaacactgatggatcgcctgaaggagaattcatcagataacacttcgctcgctgagcatctcagtgaaactgacttctatttaggtaagcattacctaagtctgggggatgaggataacgcggttgcgttattcaagctgacggtagctaacaatgtccataattttgttgagcaccgctatgcattgttggaattagcgctgctaggccagagacaagatgacctatcggaatcgaaccaacaatag

SEQ ID NO: 4658 - DNA, 2151 bp, Xenorhabdus bovienii
  Coding sequence Name=Xb4151_4152.C443.gene174.dna; Position on contig= 142997..145147bp; Strand=-
atgattttgctgaatccgattgttcgtaaattccagtatggtcagcatacagtgaccattgaaacaggcatgatggctcgtcaggcgacagcagccgttatggtaaatatggatgacactgcggtatttgttaccgttgttggccagaaaaaaatgaaagcaggtcaggatttcttcccactgaccgttaactatcaggagcgtacttacgctgctggtcgtattccaggaagtttctttcgccgtgaaggccgtccaggtgaaggtgaaacccttgttgcccgtttgattgaccgtcctctgcgcccactgttcccagaaggttttctgaacgaagttcaaatcatcgcaacagttgtttctgttaatccactggtgaaccctgatatcgttgccatgattggtgcatccgctgcactggcactgtcaggcattccattcaatggcccaattggtgctgcacgcgtcggttacatcaacgatcagtacgtgttgaacccaaccagtgatgaactgaaaaacagccgtttagatttagtggttgcgggtacagcaggcgcggtattgatggtcgaatctgaagcggagctgctgactgaagagcagatgctgggtgccgttgtctttggtcacgaacagcagcagattgtgattgatcacatcaatgcgttagttgctgaaacgggtaaagagaagtgggactgggcaccagaatctatcaaccagccactgcatgatcgcgttgctgaactggcagaaagccgtctgggtgatgcttaccgtattaccgaaaaacaagaacgttacgctcaggttaataccatcaaagaagaagtttctgcgattatcgttgcagaagcagtagaaaaaggtgttgaactggaaaaatcagaagttcttgacgttctgtctgttctggagaaaaacgtcgttcgtggccgtgtcctgcgtggtgagcctcgtattgacggccgtgaaaaagacatggttcgcgcactggacgttcgtactggtgtactgccacgtactcacggttcatccctgttcacccgtggggagactcaggcgttagttgcagcgacactgggtactgagcgtgatgcccaagttattgatgaactgatgggcgaacgagccgatcgcttcctgttccattacaacttccctccgtactctgttggtgaaacgggtatggtcggctcaccaaaacgtcgtgaaattggtcacggtcgtctggcgaaacgtggtgttttggctgtaatgccaaccgctaacgaattcccatatactattcgcgtagtgtctgaaattaccgaatctaacggttcttcttctatggcttctgtctgtggtgcttcactggcactgatggatgctggtgtacctattaaggctgctgttgctggtatcgctatgggtctggtgaaagaaggggataactttgttgttctgtctgatattctgggtgacgaagatcatctgggtgacatggactttaaagtcgcgggtagccgtgatggtatcagcgcattgcagatggatatcaaaattgaaggtatcaccagcgaaatcatgcaggttgctctgaatcaagccaaaggtgctcgtctgcacattcttggcgtgatggaacaggctatccaaagcccacgtaatgatatctctgaatttgcgccacgcattcacaccattaagatcaatccagacaagatcaaagatgtgattggtaaaggcggttcagtgatccgtgcactgacagaagaaactggtacaaccatcgaaatcgaagatgatggtactgtgaagattgcagccactgacagtgataaagcccatcacgctatcagacgtatcgaagagattactgctgaggttgaagttggccgcatttataacggtaaagtgacccgtattgttgacttcggtgcgttcgttgctattggtggtggtaaagaaggtctggtacatatttctcagattgcagataagcgtgttgagaaagtgacagactatctgcaactcgctcaggaagtgcctgtcaaggtactggagatcgaccgtcagggtcgtattcgtctgagtatgaaagaagctgtgaccaatatcactaccgatgaagcactacaatcaccagaatcatcagtagaataa

SEQ ID NO: 4659 - DNA, 159 bp, Xenorhabdus bovienii
  Coding sequence Name=Xb4151_4152.C443.gene175.dna; Position on contig= 145100..145258bp; Strand=+
atgctgaccatactggaatttacgaacaatcggattcagcaaaatcatattccttggttagtgttgccgactctaaatatcagcaacaatagacattctctttttgctacaccctcacgactaatgacaacacttaattcccttaagcactctcattag

SEQ ID NO: 4660 - DNA, 270 bp, Xenorhabdus bovienii
  Coding sequence Name=Xb4151_4152.C443.gene176.dna; Position on contig= 145379..145648bp; Strand=-
atgtctctaagcactgaagcaaaagcgcaaatcgttgctgagtttggccgtggcactaatgacagtggttctagcgaagttcaggttgccctgctgaccgctcaaatcaaccacctgcaaggccacttttcagagcacaaaaaagatcaccacagccgtcgtggtctgctgcgcatggttgcacagcgtcgtaagctactgaactacctgaagcgcaaagatcttgcacgttatactgcactgatcgagcgtctgggactgcgtcgctaa

SEQ ID NO: 4661 - DNA, 948 bp, Xenorhabdus bovienii
  Coding sequence Name=Xb4151_4152.C443.gene177.dna; Position on contig= 145853..146800bp; Strand=-
atggggcgtcgtcgtaggggccgtgcgatacacggcgtattgctgctggataagccgcaggatatttcctctaatgatgcgttacagaaagtaaggcggatcttcgatgccagcaaagcgggtcatacgggtgcgctagatccactggctaccggaatgctgccaatttgccttggtgaagcgaccaaattttcccagttcctgctggattctgacaaacgctatcgggtaattgcccgtttgggacagcgcacagacacttcggattcacatggaaaagtcatttgtgaacgtgaagtgcagattacccagccccagcttgcagccgcattggatacattccgtggtgataccatgcaggttccttccatgtattctgcgctgaaacatcagggaaaaccgctgtatgaatatgcccgtcagggaattgcaattgagcgggaagcgcgtccgattactgtttacgaattgcagttcattcgctgggaaggtgatgagctagagctggaaatacactgttccaagggaacgtatatccgtactatcattgatgatttaggcgaactattgggctgtggtgcgcatgtaatttatctgcaccgtttgcaggttgccaattatcctactcatagaatggtgacactggaacagttgcatgaattaaaaaaacaggctgaagaacaagaagttgatgcgggagaattgctcgatccattgttactgccaatggatacagcggtcgcacattttccagtcattcagttggcatcagttgttgctgcttatcttaagcaggggcagccagttcgcagtaaacacagtttaacatccggtgaatgggtgagagtcactgaaggggatgaaaacaaattcatcggcatcgcggtgattgatgatggtggcttggtggctccgcgtcgtctggtggtagaaatagaacaattataa

SEQ ID NO: 4662 - DNA, 411 bp, Xenorhabdus bovienii
  Coding sequence Name=Xb4151_4152.C443.gene178.dna; Position on contig= 146800..147210bp; Strand=-
atggcaagagaattcagccgaactcagcgcgttgcacaggaaatgcaaaaagaaattgccatcattttacagcgcgaagttaaagatccccgtatcggtatggcaacagtctctggtgttgaggtttcccgtgatctggcttatgccaaagtatttgtgacttttttgaatgtgttggtcgaagggcaagattcggatatggttaacgtgggcattaaggccttgaatgaagcttctggttttattcgttccttgctgggcaaagccatgcgtctgcgtgttatccctgaactgacgttctcttacgacagctctctggtagacggaatgcgcatgtcaaaccttgtcactaaagtcgtgaaaaacgatgagcagcgtcgtgtttctacggatcacaacgaggaaaagtga

SEQ ID NO: 4663 - DNA, 2775 bp, Xenorhabdus bovienii
  Coding sequence Name=Xb4151_4152.C443.gene179.dna; Position on contig= 147277..150051bp; Strand=-
atgacagaggtaaccgtaaaattactggcagaagagatccagacatcggttgaacgcctgatccagcaattcgctgatgctggcattcagaaaaccgcaactgactctgtttcccagagagaaaaagaatctttgctggcacacttgaaccgcgaacaaggcggttctggcggccagccaggtaaattgacactacagcgtaagactcgcagtacactaaacgttcctggcaccggtggcaaaagtaaatcggtagcgattgaagtccgcaaaaaacgcacatatgtgaaccgtgacgcgattgaacaatctccaacggaagaacaggcgaagcgtgaagcggaagagcaggctcggcgcgaggtagaagaaaaggcgcggcttgaaactgaagcgaaaaaattcgcggaagagcaagctaaacgtgatgctgaagaacaggcaaaacgtgaagcagcaaagagcgctcaacgtgaagcagaagaaaaagctaaacgcgaaggggttgacatgactcagcgtgaggcggcggaaaaagaaaaagtgactaagcaacataccgaaaacaaaccaaaatcagttcagactgagcctgccgtgcaaagtgaaaaagcgcgccgtgaagccgaagcagcaaatttaaaacgcaaagctgaagaagaggtgcgccgcaaagttgaagcggaagcgaaacgtgtcgcggaagaagcgcgtcgcatggcagaagaaaataaagataaatggtcagaaaccgctgaacccagcgaaaatactgatgattatcacgtaaccacttcccaacacgcccgtgctgcggaagacgaaaatgacgctaaagttgaaggcgatcgccgtacccgtagccgtggtggcaaagctacacgccagaagaagaataacaaacattctgaatcgaaagctgatcgcgaagaagcacgtgcagttggccgtaacaaaggcaaacagcgcaaaccgagtaccttacagcaaagcttcaccaagccagttgccgcggttaaccgtgatgttgtgattggtgaaaccattaccgtagctgaactggccaacaagatggcggtcaaaggttcccaagttatcaagaccatgatgaagatgggcgctatggcgaccattaatcaagttattgatcaggaaactgcacagctagttgctgaagaaatggggcacaaagttatcctgcgtcgtgaaaacgaactggaagaagcgctgatgagcgatcgtgacacaggtgaaacgctggctgagtcacgtgcgcctgttgttaccatcatgggtcacgttgaccacggtaaaacctcactgctggactacattcgttctactaaagtagcttctggcgaagcaggtggcattacccagcatatcggtgcgtaccatgtacaaactgaaaaaggtatgatcaccttccttgataccccaggacatgctgcgtttacttctatgcgtgctcgtggtgccaaggcgacggatatcgtcgttctggttgtcgccgcggatgatggcgtgatgcctcagaccgtggaagccatccagcatgccaaggcagctaacgtacctgttgttgttgctgtgaacaaaatcgataagccagatgctgatccagatcgcgtcaagaatgaactgacacaatacggtatcattcctgaagaatggggtggtgaaaaccagttcatgagcgtttctgccaaagcaggtctcggtattgatgaattgctggaatgtattctgctacaggctgaactgcttgaactgaatgctgttcgtactggtatggctaatggtgtggtcattgaatccttcctggataaaggccgtggcccagttgcaaccattctggttcaatcaggtactctgaataagggcgacatcgtcctgtgtggctttgaatatggccgtatccgtgcgatgcgtgacgaacttggtcttgaagtcacgtctgctggtccatccattccagtcgaaattctaggtctttccagcgtaccgtcagcgggtgatgaagcgactgtggtacgtgacgagaagaaagctcgtgaagtagccttgtaccgtcagggtaaattccgcgaagtgaaactggctcgccagcagaaatctaaactggaaaacatgtttgccaacatggaagaaggtaaggtatctgaactgaacatcgttctgaaaaccgacgttcagggtacatgtgaagcgatctgcgactcactgctgaaactgtctactgatgaagtgaaagtgaaaatcatcggttctggtgtcggcgggatcactgaaactgatgcgactcttgccgcagcgtctaacgcaatcattctgggcttcaacgtccgtgcggatgcttctgcacgtcgtattattgaaagcgaaagtgttgatctgcgttactactccgttatctatagtctgattgatgaaatcaaacaggcaatgagcggtatgctggcaccagaatacaaacagcagatcatgggtcttgcagaagtccgtgatgtctttaaatcaccgaagtttggtgctatcgctggctgtatggtgacagaaggctccatcaagcgtaataaccctatccgcgtcctgcgtgacaacgtggttatctacgaaggtgagctggaatccctgcgtcgctttaaggatgacgttaacgaagtccgtaatggtatggaatgtggtatcggtgtgaagaactacaatgacgtccgtgttggtgacatgattgaagtctttgaaattattgaaatcaaacgctccatcgtttaa

SEQ ID NO: 4664 - DNA, 1509 bp, Xenorhabdus bovienii
  Coding sequence Name=Xb4151_4152.C443.gene180.dna; Position on contig= 150077..151585bp; Strand=-
atgaataaagaaattctggctgttgtggaagcggtttctaatgaaaaatctctccctcgcgaaaaaatcttcgaagcattagaaattgcactggcgacagccaccaagaaaaagtatgagcaggaaattgacgttcgtgtctgcatcgatcgtaaatccggtgatttcgataccttccgtcgttgggtggcggttgaggaagtaactctgccaacccgtgaaatcacgctggaagctgcaaaatatgaagacccagaaatggaactgggtggttatattgaagatcaaattgaatcagtaacttttgaccgtatcactacccagaccgcaaaacaggttatcgtacagaaagtgcgtgaagctgaacgggcgatggtggttgatcagttccgtgagcagcagggcgagatcgtgactgctcaggtcaagaaagtgaaccgtgaaaatattacccttgatttgggtaataacgctgaagcggtcattttacgtgaagatatgttgccacgggaaaacttccgtccaggtgaccgtgtgcgtggtgtcctgtatgatgttcgtccagaagctcgtggcgcacagctttttatcacccgctctcgtcctgagatgttggttgagctgttccgcattgaggtgcctgagattggcgaagagatcattgagattaaagcagccgcccgtgatccaggctctcgcgcgaaaatcgcagtaaaaaccaacgacaaacgtatcgatccagttggtgcctgcgtaggtatgcgtggtgcgagagtacaggccgtttccagtgaactgggcggtgaaagaattgacattgtgctgtgggatgataaccctgcacagtttgtcattaatgcaatggctccggcggatgttgcatctatcgtagttgatgaagataactgcacgatggatgttgccgtggaaagcagcaatcttgctcaggcgattggccgtaatggtcaaaacgtccgcctggcggcacaactgctgaaaaaacatcgtggtgatgacaagtgggaactgaatgtcatgactgcggaagagctgcaagcaaaacatcaggcagaagcacatgcttctattgatacatttaccaagcatctcgacattgatgtagatttcgccaccgtattggtcgaggaaggtttctctacgctagaagaactggcttatgtgccaattaatgaacttctggcaatagaaggccttgatgaggaaaccgttgaagttcttcgtgaacgtgcaaaagcggccttgacgacgctggaactggctcagaaagagagtcttggtgatcagcaacctgccgaagatttattgaatttatctggcatggatcgtactttggcgtttaacctggctgcccatggcatctgtactctggaagatcttgccgagcagggtatcgacgacttatctgatatcgaaggactgagtgatgagaaagcaggagaactcattatggcagcccgtaatatctgttggtttggcgatgatgcataa

SEQ ID NO: 4665 - DNA, 423 bp, Xenorhabdus bovienii
  Coding sequence Name=Xb4151_4152.C443.gene181.dna; Position on contig= 151607..152029bp; Strand=-
atgatttcagcaccagttgaagctttggggtttgaattagtgggcctggagtttatccgtgcacgtgtatcaacactgcgggtctatatcgatagtgaggagggtatcactgttgataattgtgctgatgtgagccaccaggtcagtgcagtactcgatgtcgaagatccgatctcagtgctttataacctggaaatatcttcaccaggacttgaacgtccactgtttaaggctgaacattaccagcgttttatgggtgaagaagttagtctggttttacgtatggcaatgcagaatcgccgtagatggcaaggtattattaaagttgtcgatggtgaaatgattacggttacggtggatggaaaagacgaagtgttcgcactgagcaacatccagaaagcgaacctggtaccccacttttaa

SEQ ID NO: 4666 - DNA, 138 bp, Xenorhabdus bovienii
  Coding sequence Name=Xb4151_4152.C443.gene182.dna; Position on contig= 152342..152479bp; Strand=+
atgctgctccatcccgcgttcgaaaacgtggcaaatcttacgctgataatactaaaaacgcaagtttctagattatggtgccgaggacgggacttgaacccgtacgcccgttgtttaggcactaccacctcaaggtag

SEQ ID NO: 4667 - DNA, 339 bp, Xenorhabdus bovienii
  Coding sequence Name=Xb4151_4152.C443.gene183.dna; Position on contig= 152608..152946bp; Strand=-
atgtatgaagctcttttaggtgtattcttgctggctggtcttggagtaattgctctggttctgctacagcagggtaaaggtgctgatatgggtgcttctttcggtgcgggtgcgtctgcaacactgtttggttcatcgggatctagtaattttatgacccgtatgacggctatttttgctacattgttttttgttatcagtttgattctgggtaacatgagcagcaaccgaactggttcagacagtaagtgggaaaatcttgctgagcctgtaaaagttgaaaaacaagcagaagtaccagcatcgccagcaaaaccaaatagtgatatcccacagtaa

SEQ ID NO: 4668 - DNA, 111 bp, Xenorhabdus bovienii
  Coding sequence Name=Xb4151_4152.C443.gene184.dna; Position on contig= 152947..153057bp; Strand=+
atgtcgtacctgtttcctcgtggggatttaccacaattctgtagcaacgttatactgcatcacccgctcataattagaaaaattaacttattgagcgggtgtgaatactaa

SEQ ID NO: 4669 - DNA, 1338 bp, Xenorhabdus bovienii
  Coding sequence Name=Xb4151_4152.C443.gene185.dna; Position on contig= 153125..154462bp; Strand=-
atgagtagccgtaaatattttggtactgatggtattcgtggcaaagtgggtgatagcccaattacccctgattttgttttgaaactcggttgggctgcgggaaaagtactggcgcgtcatggttctcgcaagattatcattggtaaagatacgcgtatttccggctatatgctggagtctgctctagaagcagggttggcagcagcgggtctatcagcatcttttactggccccatgccaacaccagctgtggcctatttgacacgtactttccgcgcagaagcgggaattgtcatttcagcctctcacaatccttactatgacaacggtattaaattcttctctatcgatggaaccaaactgcctgataatgttgaagaagccattgaagctgaaatggaaaaaccactgacctgcgtagaatctgctgagttggggcgtgccaatcggattgttgatgcggctggtcgttatattgaattttgtaaaggcacattcccgagtgaacaaagcctgaatggattgaaagttgtattagattgtgccaatggtgcaacctatcatattgccccgaacgttctcagagagctgggtgcgaatgttgtgaccattggctgtgagccgaatggcatcaacattaatgaagagtgtggtgcaacagatgttcgcttgttacagaagcgggtacaggaagaacaggctgatgttggtctggcatttgatggtgatggtgatcgcattatcatggttgatcatctgggacagaaagtggatggagaccagatcctctatatcattgcacgtgaggcattgagacaggggcaactgcgcggtggtgcggttggtactctaatgagcaatatagggctggaattggctcttaaacagcttggcatcccatttgagcgagcaaaagtgggcgatcgctacgtactggaaaaattgcaagaaaaaggttggcgtctaggggcggaaaattccggtcatgtgattttgctggataaaactacgactggcgatggcattgtggcaggattgcagatactgagcgcgatggtacggaataatatgagcctgcatgacctttgcagcggcatgaaacttctgccacaaattttggtaaatgtccgttttgcaggtgacaacgatcctctgcaatcagaatctgtgctagaagccgttaaatcggttgaggctgaattgaacggccgtggtcgagtactgctacgtaaatcgggcacagagccacttatccgtgtgatggtggaaggtgaagatgaagaattggtcactgcattggcacaccgtattgctgatgccgtgaaaaaaacagggtaa

SEQ ID NO: 4670 - DNA, 858 bp, Xenorhabdus bovienii
  Coding sequence Name=Xb4151_4152.C443.gene186.dna; Position on contig= 154498..155355bp; Strand=-
atgaaactgacagccagaggcagtgtcctcgatctttcccgtccacaagtaatggggattctgaacgttactcctgattctttttcagatggaggcaatcacagtacctttgatgccgcgttgcggcacgcagccacaatgatcgaggaaggtgcagccattattgatgtgggtggagaatcgacacgccctggtgccgtggatgtgagtgagcaggaagaactggatcgcgttgtccccgtggttgaagcactggcgcggcgttttgatgcatggatctccatcgatacctcaaaagccatagtgatgcaggaatctgctaaagtcggggctcatatgatcaatgatattcgttcgttgcaggagtttggtgcacttgacgcagcagtaaagacgggattgcctgtttgcctgatgcacatgcagggacaacccagcactatgcaggcagagccatactatgaagatgccgtttgggaaaccaaaacatttttgacgaggcaaattgatcgctgtgttgcggcaggcatcgcaaaaaacaaactgatccttgatccaggcttcggcttcgggaagaacttatcgcataattatcagctattggctcatttggaagaattccatcatcttggcttgcctattctggctggaatgtcacgcaaatcaatgattggccaattacttcatgtaccaccgcaggagtgtgtaacaggaagtatcgcctgcgctgtgattgcagcgatgcaaggtgcccagattattcgtgtgcatgatgtaaaagaaaccgtacagacaatgcaaattgttcaggcaacactgtcagcgaaaaacatactggctgtcaagaacacgctgtga

SEQ ID NO: 4671 - DNA, 1908 bp, Xenorhabdus bovienii
  Coding sequence Name=Xb4151_4152.C443.gene187.dna; Position on contig= 155475..157382bp; Strand=-
atggcgaaaaacctgattctctggttagtcatcgcagttgtcttgatggtattgttccagagttttggtcctggcgactctagcggtcgtagggtagattactctaatttcatcagtgagttatctcagaatcaagtgcgagaagtacgtatatcgggtcgtgatattgattacagtaagaaagacgacggtaaaaaatacagcacttacatgccaattcaggatgagaagctgctggatactctactgaataagcaggtgaaagttattggtgaaccaccagaacaacagggcctgctcgcgactctctttatttcctggttcccaatgctattgctgattggcgtctggatattctttatgcgccaaatgcaaggtggtggcggtaaaggggcgatgtcttttggtaagagcaaagcccgcatgttgacagaagatcagattaaaaccacgtttgcggatgttgctggctgcgacgaagcaaaagaagaagtgggagaactggtggaatatctgcgtgaacctggccgtttccagaaactgggtggtaagatcccgaaaggtatcttaatggttggtcctcctggtacaggtaaaacgttgctggcaaaagccatcgcaggtgaggctaaagtgcctttctttaccatttccggttctgacttcgttgaaatgttcgttggtgtgggagcttcccgtgttcgtgatatgtttgaacaggcgaaaaaatctgcgccttgtatcatcttcatcgacgaaattgatgctgtaggccgtcaacgtggtgctggtctgggtggtggacacgatgaacgtgaacagacactgaaccagatgctggttgaaatggatggtttcgaaggtaatgaaggcatcatcgttattgccgcaactaaccgtcctgatgtgctggaccctgcattgctgcgtccgggtcgcttcgaccgccaagtcgttgttggcctgccagatgttcgcggtcgtgagcagattttgaaagtgcatatgcgccgtatcccgctggataccgacgttgacgcttccatcattgctcgtggtacaccaggtttctctggtgcagatcttgcgaaccttgcgaacgaagctgccttgtttgccgctcgtggcaataagcgcgttgtttccatggtggagtttgaaaaagcaaaagataagatcatgatgggtgcagaacgccgttccatggtcatgacggaagagcagaaagaatccacggcttatcatgaagcaggacacgccatcattggccgtctagtgccagaacatgatcctgttcataaagtcacgattattcctcgcggtcgtgcattgggtgtgactttcttcctgccagaaggtgatcagatcagcgcgagccgccagaaactggaaagccagctttcaacattatacggtggccgtctggcagaagaaattatctacggtgtagacagtgtttctactggcgcatccaacgatattaaggtggcgacatccattgcccgtaacatggtgacacagtggggcttttcggaaaaactgggcccactgctgtatgcggaagaagaaggcgaaatcttccttggccgttcggttgctaaagcaaaacacatgtcggaagatactgcgcgtttaattgatcaggaagtgaaagctatcgtcgatcgtaactatcaacgcgcccgtaaaattctgatggataatctggatatcctgcattcgatgaaagatgcgttgatgaagtatgaaaccattgatgtatctcagattgatgacttgatgaatcgaacaacagtgcgttcaccagcaggttgggaaggtgacaacaataatggcggtaataaccgtcataatatgtcatctccgcagcagactgtgaaacctgcggatggtaatccaaccgcataa

SEQ ID NO: 4672 - DNA, 630 bp, Xenorhabdus bovienii
  Coding sequence Name=Xb4151_4152.C443.gene188.dna; Position on contig= 157440..158069bp; Strand=-
atggccaataaaaaacgctcagcaagctctagtcgctggttacaggaacattttagtgataaatatgttcttcaggcgcagaaaaaagggcttcgctctcgcgcttggtttaaacttgatgggatacaacaaagcgacaaaatctttaaaccgggtatgaccgttgttgatttaggcgcttctccgggagggtggtctcaatatgtagtcaatcagattggtgatcgtgggcgggtgattgcttgcgaccttttaccaatggatccgattgttggagttgatttccttcaaggcgattttcgtgatgaacttgtattgaaagcattgcttgagagagtgggtgataataaagtccaggttgtcatgtcggatatggctcccaatatgagtggaacccccgcggtcgatattcctcgatccatgtatctgattgagttagcgttaggtatgtgtcgtgatgtgctggcccctggcggcagttttatcgttaaagtgtttcagggagaaggctttgatgaatacctgagggaaatacgctccctttttacgaaggttaaaattcgtaaaccagaagcttcgcgggcacgatcgcgtgaagtatacattgtagcgacagggcggaaactgtag

SEQ ID NO: 4673 - DNA, 294 bp, Xenorhabdus bovienii
  Coding sequence Name=Xb4151_4152.C443.gene189.dna; Position on contig= 158204..158497bp; Strand=+
atgactcttaacaagaaacaagtgcaatacctgaaaagtctcgctcattcattaaagcctgtcgttatgattggtaacaacgggctgactgaaggcgtgttggctgaaatcgagcaaactctttcgcatcacgagcttatcaaagtcaaagttgcaggcgaagaccgtgaaatcaaaactttgatcgctgaagcgattgttcgtgaaactggtgcatataatgtgcaaatcattgggaaaatgctagttctctaccgtccatcgaaagaacgcaggattagtttaccgaaataa

SEQ ID NO: 4674 - DNA, 477 bp, Xenorhabdus bovienii
  Coding sequence Name=Xb4151_4152.C443.gene190.dna; Position on contig= 158652..159128bp; Strand=-
atgaaacaaattccgatgacggtacgtggcgcggataaattgcgcgaagaattagaaaatctgaaaaatgtacgtcgccctaaaattattaccgcaatcgctgatgcgcgtgcgcatggtgatttgaaagaaaatgcggaatatcatgctgctcgtgagcagcaagggttctgcgaaggccgtattcaggaaatcgaagctaaactttccaatgcgcaggtgattgatatcacgaagatgattaataatggtcgtgtgatctttggggcaacggtaacggtattgaatatgggttctgatgaagaacagacttaccgtatcgtgggtgacgatgaagcgaatatcaaagagaacctgatttcggtgaattcacctattgctcgtgggctgattggtaaagaagtggatgatgttgctgtgatcagtacgccaggcggcaaagtggaatatgaagttctgaatgtcgagtatctctga

SEQ ID NO: 4675 - DNA, 1539 bp, Xenorhabdus bovienii
  Coding sequence Name=Xb4151_4152.C443.gene191.dna; Position on contig= 159313..160851bp; Strand=+
atggatcatcgtttactttttcctgaatttcaccttagtattattgatgtaaatatttttagaatactttcaccttcatatgcgagatctatggctcttttaaagattaccagcagaatagcttgtatgctcagttttagtctgagcattttcagtgcaaatgcttcctcaatagaagaagatgctcaatatttgcctgcgggaactgacttctcatttattgcccagaaaattggctcaaaaacgcccttacttgattataatgggcagcaattggcattacctgccagtacgcagaaaattgtgacggcattggcagccctgttacagcttggcaaggattaccgttttatcaccacactggaaagtaatgctgatatttcagatgggatattgagaggcaacctaactgcccgttttgttggtgatccaacgctgacacgttcgcaactgcgcaatatggtagaaacgttgaaacaatccggcataaaacagattgatggcgacctcatcatagacagttcaattttctcaagccatgataaagctccgggttgggtgtggaatgacatgacccaatgcttcagtgcacctccagccgccgcaattgtcgataaaaactgcttttctgtttcgctgtacagttcagaacaacccggtgaactggcgtttgtccgtgttccttctttttatcctgtcaatatattcagtgaagtaaaaacgctgtctaaaggctctccagaagcaaaatactgtgaactggatgttacttcaggtgaattaaacagatttactctgacaggctgtctgacacaacgcagtgagccactaccactggcattcgccatccagaatggagctagttatgcaggtgccattttgaaaaatgaactacatatcgctggcattgagctaaaaggtcacctacgtcgccaatcagatcctgagcaaccagagaagattctcgctttgaatgaatctgctccattgcatgttctgctcaaaaccatgctgaaaaaatcagataacatgattgccgataccctctttcgcaccctcggccatcgctatttcaacgtgcccggaacatggcggactggttctgatgccattcgtcacatactgaaacaaaaagcaggcatcgatctaggcagtaccatcatggttgatggttccggcctttcacgccacaatttaatcacaccagcaaccatgatggagatcttgcaatttatcgcgcaacataatgatgatctcgactttatctccatgctaccaaaatcaggttatgacggtactctgtcctatcgtccgggactccatgaagcgggtgtaaatggtaaagtctttgcaaaaacagggtcactgcaaggggtttataatcttgcaggctttattaccgctgccagcgggcagaagattgcttttgtccaatttatctcttcttattctgttttacctgacgatcaacgtacccgccgtattcctttggctcgtttcgaaagccatttatataaatcgttataccaaaatcattga

SEQ ID NO: 4676 - DNA, 1179 bp, Xenorhabdus bovienii
  Coding sequence Name=Xb4151_4152.C443.gene192.dna; Position on contig= 160911..162089bp; Strand=-
atgaaatttgtagatgaagccagcatactggttgtagcgggagatggtggcaatggttgtgtcagcttccgtcgagaaaaatatattccaaaaggtgggccagacggcggtgatggtggtgacggcggtgatgtttatctgctggcagatgaaaatctcaatacgctgattgactaccgctttgaaaaatccttccgtgctgaacgtggtcaaaacggacaaagccgtggttgtaccggtagacgtggccaagacattaccatcaaagtcccagtaggaacccgtgtgcgcgatatcgcgactggggaagtccttgcggatatggtgcgtcatgagcagcgtcagatggttgctaaaggggggttccacggtcttggtaatacccgctttaaatcttctgttaaccgtgctccccgccaaaaaactatggggacgccaggtgaaagccgtgagctgatgctggagctgatgctgctggcagacgtgggaatgctggggatgcctaatgcaggtaaatccaccttcattcgctctgtttcggcggcgaaacctaaagtggcggattacccattcacgacactggtgccaagtcttggcgtcgtgcggatggataacgagcaaagctttgtagtggcagatattcccggtttgatcgagggtgcgtcagaaggtgtgggtttgggtattcgtttcctgaaacatttggaacgttgtcgtgtcttacttcacttaattgatctctgcccgctcgatgaatctgatccggttgaaaatgcccgtatcattatcaaagaactgcataaatacagcgaaaaactggcagaaaaaccgcgttggctggtattcaataaagtcgatctgaccgatccggaagaagctaaacagcgggcaaaagccattgctgatgagcttggctgggaaggtgattattacatgatttcagctgtaaatcgtcagggtgtgaaagagctttgctgggacatcatggaattcatgaaagctcagcctcgccatatggacgtggaggcagaagcccagccggaaaaagttgaattcatgtgggatgattaccataaggaacagttacaacaatcatctgatgcggatgttgacgatgatttggatgatgactgggatgagggagacgaagaaggcatagagtttatttataaacactag

SEQ ID NO: 4677 - DNA, 297 bp, Xenorhabdus bovienii
  Coding sequence Name=Xb4151_4152.C443.gene193.dna; Position on contig= 162064..162360bp; Strand=+
atgctggcttcatctacaaatttcatcacttttctccgtaggataaccaccgtaaagctggatggctgctgtacccagagatggcataattcagaatataaaaagccccgcaacacacattgcagggcttccgattcgattgagactcaaaaaatttattcagctacgatactgataaacttacggttttttgaacctttaacttcgaatttaatttttccgtcagctaatgcgaacagggtgtggtcacgaccacaacctacgttgctgcctgcatggaatttagtaccacgttga

SEQ ID NO: 4678 - DNA, 309 bp, Xenorhabdus bovienii
  Coding sequence Name=Xb4151_4152.C443.gene194.dna; Position on contig= 162497..162805bp; Strand=-
atgtacgcagttttccaaagtggtggtaaacaacaccgagtaagcgaaggtcagacaattcgcttggaaaagctggacatcgcaaccggtgaaactgttgagtttgaccaggttctgatggtcgctaatggtgaagatattaagatcggcgctccagtagttgaaggcgttaaagttaaagctgaagttgttgctcatggccgtggcgagaaaattaaaatcgttaagtttcgtcgtcgtaaacacagccgtaagcagcagggccaccgtcagtggttcactgatgttaaaatcactggcatcgcttaa

SEQ ID NO: 4679 - DNA, 972 bp, Xenorhabdus bovienii
  Coding sequence Name=Xb4151_4152.C443.gene195.dna; Position on contig= 163058..164029bp; Strand=+
atgaatttagaatcaataattaaacttaccgctgatgatatggcagcggttaatgaaaccattcttaatcaattaaattctgatgttgcgctgatcaaccaacttggctactacattatcagcggcggtggtaagcgtattcgcccaatgattgcggtactggccggaaaagcacttcattgtgaaaaagaaaaacatatcaaagttgccgccttaatcgaatttattcacactgcaacgctattgcatgacgatgttgtcgatgaatccgacatgcgccgaggcaaagcgacagccaacgctatgtatggcaatgcggccagtgttctggttggtgatttcatctacacccgatcgtttcagatgatgactgatctcgattctatgcgggtactgaaattgatgtccgacgccacgaatgtcattgccgaaggtgaggtgatgcagttgatgaactgcaatgatcctgatacctcagaagatgattatatgcgtgtgatttacagtaaaaccgctcgcctgtttgaggtagcggcacactctgcggccattttatccggtgcgacaccagagcaggaagctgcactgcgtgactatggccgttatcttggcacggcgtttcaattgattgatgatctgctggattacgattcagatgacagcacactcggtaaaaacacaggggacgacttaaacgaaggcaaacctacactgccccttctgcatgccatgcatcatggagtcccggagcagtctgcactgatacgcagtgccattgagcaaggcaatggccgccatttgttagataccgtactagcaacaatgaaacagtgtggttcacttaagtacacccgccaacgggcggaagaagaagcagataaagccatttcagcgttacaagtactggatgagtctccatataaggcggcccttgtgggattagcccatgtcgcggtacagcgactttcctga

SEQ ID NO: 4680 - DNA, 381 bp, Xenorhabdus bovienii
  Coding sequence Name=Xb4151_4152.C443.gene196.dna; Position on contig= 164057..164437bp; Strand=-
atgaaaaaagattggtattctgcaaaagaactcattggcctcgcaggtctgccatcgtctccccaaggcgtcaatttgatggcaaggcgcgaaggttgggagcaacgccgtaagcgcggagtacaggggaaagctctcgaatatcatgtcaacagcttgcccgaagaagttctgaatgtactggccgtcagtgaaagttcggtcgagtattatcggaataagcgtcaggatccgttcatgatttggattgaagcttattatcaattaaccaaacccgaaagggaacgcatggttaagttcattttgaggaaagggctggctagcctagtccaatacataggaattcaagaggttgaaaataaagacagtatcccagattga

SEQ ID NO: 4681 - DNA, 348 bp, Xenorhabdus bovienii
  Coding sequence Name=Xb4151_4152.C443.gene197.dna; Position on contig= 164513..164860bp; Strand=-
atgaaaaaagagtggtatacggcaatggagttgaccggtgtaggtgagttacctagatcaccacaaggagttaatgccagagcaaaacgtgaagaatggttgagacagaaacgagcaggtgttcaaggcagggctattgaatatcactattcttgttttcctgaatcaacattgtcggctctggagcttcatgaaatatcacctgaatatcaggttcagaaacaagatcctctatccatttgggtgagtgcatttaatttactctccgatgaagaaaaggaggcgattacagaagtgatattacgagatggcataagaagttttttggaaaaaatcatagctacttga

SEQ ID NO: 4682 - DNA, 267 bp, Xenorhabdus bovienii
  Coding sequence Name=Xb4151_4152.C443.gene198.dna; Position on contig= 165048..165314bp; Strand=+
atgatttctatgaaatcggattggcatcctgctgatattattgctgctttacgtaaacgcggaacgacactggctgccgtttcacgcgaagcagggttaagctcatcaactttggcgaatacactttctcgcccatggcctaagggagaatggataatagcgaattacttaggattacatccggctgaaatatggcctagtcgttatttcgatccacatacaggagaactattagaaaggaaaattagagaaaaaaagaataattag

SEQ ID NO: 4683 - DNA, 939 bp, Xenorhabdus bovienii
  Coding sequence Name=Xb4151_4152.C443.gene199.dna; Position on contig= 165427..166365bp; Strand=-
atgaaagttgcagttctcggtgcagccggtggtattggtcaggcacttgcccttctactcaagacccagcttccttcaggttcagaactttccttgtatgacattgctccggtgactccaggtgtggcagccgatcttagtcatatcccaacggaagtgaaagtcactggttttgctggtgaagatgcaacccctgcattggtaggcgcagatgttgtattaatctctgcaggtgtggcgcgtaaaccaggcatggatcgttcagatctgttcaatatcaatgcgggtatcatccgtaatctggttcagcaggtagctaaggcttgtccaaaagcattaatcggtattatcacgaaccctgtgaatactactgtggcgatagcggctgaggttctgaaaaaagaaggtgtttacgacagaaaccgtctgttcggtattacaacgctggatatcattcgttccaatacttttgttgcagaactgaaaggtaagaactctgaggaattggaagtgcctgttattggtgggcactctggtgtgactatcctgccattgctgtcgcaaattcagggcgtcagcttcactgatgaagaagttgaagcgttaaccaaacgtattcagaacgcaggtactgaagtggttgaagcgaaagcaggtggcggatctgcaactctgtctatggggcaggcagcggcacgtctgggtctttctttgatccgtggcttgcagggtgaaagcaatgtcatcgagtgcagttatgtagaaggtgatggtaaatatgcccgtttcttcgctcagcctgttcgtttaggtaaaaatggtatcgaagaacgtttagatatcggcaaacttagcgattttgaacagaagtcactggatagtatgttgggcgttctcaaaaaagatatcgaattaggcgagaaatttattaacggttaa

SEQ ID NO: 4684 - DNA, 471 bp, Xenorhabdus bovienii
  Coding sequence Name=Xb4151_4152.C443.gene200.dna; Position on contig= 166894..167364bp; Strand=+
atgcgtgttccttcgaaacaggaagatttggtcaaggctttcaaagccttattgaaagaagaaaaattcagctctcaaggtgaaatagtcgcagcacttcaggaagaaggctttgaaaacattaaccaatctaaagtttccagaatgctgactaaatttggcgcagtccgaacccgtaatgcaaaaatggagatggtctactgcttacccgcagaattaggtgttcccacagccacaagcccattgaaaaatctggtcttagatgtcgattataatcattgtgttgtggttattcgcaccagtccgggcgctgcacagttgattgcacgcttactggattccctgggtaaagcagaaggaatacttggcagtattgcaggggatgacactatttttacgacaccagcacaggactttacaacaaagcagctctatgaggctattctcgatctttttgatcaagaactttaa

SEQ ID NO: 4685 - DNA, 1371 bp, Xenorhabdus bovienii
  Coding sequence Name=Xb4151_4152.C443.gene201.dna; Position on contig= 167491..168861bp; Strand=-
atgcgtattcatattcttggcatctgcggtactttcatgggagggctagcgatcctcgctcgttcattaggtcatgaagttactggttctgatgccaatgtgtatcccccaatgagtacccttctggaaaaacagggcattgagctgattcaaggatatgatccttcacagctcgatcctgagccagatatggtaatcattggcaatgccatgacacgtggtaatccctgtgtggaagcggtgctggatcgtggcattccttatacatctggcccacagtggctacatgatcatgttttgccagaacgctgggtgttagccgtcgctggaacgcatggtaaaacgacaaccgcaggaatgttagcatggatcttagaagcctgcggttataagccggggttcctgatcggcggtgtgccgggtaattttgacgtttcagcacaaatcggtgaaagtccatttttcgtgattgaagcggatgagtatgactgcgcgttttttgataagcgttcaaaatttgtgcattacggcccccgcacgctaatcatgaataaccttgaatttgatcatgctgatatttttgaaaatttagcggccgtccaaaagcagttccaccatctcgtcagggttgtgccgggaagtggtaagattctggtacccgataatgacattaacctgaaacatgtgataggaatgggatgctggagtgagctggaacatgtcggggaaacaggtaactggcaaacgaagaaagtcagtcaggatagcagcatctaccaagtgttccatcaaagtgaacaggttggtgaagtgaactggtcattggtgggtgaacacaacatgcacaatggtttgatcgcaattgcggctgcccatcatgttggtgttcagcctgcggatgcttgtcaggtactgggcgattttatcaatgcgcgccgccgtcttgaattgcgtggtgaagtgaatggtatctcagtttatgacgattttgctcatcatcccactgcaattttggtgacactggcagcgctgagaagtaaagttggcggtgtcgctcgtattcttgctgtgctagaaccgcgttcaaataccatgaaaatgggcatgagcaaaaatgatattgcgccttctctggggcgtgctgatgaagtcttcttgtatcaacctgccaatattccgtggcaggtagcagaaattgcagaacactgcatccaacctgctcgttggagtgcagatattgatgctttggtacgtatgattgttgaggcggcacaaccgggtgattacattcttatcatgagtaatggtggattcgatggcattcacgagaagttgctgactgagctgggtaagaaagtgcacgaggcttga

SEQ ID NO: 4686 - DNA, 1188 bp, Xenorhabdus bovienii
  Coding sequence Name=Xb4151_4152.C443.gene202.dna; Position on contig= 168850..170037bp; Strand=+
atgaatacgcatttatttctatccaatatcatgaagtgtgtcactattctaaccatcaatgctgagattagaaatgcaatagcctatcaatcatcccattctttagctaaactgccgcgcatgagtgcgacacgcaagtgcagcacgctctctaaaaccacaacaaaattcagggctttcgtcatgaaaacattaggcgaattcatcgtcgagaaacagcaagactttcctcatgctacgggtgaactgaccgcactgctttctgccatcaaactgggtgccaaaatcattcatcgggacatcaataaagctggtctggtggatattttaggtaccagcggcgtatcgaatgttcagggcgaagttcagatgaagctggatttgtatgccaatgaaaaactgaaggctgcattgaaagcgcgcggtgaagtagcaggtattgcttctgaagaagaagatgagatcgttgtctttgatggcgaccgtgcagaaaatgcgaagtatgttgttttgatggacccactggatggttcttcgaatattgatgtaaacgtttccgtcgggactattttctcaatttaccatagaattacacctattgggcagccagttaccgaagacgatttcctgcaaccgggaaatcgtcaggttgcggcgggttatgtggtctatggctcatccactatgttggtttacaccacaggttacggagttcatacattcacttacgatccctcactcggcgtattctgcctgactcatgaaaaagttcaattccctgccaaaggcaatatgtactccatcaacgaaggaaactacatcaaattcccgatgggcgtgaaaaagtacatcaaatattgccaagagcaagacgaagccacccagcgcccttacaccacccgttatattggctcgctggttgcagatttccaccgcaacctgctgaaaggcggcatctatatttatccaagcaccgcaagtaatccaacaggaaaattgcgtctgctgtatgaatgcaacccgattgcttttttggctgagcaggctggcggcaaggccagtgatggcaaaaaccgaattctagatatcacaccaacccaactgcatcagcgtgttcctttcttcgtgggaacaaaatcaatggtggaaaaagccgaaagctttatggctgaatttccaggtgagtaa

SEQ ID NO: 4687 - DNA, 531 bp, Xenorhabdus bovienii
  Coding sequence Name=Xb4151_4152.C443.gene203.dna; Position on contig= 170452..170982bp; Strand=+
atgagcctgaacaatgtaccggccggtaaagaactgcctgaagatatctatgtcatcattgagatccctgcgaatgcagatccgatcaaatatgaagtagataaagaatctggcgcactgtttgtagaccgtttcatgtctactgcaatgttctatccttgcaactacggttacatcaacaatactctgtcccttgatggtgaccctgttgacgtgctggttcctaccccatacccattacagccaggttccgttattcgctgccgtcccgttggtgttctgaaaatgtccgacgaatccggtgaagatgcgaaattggtcgctgttcctcacaccaaactgagcaaagaatacgatcacatcaaagatgtgaacgatctgccagaactgctgcgtgcccaaatcacccatttctttgaacattataaagatctggaaaaaggcaaatgggtgaaagttgacggttgggacaatgtcgaagccgctaaagctgaaatcctgtcttctttcgaacgcgctgctaaaaaataa

SEQ ID NO: 4688 - DNA, 348 bp, Xenorhabdus bovienii
  Coding sequence Name=Xb4151_4152.C443.gene204.dna; Position on contig= 171052..171399bp; Strand=-
atgcgagtaattgtttatggcagcctgaggcgcaaacaaggtaaccaccactggatgacctatgcccaacttctaggagaacataggttagaaggttatgaaatttatgacctgggacattatccagcggtgatccgtggcgaagggacaattgaatgcgaagtatatcgcattacgccatccatcctgacagaactggatgctttgaaaaagaattatcaggaatacgaaagggaattgattaaaacaccttacggcagtgcatggatctatttatatagactgcctgttgatggactgcatcggataacatgtggtgactggatcaagcgccacgaagaagaataa

SEQ ID NO: 4689 - DNA, 3768 bp, Xenorhabdus bovienii
  Coding sequence Name=Xb4151_4152.C443.gene205.dna; Position on contig= 171402..175169bp; Strand=-
atgaggtgggtcaaaaggctcagtatgacttttctgctgcttgttggcctgctgctgataaccattgtgggattggttggcacacaaaccggactgcattttatgattaacagcgcagcacgttgggttcccggactggatatcgccaatgtcagcggaggatggcgtgatttaaccttaaaaggtgttaaatatcagatgccgggagtgagtgttagtgctgacaatttatacctttcgctacgtttatcctgcttgaaacacagtcacctgtgtgtcaatgcgttaactacggaaggcgtggcagtctcggtgaatacggctgatcttcctccatcagaaaagtcgcctgcatcagagccattgactgaattgaaaacaccgtatcctatttcactggatttgctttctttgaagaatatccacgtcaaggttgacgatatagtgattgcgttggatgaatttaaaacaggggcgcagtggcgggaaaaacagctgacattgaaaccaacgaaaatcagcaatctattggttgctctgcctaaaacgcggcctgaacaaagcggtacagtgcaaaagggcaaacaaaagcctgaacctgaaaaatcattgggtgaaaccttgaaagcgctatttgccaaacctttcttagctgaattgcccaatgttcctattcctctcgatattatggcagaaaacattcatggcagtcagcttcgcctgacaggtgatacagatatcacgattaatgatctacggttgcaagccagtaatcagggacagcaggttgatgtgaaaaccttcagtgtaagtgcaccggaaggctcactttcgctacaggggacggcggggctatctgaacagtggccagtcaaactggtgattaagagcaatacgaatctgaatgaactaaaaggacaaaagcttgatttaaccctgaatggtgctctgttgcagcagcttaatctggcattgcatctttcaggacctattattgccaatctgagtgctcagactgagttggcgaaggcgggtttgcctgtacgcctgacattggaaagcaaacaacttcagtggccattgacgggtgaaccggaatatcgacttgatggtgttaagcttcgactgaatggcaaagccagtggctacgatctctccctccgttcagatattaaaggtcgtgatattcctcctgcattactaatgttggatgcgaagggtaatgaagaattgctcaggctaacccgtctgcgtctgtctgcattgcaggggaaagcggagatcactggcatcgttgactggagcaaagcgattagctggaatgcgaacctgattctggatggcatcaataccgctaaacaatggccagagtggccagccaaaatgaatggcaaaatggcaatacgcggtagcttgtatggcggcagttggcaactccagatccctgaaattgctcttgatggttatgtgaaacagaatatcgtcaaagcacatggcaaggcgtctggcaatgcggcgggacaatggaatattcctcagtttgacctcacttttggccgtaataggctgaatgttcaagggcagcttacagatgaaaagtggaagttggatggtgaaattaatgcgccacagttaaatggattactgccaggattgtccggtgtggttatcggtaatgtgaaactgcgcggtaacatgaaagcaccacaaatagtggcagatttaaatgcacgtaatgtgcggtggcagaatgatctgaaagtggatagcgccacgattaagggagatgtgcgctcggctgaacagattgaaggacagctctcagttgctgttcatcaattgaaacaggcggatttaatcatcaataatttgatgctaaatgctaagggcacggaaaagcagcatgatttacatttgaacattgagggcaaccccgtatcaggtcaattggcactcagtggtcgctttgaccgcagtcaggaacgctggcaaggaactatcaacaatacctactttgatactcctgtcggtgagtggcgcctaaataaggcgatggtcattgattacctgaatccacagcagaaagtaacaataggaacacattgctggcttaacccgaatgcacagatctgtgttcccaaaccgattgaggcgggagccagtggccatgctgaagtggtgcttaaacgttttgatttggccatgattcagccattccttgataaaatgactcaagttaaaggcgtgttcagcgggaatgccaatgtcaaatggacggcgggacaggctttgccacaggctaaagtcgtcttgcaaggaaatggggttcagcttcaccaaatggttgagggagctgcattacctgttgattttgaaacgttaacagtgaatgcaggactaacaaatggtaaggcaaatgtggcatggctatttaagctggcaggcaatgggcaattaaatggcaatgttcaggtggatgatctggaaggccgccgcaagctatctgggaatgtggatattcgagctctttctttaaagctgattaaaccgatcttgggtaaagacgaaaaagcggaaggaggcttgaatgccaacctgcgtttcggtggtaatgtaaaaaatccgctgttgtttggtcagcttaagacggatgaccttcaaatcgtaagtcactggttaccttttgatatcactcaaggccagctagctatctattttgatggtgtccgctctggcttggagggtgttatcaaaacgcctaaagggcagctgaaccttaacggcaatgctgactggcgtaatttgaacgcatggtatgccaaaattgccgcgaatggtgaaaaattgcgtgtgacagtgccgccaatggtgaaaattgatgttagccctaatttggtacttgaagctacgcctgatttactgaaacttgatgggaatgtggatattccgtgggcacgcattacggtgcaggaattaccagagtctgctgtgggtatttcttctgacgaagtcatgctagataaaaatctccagccgatagaaaagaaaaaatcgtccattctggttaaaagtaacttaaatattcgcattggtgatgatgtccgtttgaatgcatttggtctgaaagctcaacttaagggggtcttgaaagtcattcaggataaacaggggctggggttgaatggtcaaattgatattccagatggtcgtttccatgcctacgggcaggatttgctggtacgcaagggcacaattatattttccggcccgccggaacagccaatgctgaacattgaagcgatccgtaaccccgactcgacggcgaataaggttgtcgctggtgtgaaagttacgggattggcggataaacccaaagttgaaattttctctgagccagcaaaatcacagcaggaagcactgtcttatcttctgcgtggtgaaggtttggagaagagtggttctgacaataaccaaatgacttccatgctaattggtttgggcgtttcccaaagtggtcaattggttggcaagattggtgaaacttttggtgtttctgatttagctttagatactcagggtgtgggtgacaaatctcaggttgtcgtcagcggcaagataaccaacaacttgcaggtgaaatacggtgttggtatttttgattctctggcgaccttgacattacgctatcgtgtaatgccaagattgtatctcgatgcggtatctggtattgatcaggctttagatctgctctatgagtttgagttttaa

SEQ ID NO: 4690 - DNA, 1743 bp, Xenorhabdus bovienii
  Coding sequence Name=Xb4151_4152.C443.gene206.dna; Position on contig= 175166..176908bp; Strand=-
gtgtcacgataccccttcatatttgtgctttgcgtgtctgtcgcaactccatcggcctatagtgcaaatttacgattgaaagtggaaggtctttctggcgaactggaaaaaaatgccagagtacagctctcaaacataagtaccgaggaagtcgctcccgatgcgcgctttcaggcccgtgtcgagaaagccatacagcaagggttaaggccattgggatactacgatcccactgttgaattcacttatcaggagaaaacaccaccttcccgccctgttttgacagcgaacgtgacaccgggtgaaccggtacgggtagtcgaagtcaatgttgatttggaaggtagcgcaaaaactgataaagattatgcagcactcatcaaaaaaaatatgccaaaggaaggggcgatcctgaatcatggtgaatacgaacatttcaagggtgcattgaatagtctggcagttagaaagggttattttgatgctgtgatgaaaaaaagtgaattagaagtatcacaggagcagcataaatcctattggaacttcgatttcgacagcggagatcgttaccgctttggctccgtgagataccacggctcgcaaattcgtgaaaattacctgaacaatcttttgccgtttaaacaaggtgagtattacacttcggatcaacttgcggaattcaacagtcgtctggcgaataccggatggttcaattctgtggtggtcgtgcctgattttaaggtaggccacacgagccaggataagttattgccactggatgctttcttggttcccagctctgccaattatgttgaactagggggaggttatgcaacggatgttggcccccgcgttaaagcaaaatggaaaaagccatggcttaactctcgtgggcatagcctgagtaccaatattaacctgtcggcacctgaacaagttattgatgcatcctacaaaatgccactcaaatctaatccgcttgaacaatattatgagttgcagacaggttataaacgtaaagatattaacgataccatttctgatacggcaacattgaacctttcccgcaattgggatctcttcaccggatggcaatatggtgtcaacttacgctggagtcttagtcactttacgcaggctaacgtgacaaatacgacgatgctactctatccgggagcgactgtcagccgaattcgccagcgtggtggcactatgccttattggggagatagtcagcgttattcaatagatttttccgacaaaacctgggattcgaatgtggatttcttggtgttacaggcccatcacgtctggatcaggacttataaggataagcaccgctttgtggtacggggtgatctaggctggattgaaaccaatgaattcaacaaagttccaccgggtttacgtttcttcgccgggggggatcgcagcatccgtggttataaataccaaaaaatttcaccgaaaaatagtgagggaaaactgactggggcatcgaaactagccgttggctcactggaatatcaatacaatatctatggaaactggtggagtgcgttgtttgtggatactggcgaagcggtggatgatattaaaaagagtgattttaaaaccggcgcagggattggtgtgcgttgggcctcacccgttgggccaattaaatttgatcttgcgacgccagtaggagacgcaagcaatcatggtattgagttttacatcggtttaggggctgaactatga

SEQ ID NO: 4691 - DNA, 648 bp, Xenorhabdus bovienii
  Coding sequence Name=Xb4151_4152.C443.gene207.dna; Position on contig= 177045..177692bp; Strand=+
ttgccaaattcagccaacgaaagccaacatgtttccacacaggatgcattactgggtagggcaatcccattaactgtatcaccctaccatgtcatcacacagcattcgataaacgacattcctgaaaacatggagatagcctatataggaatggggtgtttctggggagttgagcgcctgttctggcaacaggaaggtatctacacgacctctgtgggttacagtggtggtactacgccaaatccaacttatgaagaagtctgcacagggttaaccggacatgccgaagtagtcaggatcgtatttgatccaaccaaaatcacttatgggcagttattgacgcttttctgggaaaatcacgatcccgcccaaggtatgcgtcaacatggtgatatcggtacacagtaccgctctgccatttatactatttcatctcaacaatatgagcaggcactcgctacccgcgaacaattccagcaagcgatgaatgaaaatggcgaccagcgcacaatcaccacggagatccacgcagcgaagccattctattttgcggaagattatcaccagcagtatctcttcaaaaatcctgaagggtattgtggactcggtggtattggggtatgcctcctccctacgcacaaaaactag

SEQ ID NO: 4692 - DNA, 1332 bp, Xenorhabdus bovienii
  Coding sequence Name=Xb4151_4152.C443.gene208.dna; Position on contig= 177848..179179bp; Strand=+
atgttaaatagtttattaataatacttttgctatgtgcaatcagcgcatttttttcgctatctgaaatttctctggccgcctcaagaaggatcaaattaaaactcatggccgatgaagggaacctcaatgctgcccatgtgcttaagttacaagaaacgccaggcatgttctttactattgttcaaattggtctgaatgcagttgcgatcctcgcgggcgtcgtgggagaatctgcattttcacccgccctgaaaacactattctcgaacttcatgcgtcaggaatgggccgatcaacttggctttatctgttctttcattatcgtcaccagtttctttattctgcttgctgatttgattcctaaacgtattggcatgattaagcccgaagccgttgcagtgagaattgtcaatccaatgcgtttctgtctggcaacttttcgcccgctggtatggctgttcaatggccttgctgactgtttcttcaaaatatttaaaattcctatggcacgtaatgaagatatcacttccgatgatatttatgccgttgttgcagccggagcgttagcgggtgtattacgtaaacaggagcatgagctgattgaaaatgttttcgaactggaatcccgtaccgtgccttctgccatgacttcccgtgaaagcgttatttattttgacaagaatgaagacgaaaacagtatcaaggaaaaaatatccacccatccgcattcaaaatttctcgtttgtgatggcggtattgaccatgttactggctatgtggattccaaagacttactcaaccgtgttctgaacgggcagagcctcagcttgaaagatggtgttcaaacccgcaatgccttgatgattcctgatacgctctcactctctgatacgctagaaagtttcaaagcggctggtgaagattttgcgatcatcctcaacgagtatgcattggtgatgggagtcattactttgaatgacgtaatgaccaccttaatgggcgatttagttgatcaggggcaggaagagcagattgttgtccgcgatgaaaattcatggcttgttgaaggtggcacaccaatagaagatgtgttgcgagtactggatatcgatgatttcccagactccaacaattatgaaaccatcgcaggatttatgatgtttcgcctgcggaaaattccaaagcgtacggattttgtgaaattcagcggctacaaatttgaagtggtggatattgataattacaaaatcgaccaattgctggtgacgaaaattgtggacacgcctgcccaatccaacccatctcccagcagtcaagcacaggtccagtaa

SEQ ID NO: 4693 - DNA, 207 bp, Xenorhabdus bovienii
  Coding sequence Name=Xb4151_4152.C443.gene209.dna; Position on contig= 179279..179485bp; Strand=-
atgaaaatctttcaccattataacccactgaaagttgctctttacgtaaaaactctatttcgtgggcgtttgtatattaaggacatgggcgcttttgaatttaactacgggaagatcttgccacccaagataaaagataaacgtcacttgaatgtaatgagtgaaattaatcagcaggtgttgcgcctacaggccgaaatggggtag

SEQ ID NO: 4694 - DNA, 558 bp, Xenorhabdus bovienii
  Coding sequence Name=Xb4151_4152.C443.gene210.dna; Position on contig= 179807..180364bp; Strand=+
atgataaaaaacattatgttatatgcaatactgagcttaacttcagtattcgcatctgcccataacatcgcagtaggacagccagtccctacggtcagcgtgacagataaaggtgagttactgctcaacaatgacaagttcagctaccaaaattggaacagtacagaacttcctggaaaagtaagaaccatccagcatattgctggccgcagttctgcaaaagagatgaatgatcctctgattcaagcgttgaaacaagccgaccttccaaaggaaaaatatcaaacaaccagcatcgtgaatactgatgatgctatttttggtaccagcgtcttcgttcgtaatagtctcgaagacagtaaaaaagagtttccgtggtcacagtttattgtcgatagtgaaggtttagctaagaaagcctggggtctggaacccaaaagttcggcaatcatcgtgttggataaaaacggtaacgtgaaatttgttaaagatggtaaattgagcaacgaagacatcacccatgttctcaatctgatcaaagaagaattgaacaactaa

SEQ ID NO: 4695 - DNA, 756 bp, Xenorhabdus bovienii
  Coding sequence Name=Xb4151_4152.C443.gene211.dna; Position on contig= 180459..181214bp; Strand=-
atgcagaggtgtatgatgctacaacagatctgccaattggcgcgggaagctggagctgccatcatggtggtttatcaggatgagcagccgttgaaagtagagcataaaatggatgattcacctgttactgctgcggatattgccgcccacaagattattaaagcggggttgatgcgtattgcaccggatatcccgttgctgtcagaagaagatccccctgtatgggaggagcgcaaaaactggcagcgctactggctggtcgatccgctggatggtacgaaagagtttatccagcgaaacggtgaatttaccgttaatattgcattgattgaggatggtgttccggtgatgggcgtcgtttatgttcctgtgctgaatgttttgtacgcagggcagggacatcaggcttggaaggaaaccaatgggcagacaattcctattaaggttgctgctgcagtgctgccgactgtggtgatcagccgttctcacatagacgaggaattgaaggattatcttactcaattaggaacccatcagacagtttcggtcggatcttcacttaaattttgtatggttgcagaaggaaaagctcaactttacccgcgctttgggccaactaatatttgggataccgccgcaggtcacgctgttgcgattgccgcaggtgcacatgtcacggattgggaaggtaagaagctcaattacgcgccgcgtgaatcttttctgaatccggggttcagagtcactattttttag

SEQ ID NO: 4696 - DNA, 162 bp, Xenorhabdus bovienii
  Coding sequence Name=Xb4151_4152.C443.gene212.dna; Position on contig= 181153..181314bp; Strand=+
atggcagctccagcttcccgcgccaattggcagatctgttgtagcatcatacacctctgcattcattattcagctataactttagattacatttttagcgtattttgtactggaatagcgaatactttatctcaaaaaacgcgcaaaaaaatagccggataa

SEQ ID NO: 4697 - DNA, 621 bp, Xenorhabdus bovienii
  Coding sequence Name=Xb4151_4152.C443.gene213.dna; Position on contig= 181343..181963bp; Strand=-
atgacaacaccttcttttgagtctattgaagcgcgggcgagttacggcattggtttacaggttgggcaacaattgcaggaatcgggtttacagggattggaaccagaagcattactggcaggtctgtgtgatgctctggaaaatcgttctccggctattcctgtagaagaactgcatcgtgcgttgcgcgaaattcatgaacgtgctgatagtgttcgtcatgaacatcagcagacgatggcagaagaaggcaaaaagtttctggcagaaaatgcagaacgtgaaggcgtcagcagcacagagtctggtttgcagttctctgttctgacacaaggtgatggtgcgatacctgctcgtagtgaccgtgttcgtgtgcattatactggtcgcctgatggatggctctgtgtttgatagctccgtgcagcgtgggacaccagcagaattcccagtgagtggtgttattcctggttggattgaagcgctgaccctgatgcctgttggttccaagtgggaactctatatccctcataatctggcttatggtgagcgtggcgcaggcgcgtcaattcctccttacagcacactgatctttgaagtagaattactggaaatcctgtaa

SEQ ID NO: 4698 - DNA, 513 bp, Xenorhabdus bovienii
  Coding sequence Name=Xb4151_4152.C443.gene214.dna; Position on contig= 181982..182494bp; Strand=+
atgaatgaagactcaagcataacagccctgccagaatgggtaaacgcgcgaaggattttaatcgagataggtaatgaaaaaatacaaacaaaaaacgctggcattgccagcgttttttgtcacatgttcgctttagctaatcaaagattaagcttcaggaacgatgttaacgttcaactgtgcgaatacatcgctgtgtacctggaagtgaacttcgtgctcaccagtggtacgcagaacgccgttagacaggcgaacttcgctcttagataccgcaacgccagcagcagaaactgcgtcagcgatgtcacgagtaccaatagaaccgaacagtttaccttcgtcacccgctttagaagcgatggtgacagagcccagtgcgttaatttgtgctgcacgagcttctgctgctgtcagaacgtcagccaatttggcttccagttcaacacggcgagcttcgaagaattcgatgtttttcttagtcgcaggaacagctttgccctgtggaactaa

SEQ ID NO: 4699 - DNA, 228 bp, Xenorhabdus bovienii
  Coding sequence Name=Xb4151_4152.C443.gene215.dna; Position on contig= 182620..182847bp; Strand=-
atggcacgttatttccgtcgtcgcaaattctgccgttttacagcggaaggcgttcaagagattgattataaagacatcgttacgctgaaaaactacattaccgaaagcggtaaaattgtaccaagccgcattaccggcactcgtgcaaaataccagcgtcagctcgctcgtgctatcaagcgtgcgcgctacctgtctttgttgccttacactgatcgtcatcagtaa

SEQ ID NO: 4700 - DNA, 318 bp, Xenorhabdus bovienii
  Coding sequence Name=Xb4151_4152.C443.gene216.dna; Position on contig= 182852..183169bp; Strand=-
gtggcagctaatcgtttggtgctttctggcacagtgtgcaaagtgccgatacgaaaagtcagcccatccggtattcctcattgccagtttgtgctcgaacatcgttcacaacagcaggaagccggatgtagcaggcaatcatggtgcaaagtgcccgttattgccagcggacagttattacaagagttcactcacagtataacggtcggtagccgaataaccgtttcaggattcattaatagccatcaagggcgtaatggtcttagtaaactggttcttcatgccgagcagattgaattgatagattctggagactag

SEQ ID NO: 4701 - DNA, 399 bp, Xenorhabdus bovienii
  Coding sequence Name=Xb4151_4152.C443.gene217.dna; Position on contig= 183175..183573bp; Strand=-
atgcgtcattacgaaatcgtttttatggtccatcctgaccaaagcgaacaggttccgggcatgatcgagcgttacagtgcgactatcactaacgcgcaaggtcagattcaccgtctggaagactggggccgccgtcaactggcttacccaatcaacaaactgcacaaggctcactacgttctgctgaacgttgaagcgccacaggaagcgattgatgagctggaaactaacttccgcttcaacgatgccgttatccgcagcatggttatgcgcgttaagcacgcagtaactgaaccatcaccaatggttaaagctaaagacgaacgtcgtagccgtgacctggtcttagaagaagacatggctgatgatgctgatgaagctggggactctgaagagtaa

SEQ ID NO: 4702 - DNA, 738 bp, Xenorhabdus bovienii
  Coding sequence Name=Xb4151_4152.C443.gene218.dna; Position on contig= 183779..184516bp; Strand=-
atgagtgaaattatctacggtattcatgccgttaaagccttactggatcgcgaacctcagcgattcatggaagtttatgtattgaagggacgtgaagatcgtcgcttaaccccattgttacgggaattggaagatattggtattacagttcaactggccaatcgtcaatggctggatactcagacagaaagtgcggtacaccaagggatcattgccaaagttaaacctgggcgtcagtatcaggaaagcgatttaccggattttctatcacagttagatcgcccttttttactggtactggatggcgttactgatccacataatcttggggcttgtctgcgtactgcggatgccgctggcgttgatgcagtcattattcctcgtgaccgctccgcacaactgaatgcaaccaccaaaaaagtcgcctgtggtgcagcagaaaacgtaccgctcattcgggtgaccaaccttgcccgtactctgcgtttgctgcaagaaagcaatatctggattgtgggaaccgcaggtgaagctacccattctctgtatcagagcaagcttactggcccggtggccttggtgatgggtgctgaaggagaaggaatgcgccgcctgactcgcgaacattgtgatgaattgatcagtatcccaatggcaggttctgtttcttctctgaacgtatcggttgcgaccggggtttgcttgtttgaaatcatgcgtcagagaagcgcccagtaa

SEQ ID NO: 4703 - DNA, 2481 bp, Xenorhabdus bovienii
  Coding sequence Name=Xb4151_4152.C443.gene219.dna; Position on contig= 184603..187083bp; Strand=-
atgaagcacggggagcaacagcttgctgatgacaacagaggaattacgatgtcaaaagatccttttcaggaacgagaagctgaaaaatacgaatctcctatcccaagccgtgaatacatcttggatatactttctaaacacaccactccggtaagccgtcaggaattagcaaaagaacttcagttaaccagtgcagatgcacaggaagcgtttcgacgtcgcctgcgggcaatggagcgtgatggacagttgattttcactcgtcgtcaatgttatgcattgccggaaagactggatttgttgaaaggtacggtgattggacatcgtgatggttacggtttcctgcgtgcggaaggccacaaagaagatttctatctgccagcagaacaaatgaaaatggcaattcatggcgatgtcatattggcacagcctttgcaaccagaccgtaaaggtcgcgttgaagtgcgtatcgttcgggtattggagccaaaaaacagtcagattgtcgggcgatattttgtcgatgcgggtatgggattcgttgtccctgatgacagtcggctaagtttcgatattttgatcccaaaagaagaaatttgcggtgcaagaatgggcaatgtcgtcgtcgttgaattgacgagtcgtccgacccgccgaactaaagctatcggtaagatcgttgaagtgctcggtgaaacgatgggaacgaacatggcggttgaaattgctcttcgtacccatgaaattccacatagctggccaccaatggtagaaaaacaggtggttgatcttgatgaaaatgtaccggactcggcgaaaaaaggccgtgttgacctgcgtggactgccactggttacgattgatggtgaagacgcccgtgactttgatgatgcggtttattgtgaaagaaaacgtggcggcggctggcgtttatgggtagcgattgcggatgtcagctattatgttcgtccgcaaacacctcttgatacagaggcgcgtagccgtggtaactcagtctatttcccatctcaagtcgtaccgatgctgccggaaattttgtcgaatgggctgtgttctctgaacccagaagttgatcgcttgtgtatggtgtgtgaaatgaccatttctgcccaaggcaagctgtcttcttataagttctatgaagctgtgatgaactctcatgcccgtttgacttacaccaaggtatggaaaatattgcagggtgatcaagagctgcgtgagcattaccagccgttggtgacacatatcgagtatctgcatgaactttatcaggcactggagcaagcacgggagcagcgtggagccatttcgtttgaatctgaagaagcgaaatttatttttaatgcagaacgtcgcattgagcgtattgaacccgttacgcgcaatgatgcccataaactgatcgaagagtgcatgattctggccaatattgcggcggcacgttttgttgagaaaaataatgagccagcgttataccgcgtccatgatcagcctagagaggaaagtatcttaaatctgcgttcagtcttcaacgaactgggtttgagcttattgggtggaatgaaacctgaaccgaaagacttcgctcaattgatgaaagatgtggctgaacggccggatcatgaattactacaaaccatgttgctgcgctctatgaaacaggcgatttatgatccggaaaaccgtggtcactttggtctggctctgagttcttatgcgcactttacgtcgccaatccgccgttatcctgatctggcattgcatcgagcgatcaaatacttattggcacaagagaatggtgtcgttgaacagcattggacaccaactggcggctggcataacgatatggaccacatgctgcaattgggtaaccattgctccatgactgagcgccgtgcggatgaagcaacaagagacgtggcagactggctgaaatgtgattttatgcaggatcaagtgggcaatgttttcactggcttgattactagcgtaacgggtttcggtttctttgtcaggttgaatgagctgtttattgacggcttggtacatgtttcaacactggataatgattactacagatatgataatgttggccagcgtctgattggtgagtcttctggtcagacttatcggcttggtgatgaagtagagatccgtgtcgaagcggttcacatggatgaacgcaatattgatttcaccttgctttcttcgacccgaaaggcgcgtaatcaaggtaagaccgcgcgcgataaatcgaaaagaggcacaccagaacgtaacagtggcaaaaaagggtatgatcataaaaaatcagccaattttgagccagacaacgcctccagtaaaaagaaaaaagcggaaaagcctaaagcaagcaagaagaaaacgtcagacaaaaccaaaaagattactgcaaaattgaaagcgaaacgcgtgaaaaaaacgcaggaaaaaagctga

SEQ ID NO: 4704 - DNA, 372 bp, Xenorhabdus bovienii
  Coding sequence Name=Xb4151_4152.C443.gene220.dna; Position on contig= 187091..187462bp; Strand=-
atggcttctctgcctgaaggccagatgactagcattactgaagtaactgaagtttatggtgtttcacgtaatcatatggtgaagataattaaccagctcagtaatttaggcctagttaatgctatcaggggaaaaaatggcggcattagtctgggtaagcctgccagcgagatcaaaattggcgatgtagtccgttcactggaaccgctttcattggttaactgtagtgcttgctatatcacgcccgcatgtcgcttaaaattagtgttgaatcaagcggtagaaaattttttgcaagagttggataaacatactttggctgatatggtcaaagataatcgtcccctttatcagttgcttctggctaagtga

SEQ ID NO: 4705 - DNA, 96 bp, Xenorhabdus bovienii
  Coding sequence Name=Xb4151_4152.C443.gene221.dna; Position on contig= 187613..187708bp; Strand=-
atgtataaccgggccttatgcccggttttttactttttggggataggcttttgggtgagaggttataaaacgcagctcgttttgcttaatttttaa

SEQ ID NO: 4706 - DNA, 1299 bp, Xenorhabdus bovienii
  Coding sequence Name=Xb4151_4152.C443.gene222.dna; Position on contig= 187731..189029bp; Strand=-
atgggtaagaacgttgtcgtattgggcacccaatggggtgacgagggcaagggtaaaatcgtcgacttgctgactgaacgagctaagtacgtggttcgttatcaggggggccacaatgcgggccatacactagtcatcaacggtgaaaaaaccgttctccacttaatcccatccgggatcttgcgtgaaaatgtcattagcattatcgcaaatggggtcgttttagcaccagatgctttgatgaaagaaatgaatgcgcttgaatcacgtgggattcctgtacgtgaacgcctgcttatttctgaagcctgtccgttgatcctgccttatcatgttgcactggacaatgcccgcgagaaagcgcgtggtgccaaggcaattggtacaactggccgtggtatcgggcctgcatacgaagataaagtagcacgccgtggcctgcgtgtaggcgatttgtttgataaagaaactttcgcggtcaaactgcaagaaatcatcgagtatcacaacttccaactggttaactactacaacgagcctgctgttgattatcagaaaacactggatgatattctggctgttgcggatatcctgacaaacatggtagttgacgtttctgatctgctctataaagcaactcagaaaggtgaactggtgatgttcgaaggtgcacagggtacgttgttggatatcgaccacggtacctatccttatgtgacttcttctaataccacagcaggtggcgtcgcaacaggttctggtctggggccacgctacgttgactatgttctgggtattatcaaagcctactctacccgtgttggtgcaggtccattcccaactgaactgtttgatgaaaccggcgagtacctgcgtcagaaagggcaggaatttggtgcgacaactggtcgtagccgtcgtaccggctggctggatatcgttgccattcgtcgtgcgatccaaatcaactccttgtctggtttctgcatgaccaagctggatgtgcttgatggtctgaaagaagtgaaagtctgtattggttatcgtatgcctgatggcagcgtgattgacactacaccattggcagcagaaaactgggaaggtcttgaagcagtgtatgaaactctgccaggttgggatgaaagcacttttggcgtgaaagatcacagcctgctgccagaagcagcactgagctacatcaagcgtgttgaagaactgaccggcgttcctgttgatattatttctactggtccagatcgtgctgaaaccatgatcctgcgtgatccatttgatgcttga

SEQ ID NO: 4707 - DNA, 93 bp, Xenorhabdus bovienii
  Coding sequence Name=Xb4151_4152.C443.gene223.dna; Position on contig= 189126..189218bp; Strand=-
atgaataaccgctgcctaagccactgtaagaaaacttgcagtggcttttttgttactagcatcattacgaatgcttacttaacagcccgttaa

SEQ ID NO: 4708 - DNA, 1011 bp, Xenorhabdus bovienii
  Coding sequence Name=Xb4151_4152.C443.gene224.dna; Position on contig= 189277..190287bp; Strand=-
atgcgtaagtcattcgtctttgctattgccattatattggttgtgttgtatacgtcgatattcatcgtgtacgaaggtcagcgcggtattgtactgcgttttggtaaggttgcgcgtgatgcggaaaataaaccactggtttatcagcctggtctgcattttaaaattccatttattgagacagtcaaaacacttgatgcccgtatccagactatggatatcaaagctgaccgtttcctgacgcgtgaaaataaagacctgattgttgattcttacctgaaatggcggattaaagatttcagcagatattatctggcgacaggtaatggagaaattgctcaggctgaactgctgctaaagcgtaaattcagtgaccgtttgcgttctgaaatcggtcgtttggatgtgcgtggtattgtgacggattcccgtggccgtttaactaccgatgtgcgtaattccttgaacttgggaacaaatgatggtggcacggcagaaacagcggataatcctgttgcttcggctgcggctaatgtcgggcaggaaacgaaagacaaacaacccattctgaaccagaatagtatggccgagctgggcattgaggttgtggatgtgcgtatcaaacagattaacttgccacaggaaatttcagaagcaatttatcagcgtatgcgtgcagatcgtgaagctgaggcacgtctcctgcgctcacaaggtctggaagaagctgaaaagatccgtgcagtagcagataaaacagcaactgaaattaaagctaagtcgaatagagaggcacttatcctgcgtggggaaggtgatgcggaagcggccaagctgtttgccgatgcgttcaacaaagatcctgaattctatgcgttcattcgtagcctgcgtgcttatgagaagagcttcaagaatgatggcaataacattatggtactcagcccagatagcgatttcttccgttatatgaaagcgccatttaagcagcacagtaataccaatgactga

SEQ ID NO: 4709 - DNA, 1245 bp, Xenorhabdus bovienii
  Coding sequence Name=Xb4151_4152.C443.gene225.dna; Position on contig= 190290..191534bp; Strand=-
atggcgtggaatcagcccggtaataacggacaggaccgcgacccgtggggaagcagcaataataatggcggcaactccggcggcaacaataaaggtggtcgaaaccgtggggcaactaatctcgacgatctattccgtaagctgagtgaaaaactcggtggtttcggtggaaaaaaaggtggaaatggttctgagcagggtcctaaatttggtggacgtattattggtcttgccgttgctgctgccgttgctgtctgggttgtaagtgggttctatactatcaaagaaacagagcgtggcgttgttatccgattgggtaaatttagccatgttgtgcagcctggcttgaactggaaaatgacgtttatcgatcgagtccgagccgttaacgtcgaatctgttcgcgaactggcgacatcgggtgtcatgctgacatcggatgaaaacgtagtgcgtgctgaaatgaacgtacagtatcgtgtgaccgaccctgcggcttatcttttcaatgtcaccagcccggacaacagcctgagccaagcgactgacagcgcagtgcgtggtgttgtaggcaaatacaccatggaaaaaatcctgacggcagatcgtaccatcgtgcgtaacgatacccagaaagtactggaagaaaccattcgtccatacaacatggggatcacgctgcttgatgttaacttccaaactgcccgtccaccagaagaggtgcaagtggcattcgatgatgttatcgcagcgcgtgaggaagagcaaaaaaccattcgtgaagctgaatcctacaaaaatgctgtcttgcctatggctaagggtgatgctcaacgcatgattgaagatgccagagcctataaagtcagtgtggtattgaatgctcagggtgaagtggcaagttttgccaaaattctgcctgagtataaagctgcaccggaaattacccgtgagcgtctttacattgaaacgatggagtatgttctgagtaatacccgtaaggtcattgcaaacgaaaagagcaataacatgctggtactgccattggatcaggtttttcgtaaacaagctgaagtaccgaaaacgcagtcatcagatgccaaagtagcgccagagaagagcggctctacacattttgcacctgaacaaggacaaacaggttataacaactccagtaataatcattctagctatggcaatcccagtagcctgcgtggtgagacgccaagacaagggagaccataa

SEQ ID NO: 4710 - DNA, 132 bp, Xenorhabdus bovienii
  Coding sequence Name=Xb4151_4152.C443.gene226.dna; Position on contig= 191614..191745bp; Strand=-
atgactgtgacagaatcagtactgtcagaagcatcacccaaaaatattggttgcttacaaaacgacgaaatttgtcgtttctgcccacagaggccgctgtcagacctgtcagggacaggcaatggcctgtga

SEQ ID NO: 4711 - DNA, 1281 bp, Xenorhabdus bovienii
  Coding sequence Name=Xb4151_4152.C443.gene227.dna; Position on contig= 191842..193122bp; Strand=-
ttgtttgatcgttatgaaggcggagaattagccgttctggtgcatgtttttttctcacaggaaaaagatacggaaaatctcagtgaattcgaatcattggtgacttccgctggtgtttctcctgtgcagattgtgacgggaagcagaaaggcgcccaatccgaaatattttgtcggagaaggcaaggcagaggaaattgctgaggctgtcaagaacagcggtgctgatgtggtcttgttcaaccatgcactaagccctgcccaggaacgtaatcttgaacgtctttgccaatgtcgtgtcgttgatcgcacgggtgtgatcttggatatttttgcccaacgggcaagaacgcacgaaggtaagttgcaagtcgagttggcacaattacgtcatttatctacccgtctggtacggggctggactcaccttgaacgtcagaagggggggatcggtctgcgtggcccaggggaaactcagctagaaactgaccgccgcttgctgcgtgacaaaatcaagcagattctggggcgtctcggcaaagttgaaaaacagcgcgagcaggggcgtcaggcacgtaataaagctgatattcccactgtttctcttgtgggttataccaatgcgggaaaatctagtttattcaaccggataacttcggctgaggtgtatactgccgatcaactttttgctaccctcgatcccactttgcgccggatagacgtaaatgacgtcggtacagttgttttggcggataccgtgggttttattcgccacttacctcatgatttggttgcggcgtttaaagctactttgcaggaaactcggcaggcaagattgctgttgcatgttgtggatgcggcagacagccgtttggatgaaaacattgttgcagtggacagtgttctggaagaaattgaagccaatgagatcccttccttgttggtgatgaataaaattgacatgttggaagattttgttccacgcattgatcgcgatgaggaaaaccgcccgataagggtctggttatccgcacaaactggagcaggtatccctctgttatttcaggtgttgaccgaatgtctttcaggtgaaatcgcacactatgaattgcatctgccgcctgaggcagggcgtttgcgcagtcgtttttaccagcttcaggccattgagcgtgaatggatagaagacggtggtcaaattggtattgaagtcaggatgccgatggttgattggcgccgactatgtaaacaagaattgaatttacttgactatgttgtctga

SEQ ID NO: 4712 - DNA, 303 bp, Xenorhabdus bovienii
  Coding sequence Name=Xb4151_4152.C443.gene228.dna; Position on contig= 193220..193522bp; Strand=-
atggctaaggggcaatctttgcaagatccattcctgaacgcgttacggcgtgaaagggtcccggtttctatttatttggtcaacggcatcaaattacagggtcagattgaatcttttgaccaatttgtcattttactgaaaaacacggtcagtcagatggtttataaacatgccatttcaactgttgtgccttcccgtcctgtgtctcaccacggcaataatccgaacgtgacgactggcgttggaaattatcatgctggcgttaacccagcagcaccacaggaaagtgatggcgctgaataa

SEQ ID NO: 4713 - DNA, 942 bp, Xenorhabdus bovienii
  Coding sequence Name=Xb4151_4152.C443.gene229.dna; Position on contig= 193631..194572bp; Strand=-
atgagtgatttaaaaactcaacatctaccgacagccattttcatcatggggccgacagcttcaggaaaaacggcgttatcgatcgccttacatcagcatcttcctgttgaattaatcagtgttgattctgcgttgatttatcgtgaaatgaatattggtactgcaaaacctaccgcagcagagcaggcacaggcgcctcatcgtctggttgacattctcgatccggctgaaatttattccgctgctgattttcgccgtgatgctctgaaagaaatggcggatatcacggctgctgggagaattcccctcctagttggcggaaccatgctatatttcaaagcattgctggaaggattatcgcctttaccctcttctaatcttgagatccgggcgcagatcgagcaacaggcggccaaacatgggtgggaagccttgcatcggcaattgcaggaaattgactccgttgcagcagcaagaattcacccaaatgatccacaacgtctcactcgtgcactggaagtttttcgaatttcgggtaaaactctaactgcattgactgaaatgtctggagaaatattgccttatcgtgttcatcaatttgcgatcgcacctgcaagccgtgaaattttgcatcagcgcatcgccgcccgttttgaacaaatgatcaaatcagggtttgaagatgaagtaaaagcactttatgctcgtagtgatttgcatacagatttaccttccattcgttgtgttggttatcgtcaaatgtggtcttacctttcaggcgaaatctctcatgatgagatggtttatcgtggcatctgtgcgacacgccagctagcgaagcgccagatcacgtggctaagaggctgggacaatgtgacttggttggacagtgaccaacctgaacaggcattgaatacagtgatgcaggttattagtacataa

SEQ ID NO: 4714 - DNA, 1944 bp, Xenorhabdus bovienii
  Coding sequence Name=Xb4151_4152.C443.gene230.dna; Position on contig= 194565..196508bp; Strand=-
atggctatcaggattttacccccacaattagcaaatcagattgctgctggtgaagtggttgagcgccctgcatcggtggtgaaagaattggtggaaaacagccttgatgccggcgctacccgcattgatattgagattgaacgcggtggcgcgaaattaatccgcattcgtgataacggctgtgggatagaccagcaggatctgacattagcactggcacgtcatgccaccagtaaaatcgcttcgcttgatgatttggaggcgattgtcagtatgggattccgtggggaagcactggccagtatcagctcggtttcacgattgactctgacttcccgtactgaaagccagacagaagcgtggcaggcttacgccgaaggccgtgatatggaagtcaccgtaaaacccgcagctcatcccgtcggtacgacggttgaagtattggatctgttttataatacgccagcacgtcgcaaattcctgagaacagaaaaaaccgaattcgggcatcttgatgaagtggtgcgcaggatagctctggcacggttggatgtggcgatcaacctgcatcacaacggcaaattggttcgtcagtatcgtccagcgaaagaagaatctcagcatgagcgacgtttggcggccatttgcggaatggcgtttgtgcagcaggctcttgcgctgtcgtggcagcatgattccttgtctattaaaggatgggttgctgatcccatgagtgatactgtcgggggcgatattcagtattgttatgtcaatggacgtatgatgcgggatcggctgattaatcatgctatccgtcaggcctatcaagatttgcttcagggagagaagcagcctgcttatgtattgtatctggagattgatccgcatcaggttgatgtcaatgtgcatccagcgaagcatgaggtacgcttccatcaggcacgtctggtacatgattttatttatcagggtgtggcagcagtattgaaacaaagggggaaaggagctgaactggcgcttggttgtgaggagccggctgccagttgggtgccggaaaaccgtctttctgcgggagagaaccattttctccagcaaaatacggcttcactgaaggcatcaccgccttcccgcgccgcggctgccccctcggtttcatctggagggcatgacaaagaacagcctcagcttgatcgcccgcattctggcaatgatacgcggcaacttcatcatggggaaaattaccagaagaaacagggcgagttgtaccagaaaatgatgcaatctgcaccagaggagaaacggccgctgtttcctgaaagagctgtctccgtgagggaaaaagccgctccgattcctgttggtgccgcacttttgcagggaaaaaacattagttacagttttggcaaggtattgagcatccatgctgccagttatgccttgattgagtctccgttggggattgggctactgtctttgccagttgctgaacgctggctgaaacaggtgcagttgacgccaggggagctggggcttaaatcgcagccgctactgatcccgctgaaactgtctctcagtcaggcagaaatcgacgctttaaagcagaatagtgagctattgaagactttcggtattgaatctacagtcgcacatggaaaagtaactattcatgcggtatcgttgccactgcgtcaacagaacctgccgaaactcctgccggagctgttgaactatctagtggaacaaccctcggcctgtgctgaacaggtagcgatttggctctcccgtcacgttgggagcgaacatgaaacgtggaacattgcgcaagccgtccagcttttagctgacgtcgagcgtctttgccctcaattggtggaatccccgccagagggcttattacagttaattgatttacaagcagtggtggcacttctcaatcatgagtga

SEQ ID NO: 4715 - DNA, 1326 bp, Xenorhabdus bovienii
  Coding sequence Name=Xb4151_4152.C443.gene231.dna; Position on contig= 196534..197859bp; Strand=-
atgatgaatgctttctttgtgaaagtaataaagaaatggcaagcccattgggtgatgtcctgtgtattgtttgtcatgttgagtcaactgatcatgatgacggcgacagcggctacgttgtcgaatattcatgtgaataatagcccatctgaagctaccgtaacgttgggattcactggcgggcatcctgattatcggtttttccctctgcatgctcctgagcggttggtggtggatattcgtcagtctggtcatgtcatgggactgccgatgcgtttatcaggccagaatctggtgaaagtgattcgaaccagtcagtcccctgatgcacagcataagcggcttgtattggaattggcacatcaggctaccgcgacttcttcggtgaaagaatccgccagtgaatatcaggtgatgtttacgttgaaaactaatagtgcaacggctaaaagtacaacgaatagcacctcaatgctcaagggaaatacttcattacatgaaagtaagcagttattagctaataatgctcagtcaccgaagcaggagataaagcaaactccggctcatcatgaccaaggagtgaaaaagcaggcaactaaggcagcacagggaaaatatccgattgtgattgccattgacgcagggcatggtgggacagacccaggagccatcgggcaagggggattgaaggaaaagaacgtgaccatcagcgttgcacgcaagctggaagtacttttacacaatgatcccatgttcaagcctgttttgacgaggggtggcgattatttcatctcagttgccggacggtctgaggtcgcccgtaagcacaaagccaatatgctggtgtctatccatgcggatgcagcacctaaccgcagcgccagaggggcttctgtttgggtactatccaaccgtcgcgcaaacagtgaattggggaattggctggagcagcacgagaaacaatcggaattgttgggcggtgcgggagatgttctatccaatggtattaatccgctattgagtcaggctgtgttagatttgcagtttggtcattcccagagagtgggctatgacgttgctgttcaagtattgagccagttatctcacattggctctttgcataagcgtagaccagaacatgcaagcctgggtgtattacgttccccggatattccttccatcttggtggaaacgggttttattagtcatttatcggaagaagaactgctgggatctaacgattatcaggcgagactggcacaagccattcactttgggctgcgccactattttcaggctaacccgttgcagacttctccaatgtaa

SEQ ID NO: 4716 - DNA, 465 bp, Xenorhabdus bovienii
  Coding sequence Name=Xb4151_4152.C443.gene232.dna; Position on contig= 197874..198338bp; Strand=-
atgaaagaactcgttttattacttccaaatgaaaatgccacggttgcattgggcaatgcagtggcggcaaccggcgatcgcggctatgttatttatttatatggcgatctgggtgccggaaaaacgacattcagtcgtggcttcctacaggcgcttggccatcaggggcatgtgaagagtccgacttatacgctggttgaaccttatgctttgctaccgcggcctgtctatcattttgatctttaccgtctgtctgatcctgaagaactggaatttatgggcattcgtgattatttccatcaggatgctatttgtctggtggaatggcctcaacagggtgcagggtttttacctgatgccgatattgagctgcatttgagctatgacagcgaagggcggcgcgcgcgttttgtcgcgttatctgaatatggtgaaaatctgctggataatctgaagtccttatga

SEQ ID NO: 4717 - DNA, 1158 bp, Xenorhabdus bovienii
  Coding sequence Name=Xb4151_4152.C443.gene233.dna; Position on contig= 198544..199701bp; Strand=+
atggcaacccctcttgatctgaatcttctggcaacaaacatcaaacaatggagcctttcccttggctttcaacaagtcggtatctgtgacaccgatttatccgcagaagaacccaaactacaggaatggcttgataagcaataccacggtgaaatggattggatggctcgtcacggtatgatgcgcgcccgtccccatgaactactacctgacaccttgcgggtcatcagcgtacgcatgaattacctgccagccaaagcagcttttgccagtacactgaataatcctgaattaggttatgtcagccgctattcgctgggcagagactaccacaagctattgcgtcagcgactcaaaaaactcggtgaacagattcaagactattgcagtgctcatgaatatcagggaactctgaattttcggccttttgtcgattctgccccgatcatggagcgtcccttggcggccaaggctggtctcggctgggttggtaaacactcacttatattaaatcgagaatcgggttcatggtttttcctcggagaattgttgattaaccttccccttcccatagatgccccacaagaggagcaatgcgggcgttgcgttgcctgtatgacgacctgcccaacaggtgccattgttgagccttataccattgatgcccgacgctgtatttcttacctgaccattgaattggatggtgtgatccctgaagaattgcgcccgttaatgggcaaccggatttatggttgtgacgattgccagcttatttgcccatggaatcgtttttcacaattaacggatgaagtagatttcagccctcgtgctgccctgcacacgccaaaattacttgatttattcagttggagcgaagaaaagtttctacgtattacggaaggatcagcaatccgccgcattggttatttacgctggctgcgcaatatttccgttgctttaggtaatgctctttatcaggatgatatcgtgctggcactgaaaaaaagaatcggtttaagtgaagtactggatgaacatatccactgggccatcgatcaacaaataactcgccgcaatgccaatacgattgaagttcaaacatcacagcagaagcgattaattcgggcaattaccaaaggaatacccagagatgcttaa

SEQ ID NO: 4718 - DNA, 174 bp, Xenorhabdus bovienii
  Coding sequence Name=Xb4151_4152.C443.gene234.dna; Position on contig= 199881..200054bp; Strand=-
atgtgtgagtggattctggttttattgcttatttctgattcttttccactgaaatacaattactgttttttatccacagtatttaaccttactgccatattgacttgtctgacgatgctctatttgctgcacagagttatccacaggcgaaatttctgtatctgtattttttga

SEQ ID NO: 4719 - DNA, 168 bp, Xenorhabdus bovienii
  Coding sequence Name=Xb4151_4152.C443.gene235.dna; Position on contig= 199996..200163bp; Strand=+
ttgtatttcagtggaaaagaatcagaaataagcaataaaaccagaatccactcacacattctagacgctggtgaagaaattttcctctgcctattcaaaaatgaggcggcattatggacttgttgtatctggatagcaagtgctttatcgacaatttatttatggtag

SEQ ID NO: 4720 - DNA, 387 bp, Xenorhabdus bovienii
  Coding sequence Name=Xb4151_4152.C443.gene236.dna; Position on contig= 200109..200495bp; Strand=+
atggacttgttgtatctggatagcaagtgctttatcgacaatttatttatggtagtgatagatggtacggatcaggtagttactccctgcgatagatccccccaaaggagaaaaaaggagaactgcagcagttatgccaattgtgataaacacgagagtccagcgaagttgtttcgtagcggcgctgccagaaagaaaattccccgctattccagcaaggccgtaggcaaacaaaagtggattaatccagctattatcgaacttgtagacggtctggagcagtggtcgtacatatgtgtacgccataaaatgaccaacgaccagaaaaacgtgaccaatatccagaatattgacctgcttctttatggtcttgtcaaagacaattag

SEQ ID NO: 4721 - DNA, 108 bp, Xenorhabdus bovienii
  Coding sequence Name=Xb4151_4152.C443.gene237.dna; Position on contig= 200504..200611bp; Strand=-
atgataccttcttattatctggcaagccaagcctgtcggaaaagcgccaactattccggcgctgacggtctggggctaatcacctctctgattttcatgaaatcctga

SEQ ID NO: 4722 - DNA, 129 bp, Xenorhabdus bovienii
  Coding sequence Name=Xb4151_4152.C443.gene238.dna; Position on contig= 200854..200982bp; Strand=+
atgcttatgataaataatactatttttatatctgcatatcaggaacaggcgctattatggacttgctcaaagaagatgacaagtcctttgcatccactcttatgccaagcgctcaaaaaacactcgtga

SEQ ID NO: 4723 - DNA, 3369 bp, Xenorhabdus bovienii
  Coding sequence Name=Xb4151_4152.C443.gene239.dna; Position on contig= 201153..204521bp; Strand=+
atgactcaacattatccatctaaatttgtcacaggtactgatgcccttgctgagcttttactcgctcaggctgaactggataaaagccataatctcaacactgcggggtttgttgctggatatcgcggctctcccttagcccgtttagatcaggcattatggcagcatggtaaagaacttgctcaatccaatatccgctttcaacctgctatcaacgaagatctcgccgccactgcacttatcggtactcaaaaagtcgaatccgatcctgatcggaatgttatcggcgtctttggcatgtggtacggcaaaggacctggagtggatcgctctggcgatgcgctcaggcatggcaacgcttatggctcttcaccacacgggggcgtacttgtaatcctcggtgatgaccacggttgtgtctcctcctccatgtcccatcaatctgatctcgttttaatggcttggagtatgccgattttgcatccagcatctgtttctgactatcacgatgtaggattatggggctgggcggcatcgcgcgcgagtggggcttgggtcgggtttaaagcaatcagtgaagttgtggaaagtagtgctatcagaaaaagcaaaccctttcctgaatataaaacacctgaaatcgattctggcccagatgggctgcattggcgttggccggatcttcccggcccacagattgagaaacgcttggcctataaacttaaagccgttgaagccttcgccagagctaatccgatcgatcaactccttgccccgtgcgcccatccgcgtgctctgctggtcaccgttggcaaagcgcatcgagatgtgctggaagccttacgtgccggaggcttaacgccttcccaacttgccaaacaaggggtggcttttgtccatgtccgcttagtctatcctctgtcaccgcttctcagcgatcttgcttcacaggtcactgatatttttgttattgaggagaagaacgctgttgtcgagatcctgctggcacgccatctggttaattcacagaaaaatattaagctgataggcaaacacaatcatcttggccagcaatttttacccgcagacattgagttacgtccttcattgattactcccctgctttctggatggctaaacaaactcgatttgtttctctcggttcctctggaatgggcaactaaaacaacaccacacgatcttacgcttcccaaacgcacaccttatttctgcgcagggtgtccccatagcacatcaacccgtttacctgaaggcagccaagcccaaattggtattgggtgtcatgtcatggcggcttggatggatcgtaatacgggatttggtcttgttcaaatgggaggggaaggtgccgactgggtcgggcattcaccttttattaaccgtccccatctctttcagaatttaggcgatgggacctatttccattccggccatttatccattcgccaatcaatagccgcaggcaatcacattacttataaattgctatttaatcaggctgtggccatgactggaggacagccactggatggtaatcttaccataccgcagattgtagccttaatgctggctgaaggggtcaaagaagtcgctattgttacggatgatattgataaatatcaggataaaaacctgctaaccgctaaggtgacgctttatcaacgtgattacctcgaagaggtgcagaaacgttttcgagaaatcgcgggggtaaccgtaattatctacgatcaggcctgtgccacagaactacgccgtaagagaaagcggggtctggagccgaaagcgacacgacgcgccgtgattaacgagttggtctgtgaggggtgtggtgactgtcaggtacaatcaaattgcctcgcagtgatcccggtcaaaacctcactggggactaaacgcaagatcgatcaacacgtctgcaactccgatctatcctgtctgaaagggttttgccccagctttgtcaccgtcgaaaatgccaatccacgccatgatctcagtaaaataatcccgcaaggcgatctagacaaattactccgtgaattaccccagccaatactgatcattagcgataacccttatgagatcctgctcgtcggcgtaggtggtacaggtatcgtcaccgcagggaatttactggcgattgcggccgaagcagataattattccgtcagtctactcaattttacgggttttgcacaaaaaggcggtgaagcaatcacccatgtccgactatgccatgatatgaataagctacatcaagtcagaattgaccgtgggcgcgctaatctcatcatcgcggctgatttagtggccgcaacgggacaaaattcactgacagtgatgtcaaaaagtgcaacgaaatgcgtcctcaatactcatgaaacgcaaatcggcactatgcttcgggctcccaccctgaatctggatcatcccaaaatgatgacgactcttcaccaacactgccaaacattaaattccattgatgccgaaataatggccgctgatctggtcggtgaccgaaaccaaacaaatatcgtattaatcggttatgcatggcagctcggtaagattccaatcacgctttctgctatcgaccatactattcaagcactgggcaatgccgcagacagtgcacgacgcgctttccatatcggtcgcattgctgctgtacagccagatatcctgaatgagcgcctgcacatcaagccgcaagaaagcattaagacgctggatgatcttattatgcatcgatatcaatttttggttgattaccagaatgaaggatatgcacagcgttatctcagtcgcgttgctcagattcaactggtcacgcaacaaattgatgcggaagaaattgccaaagcggtcgctgaaaatttatttaaactaatggcttataaggatgaatatgaagtcgcgcgcctctatgccaaaagcgactttttcgaaaatctccgctcacagtttgataatacggataacattcgctttcacttcagcctgccccttttcaatcgcaaagatccacgtacaggcgagcgaggaaaacgagaatatggcacatggatcatccctatcttccgcgttcttgccgcatgtaagccacttcgtggaactatgttcgatatcttcggctatcaggaagagcgcagacaggaaagaaatttactgctcgaatatgagcgattacttgattttctgatagaaaaactgaaccgcgataatttagcgatctgtcagcaactcgcggagctgcccgatcaagtccgtggcttcggtcatgttaagcaaaaagcgataaaaaacatgatggagcgtaaggaggcattactggaaaagctataa

SEQ ID NO: 4724 - DNA, 123 bp, Xenorhabdus bovienii
  Coding sequence Name=Xb4151_4152.C443.gene240.dna; Position on contig= 204592..204714bp; Strand=+
atgaatgaacggctgcgaaaacatagaagccactgttggcgagtcttcatacagccgtttagcttaatccagatgatgcgtcattatcagtatgctttttttgacatgacatcaccctgttaa

SEQ ID NO: 4725 - DNA, 1182 bp, Xenorhabdus bovienii
  Coding sequence Name=Xb4151_4152.C443.gene241.dna; Position on contig= 204737..205918bp; Strand=-
atgctaatgtctagaaaaccttctgcgctcatcgtcggtacgggtatcggtgggttgtcatgcgcgatcgcattgaaaaaaattggttggtctgtgcgtctctttgagaagacggacagtttacgagcgactggatcgggtttatcggtaatgtcaaacgccagttcggcgatgaagaagctgcttgatatcgacctcgggttgaagaattatggtgctgaagttcgaaactttgagattcgacatagctcaggattgctcttgaagcgcctccctgttcaaaagatctctgatgagcaaggcactccgagtatttgcatatcaagggaaaacctccagagagcgttgttggatcagcttggcgatgcggatattagttttggtaaacgcgtaactggctataacgaaacgagtgatgctgtccatatcaatttcgaggatggcactgtttcatcgggagacattattgtcggggctgatgggttttattctgcaattcgtgacgcgatcggaacagaatctattattcaggaagccggttatatttgctggctcgccttagttaaatactcccatcccaaaattacacccggctacgttgcccattattgggggagagggaagcgtatggggattgtagatatcggtgatggctgggtgtattggtggggaaccgcgaatatgtcgaatgatgacgccaaaagatggaaaggtacgaatagggatgtagctgagttttatgcgggttggccggatcttgttcaagatatcattaactcaactgacagtgaatccataatcactgtagacgccaaagatagaaccttccctgaacattggacaaagggacgagtgactcttctcggtgatgccgctcatccgatgctaaccagtctcggtcaaggtgctggaatatctatagaagatgctgcggtgctggggtacgtgcttaaaaatactgaggactaccgtgttgcgctacgccgatatgaagctattcggcaaccgcgtgcccgtgcaatcgtcaacacctcgcgatctttgagtgatattgaacagcatgaccgatttttcccttgtttagagcgagacgttagtatgttgctgacatccaaaaagtccatgcgtaaacggcttcaggattcgctgttatttgacgatctcgctattcaagcgcaatga

SEQ ID NO: 4726 - DNA, 7305 bp, Xenorhabdus bovienii
  Coding sequence Name=Xb4151_4152.C443.gene242.dna; Position on contig= 205905..213209bp; Strand=-
atgtcatctgaaataattttttcgaatattaagagccgagatggagcggtttggcttggttcaatcaaggggacagcttcagcccagaaatactcggtttgtgtcgttattcgtagagctaatgtcattagtctaaatggagttcaagctatgagtattgctaccgatattggagaaccgacttcgtacgaaagggatttatgggttgaggagctacatgatccgcactgtcatcagttcacagtggctcttagtgaattgttacccaggtctatcgatcttgtaaatctgaagggggttgctgaacaagttctggagtcggagcaagcttcccacaagtcttttcacgagcaagagggacatctggttctgaagaaagctcctgttgtggtttgtgccgagttatatgaattcaagaatgaagacgactttgccttattcttcaatgaatggtctcgtaagatttgggatctttctgtttcacccttggtcgagattgcgataggccaaacagatcaagctactatattaatggtacgtgctcatcacatcgttgctgacggttggggtctgaatctgttgtccaagaaaatactaggtgcttatgcagataatcatttaggtctaaatgaacaacttaaaggggtgaaacgttacgcgacaaaatatccaaccctgcaaggcagtaaacttgatgaggcaatccacgacgtcgtcgtgaaaatcgctgatactgatcccgtgttatttccaaaatctggagcggctctttcgacatcccccagctatatcagaccattcaaaatatcagcgcacgaagttgctcatggtattgaaaatggttttactccttttttggctgtttcaacggctctggcagttctgctgtcaaatgcatacggaagcgagaaatttttcattggggtgccgtttcttaacagaaccgatgcagaaattacgtcagtcagtcaccgggctaatattcttcccgtgaaagtcgaggtattacctcaaaatacactcagagcaatttactcgcagatcaaagattttatcgtctttctgaaagacaaagaatcggttccgttagggggtattatttcggctctggcaagttcctctcgtcaactttttgatgtaacaatgtcctatctgcgttatccagaatggggggcaattgctggatttgaagaaaaaacccagaatattgcgcacatgcatactcaggatgcgatagcgattcatctgtacacttatggcaataatgcagatgtttggggagatgtgtgtctgaatagctcagtatttgacactgaggactcagcgaatgcattcttagatacattcatccatcttatcaataattttggtaataatgttgataagcatgtgtcggaagtcaacctgctgacatctaagcaaatggagcagcttcgacagtatgagaatgggccaactaagcaatacagcgtgaatgaaaccgttgtttcgctctttgaggctaaagctgaacaatttcctgaaaatatcgctcttcgagatcaaattggcacatcgctttcttattctcaattaaatgcatggtcatccaccattgccgctgctttagaaggacggggaatcggccagggggatattgtggcggtgtcagtcgagcgatcgccagagatgttggctgcaatatttggtgtcctcaaaactggggcggcatatttacccattgatagcgactatcccgaagatcgtattcaatatatgcttaacgacagcaacgccaagttagtcatttctaatctaccccacgttatgaaatctgatgatcctcgtttgttccgtctggacgctctgccaactgagctaccttctcatcatcaatacagaagcaaagctcagcctcatgaacccgcatatgtgatctatacatcaggttctactggccgccccaagggtgtcattgtcgagcatcactcagtggttaatcgtttagagtggatgcaggaaatacatccgttaaccagtgacgatgtgatcctccagaaaacgtcgatatcatttgacgtttctgtgtgggagcttttttggtgggcgatgacgggagcttctgtcgcactcctgaaacaaggtgcacaacgcgatcccagagaattgatccagacaatttctacactcggggtaacggtagcgcattttgtgccgtcaatgtttgaaccctatgtgcaaactttgactgatgatagacagtctcttttatcggttagcagtctgaaatgcctatttacaagtggtgaagcgttaacccctgctgtcgtgaataaatacaggaagcttttcggtcgcgatacccgtccaccaaggctaattaatttatatggcccgacggaggcaacggttgacgtaacctactatgaattaaatctggaacaggattcggatatcaacgcagtaccaatcggttttccgatcaacaatacctcagtgagaatagcctcattgcatggggtcaggcagcctataggtatatctggagaactacagattggcggtgtgcaattagcgcgaggttatttgaatcgccccgagctgacggcagaacgttttattatcgatcagaatgacagttgcagtcgctggtaccgaacgggtgatctcgcggcttgggctgaagatggatccatcctttacctcggaaggatggatggccaagtgaagatacgcggtaatcgcatagagcttggtgaaatcaaaaacgccttacttaacctgccagaggtgctgaacgcggaggttatcgttgaagatgatgctcggggaaaacacctgattgcagtctatgtaggccgacaagacttgaatgagcgtgatattcgcgcaaagcttgggaagcagcttccttccttcatggttcctgcaagatttgtccgactggggggcattcccctgacacctaatggaaaatttgatcgcgccagtgctctcagagaggtcagtggaaataaagcatctcctcagacagtaaaacttgatgaatccgaaacgattgttgccaagatatgggagaaagtactcggtcggtcaaacattggtgcagatgacgacttctatacgcttggtggcgattccatcctgatgttgaaagtgagatcagaactggaaagtcacgggtatgacgttggcttatccgatctggcgcagtatacgacagtatgtagcttgggaaatgtcctcgaaagtgtgtcacgtgttctcagtagcccgaaagaagcccttcctccttttgctctcataagtgcaaccgaccaaaagatgctgagttcagtatacgatgatgcttaccccgtatctcaattacaacttggtttgcttttccatagtcgtgagatggaaggtgcgagaacttataaagatgtattccgatatactttaaagtcggcgtggaatgaagccgcattcagatctgctttgcaaggattggttcgtaggcaccccgcattacgcacagtttttaaccttagtgactatcatttaccccttcagctaatcagacccgagattctaattgatgatgttttatcaattaaaacgcctgatgtggttgagtatgagcatacagttcttgctcatatggataagtggtcacggtataattattcgttcttatcgggaccacttttccacgtagcgatatttgctaatagtgaatcaaactatatcgacttagttttcagctttcatcatgcaattcttgatggaggaagcgttgcaaacctgatacgtgagcttcttttgtcctattctcaggggaatgatggcgctaatctcggttaccctgaagacgaattgccgaatccgtcaatttttgtccaaaacgaaatagaaacccttgaagcaagtgagtctaagaattactggaaagaatacctctctggcgcgacgaatacattgccaataggcttggctggatattcaactgctccagtgaaacgtattttttcttatcgtttcctaatagatcctgtacttgatgttgcacttaatcagctggcaagaactattcgagtccctataaagcacctttatcttgccgctcattgcaccaccattgcgttaatgagtggtaaagaggagatcgtcacgggtgtagtgacacatacacggccggaaattaagcactcggagcgtattctggggctatttttgaacacacttcctttgagagttgatataaaaaattggaattggcttcaggttgttgaagggctgtatcgaaatgaaaaaagaagtcataaacatcggtgttttcccttaagccaaatccaagctgacaatgaattgctctctgtccagaccgcttttaactacgtacattttcatatattgcaggatatttctgcgaagtcaggtattgaaatagtcgcctttgatccgaaggaggaaacaaatttcgatattctggtaaacgtaatgcgcgatgttgatggcgaacgtacgagtgttcgggtggatctcaatggaagcatttatgccagagaacaaggggcggttttttccaggctctttaatcgtgtgttagagcgaatagcttatcaaccagaattacccgtatccctcagccactcgattactgaagttgggtgccttgtggaaaggacatcggataaggtatttatttcacttccagccatgattcgaaatagcgttcaacgtgatccggatgcagttgccatcacgtatgataacgtagagtggagctatcagcagctatgggatgcggcgacagagattgcttttttgctgagtgaacgaggggtccataaacaggatgtggttggaattgcattaccgaggtcgtttgaacaaattgcaactgtcttggctattctgaggatcggcgctatttgccttccaatcgacttatcatacccagccagccgaatcgagctgatattgaaaatagcaaatccggccgtagttgtaaccgatcattctattacagagttgcccacaagtgtgcgcatgcttttccttgagcatgattcaatcgcggcaactgcggaaagagacgatgcgacgatagattctgctgatgcggcctacattctatttacttccggctcaacgggtacgcctaaaggcgtgacgatgctgcataggggattgaccaatcttgttggctggcaaaataaaataagtagtggcgccaaggttacctctacactccagttttcgcctttgagtttcgatgtttctttccaggaaatactctccaccctctcatcaggtgccacgttgcatctgattagcgagatggagcgtcgagatccggtagctttggtcaggcatcttgatcgtaaaggcgttgagcggatattccttccgtacatcgctttgcaacaactcgctgagacggccgttatgctggaattctttccgaagaaactgcgggtgattgtctcgtccggagagcagttgcgtgtcaccaaagagatacggacgctggtcgataatctacctggcggcatattggaaaaccagtatggcccgaccgagactcatgtggtgacaagttacactatgagcagtgatcccagccagttccctgcacttccgccgattggtatcccgatcacgggtgtaggcattgtgatccttgacgagagttcaaatgtcgttcccgatggggttcctggcgaaatctgtgtgttcggagacgctttggcatcgggatattaccgttcgccggaggaaaccaagaaaaagtttattgcacacgccgacgtaccaggtgggatgttttaccggacgggggatattggcatccgttcagcgtgcggcgagattatcagccttggtcgcaaggatacactggtcaaagttcgtggctatagagtagaactctctgaaatcgagttaaaaattctcgaattctttgaaaaaattaagaaaaatgttgaagtagcggttgtcgctcggcctcgtgacgatctggattcatacttgatcgcctatctggtgggtaaggaagatggtatcgcgctggaggaactgaggcagtttatcggagctgagttacccgcatatatggtgccgacacacattacatggataaacgagcttcccaagacaccgagtggcaagcgtgatgatgcgatgctccggaaactggatatacagcttgtatcagaaaaaaattatcgtggcccagcaggcgagtatgaaagcagactttgcgagctgaccgcagagctcctgaagatccccgaaatagcccctgagcagagtatttttgattgtggtgcgacttctttgactgcaatgcgcatagtggttcttgttgagaaactgtatggcattaacgtaccgctttcagcatttgttagcgcaccaaccattgcgaaacttgccatgcttattcaaaacggtggtggtcagttcaaatttgacccacttgttccactgcgcaaagcaggtaacagcaggccactcttcctggtacatcctatgggaggaaatattctgtcatatctgcgaatgcttccgtacctgccatctgatcagccactttatgctcttcaagcatcgggtgtggatgcgggctcgtcaccaataacgactattgaggagcaggctgctttttacattgaggcgatcaagagaattcagccgacgggtccttatgtgattggtggctggtcgtatggtggatttatcgccttcgaaatggcgaatcagttaatccgatcaggggaaatggtctctaatattctgattcttgatacgatggctctgagctcacaggcaaaaggtcaggcgagcgatgatgctttgcttagttggttcttctgggaattgctgtggacatcgaagggatcttcgttacccgttcatgttgttccttcctatatcgaaagcttgcaagagaaattcgagtacatcactgatcatgcaacccagataggagcgatcccggaaggcagcacaaaagcagtcatgcagcgccttttcgaggtgtatagtgctaattggcaagccgcggctgaatacaacgcacaatgtccgaatcttgatgtgacgcttattcgcgcaaagcagcctcttcctcagatattgcaagagatgcacaatactattcgtagtgaatatcatgatcctctgaatggctggggtggcaagacgtctggccgagtgaacttgattgaagtggatggcgatcatctgactattatggaagaacctttcgttgggccaatggtgtcggcaattattactgaaattaataaagtgaaaggggtgaatgctaatgtctag

SEQ ID NO: 4727 - DNA, 600 bp, Xenorhabdus bovienii
  Coding sequence Name=Xb4151_4152.C443.gene243.dna; Position on contig= 213413..214012bp; Strand=+
atgctgagggatgccctaattaagacatcttacgaactttttgctattaagggatttgatgaaactcgagtagaagatatcactgaaaaagttgacgtttctacccgcactttttttcgatatttttcctcaaaggaagatgttgtccttgactaccaagaggcagaacacaaagactttattgccgcgctcatccgccgtccacctcatgaacccgcgttatcagcattacggcataccgctgtcgaaattatgagaaaatgtgaaggaggttcttatggctttaatacaaactgtttcatgacccttcaagacttgataaggaaccatcctttagttcgggcaaaaaatcttcagcgcggagaggatcggaaaccccctatcatttcattaatcgctcaacgtatgggaaccgaccctaaaatagatattagaccaggcatcttagccggcgttttagattatgcgcattgggctacatatgacgtttggaagcggaaaaaacactcttctatgcgttactcagatgttcttgatgaagtatttctcattatcgagaatggtctcaactttccagcaaacaatcagccggatatctag

SEQ ID NO: 4728 - DNA, 153 bp, Xenorhabdus bovienii
  Coding sequence Name=Xb4151_4152.C443.gene244.dna; Position on contig= 214018..214170bp; Strand=-
atgaaagtctgcaagccacagaaaaaaggaccgaaaggtcctttttacgttccagtgataatgaccaaaatccattctcatccagcgctttttagtcggtcgttaataacccccggcctgcgtttacccgaacctttcggttatctagggtaa

SEQ ID NO: 4729 - DNA, 156 bp, Xenorhabdus bovienii
  Coding sequence Name=Xb4151_4152.C443.gene245.dna; Position on contig= 214167..214322bp; Strand=-
atggttgtaggatgttcgtatctagaaattaaggctgacagtagtcatcagcaatgcgggaatagctcagttggtagagcacaaccttgccaaggttggggtcgcgagttcgagtctcgtttcccgctccaaattcaggattgtagatttttatga

SEQ ID NO: 4730 - DNA, 150 bp, Xenorhabdus bovienii
  Coding sequence Name=Xb4151_4152.C443.gene246.dna; Position on contig= 214347..214496bp; Strand=-
atgcggcaggaaaatgagggtaacaacgggtgtaaaatgtccacgtcacgtcagttagcatgtattttgaacgtttggtattgggttgtgtgcaaagagcttgccatcttctccaaacaagttcataatggcgcccatcttggtacgtaa

SEQ ID NO: 4731 - DNA, 351 bp, Xenorhabdus bovienii
  Coding sequence Name=Xb4151_4152.C443.gene247.dna; Position on contig= 214439..214789bp; Strand=-
atgcgccgttgctcaaaatggccccaccagaagaggagaaaaaggatggctgataactacatcgtccggacggccggtgaatggctgatcgtcggcctgttgccggatgtgtgtaaaactccgatgggcgcatcaaccccgccgatcccctatccggtggtcgccaaactggccgacagttccgcaccggaaatgttgtggaaagcctttgttatacagggcttgaagctgatatctttgctcgggagtcaactgtcggtactgtctggtttgtttatgcatatcaggctactatgcggcaggaaaatgagggtaacaacgggtgtaaaatgtccacgtcacgtcagttag

SEQ ID NO: 4732 - DNA, 1026 bp, Xenorhabdus bovienii
  Coding sequence Name=Xb4151_4152.C443.gene248.dna; Position on contig= 214801..215826bp; Strand=-
atggaatttcgtaacctgaccccctttgcagtgatgaactattcaatgctggatgtggcggatacagagcaccgtgtgatggtgatgaaaatcggttatcagttgctgcctgaccgtcgcggccattgtctggccgaactgctgcccgcgccgccgctgtgtttacaggatgaataccgcgggcagatgaatgcctcacaggtgttgcaggagagtgacctggccccgtttaaaccgcgttgtgacgtgattgttaacggcaccgcatatgcaccggataaccgaccctgcacggcgtttccggtccggctgcatgtgcaaagcaaacaggggcagaccctgctcgacaaaaccctgaccgtgaccggtgaacgggaatttattcgtgatgctggcggtcagtggcaactgaccgacccgaaaccgttttcaacactgccgctggattatcgctacgcctttgggggcgaatgcaaaattcaggcggatgataaagcagttgcacagcttaaggaaagcgatcggctgacatcggcacagcgccagcaacaccctgacggagaaaaagcgccggttgctcacgccgcctgtgaaaccaatccgctgggaatgggatttatcacgccgtggtatgccaacgccaaaccacttacccgttgcccagccccccgcattagcgcgccggaggtaccgttcacggcaccgcattttgcgaaacagctggcgggaacattatctgccgatacacccgcctgccagccgcaggggctgggctttctcggccggccgtggctgccccgccgccagcttgccggcacttacgatgccgactggcgggcacctgcatgtcaccctgccggggcatcgtccgtttattttgctgcggctgcacgacgggaggatgttgcccgtgccgatgcgcctcgatacgttaatgctcgacagcgaggcgctgacgctgcatctgacctgtcggctgaatgtgaaaaccgcgctgcccattcgggtggcggaagcgcgatttga

SEQ ID NO: 4733 - DNA, 288 bp, Xenorhabdus bovienii
  Coding sequence Name=Xb4151_4152.C443.gene249.dna; Position on contig= 215842..216129bp; Strand=-
atgatcttccagatttattcttttttaagagcggctcacaccctgaccgtcggcggagtcatgaatacggccgtcgccttaagccagagcgaacaggtgggcgtccataagtcggttatcgtcggtaacaccctgtccatcaaggccggggatgtgattgagctgcaatgcggtgccagtaccctgcgcatggacagcagcggcaaaattacccttattggcaccgagtttaagttcgaggcgagtggcccggtacaaatcaccggcaaagacatcgacctgaactaa

SEQ ID NO: 4734 - DNA, 441 bp, Xenorhabdus bovienii
  Coding sequence Name=Xb4151_4152.C443.gene250.dna; Position on contig= 216169..216609bp; Strand=-
atgacgcgtatgacatggattaagccttcattcttatggatgatgtatcgtgctggttggggaacgaaagatagtggtcaagaacgtattttggctattgatatcacacatgagggatttagagaaattttgcagcagggggtgattagtcattatgaccctgatttgttttattctcaggaagagtggaaaaaagaagttcaacaaagtgatgtggttattcaatgggatcctgaacgagacattcatttaaataagttagaacagagaactatacagattggtctgcgtaatcaagcagtggaacgttatgtaaataaatggattatcaacattgaggatattacgaatagggcacatcagattcatgaattggtcaaaatgaataaattggatatggcttacaatttgttgccagaagaaacaatttatttggaatga

SEQ ID NO: 4735 - DNA, 423 bp, Xenorhabdus bovienii; identical to SEQ ID NO: 1669
  Coding sequence Name=Xb4151_4152.C443.gene251.dna; Position on contig= 216729..217151bp; Strand=-

SEQ ID NO: 4736 - DNA, 279 bp, Xenorhabdus bovienii
  Coding sequence Name=Xb4151_4152.C443.gene252.dna; Position on contig= 217011..217289bp; Strand=+
atgtgccactatccgtttcatacgcggctcccaggcataccagagccagcgctgatttttctgactccccacaaacgactcctgctcatccacttcacagataagatgaatgtcatccccgtcaagaggaagcgtcgtcacgttccgggggttgagtttttaagcgttttcatcacagtagctgttgccaccttcaatacgcgggccgtgtcacggatgccgctgttattcatcgccatatcaatagtctgctctttgactcccggtttgcaagcttga

SEQ ID NO: 4737 - DNA, 141 bp, Xenorhabdus bovienii
  Coding sequence Name=Xb4151_4152.C443.gene253.dna; Position on contig= 217464..217604bp; Strand=-
atggccaaagttgatgtctattgccgttattgccacaaatcagaacaggtcaaaggacatgggaaaggaaatggcggacatcctcgttatcgctgttatagctgctgtaaggtctttcagttggggtcatgtattaaatag

SEQ ID NO: 4738 - DNA, 732 bp, Xenorhabdus bovienii
  Coding sequence Name=Xb4151_4152.C443.gene254.dna; Position on contig= 217694..218425bp; Strand=-
atgatccacagtaaatattgcatatatattaatgatgtagaatgcgctatagccgatgatattgacttttttcacctgagtaatcatgaaagcgatgattttggattgattctattaagatcaaaagaaataaagatgcagagtagtgtcaaagtaaaaaaagaagacactattactatatcctattatatcaatgggatatgtgcatttgaatttaatggtcatataatagacaaagaaaatactctaacaaacagccaagggttttcattcgtaataaaaacttctgatgagccacctcttaccattattgctattttaaaagagtgggttaaaggaaatgattttatctactggaaaaacaacaaatgcatagaagcaaaaaatctatggttaaccgcatgtttatactggcagcaaattttcccaccaaaacctaataaaatacttaatgcctcactaagcttagaaggcatcaataattatcttgacttcttttgcatgcttggagaagcattttggggtaaaagaggatatataggtagagattttcatgggtttgatgatttattgggtgatcttagctatgaaaagtcagaaattaatatttatattgaaaatatgaataaattaaaactttttttagaaagaattagtcctcctgattacaattaccatgaaattttcatgggaattttagtaaatagaaagtgtaatattaacaaaaaataa

SEQ ID NO: 4739 - DNA, 312 bp, Xenorhabdus bovienii
  Coding sequence Name=Xb4151_4152.C443.gene255.dna; Position on contig= 218339..218650bp; Strand=+
atgattactcaggtgaaaaaagtcaatatcatcggctatagcgcattctacatcattaatatatatgcaatatttactgtggatcatagtattgccattctgttgaataatttaatgtttatcatttcattgacttgtgccctggatatttaccaccatcggggtaccaaggactcggaaatttatagactttttcgtaatcatgatttaatacatatccatatattttttgaccattcggtaatgtttgttctagtatgcgatggtgtgggtcaagcccttttcctgaatgaactacttgccattctttag

SEQ ID NO: 4740 - DNA, 330 bp, Xenorhabdus bovienii
  Coding sequence Name=Xb4151_4152.C443.gene256.dna; Position on contig= 218767..219096bp; Strand=-
gtgtgggcacagcggctgacgacgtggggcagggcggagaaatctcaggtgctggcctccaatgatgcggattatcacgttagctgcaacctgcgttttgtggggcagtatgaagatgaggaaagtggattatactataaccgttttcggtattatgatcgggagacggggcagtacctgacaccggacccgatagggctggcggggggagtgaatccctacgggtatgtgcataatcccacaggatgggtagatccgtttgggttggcgggcaaagattgcgataagttcactaaattatcttcaccaaacccagtacctaagcgttag

SEQ ID NO: 4741 - DNA, 567 bp, Xenorhabdus bovienii
  Coding sequence Name=Xb4151_4152.C443.gene257.dna; Position on contig= 219138..219704bp; Strand=+
atgatcgctgacgatgtaatgcaatttaccccattcataacgcgccgacggcgtaagtttacccggttcgtacagccagcggatacgctgatcttcggcgggcgtgccatccgcatacaacggcgtttcctcaatcaactggtcgccgctccacaggtaatcctgccccatcatggtacggggtttcggcgtcatatccggcttgccgtccagccagcgctggagattcgcagcggccagtttaccgtcatggactttgagtttccgaatgcgccgcccgaacgcatcatactggtaatgccagcgcgagccgtccggagtttcacactgggtcagctggttcagtgcatcccagcggtagcgccacacttgtggccgaaaaccatcgcgctgtgcggtcttttctaccagccgcccgctgtcatcatagcggtagctgacatcaccgcgccggataacccgcccggcctgctggcactgggtcatttgcgtcacggcaccttgcgcgtccaaaaaataaagccggaagatcacagggatctttccggcttatattttctgagttaa

SEQ ID NO: 4742 - DNA, 588 bp, Xenorhabdus bovienii
  Coding sequence Name=Xb4151_4152.C443.gene258.dna; Position on contig= 219701..220288bp; Strand=-
atggaaaaatcattaaaattgataaataataatttttcactaagtgaatttaattttagtggattcagttcatctgtaaattgggttggttttttcgaaagaaaacatgatttctcttatcaccttattgatgaatccattgagttattttctgatttctttgaaggaaaacatgctagtccgacaatcattactgccctttcgtttgacgatgataaagaagatgacatagagacaattgcgagatatcaagaaatttaccatagcgtcaaagaaaaaaacttattacttccgatgacagaaagctatgaaaattatttgtatggagaaacattattaccagcacattcattaagttttagttttacaaaaaatgattttatcgatctttcaaaacttattatgtgtcatgcgggggtaataggtcaggtttgtttttacataaaccctgccctcaatataggtgtttatcctcatgaagatactggctttggttgcatcgcactcaatggagaaaagaatacatgcattgattttttaacttattgtaaaaaaaatgaaaatttcaatgttgttatagataattaa

SEQ ID NO: 4743 - DNA, 1071 bp, Xenorhabdus bovienii
  Coding sequence Name=Xb4151_4152.C443.gene259.dna; Position on contig= 220260..221330bp; Strand=-
atgacccagagccagcaggccgggcgggttatccggcgcggtgatgtcagctaccgctatgatgacagcgggcggctagtagaaaagaccgtacagcgcgatggtttccggccacaagtgtggcgctaccgctgggatgcactgaaccagctgacccagtgtgaaactccggacggttcccgctggtactatcagtacgatgctttcgggcggcgtatccgcaaactcaaggtgcacgacggaaaactggcggcagccaatttacagcgctggctggacggcaagccggatctgacgccgaaaccccgtaccatgatggggcaggattacctgtggagcggggatcagctgattgaggaaacgccattgtatgcggatggcacgcccgccgaagatcagcgtatccgctggctgtacgaaccgggtaaacttacgccgtcggcgcgttatgaacggggtaaattgcattacatcgtcagcgatcatcagggtacgccccgggaaatgctgaacgaggaaggcgggctggtgtgggcacagcggctgacgacgtgggggaaagcagagaagtcgcaggtcattgcctcaaatgacccggattatcatgtggggtgccatttcaggtttatggggcagtacgaagacgaagaaagtgggttatactacaatcgttttcggtattatgaccgggaaactgggcagtacctgacgccggatcccattggcctattgggcgggctgaatccgtatgggtatgttgataatccggtcaattttattgacccctttgggctggcaaaatgtcacttagacaatccgaagaaaaaagtaaatagtgcagatgtaggagattttgttagaacaccaacctctcacccagatgattttaccaaaataaaaggtggtaattataagaataagaatacaaatgagatatggagtaaaagtaatactacacatagcgataaagagggtgagtggaaagttggtattggaaaagcagaacctaaaccaagacataaaataactataggtatgagtgatggaaaaatcattaaaattgataaataa

SEQ ID NO: 4744 - DNA, 528 bp, Xenorhabdus bovienii
  Coding sequence Name=Xb4151_4152.C443.gene260.dna; Position on contig= 221401..221928bp; Strand=-
atgagtatcgagagtttaaataatatattgcccttacctatccatccaaatgaaaatggtcagaacagaaaatggtcgttgatagatgagcggcacgcttttcctaaagattatattgattttatcactcaatatggcacgggcagaattgccgattttatcactatatttaacccatttagcgaagatgatgatctgaattttttcaggcagaaggaatggattattgaggattttaattctcttgttgaatctgatccggattactatccgtttattctttatcctaaaaaagatggattgcttcccataggcgttactgataacggtgactatatcttttgggttgtatcatcagatgacagtgaattatggaaggtagccattattgctgcaagggcaccagaagttgaatatagacaagaaaacttcactgattttttagaaggtgttttatccagaaagatcaagtgcatgtcatttcctgacggttttccacctaacagtatagaatttgacagaatttaa

SEQ ID NO: 4745 - DNA, 177 bp, Xenorhabdus bovienii
  Coding sequence Name=Xb4151_4152.C443.gene261.dna; Position on contig= 221932..222108bp; Strand=-
atgagtggaatcgagggtcgaataagaaaagccttagaacaaggacaagttgtcgaaatgagttctgttcctatttataaggacccttccagaataccagctggtattacaatgaaggctgaaggttcgggcggattctatgagtatgtaactgttcttaaccctccaggaatgtaa

SEQ ID NO: 4746 - DNA, 348 bp, Xenorhabdus bovienii
  Coding sequence Name=Xb4151_4152.C443.gene262.dna; Position on contig= 222223..222570bp; Strand=+
atgatggaaaaaactcacatgagccaatccaggtttactcaagccgagtggcgggacctgtttgaacagcagaaaaaatccgaactgactgtcccgcagttttgccaaaaaatcggtgtgtcgacaacccggttctatcaccaccgccaacgcacctcccatccaccagaaaagccgtctgggctggcttcaccgtctgcttttattaaagtcagcaccgctcagaaaaaatccgcctcatccagcatactccccatcttatttgagacaccacatggcacactgcgttttcctgccggcacggataagcatgttatcattgcgattattcgggggctcgccgcatga

SEQ ID NO: 4747 - DNA, 354 bp, Xenorhabdus bovienii
  Coding sequence Name=Xb4151_4152.C443.gene263.dna; Position on contig= 222567..222920bp; Strand=+
atgaaaatgtttgtggatgtgccggaggtgtatttgtgccgctcatttatcgacttccgaaaatccatcaacgggctggcggtctgggtggagctggaaatgcaactgtctccgacgcaaaccgcgttattcctcttttgcaacaagaagcgggataaactcaaaatcctctactgggataaaaccgggtttgcgctctggtacaaacggctggagaacgcgaaattcaaatggcccaccgccgtcaacagtgcctccctgaccctgacagagcagcaactgcacgggttgttatcgggttatgatgtcatcgggcaccagcccttctccgtacaggattgccatgtcgcctga

SEQ ID NO: 4748 - DNA, 1020 bp, Xenorhabdus bovienii
  Coding sequence Name=Xb4151_4152.C443.gene264.dna; Position on contig= 222991..224010bp; Strand=+
atgaaaattgatattgatgccctgcccaatgaccccgctgaactgaaacggctgctgattaagcagtcgcagcggctggcctttttggaagagcagttccgtttagcccaacaaaaacggtttggggcttcctcggaagcgttccccggccagggggagttgtttaacgaagcggaagaaattgcgctgccggctgaaacggccgccgcacaggaaaccctcatacctccccgccgtaagccgacacgcaaccccctgcccaaagatttaccgcgcgaaaccgtgttccatgatatcgccgaggaagaaaaacagtgtgtgtgctgtggcggcaggttgcatcagatgggggcagatcgcagtgaaaaactgttgttcattcccgctcaaatcagggtggttgagcatgtccgccccaaatacgcctgccgtgaatgtgaaaaatccggcattcagacgcctgtcaaacaagcctccttgccagcgatgcccatcaagaaaggcatggcgaccagcagcctgctcagccagcttatcaccaataaatatcagtatgggttaccgctgtaccgtcaggaaagtgtgttcaaacagtatggcattgacctcagccgccagacccagagtgactggatattaaaatccgcgcagttgtttacgccgttggtggccaggttcagggaaatgctgttgcaacaaccggttctccatgcggatgaaaccccggtgaaggtggtgacgtctgaaaaaacgacccattacatgtgggtctattgtgggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 4749 - DNA, 279 bp, Xenorhabdus bovienii; identical to SEQ ID NO: 890
  Coding sequence Name=Xb4151_4152.C443.gene265.dna; Position on contig= 223961..224239bp; Strand=-

SEQ ID NO: 4750 - DNA, 291 bp, Xenorhabdus bovienii; identical to SEQ ID NO: 155
  Coding sequence Name=Xb4151_4152.C443.gene266.dna; Position on contig= 224231..224521bp; Strand=+

SEQ ID NO: 4751 - DNA, 747 bp, Xenorhabdus bovienii
  Coding sequence Name=Xb4151_4152.C443.gene267.dna; Position on contig= 224744..225490bp; Strand=+
gtggtaagtgcattctccgttgagaaagggcttagcttatgtcagtgtgctgtagacggaaaatcaaacgaaattaaggccatccccacattattatcgatgctttccttgaaaggccatctcgtgacgcttgatgcgatgggctgtcaacgcacgattgcccagcaattacgcgagagcggagccgattatattttgtcccttaaaggcaatcagggaaaaaccttttcggaagcggttaactattttcaacaacaacaggcaacacaaaaaccttatctgaaacctgaccatgatgaatttgaagatagccatgggcgtaccgtcagacgacgcggatgggttctaccgctgacaccagaaacaaaacacttaggctcctggccagatattcaggctcttctggtcacagaaacaatacggcaagaacaatattctgaaacagtcacctcttattttcgttattatttaagtagttgtcaggatgctcctgcctttcagttagcagccattcggaaacattgggctattgaaaatagcttacactgggtactggatgtcacttttcgggaagatgattcacggatgagagagcagatcgccacaagaatatttgcccaattacgtaaaatggcgctcaatatcgtcaaacgggataccaacagtaagttgagtttgagtgcccgaaggaaatcagccgggtgggataatggctacatggaagccctgttatttaatcaattttag

SEQ ID NO: 4752 - DNA, 123 bp, Xenorhabdus bovienii
  Coding sequence Name=Xb4151_4152.C443.gene268.dna; Position on contig= 225505..225627bp; Strand=+
atgcgtaacccctggcaggatatcagcgggattgccctgactgtgtcactgaattatgggatggtttggaggtggagacacaaaacgaagaaaccgggaagtgtgctcaaagagcaattctga

SEQ ID NO: 4753 - DNA, 1074 bp, Xenorhabdus bovienii
  Coding sequence Name=Xb4151_4152.C443.gene269.dna; Position on contig= 226076..227149bp; Strand=-
atgaaaagactgctggctctgattcttctcactccactcctgatttcctgctctagcaaaaaagatattgaatacaatgaagcatacgtaaaagatacgaatggttttgatatcttaatggggcaatttgcccataacattgaaaatatctggggcttacaagaagttttaatcgcaggccctaaagattacgtaaaatacacagatcaataccaaactcgtagccatatcaattttgatgcgggaaccatcacaattgaaactctatcgcctattgaaccctctgaacatttacgtaaggcgattattaccaccttgctgatgggcgacgatcctggctctgttgatctttattctgacatcaatgacattcagataagcaaagagccatttctttatgggcaggttttggataatgcaggtgaggcaatccgttgggagtggcgtgcacgtcattttgcaaattatcttctccagaataaattacaaaaacgccaatcagggctacatatgatttggaccgtcaccattcaattggttcctaatcatttagataaacgggcacataaatacttaccgatggttcgcaaagccgccatcaaatatggcgttgatgaatccctgatccttgccattatgcaaaatgaatccagctttaacccttatgctgtcagtcgttctgatgcactgggattaatgcaggtcatgcagcataccgctgggcgggatgtcttcaaaatgcaagggaaatccggccagcctagccgcagttatctcttcgatcctgaaaataacattgatgcaggtaccgcatatctatcgatcttgcagaatatctatttaggggaaatcaacaacgcaacctcacgtcgatatgccgttattaccgcctacaatggcggcgctggcagtgtactgagagtgttctccagtgataagaaaaaagcggcacaaatcatcaataccatggcacctggtgatgtttatgaaacgctgaccaataagcatccagcttctgagtcgcgccgttatttgatgaaagtgaataatacccagaaaggctatcgtcgatag

SEQ ID NO: 4754 - DNA, 273 bp, Xenorhabdus bovienii
  Coding sequence Name=Xb4151_4152.C443.gene270.dna; Position on contig= 227302..227574bp; Strand=-
atgagcagaactattttttgtacttttttgcaacgagaagccgaaggccaagattttcagctctatccaggagaactgggcaagcgcattttcaatgagatttctaaagaggcgtggcagcaatggatgagtaaacaaaccatgctgatcaatgaaaaaaaattgaacactataaacccagaacatcgcaaactactcgaacaagaaatggtgaagtttttgtttgaaggtcatgatattaaaatcgacggttatacaccgccggaaaaataa

SEQ ID NO: 4755 - DNA, 1041 bp, Xenorhabdus bovienii
  Coding sequence Name=Xb4151_4152.C443.gene271.dna; Position on contig= 227604..228644bp; Strand=-
atgatggaagccgagcaattttcacaggcggtacttgaatggtatcaccgctatggtcgcaagaccctgccatggcagctggaaaaaacgtcctatcacgtctggctttcagaggtgatgctgcaacaaacacaggtcgcgactgtcattccctatttccagaattttatttcacgttttcccaatgttgcctcactggccgccgcaccattggatgaggttttgcatttatggacggggctgggttattacgctcgtgcccgtaacctgcacaaagcggctcagcagattgttgctatacacaatggtcaattcccgactacctttagtgatgttattgccctgcccggcgttggtcgctctaccgcaggtgccattctttcactgtctcagggaaagcacttcccgattctcgatggcaacgtgaagcgcgttctggctcgctgctacgccattgctggctggccggggaaaaaagaagtagaaaaccagttatgggatatcagtacccgtgttaccccgaaacagggcgtcgagtattttaatcaggcgatgatggatttgggcgcgatggtctgcacccgcagcaaacctaaatgtgaaatctgcccactcaatacaggctgtatctcctacgccaatcatagttgggcaagctatccagggaaaaagccaaaacaaatcatccctgagaaaacggcctattttttattgatgcagtatggcgacacagtttggttggagcaacgtccactttcaggcatttggggaggattatttgcatttcctcaattcacggatcagacttcactggaacaatggttgaaagactccggtatttctcacagcaaacctgatcaactgatcgcatttcgtcatacattcagccattttcatctcgatattgtaccgattaaaatcgatattttatcttttgattcctgcatggatgaaagcaagggactttggtataacttacgccagccagcaactattggattggcagctcccgttgaatatcttttgcagcagctgggataa

SEQ ID NO: 4756 - DNA, 147 bp, Xenorhabdus bovienii
  Coding sequence Name=Xb4151_4152.C443.gene272.dna; Position on contig= 228607..228753bp; Strand=-
atgctgatttgcgtagcgcttcgaaacaaagttcgggtttacactgaggttacactatgttgcaatcctgttcacgaaacaatgatcatctataaagacaattattctaatgatggaagccgagcaattttcacaggcggtacttga

SEQ ID NO: 4757 - DNA, 720 bp, Xenorhabdus bovienii
  Coding sequence Name=Xb4151_4152.C443.gene273.dna; Position on contig= 228888..229607bp; Strand=+
atgataaataacgtaatttcaccggaatatgatgaaaatggcagggctttgcgccgtgtccgcagttttgtgcgtcggcagggtcggttaacgagtcgtcagcagcaagcacttgatgatatgtggccaaagatgggcatggattatcagccagaactgttcgatatgggcgaactctttggtcgtgaagcgcctgttgtactggagattggtttcggaatgggagcatctctggtgatgatggcaggccagaatccagagaaaaacttttttgggattgaagttcatgtgccgggagtaggtgcatgtctggcttccgcagaagatgaaaatctcagtaatctgcgtgtaatgtgtcatgatgccattgaagttttggaaaatatgctgccggaacagagtctggaaatggtgcagcttttcttccctgatccgtggcataaagcccgtcataacaaacgtcggattgtacagcctgagtttgctcaacttatcagaagtaagctgaaaatcggtggtgtcttccatatggcaaccgactggcagccgtatgctgaacatatgctgaaagtaatgagcggggcagaagggtattgcaacgtgtcggaaaatagtgattatgtaccacgtcctgattcacgtccggttacgaaatttgagatgcgcggtcagcgtttggggcatggcgtatgggatctaatgtttaagagggtaaaataa

SEQ ID NO: 4758 - DNA, 327 bp, Xenorhabdus bovienii
  Coding sequence Name=Xb4151_4152.C443.gene274.dna; Position on contig= 229607..229933bp; Strand=+
atggctaaaaaccgtagtcgtcgtctgcgtaaaaaattgcatattgatgaatttcaggaactgggtttttccgtaaagtggaatttcccggccaatacaccagttgatatcgttgacaacacagttgatgcctttattgaagagctggttgaaccaaacggtctggcgctggatgccagcggctatttacagtgggaaggtttgctctgcctacagaaaatcggcaaatgtaccgaagaacaccgtcagttggtggagaaatggctgaaagatcgcggtatggaagacgttgccatctcagaattgtttgatgtgtggtgggattga

SEQ ID NO: 4759 - DNA, 927 bp, Xenorhabdus bovienii
  Coding sequence Name=Xb4151_4152.C443.gene275.dna; Position on contig= 230024..230950bp; Strand=+
gtgaaggtaaggttctctaattcgttattggcagatatcttagatgaagtacgccctttgattggccaaggaaaagtggcaggttacatacctgctttggcagaagttgcggtaaataatctggcgatggccatctgtacggttgatgggcaggtttttagagcgggagatgcggaaaagcgcttttccatacaatccatttccaaagtattgagcctgacactggcgatgacgcgctatcaagagcaggatatctggcagcgagtgggtacggaaccttcgggacagccgtttaattcattagtacagttggaactggaaaaaggtattccccgtaatccctttattaatgcaggtgcattggttatctgtgacatgttgcaatcaaggttaagtgcgcctaaacatagaatgctggagttcgttcgtagcctcaccgggcaaaaatacatttgctatgatgatatcgttgcccgttcagaaatggagcattccagtcgcaatgctgcaattgcttatttgatgaaatcgttcggtaattttgagaatgatgtgctcacggttctacaaacttatttccactattgtgccttgaaaatgaattgtgttgaactggctcagtgttttatctacttagcgaatcaaggccgtatgataggttccggacaacaaattttaagtcttcggcaaaccagacagattaatgcgctgatgttgacgtgtggtatgtatgatggttctggagagtttgctttcaggatcggaatgcctgggaaatccggtgttggcggaggaatagtctgtgttgtgccaggggaattcacggttgctgtatggtctcctgaactgaatagctccggtaactcactggcgggttgtgcggcattggaaaaattggctgagcgtatcgggcgctctattttttag

SEQ ID NO: 4760 - DNA, 723 bp, Xenorhabdus bovienii
  Coding sequence Name=Xb4151_4152.C443.gene276.dna; Position on contig= 231031..231753bp; Strand=+
atgttacgcagaatcgcgattgctgcatcgttattatttgtcgctcaggtacaggcagattctgactgtcaggcgacaattcaggatgacattattgtcacgtcaaagtcagtccagattgttggagccagtgggaatctgagaattttgccagatggttctatgctccgtaacggtaaagcactgtcattgaattcagaacagcgtggtaaggctcagcgatatcagcaggctattcggcaggatctaccgtgggttaagaaagaaacactgagccatctgacaagtgcccgtcaagcgctggataaagttgtcgtcaatacaatgggaaaggagagtaatatccgtaaccgtttatcccaattggaatctggcctcaataagcaaattgacaaagtacttgaaactcgttctgatggcattgcattcaactctcaggccattaagaaggtggaatccgaagggcagaatcttattcagcagagtcttggtggtattttgcaggatagcattaatgaagtgagccgtaagaaaagtgagcagaatggtgatggcaaacagatgttgatgtcttttctcggtggattaggcgggatgcaaaatggttttgatgcagaatggaaaaaacaggaacaagagctggatcgctttaagggtgaagtttgcagtaaagccaaccaattggaacaactacgcaccagtctcatgaactccattaagtga

SEQ ID NO: 4761 - DNA, 966 bp, Xenorhabdus bovienii
  Coding sequence Name=Xb4151_4152.C443.gene277.dna; Position on contig= 231855..232820bp; Strand=+
atgcgtaattcaggtgtaacaatgaaaaaaatcctgccagttgttttagcttcgctgctttctgtcactagttattctgcattcagtcagccatcagtgttatttactcctaattccgtgatagtacaatctggtgatttcgtcacagtaaaacatttttccggtgaaacacaggttaaaaagaaccctgaacggatcgtcctgtttgattttgggatttacgattcactggtaaagctgggtttatctgatcgcgttatcgcattacctgtcggcaatgcccctgaatatgtgcgtggtaatatgtcagcaaatatgcagaatgcagggggaatgaaagaaccggatttagaaaaattggctggcatgaaaccggatctgattgtgattaccgggcgtcagggtaatttctatccatctctgtcaaaaattgccccaacagtgaatttagatactgacagtaaaaattatttgtcgtcagttgaaagtaacttaaagttattaggtgaactatttaacaagcagaatgcagttaagacccagattgaagatctggaaaaaacgattgccacagcgcaggagaaagctaaatattcaaatagtaaggtattggttcttttacataacgcaggtactttatatccgaataaccaagccattgtctatgatgtggtgaaaactcagcgcgctgaattaccgcttccaaccgataaagaaaaatcccgtgcggtaacagcagaaatgattgctaaagcaaatcctgatgctatttttatcatcgaccgcagcaaagcgattggtgcaggagaattgacaaaaaatcagtttgaaaatgatcaggtgaaatcaaccaatgcctataaaaatggtaagattgtttatctgcaatctgatctatggtatttgtctggcggtgggctggatagtttgacacagcaagtgaatgcggttgctgatgtattgtaa

SEQ ID NO: 4762 - DNA, 222 bp, Xenorhabdus bovienii
  Coding sequence Name=Xb4151_4152.C443.gene278.dna; Position on contig= 232844..233065bp; Strand=-
ttggcagatcaccaaacacggcaagttattcctgaattcactgttagagctgtttctttaaaggataaactgcacctgaaaatatcaggtgcagcctttattggcgaatgccttgcttgcaagaattgctttaaatcacgtttatttttgatggtaataatatcagtattaataccaaccaactcattagaatttagtattgatttcttggggatgatttaa

SEQ ID NO: 4763 - DNA, 1131 bp, Xenorhabdus bovienii
  Coding sequence Name=Xb4151_4152.C443.gene279.dna; Position on contig= 233005..234135bp; Strand=-
atgcttaaattaccgccactaagtctttatatccatattccctggtgtgtacaaaagtgcccttactgtgatttcaattcacacgcgttaaagggagatgtaccacatcaggaatatgttgagcacctgctggcagacttacgtgctgacttgccgatgattgaagatcgtgaagtatcgacaatttttatcggcggcggaacccccagcctgctcagcgctgagggtatgcaacgcctgcttgacggagtacgggcgtcactgccactctcttcgcaggcagaaatcacgatggaagccaatccgggaactgttgaagctggccgtttcagcgcttaccagaaagcaggtgtcaatcgaatttccatcggcgtacagagctttggttcagataagttgattcgtctagggcgcatccatggcccagacgaagcaaaacgggcagcacatttggctgccgaccttggtttacgcagtttcaatctggatttaatgcacgggttgcccaaccaaacactgaatgaagcattggatgatttacgtcaggcgattgaactttctccgccacatctgtcttggtatcaattgacgattgaacctaataccagctttggttcccgcccgcccgttctaccggacgatgatgcgctatgggatatcttctcccaagggcatcaattattgacagctgcgggctatcagcaatatgaaacttcggcctatgccaaagcgggttaccaatgtcagcataatctcaattactggcgttttggtgattacttaggtattggctgcggcgcacatggaaaaatttcgtttgaagatggccgtattctccgtacagtcaaaaccaagcacccgcgcggttatatgcagggacgttatttagatcaacaaaatcaattggataatgaagatcgtccatttgaatttttcatgaaccgttttcgcttgctggaagctatgccacgacacgatttcagtgattttaccggattaccggaaagtgccattcgtccacaacttgatgaagcactggctaaaggttatatcactgaaaacgcgacgcattggcagatcaccaaacacggcaagttattcctgaattcactgttagagctgtttctttaa

SEQ ID NO: 4764 - DNA, 594 bp, Xenorhabdus bovienii
  Coding sequence Name=Xb4151_4152.C443.gene280.dna; Position on contig= 234128..234721bp; Strand=-
atgcaaaaaattgttctcgccacaggcaatgctggcaaagttcgtgagttggctgatttactgactgactttggcttagatatcgtggctcaaaccgagctgggtgttgattcagccgatgaaacaggtctgactttcattgaaaatgccatcatcaaagcgcgccatgcagcagcaataacggggttacccgcaatagcagatgattcagggctatcagtcaatgccttaggcggcgcaccgggcatctattctgcccgctacgcaggtattgatgcttccgatcgggataatctggaaaagctgctggaagcgatgcgtgatattcctgatgaaaagcgccaggcacaattcaattgtgtactggtctatctacgccatgcagaagatccgactccactgattttccacggtcgctggtctggcatcattacccatgaacccgctggcaatggcggttttggttatgacccgattttttatgtgccagaatttggctgtacggcagcagagctgagtcacgaacaaaaaagtgcagtttcacatcgtggacaagcgttgaaaatgctgttggaagccatgcttaatgcttaa

SEQ ID NO: 4765 - DNA, 564 bp, Xenorhabdus bovienii
  Coding sequence Name=Xb4151_4152.C443.gene281.dna; Position on contig= 234752..235315bp; Strand=-
atgcaattcttaaactttatctttcttaccgttctagatttatatattgcggttttactgcttcgagtctggatgcaatgggtacgttgtgatttttataatccattcgcacaatttatcgttaaaatcacccaacctgtggtacgcccattacgcaaggtcattcccgccattggtcctatcgatacagcatccatagtgtttgcctatctaatcgttcttcttaagatgctgatacctgcatggctcgcaacgggacaatttgtgatacctctcgcgattttgttcctagtcggaatgattgaactgcttaccgcagccggaaaactcatattctggctcgtcattgcccgtgcattattaagttggatcagtcaaggacgcaatccggttgactacgttttgattcaattgactgagccattgatggcacctatccgtcgtatcattcctgccatgggtggcattgatttttctgccatgattgtcatgttagttctctacgcgctgaatgtcctacgttacaatgtcatgacgtggttaatttcaatgataagcggttga

SEQ ID NO: 4766 - DNA, 957 bp, Xenorhabdus bovienii
  Coding sequence Name=Xb4151_4152.C443.gene282.dna; Position on contig= 235349..236305bp; Strand=-
atgatatggaagctgctatctcctgcggctctacactggtgcgcattggaacggcaattttcggtgcccgtcagtacaatactcaaccctaaattaactggccaaaatcaactgattaatatgcgggactatttaatgaaaaatcgtaaaatcacctttattggcgctggaaatatggctcatgccattatcgccgggctggtcagaacaggttatcctgctgaattcatcacggtctgctccccaaatacaacccgtcgtgacgttctggcaaaagagtatggcatcaacagcgaaaacgataacattcgttatgcccaggaagccgatgtcattgttctggcagtaaaacctcaaatgatggaagaagtttgtgattcactgcgttcacaaatagatttcagtcataaactggtactctctattgccgcaggtattccagttgcccgtttttacacgctgttgcaagataacctcaatatcatccgcatcatgccaaatacgcccgcacttgtggggcaagggatcagtggcctatttgcgcctgagtacgtcactcagcctgatcgccagtttaccgaatcactgatgtgcggtgttggtaaagtctgctgggtcaatgatgagaatggcatcaacaatattattgccgtcgcaggcagtgcgccggcttactttttcctgtttatggaatccatgcagcaagaagctgaacgtctgggattcgatagccaaactgccagagaacttgtcctgcaagcggctacaggttcggctaaacttgctgagtcacaggcagatcttccttttgctattctgcgcgagcaggtaacatctaaaggcggtacaactgccgaagctctgcgcattttttatgaaggccatctacctgagatcgtatccagcgccatgcaggcagcaatccgccgagcgcaggaaatggaaaaactattttaa

SEQ ID NO: 4767 - DNA, 702 bp, Xenorhabdus bovienii
  Coding sequence Name=Xb4151_4152.C443.gene283.dna; Position on contig= 236214..236915bp; Strand=-
atgaacaatatcgaacaaaatcttcacgatgtcaggaaccgcatagcccttacagctcaaaagtgcggacgctatccacaagaaattacgctgcttgcagtcagtaaaaccaaacctgcggacgctatcgcaaaagccatagagactggtcagcgggaatttggtgaaaactacgttcgagaaggggttgagaaagttcaacactttgctaatcataatgatttggtatggcactttatcggccctttgcagtccaataaaagtcgcttggtggcagaacattttgactggtgccataccatagaccgattgaaaatagctcaacgcttaagtgagcaacgccctgaaaacatggcgccacttaatatcctgattcaaattaatatcagtggtgaagacagcaaatcgggcattattctgacagcactgccggaactggcaaagaccataaatgcgctacccaatctggtattacgtgggctgatggcgatccctgcaccagaaagcgattttgaacgtcagatggcgatatttcaccaaatggaacaagcatttattgaattgaaaacgcaatatccacgagttgatacactttcaatgggcatgacggatgatatggaagctgctatctcctgcggctctacactggtgcgcattggaacggcaattttcggtgcccgtcagtacaatactcaaccctaa

SEQ ID NO: 4768 - DNA, 1011 bp, Xenorhabdus bovienii
  Coding sequence Name=Xb4151_4152.C443.gene284.dna; Position on contig= 236937..237947bp; Strand=+
atgaatatggaaaaattggtggctcttagtgtaaagcataatgcttctgatctgcatctttgtgtcgggaaagttccggttttgcgcatcaatggtgtgctgtacccacagatgcaactggcagaaatgcagggtgataccctcattgcatggagtaggaaaatattgaccgaagaacaacagcagcagttacaggaatacggtcatgttgattttgtggtggaaatgccagataagcagcggttcagggggaatctgttttaccaacagtgtcatgtttcattggtattgaggttaatcgcggataaatgtcctactctggaacaattatatgcaccggacattatccaacgtctgattttgcaggagcaaagcgggttggtattagtaacaggcgcaacgggaagcggtaaatctactactttgtcggcgataatcaatgcgttcaataatcatggcaacaaacatatcattacgttggaagacccaatagaattcgttcatcaaagccgaaattgcctgatacagcaaagacaaatcagcagggatgtgccggattatcaaacggctttgaaaggtgcattacggcaagatcctgatgtgattttgctgggagaattgcgtgacaaagagacgatccgcttggcattgacagcggctgaaacaggacatctggttctgtcaacattacatacccgtggggcaattcaagcactagatcgtttggttgatgttttcagtgcagaagaaaagggctggatatgcagccaactggcaggaagtttaaaagcagttatttctcaacaactgcttcctgccagagaagggggaagagtagccatttatgaagttctggtcgtcaaccaagcggtcagccatttgatcagggaaggaaaaaatcatcaaatcgcgacattaatgcagacaggagctgcctacggtatgcaaactcatgagcaaagccgacaacaacgtgagttgttgggattgctggctgttgttccacaatga

SEQ ID NO: 4769 - DNA, 426 bp, Xenorhabdus bovienii
  Coding sequence Name=Xb4151_4152.C443.gene285.dna; Position on contig= 237973..238398bp; Strand=-
atgaaaaaccgtacaataatcgcattcgatttcggtactcacagcattggtacagctatcggacaagagataaccggtacagccagagcattgagtgctttcaaagctaaagagggttctcccagttgggaactcattgaaaaacttctcaaagagtggcaacccgatttgatcattgtcggattaccactaaatatggatggcacagaacaactcgttaccgctcaggcgcgtaaatttgccaatcggctacacgggcgttttggcgttcaggttgaactgcacgatgagcgattgaccaccatagaagcacgctctcacctgttcgatcacggtggttataaggctctggataaaggcaaagtcgattctgtttctgctgtcgtcattctggaaagctggtttgagcaacaatattcacaataa

SEQ ID NO: 4770 - DNA, 564 bp, Xenorhabdus bovienii
  Coding sequence Name=Xb4151_4152.C443.gene286.dna; Position on contig= 238398..238961bp; Strand=-
atgaacctacagcaccattttcttattgccatgccttcgctctctgatccttatttcaaccgttcggtagtttatatctgcgaacacgatcaaaacggggcaatggggttagttatcaataaacctatagcccaaatttctatccaaagcatcctagaaaaattggatatcactcccgaaggcagagacgacagcatcaatttagataaacctgtgatggcaggtggcccactgtctgaagaacatggctttatcttgcacactccgcaatccgggttcagttcaagtatccagatctctgatgaaacgatgataaccacgtccaaagacgtgctggaagcattaggtacaacacgccagcccgaaaatgttttaatgaccctggggtattcaagctgggaaaaaggccagttagaacaagaaatcatggaaaatagctggctgaccgtcagtgcagaatcctctatcattttcgagacccccgttgctgatcgctggcatgaagcggcttcactgctcgggatcaatatttacaacctcgcaccacaagcagggcatgcctga

SEQ ID NO: 4771 - DNA, 960 bp, Xenorhabdus bovienii
  Coding sequence Name=Xb4151_4152.C443.gene287.dna; Position on contig= 239053..240012bp; Strand=-
atgatcaagctcggcatagtgatggatccaatttcatccatcaaaatcaagaaagacacaagttttgccatgttgctggaagcgcagaaacgtgggtgggaaatccattacatggagatgaatgatctctatctacatcaaggggaagcccgcgcccgtacccgtctgctcacggtcgaagaaaacctacagcaatggtatcagttcggcagcgagcaagagattgctctcgataacttgcatgtgattctgatgcgcaaagatcctccttttgatacagagtacatctatgctacttatattctggaaagggcagaagacaaaggcagtttgatcgtcaacaagccacagagtctgcgcgactgcaacgaaaaactgttcacagcctggttcccagagttgacaccagatacactggtgactcgcaatgcaaaaaccttacgtgagttccatcaaaaacatggcgatgttatctttaagccactggacggtatgggaggcgcgtctatcttccgtttaaaacaagatgacccgaatatcggtgtcattattgaaacgctgaccgaacatggcagccgttattgtatggcgcaaaatttcttgccggccattaaggacggggataaacgtgttctggttgttgatggcgagcctgtaccctattgccttgcacgcatccctgcacagggcgagacccgtggtaaccttgcggcaggtggacgcggagaagcccgccctctgtcagaaagtgactgggcaattgcccgtgctgttgcaccagttttgaaagagaaagggttaatctttgtcgggcttgacatcattggcgatcgtttgactgaaatcaacgtcaccagcccaacctgtgtacgtgaaatagaagctgcattcccagcaatttctattactggtatgctgatggatgccatcgaaaaacgattggaaaaacagcctgcataa

SEQ ID NO: 4772 - DNA, 732 bp, Xenorhabdus bovienii
  Coding sequence Name=Xb4151_4152.C443.gene288.dna; Position on contig= 240022..240753bp; Strand=-
atgcgaattccccgcatctatcaccctgaacggctctccgtagagacggaaatctatctgagtgatgaggctgccaaccatgttggccgggtacttagaatgagtaatggacagccattacagttatttgatggcagcaatcaggttttcgatgcagaacttattgaagccagtaaaaagacaatcaaagtacgtattaccgatggcaaactgtccgatcatgaatcaccactaaacctgcatctggggcaagtaatgtcccgtggtgaaaagatggaattcacaattcaaaaatcggttgaattgggtgtcaataccattactccactactttctgaacgctgtggtgtaaagctggatgcggaaaggctagagaaaaaattacagcaatggaaaaaaattgttatctctgcctgtgagcaatgtggacgtaactgtattccagaaatccgcccggtcatgtcacttgaagcatggtgcgcggaaaacgatggtagcctaaaattaaatctgcatcctcgtgccagccaaagtatcaacacactgccactgccagtcgaaaaaatacgcctgttaatcggccctgaagggggattatccgctgaagagatcgaaatgacggcaaatcaccaatttactgatattctgttaggccctcgcgttttgaggacagaaactacggcactcaccgcaattacggcattgcaagttcgtttcggtgatctgggttaa

SEQ ID NO: 4773 - DNA, 120 bp, Xenorhabdus bovienii
  Coding sequence Name=Xb4151_4152.C443.gene289.dna; Position on contig= 240711..240830bp; Strand=-
atggcgatgaatcaactttgtgatatggctattgcgccataccggaaacatccggacaaaagaaggaaagaagaaatatgcgaattccccgcatctatcaccctgaacggctctccgtag

SEQ ID NO: 4774 - DNA, 507 bp, Xenorhabdus bovienii
  Coding sequence Name=Xb4151_4152.C443.gene290.dna; Position on contig= 241057..241563bp; Strand=+
atgttttcatggatgataataaaggatggtttgaccaatatggatagtataatgattatggttttctgtagtgtattaatttttttatcaatcattgatattaaaacttatcaattaccagatgttatcactcagcctttattatgggttggccttatttttaatagcagtgagaatttagtatcgatcaagagtgcgatatatggtgttatatcagggtatctatttttatggttattaaataagttctgtcgatatatattaaagaaagagggaataggatatggtgatctgaaattaacggctgctattggtgcgtggctgggtatggaaatgatccccgtattgatgttgctgtcttcaatatctggactgttcggatttatgatagtttggtttaaaagaaaaacatatcctgattttattgcatttgggccttatatttgtttgtctgcgatagtgttgatggggcttagagtcagtaatatcgatatcatggggatttaa

SEQ ID NO: 4775 - DNA, 816 bp, Xenorhabdus bovienii
  Coding sequence Name=Xb4151_4152.C443.gene291.dna; Position on contig= 241638..242453bp; Strand=+
atggtattaaagattacggcactactggaaaatcaggtttttgcgccctacaaaacggcgttgaccggtaaacccggactgagtttactgattcagaatcaagataccacaatcctgtttgacacagggccagatggcagctttattgataacgcaaagaaattaaatatcgacttatctgtggtctcaacggttgtgatatcacacggtcattttgatcattgcggtgggctaccttttttttctactgatgccaaagttatttgccatcctgatgttaaaaatgaaagatattatggttgggtgatcaccgacaacaaagcacttacattcaaaaaactatccaagcaagttgattacggaaaatttgatacttttttctcaaaggatgaaactcatattaatgatagtttcgtctattcaggagagattaaaaaagaagaaaacaaatgctatggcgttattgttggagaaaaagtcgaaggaaaatattctcctgattttgttaaagatgaaggtgttttaatttataaatctagacatgggttaattatttttatagggtgtgggcatcgtggtgttattgaaattataaaattttgtaagaagataacgggtattgatcaagtttatgcagttattggggggctacatttacgttatgcttcaccgtttaaactattgcctatcagaaaatacatcaaaaaagaaaatatacggcatgtttatgcttgccactgtagtggtatgtgggggaggttatggttacctaatgctaaaagtctttctactgggcagtcaattgagattgattaa

SEQ ID NO: 4776 - DNA, 885 bp, Xenorhabdus bovienii
  Coding sequence Name=Xb4151_4152.C443.gene292.dna; Position on contig= 242594..243478bp; Strand=-
atggctcgcaaaacaacattaaatatcgctctggcggcgaccctttctctgggagtggcatcactggctcaagcaactaatctcaagttggatatctacaatccaggtgaaactggtgtattccctgtctcttctgaaatcatcagtggcgaccatgaagttgtcctgattgatgcgcaatttaaaaagagtgatgcccaagagctggtaaaaatgatccagcaaaccggaaaaaaactgacaacgatctatatcagccagtctgatcctgatttttactttggtcttgatgtgatcacgacagccttccctgaagccaaagtgatcgcttcacctgaaaccatcaaaaccatcaatgaaaccaaagacggtaaactggcatattggggtggcattctacaagatcaggccccgaaaaaggttattgtgccagaaccactgaaaggaaataccttcaccgttgacggtgaaaagctgatcgtggaaggtttagatggcccagccgcagatcgtactttcgtttgggtgcctaaattaaaagctgttgttggcggcgtcaccatttctggcaatatccatgtatggattgcagatactcaaaccaaagtatcacgccagcactggatgcagacattagatcgcatcaagagcctgaaacctgacactattgtacctggccattatgtaggtaatgcaccgatgacgctggaatcagtcacatttacgcaaaagtatctgaccacactggaaaaagagttaccaaaagccaaagattcagaggcgttgattgcagctatgaagaaacactatccaaaccttgctgatgaatccagccttgaactcagtgccaaggtattgaaaggtgaaatgaagtggcctcaataa

SEQ ID NO: 4777 - DNA, 132 bp, Xenorhabdus bovienii
  Coding sequence Name=Xb4151_4152.C443.gene293.dna; Position on contig= 243418..243549bp; Strand=+
atgccactcccagagaaagggtcgccgccagagcgatatttaatgttgttttgcgagccattattgaattcctgtatcaaaatgtttatttgcttgaatggcacgtataataagttgcatatttcgatttaa

SEQ ID NO: 4778 - DNA, 915 bp, Xenorhabdus bovienii
  Coding sequence Name=Xb4151_4152.C443.gene294.dna; Position on contig= 243618..244532bp; Strand=+
atggataggatcacggcagcacaggtttttgtcacgattgtggagcaggggagtttggttgcagcggcggaacggcttgatatgtcacgggcaatggtgtcgcgttatctggctgaaatggagaaatgggcaggtgttcgtctactgcatcgtacgacacgtaaaatcagtctgacttcggcaggagaaaatgcttatcagcgcagtctgaaattgctggaattagcggagacaatgcccgttcagcaatcactggtatcacaaaccctgagagggttgctgagagtgagctgttctcaatcgctgggtactagcgcgttgtctgttgctattcctgaatttatgcgcatatatccacaaattgccgtcaacttgcaaattaacaacaaagttatcaacttgattgaagagcgtattgatttagcgattcgcattactaataatttggaaccgaatctgattgcccgtccattatccatttgtcattctgttgtttgtgcggctccttcttacttagatagaaaaattattccgcagaaacccactgatttagcctcacataactgcctgacatataatttttttggcaaaagtttgtggttgtttgaaaaacaacatgaacagtattcagttcctgtcagtggtacgcttagtgccaacgaatcaacagtactgatggaagcggctttacagggagcaggcataaccatgcagccttattattctgctgctccgcatttaatatccgggcagttggttgagttattgccggattatcaacctcaggcaatggggatctatggtatttataccagtcgtcagaatatgccggttactttacgggcattgttggattttctggtgggctggtttgctaatgcaccccattggcagcagttaatgttgaaaagctaa

SEQ ID NO: 4779 - DNA, 930 bp, Xenorhabdus bovienii
  Coding sequence Name=Xb4151_4152.C443.gene295.dna; Position on contig= 244515..245444bp; Strand=-
atgcactcttgttcatggcgacacattgagatttttcacgcagtaatgaccaccaaaaacctgactgacgcagcggtgttgttgaaaacttcgcaacccactgtcagccgtgaactggcgcgttttgaacagttgctgaaattcaaattatttgatcggatcaaagggcgtttatttcccacagcacagggattgcgattatttgaagaagtccagcgttcttattatgggctggaaaggatacttaatgcggcagaaagcattcgtcaatttgaacatgcgcagctttctatcgcctgcctgccagtgttttcccaatctttactgccaaaagcctgccatagttttattcaacgctatccggaagcgaagctgaccatcatcccgcaagaatccccgctgttggaggaatggctttcagcacagcgccacgatatcggtttgaccgaacatttgcagactcccgcaggcactgagcaagaaacattgattaccttgaatgaagtctgcgtcctgcctgccaatcatccactcagtcaaaaatcacaactgacgccagaagattttcatgagcaaaaatttatcagcctgtcgataaccgacagttacaggcagctcattgataccatatttagcgaacatcatgtcaatcgcaatatgatcatggagacacacagcgcggcgtcaatctgtgccatgatcagtgaaggtatcggcatgtctgtcgtgaatcctttaactgccttggattatctggataaaaatgcggggatttgcgtccggccattcagtatagacatcccattcacggtcagtttaatcaaacccatacatcggccattctcggaacccgtcgaaatattcattacccatttgaaacaacagaccggccagtttccgctaaaactggcattagcttttcaacattaa

SEQ ID NO: 4780 - DNA, 1284 bp, Xenorhabdus bovienii
  Coding sequence Name=Xb4151_4152.C443.gene296.dna; Position on contig= 245630..246913bp; Strand=+
atgacgatatcaactttgactggtttttcaggcgaaaaatttactccagagaatctgctgcgtttacccgttgattacggaacaccattatgggtttatgacagtgacattattatccgaaaaatcaatcgattaaagcggtttgatatcattcggtttgcacagaaagcctgctctaatacccatatcctgagtttgatgagagcacagggagtaaaagtggatgcggtgtcattgggggaaattgaacgggcactttatgctggatatcagcccggccgtgatcgatccgaaattgtgttcactgcggatttgattgatgaaataacacttaatcgagtgattgagttggatattccagtcaatgtcggctccattgatatgctggagcagattggtacacgtcagtcgggtcatcctatttggctacgcattaatccgggatttggtcatggtcatagtcagaaaaccaatacgggcggcgaaaacagcaagcacgggatctggtttcaggatttaccgctggcgattgagaaagtccgccaatatgggctgaaattggttggattacatatgcacattggttctggagtggattatcaacatcttgccaatgtatgtaacgctatggtggaacaagttatatcgtgcggtgaggacattcaggccatttcagcaggaggcggattatcaattccttataaaacgggtgatgaaatagtggatactgaacactattacagtctgtggcataaagctcgccagcgcattgaacggcacttggggcatcatgttgaactggaaattgagccaggccgttttctggtggctgaatcaggtattttgatggctgaagtgagggcagtaaaaccaatgggtagccgtcattatgtgctggtggatgcgggtttcaacgatttgatgcgcccaacgatgtatggaagctatcatcatatttcagttttatcggtgaatagccagcatattgatgaggctgtttcgcaggatgctgagttacatgaaacgttagttgcagggccgttatgtgaatcaggtgatgtgtttactcaatcagcaggaggcgatgttgtgccgcgtttgttgcctcgcgtttgtgtaggggattatttgattttccacgatacaggcgcttatggtgcatctatgtcttcaaattacaatagtcgccctttgatccccgaaattttgtttattgagggtgacgcccgtttgattcgacgtaggcaaacaatagaagaattgctggcattggaagcggtataa

SEQ ID NO: 4781 - DNA, 2037 bp, Xenorhabdus bovienii
  Coding sequence Name=Xb4151_4152.C443.gene297.dna; Position on contig= 246974..249010bp; Strand=-
atggcaaatgatttccaaattagccatgagttagccgatcttcctccagaactctggacatacctgaaggaaaatcgcttctttgccatgatcatcaagaaagaatatggtggcctggacttttcagcttatgcccaatcacaagtactgcaaaaactgtctggtgtctctggtattctggcgattactgtcggggttccaaactcactggggccgggtgaattattacagcactatggtacagatgagcagaaaaaacattaccttcccggccttgcccgtggtgaagaaatcccctgctttgccttgaccagcccggaagcaggctcagatgccggagcgattcccgatactggcgtcgtctgtatgggtgaatggcaaggcgagcaagtgctcggtatgcgtctgaactggaataagcgctatatcacccttgctcctatcgcgactgttttgggattagcattcaaattgtatgatcctgaacatttgatcgggaataccgagtcattgggtataacctgtgccttaatccccactaataccccgggggttgaaatcggcaaccgccatttcccactgaatgttccattccagaatgggccaacccgtggtaaggatattttcgttcctatcgattacatcattggtggaccgaaaatggcgggtcaaggctggcgtatgctggttgaatgtctatcggtcggccgtggtattaccctgccatccaacgcaacaggtggattgaaaagtgccgccatggcaatcggtgcttactcttatattcgtcgccaatttaaacttccgattggcaaaatggaaggtatcgaagaaccactggcccgtattgcaggtaatacttatctgatggatgctgcggcaactatgatcacaggcggcattatgctgggtgaaaaacctgcggttctgtctgctattgtgaaataccactgtacccacagagggcaacgctcgattattgatgcaatggatatcgctggcggtaaaggcatctgtcttggcccatccaacttccttgcccgtgcctatcagggtgcccccattgctattaccgtagaaggcgctaatatcctgactcgtagcatgatcatctttggtcagggtgcgatccgctgtcatccttatgtactggctgaaatagccgcagcagaaaataacaatgtcaaagcctttgataaagccctgtttggtcacttgggtcatgttgccagcaataccctgcgcagcctgtggcttggcatcactaatggcagaaccagccgtacgccagtcagcgatgcaactcgccgttactaccagcacatcaaccgtctaagtgctaaccttgccctgctctctgatgtttcaatgggtgtattggggggaagtctgaaacgccgtgaacgcatttcagcgcgtcttggggatattctgagtcaaatcttcctggctacagcagccctgaaacgctatgaagacgaaggccgtcagaaagaagatctgccattgttgcaatgggcggtagaagatagtctgtatcaggcagagcaggccctgaacgatttactgcgcaatttccctaaccgtttggttgctggtttaatgcgagtgatggtgttcccattgggtcgttcacatactgcaccgtctgataaactggatcataaactggctcagatattacaaacaccttccgcaacgcgcagccggattggtcgtgggcaatatctgacaccaagcgagcataatcctcatgggttattggaagaagctctgcacgatatcattgccgcagaacccattcatgcacgcttaagccgcgaagcaggcaaaaacctgagctttacacgtctggatcagttagctgaacgtgcactggcggatcacaagatcacccaagaagaagcagatattctgaaacgtgcagaaaatagccggctgcgttcaatcaatgttgatgaatttgagccggatgcatttgctgtacctcattcagcaaaaaagcctgaaagtcagcgtcagactaaagccgcttga

SEQ ID NO: 4782 - DNA, 360 bp, Xenorhabdus bovienii
  Coding sequence Name=Xb4151_4152.C443.gene298.dna; Position on contig= 249061..249420bp; Strand=-
atgaccgctctcagcattattttgtttttagtcttgattggcgggctttgttaccgcaaagtcagcctgtctgccagcagcctgctgcttgttgcctatacactcgtcatgggcataacgggtctttggagctactggttgttattgccacttgccattattctgttcccccttgtctttacaccaacgcgtatatctctattctctgcacccggcttaaaagcattccgtaaagtcatgcccagcatgtctaccacgagaaagaagccattgatgcaggaacaacctggtgggaaggtgagctgttccgtggtaatcctgattggcaaaaactgcacagctatccgaaaccacagttaa

SEQ ID NO: 4783 - DNA, 153 bp, Xenorhabdus bovienii
  Coding sequence Name=Xb4151_4152.C443.gene299.dna; Position on contig= 249490..249642bp; Strand=+
atgaggaaaacgtatttatcaatatatttacatcttaattacaatctagctcacaaagtcattgtagtttgctgtgtgaaaatttcattgagatgtgatggcatcttctttcaggagagggaatccgttacactgatcggcagattttattaa

SEQ ID NO: 4784 - DNA, 582 bp, Xenorhabdus bovienii
  Coding sequence Name=Xb4151_4152.C443.gene300.dna; Position on contig= 249673..250254bp; Strand=+
atgtatcaagatctgatccgcagtgagttgtctgaagccgcagatacgctggctaaattccttaatgatgatgcaaatattgacgccatccaacaagcagccgttttgctggctgattcattcaaagcaggcggaaaagtactttcctgtgggaatgggggttcacactgtgatgccatgcattttgcggaagaactgaccggccgttaccgcgaaaatcgtccgggctatccgggtatcgcgatttccgatccgagccatttatcctgtgtgagcaatgattttggttacgattatgtattttctcgttatcttgaagcggtagggcagaaaggcgatgtactgttgggaatttcgacttcgggtaattccggcaacatcatcaaggcgattgaagcagcccgtgcgaaaggcatgaaagtcatcacgctgacaggtaaggatggcgggaaaatggcaggaacggcagatgttgaaattcgtgtgccgcatttcggttatgcagatcgcattcaggagatccacatcaaagtgatccatatcttgattcaactgattgagaaagaaatggtaaaagactga

SEQ ID NO: 4785 - DNA, 768 bp, Xenorhabdus bovienii
  Coding sequence Name=Xb4151_4152.C443.gene301.dna; Position on contig= 250281..251048bp; Strand=+
atgtgcgaattacttggaatgagtgccaatgtgccaacagatatcgttttcagtctgagtgggctcattcagcgtggagggtatactggcccccacaaggatggatgggggatcaccttctatgaagggctgggataccggacattcaaagatcaccaatccagttatcattcacctgttgctcgctttgttcagagctatccgattaagtcagaagttattgtcgctcatatccgtcaggcaaaccgaggcaatgtttctctggtaaatacccatccgtttacccgtgaactatggggaaaatattggacttacgcccataatgggcaattgcagggataccgtaacctgaaaacaggcaattaccgaccggtcggtgagacagacagtgaatgggcattttgctggatactgcaacaattatcgctcaagtaccccaaacggccttccaactggcctgcggtatttcgctttattgcatcgctggcaggtgagctgaagaaaaaaggggttttcaatatgctgctgtcagatgggcagtttgtcatggcctattgctcgacccaattgcattggatcacccgtaaggcaccttttggcacggcgaaattgcttgatcaggatgttgaaattgattttcagcaacatacccatcctggtgatgtggtgtcagtgattgctacccagcctttaaccggtaatgaagattggcaacgtattgaaccgggtagctatgagttattttactttggtgaacgtgtagtctga

SEQ ID NO: 4786 - DNA, 204 bp, Xenorhabdus bovienii
  Coding sequence Name=Xb4151_4152.C443.gene302.dna; Position on contig= 251024..251227bp; Strand=-
atgacgcaacagaatatgcagcgttatcgcaataacgataattattcgttttggatccaattacagcccgcctatgaatactttgccaaaaatagcaaacctaccactgtcaacgtaatagacgggcaatatattgtgagtacaaaatccgaaagttcgttactcttaagtaaatcaactcagactacacgttcaccaaagtaa

SEQ ID NO: 4787 - DNA, 1278 bp, Xenorhabdus bovienii
  Coding sequence Name=Xb4151_4152.C443.gene303.dna; Position on contig= 251168..252445bp; Strand=+
ttggatccaaaacgaataattatcgttattgcgataacgctgcatattctgttgcgtcatcctgaaagggtaaatatttattcagggcaatcgcatctaaaattcattgacaatggtttaatttcatgtcgttatgcagcttttaaatccatccttatgtcctctgtcagccctttgttacagcattttgcctcacttgaagatccccgagttcaacgaactcagttgcatagtttggaaaatatcctgactatcgccatctgcgctgtgatttgtggcgctgaaggttgggtcgaaattgaagagtttggcgaatctaaacaggatttctttacccaactgcttgatctcactaatggcatcccctctcacgatacctttggtcgtgtctttgctgcacttgatgcgcaggcttttgccgactgtttcacctcctggatatctacgctggcacaaggagttgatcaggatatcatcgctattgatggcaaaaccatgcgccggtcactcgataaagccaacggcaaggcggcaatccatctggtcagcgcctttgcctgtaccaatcgcttagttctgggacaagtgaaagtggagagtaaatccaatgaaatcaccgctattcctgagttacttcgacgattggttttgtctggaagtctggtgactatcgatgccatgggatgccagaaagcgattgctcatcaattacatgaagcgggcgcggattacgtactgagcctgaaagaaaatcatcccggcctgtataatgatgtcagccattatttcgattatgtctcatcccaaccggagcacctgagcgaatatgaagacgtggatgccggacatggccgcattgagcgacgcacagtacaaatgacccatgttgattggttgccggaaaaggcgtgctggtgtggtttacacagcataatacgggtgatccgcgaacgctatgtaggaaatgaagtgagccgggagagctgttattttatcagcactttacgtccgacagaggctcaacgggcagcgacagcgatccgcagtcactggcaaatagaaacgcaactccattggtgtctggatattgcttttaatgaagatcagcagcggatgcgggaaggcaatgcagccgccaatatggcattactcaataaaatcgcgttgaatttactgcgcttagctcccaccaaagcgggaattaaagcacgccgtaaacgggctggttgggatggtgaatatctacttacagtactgggcaaagcgcatcaaatttag

SEQ ID NO: 4788 - DNA, 543 bp, Xenorhabdus bovienii
  Coding sequence Name=Xb4151_4152.C443.gene304.dna; Position on contig= 252442..252984bp; Strand=-
atgaaaaaaacggcgttttatctctcactgttgctgttattccatatgtcctgttctgctctggcgcaaagcactccatcgtggctccagtcacccaatgaacgacgcccgctgaaacaacctggggccgagattttcattcaaatattcaaagaagaaaaagtgcttgaactttatactaaagacaacacagaccattaccaattagctcaaagttatcctatctgtaattactctggagggcttggccctaagacactgacaggagatttcaaaagccccgaaggtttttatcatgttaaccttaaacaattaaagcccaatagccgctattatcgcgctattaatttgggttttcccaatgaatttgataaattccgaggctattctggtaataatttaatgattcatgggggatgtaaatccattggctgttacgccatgaccgatcgctatatagatgaaatctaccgatatgcggaaagtgcaatatcttacggacaggatgaaatcaaaataaatattcaaggcaatcgcatctaa

SEQ ID NO: 4789 - DNA, 96 bp, Xenorhabdus bovienii
  Coding sequence Name=Xb4151_4152.C443.gene305.dna; Position on contig= 253217..253312bp; Strand=-
atgtctcaagttattcactccgataatcgttacaattttctcttaattttctccgacggtaattctaacatctcccctcacaagctgtctgactaa

SEQ ID NO: 4790 - DNA, 1344 bp, Xenorhabdus bovienii
  Coding sequence Name=Xb4151_4152.C443.gene306.dna; Position on contig= 253420..254763bp; Strand=+
atgattaaaattaaaaaaggactcaacctcccaatagcaggagcgcctgcccaagttatagaagatggtccgacaattcgtcatgtcgctttattaggcgaagaatatgttggaatgcgtccttctatgctggttaaggaaggtgagcatgtcaaaaaagggcaaattctttttgaagataaaaagaatccaggggttatttttacgagtcccgctagcgggaaaattattaccatcgggcgtggagaacgccgtgtacttcaatctgttgtgattgaggtgagtggtgatgagcaagtcatgtttgatcgctatgatcgtacagaacttgctggcctgacacgtgaacaggtggagaataacctgctcatatctgggttgtggacggcattacgtacacgtcctttcagtcactctcctgctcccggttccacaccaaaggcaatcttcgttactgcaatagatactcagccattggctgccgatccattagtcgttattgcgacgcaggaagaggcttttgttgatggcctgaatattctgtcaatattgacagatggaaaagtccacgtctgccatggcgctggaaatattccaaatgcaggaaacaacactcaaattacttacaatcaatttgctggtccacatccggcaggtctggttggaactcacattcatttcattgaaccggttagcgccaagaaaagcgtatggcacttggggtatcaggatgttattgccattggtaagttattcacaaccggtgagctttacactgatcgagttgtatctctggcgggtccacaagttaaatccccccgcttagtacgtagccgtctgggagctgatttgcaagagctgactcaagatcagctgaaagaaggtgaaaatcgtattgtttctggctctgtactgtgtggtaccaaatcagatggagttcgtcattatcttggtcgtttccatactttggtttctgttcttgctgaaggccgtgaaaaagaattatttggctggattgcaccaggcgttaataagttctcgattacccgtaccacgattggtcatttcctgaaaaataaacgttttgccttctcaaccagcacgaatggtggggaacgctctatggtgccaatcggcaactatgagcgagtgatgccactggacatcatggcaacgcatttgttgcgcgacttgcttgcaggcgatagcgacagtgcccaggcattaggttgtctggagctggatgaagaagatttagcattgtgtacctatgtttgccctggcaaatatgagtacggtccggtactgcgtgatgtgctgactaagattgagcaggaagggtaa

SEQ ID NO: 4791 - DNA, 1239 bp, Xenorhabdus bovienii
  Coding sequence Name=Xb4151_4152.C443.gene307.dna; Position on contig= 254767..256005bp; Strand=+
atgggcctgaaaaatttatttgaaaaagtagagcatcactttgaggccggtggcaaactggaaaaatattatcctctgtatgaggcagtttccaccgtcttctatactccgggaacagtaacgcgagggcgtgcccacgtccgtgatgccatcgatctcaaacgcatgatgattttggtctggttatctgtttttccggcaatgttctggggaatgtataacgtcgggaatcaggcaatacctgctctgactcatttatacagcggagaagcgctacagcaggttttagcttctgattggcattacgtggttgcccagtatcttggtgcatcactgacgccggatgctggctgggacagtaagatgttgctgggtgcaacctatttcctgccaatttatgctgtagtgttcgcggttggtggtttctgggaaattctgtttgccatgatccgcagacatgaaatcaacgaaggtttctttgtcagttccatcctgtttgcgctgattgttcctccgacattgccattatggcaggctgctctggggatcactttcggtgtggtgattgcgaaggaaatatttggtggtacaggtcgtaacttccttaacccggcattggctggtcgtgccttcttgttcttcgcttaccctgcccagatttcaggtgatctagcctggacggcagctgatggtttttccggtgcgactccattgtcccagtgggcaaatgcaggtagtcacggtttaatgaataccattaccagccagcctgtcacatggatggatgctttcattggtaacatcccagggtcaattggtgaagtttccacactgatgattttcatcggtggagccatcattctgtttacccgcattgcttcatggcgcattgttgccggcgtgatggtcggaatgatagccatgtcttatctgttcaatgcaattggttcaagcactaacccaatgttctctatgccgtggtactggcatatggttctgggtggcttcgctttcggcatgatctttatggctactgatcctgtatccgctgcattcacggataaaggaaaatgggcatacggcattctgattggtgtcatgtgtattcttatcagagtcgtaaacccagcatacccggaagggatgatgttggcgatcctgttcgctaacctgttcgcgccactgttcgattatctggtcgtgcaggccaatattaagcggagaaaagcccgtggctaa

SEQ ID NO: 4792 - DNA, 795 bp, Xenorhabdus bovienii
  Coding sequence Name=Xb4151_4152.C443.gene308.dna; Position on contig= 255998..256792bp; Strand=+
gtggctaatgagaaaccaaaaaataatgacagcattggcagaacattcctcgttgtttttgtgctttgccttgtatgttcgattgtggttgcaggggcagccgtaggcttgaaagcgcagcagcaggaacagaaactgctggataagcagcgtaatattctggatgtcgccggtctattgaaacccaatatgacgacagcggaaatcaaagaaacctatagcagccgtattcaacctgaattgcttgatttgaaaacggccacgcttgaaaaaggcgatggtaaatttgacctgaaaaatgccctgcgtagtgatgaaaccagcatggctctgccatcagaacaggatctggcaagaatccaccgtcgcgccaatatggcagaaatctatctggtgaaagatggtcaaggcaaaactaccgagctggtgctgccggtatatggttctggcctgtggtcaatgatgtatgcatttatttctattgatgtggatggcgtaacatctcgcggcattacttactattctcatggtgaaacaccgggattggggggggaagtggataacccgcaatggcgcaagcagtgggtgggtaaaaaactctataactcacaaggtgttccggcgattaaggtcgttcgtggtggtgctggcgataacccttatggtgtagatggtttgtctggagcgactctgacctccaatggtgttcagcatatgtttgatttctggctgggtgataacggttttggcccattcctgaaaaaagtacgtgagggagccttgaaagatggctga

SEQ ID NO: 4793 - DNA, 630 bp, Xenorhabdus bovienii
  Coding sequence Name=Xb4151_4152.C443.gene309.dna; Position on contig= 256785..257414bp; Strand=+
atggctgatagtaaagaggtaaaacgcgtccttcttgggccgctgtttgataataacccaattgctttgcaggttctgggagtgtgttcggcactggctgtcaccaccaagctggaaactgcgctggtgatgacgattgctgtgacattggtgacagcattttctagctttttcatttcattgattcgtaattacattcccggcagtgtgcgaatcattgtacagatggcgattattgcatcgttggttatcgtggtagaccagattttgcaggcctatgcctatgaaatctccaaacagttatctgtgtttgttggtctgatcatcaccaattgtattgtgatgggacgcgctgaagcctatgccatgaaatctccgcctgttgaaagtttcatggatggtatcggcaacggcttgggatacggtgtcattctgttgctggtgggttttttacgtgaactgtttggttcaggaaaactgctcggcatgacggtgctggaatctgtcaagaatgatggctggtatcagccgaacggtttgtttctgttggcaccgagcgcattcttcatcattggtatgctgatttggggtctgcggactctgaaacctgcacaggttgagaaggagtaa

SEQ ID NO: 4794 - DNA, 597 bp, Xenorhabdus bovienii
  Coding sequence Name=Xb4151_4152.C443.gene310.dna; Position on contig= 257423..258019bp; Strand=+
atggaacattatattagtttgtttgtccgcgccgtctttattgagaatatggcgttagctttctttcttggtatgtgtacgtttttggcggtgtcaaaaaatgtgaagacagcttttggtctgggcgttgctgtaactgttgtgttgggaatttccgttcctgccaacaaccttgtctacaatctggtactccgtgatggagccttgatggatggggttgacctgagcttcctgaacttcattacctttatcggggtgattgctgcactggtacagattctggaaatgatcctcgatcgttatgtgcctgcactgtataacgcactggggattttcttgccgttgattaccgtgaactgtgcgattttcggtggtgtttctttcatggcacagcgtgactataacttcagcgaatccgttgtttatggtttcggttcaggtatgggctggatgctggcgattgttctgatggccgcgatccgtgaaaagatgaaatatgcggatgttccagcaggtctgaaaggattggggatcacctttgtcactaccggattgatggcattgggctttatgtccttctccggcgtgcagctctaa

SEQ ID NO: 4795 - DNA, 1227 bp, Xenorhabdus bovienii
  Coding sequence Name=Xb4151_4152.C443.gene311.dna; Position on contig= 258035..259261bp; Strand=+
atggatataatcattctaggcgtagtaatgtttaccctgattgtgttggcgctgacggctatgattttgtttgcaaaatcaaagttagtgaacaccgggaatattaaaattgaagtcaatggcgatgaggaaaaaagctttacggctcctgctggcgacaaattgttgaacatgctttccaatcagggggtgtttgtttcctctgcttgtggcggcggtggctcctgtggccagtgccgtgtgaaaattaaagaaggcggtggtgacatcctgccgactgagctttctcatattaataaacgtgaagcaaaagaaggttgtcgtctggcatgtcaggttaacgttaagcaagacctgaaaattgaattgccagaagagattttcggcgtcaaaaaatgggaatgtgaagttatctctaacgataataaggcaacgttcattaaagaattgaagctgaaaattcctgacggagaagtggtgccgttccgggcgggtggttacattcagattgaatgtcctccacatgtggcccgttatgcggattatgatgtaccagaggaataccgtgaagattgggataaattcaatctgtttcgttatgtttctgaggtaaaagaaccgactgttcgtgcgtattcaatggctaactatccagaagagcacggtatcatcatgctgaacgtgcgtatcgctacgccgccgccaagaaacccagacgttacaccgggtattatgtcctcttacatctggtcattgaaagccggtgataaagtgacaatttccggtccatttggtgagttctttgcaaaagataccaaagcggagatggtcttcatcggtgggggcgcaggtatggcaccaatgcgttctcatatctttgatcagctcagtcgtctgaactccaaacgtaagatcagcttctggtatggtgcgcgttccaaacgtgaaatgttctataccgaagatttcgaccagcttgcggcaaagaacgacaattttaactggcatgtggccctgtctgacgccttacctgaagataactgggatggttacactggctttattcacaatgtcctgtttgagaactatctgaaagatcatcctgcaccagaagattgtgagttctacatgtgtgggcctccggtcatgaatgctgcggtcattaagatgttgaaagaccttggcgtggaagacgaaaacatcatgctggatgatttcggtggttga

SEQ ID NO: 4796 - DNA, 1032 bp, Xenorhabdus bovienii
  Coding sequence Name=Xb4151_4152.C443.gene312.dna; Position on contig= 259334..260365bp; Strand=+
atgctgagtaaaaaaattatccactggggtgtgttgatgtttacggttttgctgctgtcagcctgtggtggccctgaacagcaaaatctgagcgggcaaacgatggggacttattactccgtcaaatatgttgctgactcatcgataccttcccctgaaaacctgcaaaaagagattgatcggctgctggaagaagtgaatgaccagatgtccacttatcggccaaattctgaattaagtcgttttaatcaaagccgtgaggttaacacaccttttctggtatccgccgctacggccaaagtggtcaaggaagccattcgaatcaatcaactgacggatggtgctttggatgtgacagtagggccattggtgaatctgtgggggtttgggccggaagggcgaattaccaaggcgccgacggatgaagaactggttatgcgtcgtgcgtggacgggtatcgataagttgtctgttgaaggtaatagcttgattaaatctattcctgaactttacgtcgatctttcctccatagccaaaggctatggagttgatgttgtggctgaatatctggcctcccagaacatcaaaaattttatggttgatattggcggggaagtacgcacactgggtaacaatggcaaaggcgctccgtggcggattgctatcgaaaaaccatcggatagtggcattgaacagagagctcaagaaattattgagccggatcgtatgtctattgcaacatcgggtgattaccgcaactatttcgaacagaatggggtgcgctattctcacaccattaatcccaaaacaagcaggcctatcactcataatctggtttcaatcacggttattgccccgacatgcatgagtgcagatggcttttctacgggactggatgtattggggccagataagggaatggaagtggcagagaagctgaagattcccgtctttatggttgtcaaaactcaagatggctttgaagagcgctatagttcagcctttaagccatacatacaacagaagaaatga

SEQ ID NO: 4797 - DNA, 420 bp, Xenorhabdus bovienii
  Coding sequence Name=Xb4151_4152.C443.gene313.dna; Position on contig= 260307..260726bp; Strand=+
atggctttgaagagcgctatagttcagcctttaagccatacatacaacagaagaaatgaggaggaaaggttatggaagtctttattgcagcctttatctttttcttgttggcttttgcaggaatggcactgggctacatttttaagcgtaaaagtattcagggaagttgtggtggtttggggagtattggtgtggagaaagtttgtgattgcccagaaccctgcgatacccgtaaaaaacgcctggcaagagaagctgctcgtcatgagaagctggaaaaaaaccgaattctttgaggttttttttgtggttaaaaaattttcagctaaaaaatgcgacccgctgccagatacacagcgggtttttgttggttgttcagatgatgttgagagagtgacatttgctgtgagcctgctgtaa

SEQ ID NO: 4798 - DNA, 153 bp, Xenorhabdus bovienii
  Coding sequence Name=Xb4151_4152.C443.gene314.dna; Position on contig= 260682..260834bp; Strand=-
ttgcccaaaaaagccagacgggcatttcttctcacgcaacttcaaggtatgtgctataaagaagtcgcaaagaatttagatgtttcaatgagctccgtgaaaaattacttacagcaggctcacagcaaatgtcactctctcaacatcatctga

SEQ ID NO: 4799 - DNA, 279 bp, Xenorhabdus bovienii; identical to SEQ ID NO: 890
  Coding sequence Name=Xb4151_4152.C443.gene315.dna; Position on contig= 261085..261363bp; Strand=-

SEQ ID NO: 4800 - DNA, 291 bp, Xenorhabdus bovienii; identical to SEQ ID NO: 155
  Coding sequence Name=Xb4151_4152.C443.gene316.dna; Position on contig= 261355..261645bp; Strand=+

SEQ ID NO: 4801 - DNA, 213 bp, Xenorhabdus bovienii
  Coding sequence Name=Xb4151_4152.C443.gene317.dna; Position on contig= 261847..262059bp; Strand=+
atgtcacaattcgaaaaattaccattcggagataaaacacctctaatacttatttttggtgggatatttttactcgcagtttcaattttaaagtggatgacatctgatattgaagtggactggctgtataactcaattgaaagcttgctggctatttaccttgtcaaccttggaatcagactgcgtaaaaagtatcgaaacaataacgagtga

SEQ ID NO: 4802 - DNA, 489 bp, Xenorhabdus bovienii
  Coding sequence Name=Xb4151_4152.C443.gene318.dna; Position on contig= 262311..262799bp; Strand=-
atgtgtagtatcctagtgttattgatatgtagccatttggagtgtggtatgttaattgcgttagttgatataaataaggacaattatgaagctgtctgcgatctatctgtaactgatgaacagctagaatatattgctgaaaatgtgttttctctcgctcaatccaagttttttccatcatatgaaactcgcgcgatttatttggatggtacacctgttggtttttttatgtgggtaccttctgataccggacaaaaaacaactatttggcgttttatggtagataaaagccatcaaaataaaggtattgggcgcaaagcgttatcactagctattgaggaaatcagacggacagagcaattggaagaaatagaaatctgttatgacccaaataatcttgttgcgaaaaatttttatgccagtttcggctttattgaagttggtatagatgaagaagttaaagaaatgttggcggttataagggtatag

SEQ ID NO: 4803 - DNA, 111 bp, Xenorhabdus bovienii
  Coding sequence Name=Xb4151_4152.C443.gene319.dna; Position on contig= 262804..262914bp; Strand=-
atgtcaattggatataattataatttgtatcttgaattccaaggcctcgcactcgcggggctttttattgcaaaaaaaacagataagaattgccattccctttggttgtag

SEQ ID NO: 4804 - DNA, 498 bp, Xenorhabdus bovienii
  Coding sequence Name=Xb4151_4152.C443.gene320.dna; Position on contig= 262898..263395bp; Strand=-
atgacctgtgattgggtaaaaatggacttcatgttgtcttttgatctttttataggaaccgcgaatgcaacattacaaggatcagaaggtcatgttgcttggggatatgtaaaagatgggtacaaatgggatgagcaggagtggtcgaaatcttttggtgatttgaaagtcattcaaaataaaacaggcattgtggaaaccacatcattttattggcatgtaaatagagagcatagcgatggagtgattctttggctcgcgtattctgatactagtcaagaaagtttccataacttgataaatttctttcaaactaaagaactccatataacggttgatggtatgacttataatctaggtaaaagcttagatattacaactaaaccagaatacggacatgtaatcgacaatacatataaaaataatgatgcaaaaaaattgggtgccatattgaaacatacaggtgtaaccaagcgtctttatgtcaattggatataa

SEQ ID NO: 4805 - DNA, 279 bp, Xenorhabdus bovienii; identical to SEQ ID NO: 3227
  Coding sequence Name=Xb4151_4152.C443.gene321.dna; Position on contig= 263582..263860bp; Strand=-

SEQ ID NO: 4806 - DNA, 291 bp, Xenorhabdus bovienii; identical to SEQ ID NO: 155
  Coding sequence Name=Xb4151_4152.C443.gene322.dna; Position on contig= 263852..264142bp; Strand=+

SEQ ID NO: 4807 - DNA, 309 bp, Xenorhabdus bovienii
  Coding sequence Name=Xb4151_4152.C443.gene323.dna; Position on contig= 264159..264467bp; Strand=-
atgtctgaaattaataagccagagaaaacgagtgctaatcaaaattgctttatcaaccctgatcaatacaaaaatcacgatgtagttgcacccgttggttcatatccttgggcgataattcaattgtatttaggaaaccttatgtatcgcaatgattgggattaccccaatgaatacataggacttgttcctgaatcaggggaaggtgataatcttccttatgttattaagaagcgtatacacaataattttgaacagtggcagcccgcacaagaagatatgatggcttgtgattgggtcatgtattaa

SEQ ID NO: 4808 - DNA, 462 bp, Xenorhabdus bovienii
  Coding sequence Name=Xb4151_4152.C443.gene324.dna; Position on contig= 264803..265264bp; Strand=-
atgagaaaacagcccaaaccgcctattaacccgataacatacagggggagctcgtggcggcgggcagtactggccatggataaacccaaactggcatgggtactgtactgttatgcacattccctggattatcgctatcaggttgaaatatgcgaatatctctggggaggctttctggcagggcaaacaaaccgtcggttatcaatcaaagtcagcacgagattgaaaggattggtatggttggccgttcagcaacgtgccaaggggtgtcgttcagagaatttcttatcttataccagatcagaattggccagcttgactggggtgagtttatacaattggaaaaataattatgcggcacattggatagccttggtggagttatgcgaaaacatggatagagaagcactccaagatatcatcagattaagaattaaacaaaaatcagaccatgatctataa

SEQ ID NO: 4809 - DNA, 150 bp, Xenorhabdus bovienii
  Coding sequence Name=Xb4151_4152.C443.gene325.dna; Position on contig= 265368..265517bp; Strand=-
atgactaaatggtattcgcatgacttgcaatacgtacgcacgcagattatccccgcattgtttgatattgccggtgaaaccaaggggcaattggcggcatttgaagactctccactgacatgtacagatcactataattgcgatacataa

SEQ ID NO: 4810 - DNA, 1008 bp, Xenorhabdus bovienii
  Coding sequence Name=Xb4151_4152.C443.gene326.dna; Position on contig= 265517..266524bp; Strand=-
atgaattatttactgaccccgcacattgtccgtgatctggggctggtggtctttaagccgggtcgccatctcctggatgggttttatggcaggatgttgctcacgcctgagcctgctgtgctccggtctgctccatcagggcaagtaacagaagggcaatggctggcttccgataagcgtttgtaccctttttttcagcatgagcgggtcattaaagtcgctggcggtttggaagggatgaagcattacatcgcccagacgatttcattctgccaggcggcagatgaggaaaattaccatcataatttattgacaataactgtatataataacagcgccgtcagaacatgctggcatcatgataaccaatgtcgggacggctctgatcgtatacaaaacgcagcggaacaaaacctgtatcagtgggtattgcataacgtcatcagtgatttccggttgcctgctcatcatcaggtgacatggccagaattatttagctgggcggtcattcatcgggtggcggatttgctgccatcatttatcagtcatcgcgccctgcagcgggcagatgaccacggagagaaaattggaagtaccaccagcgaacatgatatccgatgggaacccctgacctcacaggacattgttaatgagcgtgtggagcaggttaaaaatgtgctgacggcagaggttgacgctgaaccgcccgccagctttatgcgtttgccaaaattacaacggtggcgcaatacccaatggctgaaatgggtgaaatcccagccctgtgcggcctgtcaacgtcctgccgatgatccccaccacattatcggtcatgggcagggcgggatgggtactaaggcgcatgatttgttttgtctgccactttgccgggaatgtcatgacgacctgcatcgggacaggctggcatgggaagaaaaacacggtagccaggtggatttattatttcgttttttggacagatcgctgggaataggggcaatcaaataa

SEQ ID NO: 4811 - DNA, 681 bp, Xenorhabdus bovienii
  Coding sequence Name=Xb4151_4152.C443.gene327.dna; Position on contig= 266521..267201bp; Strand=-
atggcaagtttaatggcatacggattaaccatgtcgagcagggagattgctgatctggttgagtcccgacatgattcagtgaaaagaaccgtcgaacggctggcagaacgggctgttattcaactcccaccaatggtggaagtcaaaaatcaccagaatcaaaccacttatgaataccggataggcaagcgtgacagctatgtgattgttgcacagttatcccctgagtttactgcccggctggtggattgctggcaggcactggaacagcaccaaatttctcatatcccccaaacgctgcctgacgcattgcggttagctgcagatttggccgagcacaatcaggcgctggaatcacaattagccgatgcagccccaaaagtggcgtttgtggatcggtatgtggatgcgcgtggatcaatgacatttcggcaggtttgcaagctgattgaggcaaaagaaccggagtttcgcgggttcctgctggacaggcggatcatgtatcgattgaatggcacgatgctgccctaccagaaccacatcgatgcaaaacggtttgaagtgaagacgggcacaaatatcactaatgctcatgcgttcactcaatcacgctttaccacaaagggaattcgctgggtggcgggtttgtgggcggaatacaaagtggggtacatggcatga

SEQ ID NO: 4812 - DNA, 237 bp, Xenorhabdus bovienii
  Coding sequence Name=Xb4151_4152.C443.gene328.dna; Position on contig= 267201..267437bp; Strand=-
atgttccagcgcagcaaaatggtctatggcgtgaatattttccctctgctggtgatggcttatcagttgcgccgcaggtggtcgctgaggcagttacggggtcactggtgtgagggtcagatattgctgaaaattatccgtcagagtcagcgtgattggccgtatttcaattttgaaatccactatcaagatctcaggaaacgggtgaaacgcggacagggtaagggcgtgatttga

SEQ ID NO: 4813 - DNA, 618 bp, Xenorhabdus bovienii
  Coding sequence Name=Xb4151_4152.C443.gene329.dna; Position on contig= 267437..268054bp; Strand=-
atgacgttcgcgctggatatcgcagaaaatgacattcccgaggaacctaacgatcccgctcatcaggtattgaactacttcaatcaggccactgattccaactaccgtgacggaaaaaccagtatgggctacatccgtgcacgtttaagtgaaggttacgcaacggaagatttgatactgatcacagattacttgattgccaagtgggcgaacgacggcaaaatgcgggattacctgcgtccaaaaaccctgtttagcccggaaaattgcgcggaatattttgacaaggcgtgcaaatggcacaaagcagagcgtcctgcctgtgttaacggtcgctggctgaaagccggggaagccgacgttgtcattgataccgtggagcgtgacgcaacattccgacagctattttcaacaggctggacaccggcaaaccgtattcaggaacgggcggcacaactggcacgtaaagcgggagtgggtcgcatgaatgaagtgcctggactggctgcttggcgtgggatctggaagcaggccgcagaacagattgcgaaagacgagttgctatcgggatttcgggttgttggtggaagctctgagcagaatggggggactgcataa

SEQ ID NO: 4814 - DNA, 363 bp, Xenorhabdus bovienii
  Coding sequence Name=Xb4151_4152.C443.gene330.dna; Position on contig= 267992..268354bp; Strand=+
atgagcgggatcgttaggttcctcgggaatgtcattttctgcgatatccagcgcgaacgtcatattttatgtgatgggcgggaattgaatattgcgccggatattgtctgcgattttcgctcgttgccatttgccagtaacacatttcagttggttgtgttcgacccacctcatctggaacgagcaggtgaaaacggttggcagcggaaaaagtactccgaaagaccgaagaatttgaacgatattctaacaacggagctgaacaacattatttttgatgcgacacgggaaggaaaggcgacacttgcaggagtggcgaaagtaattttggagaacagttatcagaaaggagaaaagcaatga

SEQ ID NO: 4815 - DNA, 270 bp, Xenorhabdus bovienii
  Coding sequence Name=Xb4151_4152.C443.gene331.dna; Position on contig= 268351..268620bp; Strand=+
atgagaatgaacacagcgtttttgttaatggcagagtttgaaacctcgcaaattccgctgtcaactatagccgagaaataccttgaactaaccccagcgacagcagagcgtaaagctattgaaggcaagttaaaatttccgacatacagaatgaatgacagccagaaatcaccgcgaattgttcatgtgcacgatcttgctgagtatatcgataagcaaagggagttggcagcaaaagaagtggaaagaatgcagtttaaaaaaaagtaa

SEQ ID NO: 4816 - DNA, 165 bp, Xenorhabdus bovienii
  Coding sequence Name=Xb4151_4152.C443.gene332.dna; Position on contig= 268682..268846bp; Strand=-
atgcaggtttcctgccagacagaaataaaaggaaaaatgcttatgcttgataaaagtcaacggattgatagtggctcggtgtcgaaaaggaggtataatcccgcgatttttttatctgccggctatatacagtggggattattttattacatatcaactaattaa

SEQ ID NO: 4817 - DNA, 1086 bp, Xenorhabdus bovienii
  Coding sequence Name=Xb4151_4152.C443.gene333.dna; Position on contig= 268910..269995bp; Strand=+
atgcaaccgcctgggggctacgcagtgaccaacaaaacctctcttagctataaagatgctggtgtcgatattgatgctggcaataccttagtcaatcgtatcaaaggtgtcgtgaaacagacccgtcgccctgaagtgatggggggattaggcggtttcggggcactatgtgcgctgccacagaaatatcgtgaacctatcttagtttctggtacagatggcgttggcaccaagctgcgtctggctatggatctgaaacgccacgataccatcggggttgatttggtcgccatgtgtgtcaatgatctggttgttcagggagccgaaccgcttttcttcctagattactatgcaacaggcaaactggatgttgataccgcagccagtgtcattacgggtattgccgaaggttgcaagcaagctggctgtgccctggtcggtggtgaaaccgccgaaatgccgggtatgtatcatggtgaagattatgatgtggcagggttttgtgtcggcgtggtggaaaagtcagagatcattgatggcagccaagttcaagtgggtgatgcgctaattgcactggcatccagtgggccacattccaatggttattcattgatccgtaaaatccttgacgtcagccagaccaatccggaaacagcagagcttgaaggtaaatcgctggcagatcatttgcttgtcccaacccgaatttatgtcaagcctgttcttgaactgattgaacagttcgagatccacgccattgcccatctgactggcggcggcttctgggaaaatattccccgcgttctaccggaaaatatgcaggccaaaatcaatgcctccagttggcaatggccagctatctttacgtggttacagcaggcaggcaatgtcagcaatcacgaaatgtatcgcacatttaactgcggagtaggcatgatcatcgctctgccacaatctctggcagaacaagcggttgagtggctgaacgcggcaggtgaaaacgcttggcagattggtactattaccgaatttgataccaatactgaactgaacaccaacgagcaacaagttatcatcagcgaatga

SEQ ID NO: 4818 - DNA, 648 bp, Xenorhabdus bovienii
  Coding sequence Name=Xb4151_4152.C443.gene334.dna; Position on contig= 269992..270639bp; Strand=+
atgaaaaccatgaaaaagattgtcgtcttggtttccggtaatggcagcaatcttcaatccattatagacgccagccagcaaaaccggattaatgggcatatctgtgcggtattcagtaataacgacaatgcctatggtctgcaacgtgcagaacaagcggatatccccgcccattttctcaatccgcaagcgttttcggatcgcacggcttatgattgcgccctgctcacagccattgatcaatatcagccagatttagtggtactagcgggctacatgagaatactatcgcctgattttgtgcagcactactgtgggcgcatgctcaatatacatccttctctgctgcccaaataccccggtctgcatactcaccgtaaagccattgaaaatggcgatcaagaacatggcacttccgtccattttgttaccgaacagcttgatggcggccccgttattttacaggccaaagtacctatttttgaggaagatcaggaagaagatgtcatcaggagagttcaggttcaagagcatgatatctatccgctggtcattggctggttcttagatgggcgtctgggaatgagcgataatgtagcaatactggatggcaaaatactgccacagcagggttacgcctcagaataa

SEQ ID NO: 4819 - DNA, 564 bp, Xenorhabdus bovienii
  Coding sequence Name=Xb4151_4152.C443.gene335.dna; Position on contig= 270911..271474bp; Strand=+
atgtccagtggttctgaaaatccacctgtaaatttacgtcctcttgagcgggaagatctccctttcgctcaccaaatcgataacaacgccagtgtcatgcgttattggtttgaagaaccctatgaagcttttgtcgagctatgtgatctctatgacaagcatatccatgaccaaagcgaacgccgttttatcattgagagcatgaacgccaaagtcggattagtggaattggtcgaaattgattatattcaccgacgcgcagaattccagattatcattacaccggcctatcaggggcaaggctatgcaaccaaagcggctaaacttgcgatggaatacgcattttgtgtattaaatctctataaactttatttaattgttgataaagagaatgaaaaagcgattcatatatacaacaaattagggttccataccgaaggcgaattaatcgatgagttttttataaacggctcttatcatactgccattcggatgtgtactttccaacaccactattttgccaataaagcctgcgaatcccagaccagctcgctggcccattaa

SEQ ID NO: 4820 - DNA, 2070 bp, Xenorhabdus bovienii
  Coding sequence Name=Xb4151_4152.C443.gene336.dna; Position on contig= 271491..273560bp; Strand=+
atgtcccacgaccgcctctataacgaaaaagaactcagttggctctctttcaatgaacgtgtacttcaggaagcggctgacaaaagcaatccacttattgaaagaatgaggtttttagggatctactccaataatctggatgaattttataaagttcgctttgccgatgtaaaacggcgcattcttatcagtgaagagcggggttctgccaccagcggccgccaattattgaaaaaaattcaggctaaagttgtaaaaatcgatcaagagttcgatgagctctataacgatttattgttggaaatggcacgtaatcagattttcctgattaatgagcgacaaatatcccccaatcagcaaatttggttgcggcaatattttcgccagcatttacgcccacacattacacctattgtcatcaatccagaaaccaatctggttgaatttttgaaagatgattacacctatctggctattgaaattattcgggggcaagagacaaaatatgccctgctggaaattccctcagacaaagtcccccgttttgtcaatttgcctccagaaatgccacgcagacgcaaatcgatgatcttacttgataatattctgcgctatacgctggacgaaattttcaaaggttttttcgattacgatacgctgaatgtttattcgatgaaaatgacccgtgattccgaatatgatctggcaacagagatggaatccagtctgttggaactgatgtcttcaaccctgaaacagaggttgaccgccgaacctgtccgttttgtttatcagcgtgatatgcctgatgaaatggtggatctcctgcgcagtaaactggggctatccaatgatgactccgtgattgccggtggccgctatcacaatttcaaagacttcatcaagtttcccaatgaagggaaccgaaatctgctgaacaaaacaatgccacgactacgccatacttggtttgagcattttcgtaacggttttgatgccatccgtgagcaggatgttctgctctattatccttatcacaccttcgagcatgtgctggaattgctgcgtcaggcatcgttcgaccccagcgtgttgtctatcaagatcaatatttatcgtgtggcaaaagattcacgtattattgattcagtgatccatgccgcccacaacggcaaaaaagtgactgtggtggttgaattacaagcccgttttgatgaggaagccaatatccactgggcgaagcgactgactgaggcgggtgtacatgttattttctccgcaccgggcctgaaaattcacgccaagttatttgttatctcgcgtcttgaaggggatgaaattgtccgctatgcccatattggaaccgggaatttcaatgaaaaaacggctcgttcatacactgattattctttgctgactgccaagccggaagtcaccaacgaagttcgccgtgtatttaactttattgaaaatccttatcgcccagtcacgtttgagaatctgatggtatcaccgcaaaattcgcgagctatgctcaaccaactgattactcaggaaattgaaaatgccaaagcaggcgaagcggcgggcatcactctgaaaatcaacaaccttgtggacaaggaattggtggatcgcttgtatgatgcctcagaagcgggtgtcaaagtgcgtcttctgatacggggaatgtgctctctagtgccaaatcaggcgggtttcagtgagaatatacaagtcaccagcattgtggatcgcttcctcgaacacgatcgagtttatgttttcactaacaaaggggatgaaaaggttttcctttcttcggctgactggatgacccgcaatatcgattatcgtattgaggtcgcagtttgtctgctcgatcctcaattaaaacagcgggttttggatattctggaattgcagttcagtgatacagttaaggctcgctatatcgataaagagttaagcaatcgctatgttccacgcggaaataagcgtaaaattcgcgcacaaattgccgtctatgattacctgaagacattggaacaaccggagccaagagcctga

SEQ ID NO: 4821 - DNA, 1533 bp, Xenorhabdus bovienii
  Coding sequence Name=Xb4151_4152.C443.gene337.dna; Position on contig= 273564..275096bp; Strand=+
atgccgttgaaacacgacaaaccaatgcccaaacccatggaaattgccaccattgatctgggctctaatagctttcacatggtgatcgcccgtattgtgaatggcgcactacaggtgatcgggcgtttaaagaaacgcgttcacctcgctgatggcctcaacagcaaaaatgaattaagtgaagaagccattaatcgtggccttgcctgtctttctctgtttgcagaacggttgcagggtttttcccctaataatgtctgtctcgtaggtactcacagcctgcgtgaagccaccaatgcacaagagtttctaaaacgggcgaaagaagtcatcccctaccccattgaaatcatttccggtcatgaagaagcccgcctgatcttcatgggtgttgaacatactcaaccggaaaaaggccgtaagctggtgatcgatattggtggtggttctacagaactggtgattggtgaagatttcgaaccgctgttaattgaaagccgtcgcatcggctgtgttagtttttctcgtcaattctttcctgacaacataataaacgaacaaaatttccgtagggcgcggcttcaggctgcacagaagttagaaaaccttgtttggcaattccggatgaaaggctgggattttgccttgggagcatcaggaaccatcaaagcagtgcaagaattactcgtcggattaggtgaaaaagatggtctgattacacctgagcgtctcaatatgctggtgaagcgggttctgaaatacaagaatttcaaatcactggatctgcctggtttatccgaagaccgcaaacaaacctttgtttccggcctggctatcctgtgtggtgtgttcgatgtcctgcatattcaagaactgcgcttgtctgacggggcactgcgtgaaggcgtactttacgagatggaagatcgtttccgtcatcaggatattcgtcagagaaccgccaaaagccttgctgaccattataatatcgatagagaacaagccgagcgcgtttggagtactgccaaaacactttacgatcaatgggtgacgcagaatccgaaacggctccagccacaactggaatcaattctgctttgggcggcaatgctgcatgaagtcggtttaagcataaacctgagtgggctacagcggcattccgcttacatcctgcaacacaccgatctgccgggctttaaccaagaacagcaatcattgctggcaacattggtacgctatcatcgcaaggccattaaagtgcatgagcatccccgcttttacctgttcaagaaaaaacaatatctcccgatgctccagatattacggttggcaacattactcaacaaccagcgccaatccaccacaacacccgagtcgctcaggctggacacttctcatggtcactggacgctctacctgccacaaaactatttaatcaaaaatgccctgatgcagctcgatttggaaaaagagcaggcttactggagtgacgtggttggctggtacttgcatatcaaagaggaaacggcgtaa

SEQ ID NO: 4822 - DNA, 1464 bp, Xenorhabdus bovienii
  Coding sequence Name=Xb4151_4152.C443.gene338.dna; Position on contig= 275203..276666bp; Strand=+
atgttacaaccggcctttaaatctggtaattcaactgttgccagtcaacattcccaaaagctggcagttgttcgccaacgtctgctgtctctttttattaacgataaattattcgttgatacgttattaggtcaggctgatgaacattcaacaatcagcgacgagcagttactggaaaaaattgaggaagtcagtgcgcagctggccaatctgcacgctgccgacattgcagatattctggaagccctgccctacgatgaacgtcttgctttatggcgactcatcgataataaccagcgcggtgaggttctggtggaagcctccattccggtctgggacaatttaatcaaggatatgtctgaccttgaattgttgaaagccattggcacactgcatgtggatgagcaggcttatattgcagaatatctaccccgcgatactacacgccgtttactgacttatctggaaccgagtcaacgcaaccgtattcgtgaagtattgcagtaccacaaagacagcatcggccagatgatggattttgagtttgtgacagtgcgaagcaacatcacactcagtacggtacaacgtttcctgcgttccagaggctcgattcccgacgcaacggataaaatttttgtcattgaccgcaaaaaccgccttcagggggaactcccgctcacaaccctactaaccaatgcaccggataagttggttgcagaagtgatgaatacagagactgtcactttcttaccagagcaaaaaggcgaggatgccgccagtgcgttcgaacgttacgatttaatttccgctgccgtggtggataataacggtcgcctgatggggcgtctgaccgttgaggatatcgttgacaccttaagtgaagaaacagacaccaatatccgacgcatggggggattaagccgtcaagaagatgtcttcgctcctgttgggcagacagtaaaaacccgctggacatggctcgccattaacttgtgcaccgcttttattgcctcgcgggtgattggcttgtttgaacataccatttcccaactggttgcccttgcgacattaatgcccatagtggcgggtataggaggtaacacaggcaaccagaccattaccatgatcgttcgggcgttggcactccaccaaatccaatccggcagtttttcttatctgttattgagggagttcggtgttgctctgattaacggtgttatctggggtggaatcatgggcgttgtcacctatctactctatggcgatcttgcgatgggcggtgtgatgacaatggcaatgatattaaatctgctgatggcagctctaatgggagtattgattccatttattatgatgaaactggggcgagatccggccattggttccagtgtgatgatcacggcaatgaccgatactggcggattctttatctttttggggttggcaacgctgtttttgatttga

SEQ ID NO: 4823 - DNA, 249 bp, Xenorhabdus bovienii
  Coding sequence Name=Xb4151_4152.C443.gene339.dna; Position on contig= 276991..277239bp; Strand=-
ttgtgcagataccccgtatgtcaaagggcagatttctgccctatagagacagtagcttcccttcccacctctccacaatctccggcttttctttcaggtagtcgtagcgatcataatgtttggttgagacgccgggcttttttatccctcatctcggaactgatccccccattcagccagtgtaaaatcaattgctacatgtcatatagagtacttttttttgtttgtacatacatgtgtgcattttaa

SEQ ID NO: 4824 - DNA, 99 bp, Xenorhabdus bovienii
  Coding sequence Name=Xb4151_4152.C443.gene340.dna; Position on contig= 277404..277502bp; Strand=-
atggttggtgggacattaacaaaatctatttgcctatggctgactgataagactatgagtttaaaggggacaatcctcccctttaatttaacctcttga

SEQ ID NO: 4825 - DNA, 213 bp, Xenorhabdus bovienii
  Coding sequence Name=Xb4151_4152.C443.gene341.dna; Position on contig= 277632..277844bp; Strand=+
atgcaagataaaaagcctgatgtgcctgtctcagaagatagcaatctcgttattgttacaacaccggaatatgtcaaagattcaatcaaagaagccattgcagcacacgccacaagccgtaaccatccttatgcaactcaggcagaaccgggatttgtcactttaaataatgaagtcaatagcgatagtgagttaaccgtcgcaaccctctaa

SEQ ID NO: 4826 - DNA, 783 bp, Xenorhabdus bovienii
  Coding sequence Name=Xb4151_4152.C444.gene1.dna; Position on contig =117..899bp; Strand=+
atgaacagacatcatttgtcagcggctatttttgaccatcatcaaatagaagataaattcttttcatctatcagccagatgcatgcgcatatcagtgagcatgttcgagcctatgtgactgggcttggaacttatgctttaaattttttgttagtgacagatggtcagatgaaaacagaagaagtgctaaaaatggctattcagttgatggatgaaagtgtaagtgtcccttttggtatttttgccgtggagcctgacagcaaaactctggaagtgatcaaacaggccggatttgtgcccgatcctgatggtactacgacggctatgtggctggatttggctaattggcagatgggcgagggggcatttttggcgtatgaaatcagaaacgttgatcactgtctggcagactgggccatcccgatagaaagtgcgtttgaaacagggagtatgttatcagggcaataccagatatgtcatcaggctgctttggatgcagggaaatgtctgcaacactatgcattatatgtggatgggcagccgctttgtgctttaacgttgtcgaggatggataatattgttcgtcttgatgatattggcacagtcgtgggaaagcagggaaagggatatgcctctgctttaataaattatgttctgcatgaggccaaacagtatggtgcaggcgcgtgttatctggatgcttcccatgatggtaatgcgctgtatcaaaggattgggtttaagccattatttgaatatcagggatttatccgtgagtcataa

SEQ ID NO: 4827 - DNA, 1851 bp, Xenorhabdus bovienii
  Coding sequence Name=Xb4151_4152.C444.gene2.dna; Position on contig =952..2802bp; Strand=-
atggagcaaaacccgcagtcacagctaaagctacttgtcacccgaggtaaggagcaaggctatctgacctatgctgaggtcaatgaccatctgccggaagatatcgtcgattctgatcagatagaagatatcatccaaatgatcaatgacatgggcattcaggtaatggaagaagcacctgatgctgatgatctcatgttggcagaaaacacaaacgacaccgatgaagatgcggcagaagctgctgctcaggtgttatccagtgtcgagtcagaaatcggacgcaccaccgatccggttcgtatgtatatgcgtgaaatgggtacggttgagctactgactcgcgaaggtgagattgacattgcaaaacgcattgaagatggcatcaaccaagtacagtgctctgtcgccgaatatcctgaagcgatcacatatttgctggagcaatacgaccgcgtagaagcaggcgagtgccgtctgtctgatttgatcactggcttcgttgatcctaacgcagaagaagatctttcaccgacagctactcacattggctcagaacttcctcaggcagagcttgatgactctgacgacgatgatgacgaagaaagtgaagacgatgctgacagcgaagatgataacagcatcgatccagaattggctcgccaaaagtttcaggaactgcgcgaccaatatgaaacgacccgtcagtcaatcaagagttacggtcgcagccatccgaataccgcagcagaaattttaacgctgtccgaagtattcaaacaattccgtttgataccgaaacagttcgattatctggtcaacaacatgcgttccatgatggatcgtgtacgtcttcaagagcgtcaaatcatgaagatgtgtgttgaactgtgcaaaatgccgaagaaaaacttcatcacactgttctctggcaatgaaacgactgatacttggttcaccgcagcaaaagcgatgaacaagccgtggtctgataaattgtcagaagttgaagacgatgtgatgcgtagtttgcaaaagctgcgccaaattgaagaagaaaccggcctgactattgagcaggtcaaggatatcaaccgtcgtatgtccatcggtgaagccaaagctcgccgtgcgaagaaagagatggttgaggccaatttgcgtctggttatttcgattgcgaaaaaatataccaaccgtggcctgcaattcctcgatctgattcaggaaggtaatattggtctgatgaaagcggttgataaatttgaatatcgccgtggttacaaattctcaacttacgcaacatggtggatccgtcaggcaatcacgcgttctatcgctgatcaggctcgtaccatccgtatcccggtacatatgattgaaaccatcaacaaactcaatcgtatttcccgtcagatgttgcaggaaatgggtcgagagccttcaccggaagagctggcagaacgtatgttgatgccagaagacaagatccgtaaggtgctgaaaatcgctaaagagccaatttcaatggaaacaccagtaggtgatgatgatgattcacatctgggggatttcattgaagataccacattggagctgccgctggattctgcaacatcagaaagcctgcgttctgccacccacgatgtgctggctgggctgactgcgcgtgaagcgaaagtgctgcgcatgcgtttcggtatcgatatgaacaccgaccatacactggaagaagtgggtaaacagtttgacgtaacccgtgagcgtattcgtcagatcgaagcgaaagccctgcggaaactgcgtcacccgagccgttcagaagtactgcgcagcttccttgatgactga

SEQ ID NO: 4828 - DNA, 1749 bp, Xenorhabdus bovienii
  Coding sequence Name=Xb4151_4152.C444.gene3.dna; Position on contig =3059..4807bp; Strand=-
atggctggacgaattccacgcgcatttatcaatgatttattagcaagaaccgatatcattgatttgatcgatataagagtgcctctcaaaaagaaaggcaaaaatcatcaagcgtgttgtccttttcataacgaaaaaaccccttcatttactgttaatgctgataaacagttttaccattgctttggttgtagtgcacatggaaatgccattgattttctgatgaattatgacaggctcgattttgtcgaatctatcgaagaactggcggctatgcacgggttagaagtgccctatgaagcaaactcaggcggcggtcacatcgaacgccaccaaagacaaaacctttatcagttgatggatacgataaacagtttctatcaacattcactgacgacgcccaacggccaatcagcccaacaatatttactcagacgcgggctcagtgaagagatcatccaccgcttcgccatcggctttgctccaacggggtgggataacgtcctgaaacagtttgcccataatgcggaagagcgaaagcagttaaacgacgcgggaatgctggtcacaaacgacaatggccgcacttatgaccgtttccgcgagcgtgtgatgttcccaatccgcgatcgtcggggtcgtgtgattgcattcggtggcagggtactgggagatgcgcttcccaaatacctgaactcaccggaaacagagatttttcataaaggccgacagttatatggcctttatgaagcacaacagaaccacaattccctttcaaggctattggtggttgaaggttatatggatgttgtcgcactggctcaatttggcattgactacgctgtggcttcgttaggaacatctacgactgccgaacacgtccagttactttttcgaacaaccgataatgtcgtctgttgttacgatggagaccgtgcaggccgtgatgctgcctggcgagcgctggaaacggcgctgccctatttgaatgatggtcggcaattacgttttatgttcttgcctgatggcgaggatccagattcactgattcgcaaagaagggcgtgaagtatttgagcaaagaatggaaaaggcactgactttgtctacatttttgttcgaatcactgttaccacaggttgatttgagtaccccggaaggaacgaccaagatcagctcgcttgctatgccgttgatcagtcaagtcccgggagaaacactgcgactctacctgctgcaagaacttggtaacctgttaggaacacctgatacaacacaattggaacgatttttggcaaaacttgtcaaaaaagataccagtacctatcaggcgctaaaactgaagccaacaacaatgcgtatcttgattgcattgttggtgcaaaatccgcatttagcgacattagttccttcattacaaggattgttttcagttcagatagcgggattaccgttattcattgagcttgtcgacacatgtcttgcacaacctggcttaacaaccgggcaacttttagagcagtatcgcgataataagtacgcaaaacagcttgaaaagctcgccgcatggaacgatatacaggtagatgagattgctgaaaaaacttttagcgatgcgctgaatcatcttttcgcatcagcgcttgatgaacgtttcagctttctgattgccaaagaaagaacagaaggcctgacaccagaagaacgtgaagaagtcagattaatcacagagtccggtgacagaaaataa

SEQ ID NO: 4829 - DNA, 216 bp, Xenorhabdus bovienii
  Coding sequence Name=Xb4151_4152.C444.gene4.dna; Position on contig =4923..5138bp; Strand=-
atgccagtaattaaagtacgtgaaaacgagccattcgacgtagcactgcgtcgctttaagcgttcttgcgaaaaagcaggcgtattagcagaagttcgtcgtcgtgaattctatgaaaaaccaacgactgaacgcaagcgcgctaaagcttctgctgttaagcgtcacgctaaaaaactcgctcgtgaaaacgcacgccgcactcgtttgtactaa

SEQ ID NO: 4830 - DNA, 1038 bp, Xenorhabdus bovienii
  Coding sequence Name=Xb4151_4152.C444.gene5.dna; Position on contig =5567..6604bp; Strand=+
atgcgagttttaggtatagaaacgtcctgcgatgaaaccggaatcgcaatttatgatgacagaaccggtctgctagccaatcaattgtacagtcaggtcaagctgcatgcggattatggtggtgtcgtgcctgaactggcgtcccgtgaccacattcgtaaaacggttcccctgattcaggctgcgttgaaagaagccggtctgacgagcaaagatattgatgctgtcgcttacaccgcaggcccaggtttggtgggggcgctgttagttggggcaaccatcggtcgctcattggcctttgcgtggaatgttcctgctattcctgtacaccatatggaaggccacttgctggcaccgatgttagaagaaaatacgcccgagttcccttttgtcgcattgctggtttctggcgggcatactcaactgatcagtgtgaccggtattggtgagtataaactgttaggtgaatctatcgatgacgcagcaggtgaagcattcgataaaacggcaaaattactggggctggattatccgggcgggcctgtacttgctcgtatggcacagcatggcgaggcgaggcgttttgtcttcccgcgcccaatgacggatcgtccagggctggatttcagtttctctggcttgaaaactttcgccgccaatacgattcgcaatcatattcatggtcatgattccggcgaagatgaacaaaccaaagcggatattgcccgggcctttgaagatgcggttgtggatacactggcgatcaagtgtaagcgagcactggaacaaacgggctttaaacgtttagtgatggcaggtggtgttagtgcaaaccggacattgcgtaccaaaatgcaggaagtgatggaaaagctggggggagaagttttctatgctcgccctgaattctgtaccgataatggtgcaatgatcgctcttgctggtatgatgcgtctgcaaggcagcactgaaagtgcgctgggtgtgacagtcaaagcacgctggcctctggctgatctccctcctttgaaaaagtga

SEQ ID NO: 4831 - DNA, 975 bp, Xenorhabdus bovienii
  Coding sequence Name=Xb4151_4152.C444.gene6.dna; Position on contig =6674..7648bp; Strand=-
atgcttacagaaatgaccactgtctatcgtaaatctattgcactgtatacttttgttgaaagtaatgccccgacatatttaagcactcaagatggaaaaaccgcagagcaacttgctaaactatgtcatgtttccgtcgatagatttcaccgactactcaattatatgcgttcacttggtgtattactggaaaaagatgataaattttatcttaccgaacagtgctcatcattaagtgatcctaatagccttgagacattgcatataaaatttgaattagattcaattaattggaattcttgggcaaaatataatgcttccttaaataaagaaaataataaatcggcttttgaaattaatcatcatgaaaaattttttgattattttggtcatgagaagaataaaatccttaaagataacttcgataacttaatgtcaaaagtgaccaatataatgaatgaatatattattgagcacattccgctacataatatttcatcagtcattgatgtcggtggcggatacggcgctttagcaaaaagaataaaagaaaattatcccaatattagatgtgctgtcatggatcagtatgattttatcaaacaagaatcagagggaattacctttattaatggtgatttcttttccgctattccttcaggatatgatgcctattgcatgaaaaatgttttacataattggccagatgaacgtgtcactgacattctaaaaaattgtcatcaagccatgcacaaagattcgactctatatattatcgatatgattaaagaacaaagtaatgcagaagcagaatcctttgatttatacatggatgttcttttattaggtaaagaacggtatcaattcgaattagaagcactggtaaaacaggttgggctcaccatcactaacatatacaaaataggcggttctaaaacaggaggaccacaatatgttattgaaattaaaaaataa

SEQ ID NO: 4832 - DNA, 804 bp, Xenorhabdus bovienii
  Coding sequence Name=Xb4151_4152.C444.gene7.dna; Position on contig =7992..8795bp; Strand=-
atgaccgctaattcttctataaatacgatatccatcacgaccttttccccgtttttcggttcaccggataccacttccggccaaatgtgcgtattatccattgttagagttaagaaaacgacccttattcattggagatatcttatgagtgctatcgcacttggcatgatcatcttcgcgtacctatgtggctccatatccagcgcgatattgatctgccgtttggcaggactacccgatccccgccagaatggttccggtaacccgggggcaacaaatgtactgcgcatcggaggtaaaggtgctgcactggcagtgcttatctgcgatgtcctgaaaggaatgattccggtttggctggcgtacaaactcaatattcaacccacctatttgggcattatcgccattgtcgcctgtctaggccacatttaccccgtgttctttcgcttcaaaggcggtaaaggcgttgcgactgcgtttggggcgattgccgccattggttgggaccttatgggattaattgctggtacatggctgctgaccgtgctgttaagcggttactcatcattgggtgccattgtcagtgcgttgatcgctcctttctacgtttggtggtttaaacctgaattaacctttcccgtcgcaatgctttcctgtctgatacttctgcgccatcacgataatattcagcgcctttggcgtgggcaggaaagccgtatttggcagaagctgaaaaagaaacaggaaatgacggataaagaaaaaattcaagcggttaaagagcaggaacagcaagacgagtaa

SEQ ID NO: 4833 - DNA, 438 bp, Xenorhabdus bovienii
  Coding sequence Name=Xb4151_4152.C444.gene8.dna; Position on contig =8695..9132bp; Strand=+
atggataatacgcacatttggccggaagtggtatccggtgaaccgaaaaacggggaaaaggtcgtgatggatatcgtatttatagaagaattagcggtcattactacaattggtgtttatgactgggaacagacaattaaacagaaactggtgttcgatatcgaaatgggatgggataacaaacgcgcgtcttccagtgataacgtcgaacactgtctggactacgccaaagtcagcgaagcggtgatccaccgtgtggaaagccagcgctttgccttagttgagcgggtggcagaagaggtggcggatattttactgaatcaatttcattcgccctgggtgaaaattaaagtcagtaaaccgggtgctgttgctcaggcaaaaagtgttggtgtggtgattgaacgcagttcaaatgatgtaatcataaatggctga

SEQ ID NO: 4834 - DNA, 1182 bp, Xenorhabdus bovienii
  Coding sequence Name=Xb4151_4152.C444.gene9.dna; Position on contig =9236..10417bp; Strand=-
gtgaaagtttatttggttggcggtgctgttcgcaatcaactcttaggtctgcccgtgacagaaagagattgggtgatagtcggaggaaatcctgaagaacttttatctcaagggtatcaacaggtcgggaaggattttcccgtttttctgcatccaaaaacccatgaggagtacgcgctagcacgcacagaaagaaaatccgggcaggggtataccggttttacctgttatgccgctcccgacgtgaccttggaagaagatctgctgcgtcgagatttgacgattaacgccattgcacaaactgccgaaggcgagttgatcgatccttatcatggtgctgatgatctcaagcatcgtattttgcgccatgtctctggcgcattttcagaagatccattgcgtgtactgcgtctggctcgttttgctgcttactttgctcacctgagtttctcaattgcgccagaaacccaatcactcatcacaaaaatggtgaagagtggcgagttgtcatccctgacgcccgaacgggtctggcgggaaaccgaaaaggcacttacttcaccctcaccgcaaatctactttcaggttttacatgattgtggtgcactggctattcttttcccagagatcgatcgcctgtttggtgtagcccctatttcttcatgggagaaatcatcccttcaaatggatgcaggtattcattcattgaaggccttacacatggccacgcaattgagccaagaaatcgatattcgtttcgcctcattgtgtgcgcacaccgaagccatacaggttaagcagatgtgcgaaagactgcgcattcccaatacagcacgcgatcttgctgtcattgtggcgcagtaccacgattgggtacacactgccgagcagttgcctccagaaaccctgttggcattgtttaatgccgtggacgcatggcgcaagccccaacgaattgagcagttgattctttgtagccaagctgacgcccgtgcatataccgaactggaagcatcccgctatccgcaggggcgttatttgcgtgacgcctttaccactgtcagtcaggtgaatgtccaagacgtaattgcccgtggatttcagggcgctgagatccgtactgaattagataggcaacgccagctcgccatcaccaaatggaaacaaccatctattgattaa

SEQ ID NO: 4835 - DNA, 621 bp, Xenorhabdus bovienii
  Coding sequence Name=Xb4151_4152.C444.gene10.dna; Position on contig =10433..11053bp; Strand=-
atgcaaaaactacatcgattatttatcctattcctcggttttactttaccgttatccatacatgctgaagaaaaacgttatgtctctgatgaattatcagcttacattcgtagcggcccaagcaatcaacaccgtatcatgggttcgctgaattcaggtgaagaagtcatcttgttgagtagtaattcagaaaatggttactcacaagtcaaggatagcaaagggcgtataagctggatcttaaccaatgaactgagcaccattcccagcctgcgtgaacgcattcctgctatggaacaagagatcagaaccctgacgagtaagctggctaatattgataataactggaagcaacgcaccgcagatatgcaaaacaaagtgtctgccagcgataagattattaatgatctaaaagaagaaaatgccaagatccagaacaaactgactgtagctgaaaaaaaggtagatatggccaatttacagttagatgataaacaaagagaaattatcttacagtggttcatatatggcggcgcagtcgcaggtatcggcctcattctgggtcttgtgctgccacatattattccacgacgcaaacgcaaagatcgctggatgagctaa

SEQ ID NO: 4836 - DNA, 942 bp, Xenorhabdus bovienii
  Coding sequence Name=Xb4151_4152.C444.gene11.dna; Position on contig =11353..12294bp; Strand=+
atgcgttctgtagaggtagagttaaaattgtctgtcaaacccgatgcgataccggcagttcgccagcaattgtttcagtttccccaccattatttttcaccacaacacctgactaatatttactttgagacgtcagataatcaattgcgtcgctgggatatggggctgcgcatccgtggttttgatggacactatgaaatgaccatcaaaacagccggtaaagtgttgggtggattgcaccagcgacctgaattcaatgtgccacttcatcatcctgaactggatttggctcagtttcctgcccatatctggcctgaaaataccgatattacacaattacaagatcaactgaccgcgttgttcagcactgattttacccgtgaaaagtggatcttgaaccacggacaaagtgaaattgaagtcgcattggatcaaggtgtcattcgttctggaaatcgaacggccgctatttgtgagtttgaactggaactgaaaaaagggaatgtggcagatattctgttacttgcagataaactggcattgcaggaggggctgcggttggcgcataagagcaaggcggcgcggggatatgcacttacgtatggtttgactcagaccgatttatcgcaggttcccgaaacgttgggatggcagcagccattatctgttcttctgcctgaaattttagcgcagtggcaggagcaggaagaaggatggctggcaggtatacctgaaggaaaaacaggattagagcaggttttagtgtggatagagcagcttacagaacaacaggcggaagcttttcctgtattaggctcattgcctgcattaaaaggggctttatcagcagtgaatgccgatgcagaaacattgtgttacagcgcatcatggctgcaatgtaagttagcgttaactcagtggttgatggctcaagcacgataa

SEQ ID NO: 4837 - DNA, 2841 bp, Xenorhabdus bovienii
  Coding sequence Name=Xb4151_4152.C444.gene12.dna; Position on contig =12355..15195bp; Strand=+
atgttgccactttcagtgcctttggctcaccaattacagcatgtcattgctaatttccaacaatcagcgggaacaataaaatcctttgtgccacatgaacaggcggtgttgtctctgagtgactttgtggcggaaaatctgctgttacatccggcatggcttgatgaaatccgtcagaatcctcctcaaccggaggaagggcaacactattctgattggttaaatcaggcgttgtctgtggcaagtgatgaaaattccctgatgcgaattctgcgcctgtttcgtcaccggatgctggttagaattgcgtggttgcaggcactacaaggcagtacgacagagcagacactgcgacaactgagtatgttggccgaagttttgattgtggcagcccgcgataggttgtatctgcgttgctgtcaggattggggaacgccaaccaatcatgaaggcgtagcacagccgttgttaatccttggcatggggaaattgggcggtggggaactcaatttttcctccgatatcgatctgatttttgcttatcccgaaaatggtgtgacacaaggtggacggcgcgaaatggataattcccagttttttacccggctggggcagaaactcatcaaagtgctggatcaacaaacggtggacggatttgtttatcgtgtagacatgagattgcggccatttggtgatagcggaccgctggtgttcagtttttcggcactggaggattattatcaggagcaaggacgtgactgggagcgttacgctttggtgaaagcacggatcttggggtacgacgagcaggtgtattgccaggaactgcgccagatgttgaggccgtttatttttcgccgttatatcgatttcagcgtgattcagtctttgcgtaatatgaaaggcatgattgagcgggaagtgcgccgtcgaggtttaaaagacaacattaaactaggcgcaggtgggatccgtgaaatcgaatttatcacacaggtatttcagctgatccggggagggcgggagccgagcctgcaatcccgttcattgctgctgacattgaaagccattgaagtattggcattgttaacaccggaacaggtgagagagcttgaagaaagttatctatttctgcgtcggctggaaaacttgctgcaatccattcgagatcaacaaacgcagactttacctgaaagtacgctggatcgcgcccgcttgtcttggggcatgggatttgcagattgggatgggttgttggcggaaacagagcacaggatgcatgctgttcgaagtatcttcaggcaattgatcggtgatgaaactgacgaaaatgtcgaagaagccagtcatgtaccgtttaagagtgtatggcaggaggctttgaccaggagtgaattgatgatgcttgttcctcatcttgatgaggaagatgctcagaaagtgctcgatgtgattgccctgtttcgtcacgatgtcagtaagcgcactattggcccacgcgggcgtgatgttctcgatcagttgatgcctcgtctgctggcaaaaattggggtgagagaagataccaatactgttttggaacggatggttcctttgttgctgagtatcgtcagccggacgacttatttggagttgatgctggagtcagagcaggtaatgattcacgttatccgtctgtgtgccgcttccccaatgattgccagccagctgtctctccatcctttgctgctggatgaactgcttgatcctaaatcgctgtatgaaccgctgccacttgaagcctaccgggatgaactgtaccaatatttactgcgaattcctgaagatgatgaggagcagttgctggaggcactgcggcaattcaagcaagcgcagttattgcgcattgctgcggaagacatttcgggtgtactgcctgtcatgaaagtcagcgatcacctgacttatctggcggaagcgattatcgggactgtggtacagcaggcgtggaaccagatggtaaaacgttatggtgcaccagcacacttgtcccgacagcaaggactgggttttgccatcatcggctatggcaagttgggaggatgggaactgggttatggttctgatctggatctggtgtttttactggattgcccaatggacgtagtgactgatggagaacgcgccattgatgcccgtcaattttatttgcgccttgcccaacgtattattcatttgttcagtacccggacagcttcgggagtgctttatgatgttgatgcccgtttgcgcccatccggtgaatcgggcatgttggtcagtaccctcgatgctttcgacgattaccagaaacatgaggcgtggacttgggaacatcaggcattaattcgggcgagaatggtgtttggtgatgagaaaatgcgtggtgattttgaacgtattcgacatgaaactctatgccggcctcgcgatccggatctcttgtgtcagcaagtgcgtgaaatgcgcgagaaaatgcatcgtcatttaggtagccaccaacatgaccagtttgatatcaaggctgatccgggtgggatcacggacattgaatttatcgctcagtatcaggtactgcgctatgcaccggaaaacgcaaagctgacccgctggtctgataatgtacgcattttcgaattgatggccagctataacattatggatgaacaggaagcgatggcgctgacgcaggcttatattaccatgcgtgatgaactgcatcaccttgccttgcaggccttacccagtcgtgttcctgccgaaagcttcagccagcagcaaatattggtgcgcgatagctggcagaaatggctcggtcgttga

SEQ ID NO: 4838 - DNA, 1425 bp, Xenorhabdus bovienii
  Coding sequence Name=Xb4151_4152.C444.gene13.dna; Position on contig =15296..16720bp; Strand=+
atgaaagtaacactccctgattttcaccgcgcaggcgttttggttgtcggcgatgtcatgttagaccgctattggtacggcccaaccagccgcatttcaccggaagcaccggttcctgtggttaaggtggataccattgaagagcgccctggcggagcggccaacgttgccatgaatattgcatcgctgggggcaaatacacatttgattggtctgacgggcattgatgatgctgcgcgggcattgagtgaaaaactcagtagtgtgaaagtccagtgtaatttcgtttctgttccaacgcatccaaccatcacaaaactgcgggttttgtcgcgtaaccagcaattaatccgtctggattttgaagaaggcttccaaaatgtggatgcccagccaatgctggaaaagatccaacaatccctgccttatgtcggtgcgttggtgctctcggattatgccaaaggtgcactgagtcagatccagacaatgatcaaactggctaatgaagcccatgtgcctgtactgatcgatccaaaaggcagtgattttgagcgctaccgtggcgcaacgctgctcacaccgaatatgtcagaatttgaagcggttgtggggcactgtaaggacgatgacgagctgatggaaaaaggcacaaaactggttcaggatctggaattgaaagccctgctcattacccgttctgaacggggaatgagtttactgcgcgtagggcagccaactttgcatctgccaactcaggcacaggaagtctttgatgtgaccggggcgggggataccgtgattggcgtactcgcaacggcgctggccgcaggaaaaccattgaatgaagcctgttatcttgctaatgcggcggcaggtgttgttgtcggcaaactgggaacctccactgtttcgccagtggaattggaaaacgcagtgcgtggccgagcagaaaccgggtttggtgtgatgagcgaagcacaattgaaagacgtggtggcacaggcgcgtcagcgcggtgagcgaatcgtcatgaccaatggctgtttcgatatcctgcatgcagggcatgtttcttacctgtccaacgctcgtaaactgggtgatcgcttgatcgttgccgtcaatagtgatgcttcgactaaacgtctgaaaggggaaactcgacccgtgaatccgttggatcagcgcatgatcgtattgtccgcactggaatcagtggattgggttgtggcattcgaagaagatacaccacagcgtttaattgcaggcgttctgccggataccttggtcaaaggcggtgattatacgccagatgagatcgcgggcagtcaggaagtctgggcagctggtggggaagttatggtattgaattttgaggatggtatctcgaccagcaatatcatcaacgctattaaaaaccagtaa

SEQ ID NO: 4839 - DNA, 288 bp, Xenorhabdus bovienii
  Coding sequence Name=Xb4151_4152.C444.gene14.dna; Position on contig =16832..17119bp; Strand=-
atgctcgatccaaagaaaattgaacaaattgcccgccagatccacaattctatgccgaaaggcgtgaaagaatttggtgatgacgtagaaaaaaaattgcggactgttttgcaatcccaactgagcaagttggatctcgtcaaccgtgaagagtttgatatccagacccaggttttactgcgtacccgtgaaaaactggccgcaatggaacaacgcctgaacgaactggaagcccgtatcggaaacccgcaggcaggaattgaaaagaagactgagcaagcggaataa

SEQ ID NO: 4840 - DNA, 291 bp, Xenorhabdus bovienii
  Coding sequence Name=Xb4151_4152.C444.gene15.dna; Position on contig =17264..17554bp; Strand=-
atgggttaccagaatcagggcaattttgaggagttgatgctgcaaaaaatacgcaacaaaacaacaggcaagcgcaagcacttgattgatgctgttattctctcccatccggactatcaccgtcggctccagaatcacactggatctgctgacctctgttttatccatcgttgttctgagacatctgagaacaacaaaaagataactgcaaacagagcgctcgcgggcttaatgaaatcaccagaaagttatttcactttaccgccggtagggactttcaccctgccctga

SEQ ID NO: 4841 - DNA, 654 bp, Xenorhabdus bovienii
  Coding sequence Name=Xb4151_4152.C444.gene16.dna; Position on contig =17578..18231bp; Strand=+
atgaatcagacgctactttcctcatatggcacaccatttcagcgtgttgaacgtgcaatcgctgctttacgcgcaggccgcggagtgatggtactggatgacgaaaatcgtgaaaatgaaggtgatatgattttcgctgctgaaacgatgaccgtagaacaaatggcattgaccatccgccatggcagcggaattgtgtgtctttgtctgaccgaagaacgtcgtcagcaactgcaattgcccatgatggtggaaaataactccagtcagtatcagactgcttttaccgtcaccattgaagcagcacaaggggtgacaacgggagtttctgcggcggatcgcattaccactattcacgccgccattgcagagggtgcacagccaaatgatctgagtcgaccagggcatgttttccccctgcgggcacagccgggaggggttttgacccgtcgtggtcatacggaagcgaccattgatttggttaaactggccggttttaagccagcaggtgtgctgtgtgaactaacaaatgatgatggctcaatggctcgtgctgctgaagtgattgaatttgcgaaacagcatgatatgccagttgttaccattgaagacttagtagactatcgccagcagatggcgaaggctgccagctag

SEQ ID NO: 4842 - DNA, 204 bp, Xenorhabdus bovienii
  Coding sequence Name=Xb4151_4152.C444.gene17.dna; Position on contig =18233..18436bp; Strand=-
atggcaagattacgacttttcttccttgaatacagccaatcaaaaatgatggagtatttcaaaaatactgaaggccgcagggggtggactgcggcctttcaagcgtacacgcaatataaccggtatattcgattccgatacgttttctattccgaacagctttctatttcacccaagaaaacaatatggcagaaaacaatatga

SEQ ID NO: 4843 - DNA, 777 bp, Xenorhabdus bovienii
  Coding sequence Name=Xb4151_4152.C444.gene18.dna; Position on contig =18504..19280bp; Strand=+
atgagtctcctgaaaatgcctgctttattcgttggtcatggtagcccaatgaatgcccttgaagataaccgctactcacgtgcttggtttgaactgggaaaaaaattgcccagaccgagagccattctggtgatttctgcacattggtacactgatggaacggttgtgacagccatgactcagccaagaactatccatgattttggtgcttttcctcaggcactgcacgatatgcagtatccggctaaaggttttcctgagttggcggtgttgatacaagatatccttgatcccattgaggttgaaaccgattttggagattgggggttggatcacgggtcttggggtatcttggcgaaaatgtatccagatgcagatattccggtgattcagttgagcatggatcgcaaccaaccggcttcttttcattatgaaatcggcaagaaattagctgtactgcgagatgaaggcattctgattatgggcagtggtaatgtcgtgcataacctgccggccgaaaaactgggtgcagagccttattcttggtcgctgtcttttgagcagtttgtccgcgaaagcttgactagccttgaggagccacatcctttgttccatgcattggacaggggagatggcaaattatccaacccaacgccagaacatttcctgccgctgttttatgtgataggtacatgggacaaaaaagagccgatttcaactcctgttgagggtattgaagatggctctttgagtatgttgtcgattcaagtcggataa

SEQ ID NO: 4844 - DNA, 1161 bp, Xenorhabdus bovienii
  Coding sequence Name=Xb4151_4152.C444.gene19.dna; Position on contig =19315..20475bp; Strand=-
atgaaacgtattggtattaccgagcgcccggactggcgcgaaaaagcaacagaatatggttttaactttcacaccatgcatggccagccctactggagtgaagaagcgtattaccaattcaccctgagccagattgaagaaattgaagatgctacggcagagctacaccaaatgtgtttgcaggtagtggaaaaagtcgtcaatagtgaagaactgctgactaaattccagatccctaaacattgctgggagtttattcgttcttcatggataaccagccagccttcgctctattcccgtttggacttcgcctatgatggcaaaaatccgcccaagctgctggaaaacaacgcagataccccaacttcactgtatgaatctgccttctttcagtggatttggctggaagatcagctcaatgctggaaatctgcctgctaatgcagatcagttcaatagcctgcaggaaaagctgattgagcgttttgaccaattacgtgaaaagcatgggtttggcttgctccatatggcttgctgccaggatactgaggaagaccgtggtaccattcaatacttacaggattgtgccttagaagcgggtattccgacggaattcctgtttattgaagacatcggtctgggtgaaaaagggcagtttaccgacttgcagaatcaagtgatcggcaacctgtttaaactgtatccgtgggagtttatgctgcgcgagattttctcaaccaaactggccgatgctggcgtccgctggctggaacctgcatggaagagcattatctccaacaaagcgctgctgccgatgctgtggaaaatgttcccgaatcatccgaacttgctgccggcttattttgccgatgaacactacccagaaatggatagctatgtcattaagcctttattttcccgtgaaggtgccaatattcgcattatcgagcaaggcagggaaatcgccagtgccgatggcccctatgggaaagaaggcatgatcgtacagcaattccatgccctgccaaaatttggcgatagctatacgctggtaggcagctggctggtcgatgatcaatctgcgggtatttgtatccgtgaagatcgtgaattgattacacaagatctttcacggttttacccgcatattattttagactaa

SEQ ID NO: 4845 - DNA, 717 bp, Xenorhabdus bovienii
  Coding sequence Name=Xb4151_4152.C444.gene20.dna; Position on contig =20482..21198bp; Strand=-
atgggattagctcttattcaaatacctccaaggtggatgccccctatgacaatgaaacggacaaaagagataaaccacgatactttccgtaaaacgtggcgaaattatcgtttggcacctgtggcactcgctatcagtgcggttttcatgctatcggcctgtgaacagaacgatgaaacggtatcactctatacaaatgccgatgagtgctctcaggcgaatccttctcaaagtgagcaatgcaagaccgcttacaacaatgctctgaaagaagcggaaaaaaccgcaccgaaatatgcctctcgcgaggagtgtgttgctgagtttggtgaacaacaatgtacccagaccccagctcaagctggagttggaacccaggctcaggctcaaagcagcagcgggagtttctggatgccattgatggctggctacatgatgggacgtttgatgggcggtagttctacaccatcacaaccgttatttacatcaaaatccgccaccagcccagccaacggcaagtttgttgatgctaccggcaaaagttatggctctgccgccgcaggcggtcgcaccatgacagtaccaaaaacggcgatggcaccaaaaccagcaacaacaactaccgttacccgcggtggcttcggggattccgtagcgaaacagtctaccatgcagcgctcatcttccggttccacttcccgttctatgggtggttaa

SEQ ID NO: 4846 - DNA, 1365 bp, Xenorhabdus bovienii
  Coding sequence Name=Xb4151_4152.C444.gene21.dna; Position on contig =21331..22695bp; Strand=-
atgaaaaaattgctctctctttttatcgctatgaatctggtaggtttcagcactttaagccatgcagaagatctattacaaatttacaagcaggcgaaagaaactaaccccgaattgcttaaggcgcaggctgaccgcaattcaattattgaaaaaattaatgaagtccgtagccctttgttaccacagcttgggctgaatgctggtgttgactacggcaaaagttttcgcagtaaagcagactcagaaagctatgggacaaatgcaaaactgcaactgacgcaaaccattttcgacatgtcaaaatggtatcaactgaatcaggctgaaaaatctgcaggtatcgctgatatcagttaccagatcgcccagcaaaaattaattttggatacagccaaagcttatttcgatgtcttgagtaaaattgatgcgttaacctataccgaagcacagaaagcctcgctgtaccgccaattggatcaatcaagccaacgctttaaggttggtctggttgccattaccgacgtacaaaacgcccaagcccaatacgataccattcttgcgttagaagtttcagatcgtaacaatctggaaaattcgctggaaggactgcgtctgatgacaggaatctactacccacaactggcttcattgaatattgaccgattcaaaaccaatcaacctaatcccgttgattctgtgcggaaagaagccgaaacccgcaacttaagcctgttatcagcacgtttgacacaggatctaaaacgcgaatttatcaaagatgcgcggacaggctacatgcctactattaatttgacggcaagcactggggtcatcaatagccataaacgtggtacccaacgaattgattcctacgatggcggtaacaacgttggtttatcattaagcctgccactttatagcggcggtctcaccaattctcaggtcgaacaggcaaaatataactttgtcagtgccagtcaggacttggagaatacctatcgcaaggttattcaggatgttcactcctcctccaataacctttccgcttctatcagcagcattaaagccaataaacaggcagttgtttctacacaaagttctctggattcaatggaagccggttatcaggtaggaacccgtaccattgttgatgttctggacgccacaaccaagctgtatcaagccaaacagagcctatccaaggcacgttatgactatctgattaatcaactagtgaataagcaggctcgtggcaccttaaatgaagatgatttggtggcactcaatagtattttaggcacaaagatctcaacggattctagcaatattattaaagagatgaaaacaccaacaactcgctga

SEQ ID NO: 4847 - DNA, 636 bp, Xenorhabdus bovienii
  Coding sequence Name=Xb4151_4152.C444.gene22.dna; Position on contig =22913..23548bp; Strand=+
atgagtgaaaatctcgtttcaccgctcacgtttacgacgcaggatgttgaaattatctcccgaaaaacgctctaccgtggttttttcaaaatgaccgagtatcaattcaggcatcgcctgtttcgaggaggatggagcgataacatcaaacgggaagtttttgaacggggtcatgcggctgttctgctgccttatgatccggtacgtgacgaagtagttttgattgaacagatccgcattccagctattgaaacgagtgaaacgccttggttgttggaagtgattgccggcatgattgaagaaggcgaagacgttgagcaggtcgttcgccgggaagcgatggaagaggccggtcttgaagtcaaacgttgtcagcctgccctgagctacctttccagcccgggaggaacgacagaacgcatggcgatctttgtcggtgaagttgatgctgccacggcgtcaggaatacatgggctggctgatgaacatgaagacattcgggttctggttgtcagccgtgagcaggcctacctgtgggtggaagaagggattatcgataatgcggcttcggttattgcaatacaatggttagctctgcaccatgaaaagctcaaaacagcatggttaggaaaatag

SEQ ID NO: 4848 - DNA, 192 bp, Xenorhabdus bovienii
  Coding sequence Name=Xb4151_4152.C444.gene23.dna; Position on contig =23523..23714bp; Strand=-
gtgatttgcagtattctggctgtggctccctccgccacaggtactttaagcaggctttccaaatggtttccttttcctgtcagtcataagaattattctagcgcttctttacaaaaaagatctgctgactgggacacacttcccgttttccagcataaattaggaactattttcctaaccatgctgttttga

SEQ ID NO: 4849 - DNA, 840 bp, Xenorhabdus bovienii
  Coding sequence Name=Xb4151_4152.C444.gene24.dna; Position on contig =23653..24492bp; Strand=+
ttggaaagcctgcttaaagtacctgtggcggagggagccacagccagaatactgcaaatcactgatacgcatcttttcgccagtaaaggcgattcgctactgggcatcaatacctaccgcagttaccatgctgtactggatgcgatccttgagcagagtattgatattgacttgatcgttgccacaggtgatttggttcaggatcagacgatcggcgcctatcagaattttgctgaaggtattgcccgtctgcctgctccctgtgtttggttgcccggtaatcacgattatcagccggcaatggtcgatgtgctggcggcggcaggaatttcaccttccaaacaggtactcattgggcagcattggcagctggttatgttggatagtcaggtgcagggcgttcctcatggtgaattgacggattaccagcttgaatggttgcaaaaatgtctggataagcataatgatcgcaatacgattgtgatgcttcatcaccatcccgtgccatctgggtgcacatggctggatcagcatagcttacgcaatgccccggctctggcagaatccctgaaggataaactacaggtaaaagcgatattgtgcgggcacattcatcaggagctggatagaatgtggaatggcatccgtgttatggcaacgccatcaacctgtatgcaatttaagccacattgtactaattttatgcttgatacagtggctccgggatggcgttatcttgaactgtctgtggctgacaatcgggaagcgaaactgcaaacgcaggttcacaggctgaagagtaatgaattttgcccggatttagcttcggacgggtattaa

SEQ ID NO: 4850 - DNA, 609 bp, Xenorhabdus bovienii
  Coding sequence Name=Xb4151_4152.C444.gene25.dna; Position on contig =24492..25100bp; Strand=+
atgtcaacgttactttatttacatggtttcaacagttcgccacaatctgcgaaagcaaatgcgctgaaaatgtggttacaccagcagcacccggaaatcgacatgctcgtgccacaattgccttcttatcctgaagacgcggccagtttgctggaagatttggtaatgactcgcgccggcgaaaatatcggtctggtaggctcttcgtttggtggttatctggctatctggctttcacaatgctttggcctgcctgccgtagtcgtcaatcctgcggtacgcccatttgaccttcttcagaattatcttggggaaaacgtgaatccctataccgaagagcggtatactctccagcaaagtcacatttatgatctcaaagtgatgcacattgacccgctggaatcgccagatcttatctggttattgcagcagacaggagatgaaatactggattatcgtcaggccattgcttacctgatgcaatgcaggcagacagtcgaatcaggtgggaatcatgcttttattggtttcgaacattatttccctcaaatcatcaacttcttggggctaaccagtggcaataacaaaaaaattgccaaaaataagtaa

SEQ ID NO: 4851 - DNA, 1896 bp, Xenorhabdus bovienii
  Coding sequence Name=Xb4151_4152.C444.gene26.dna; Position on contig =25176..27071bp; Strand=+
atgactcaatctagttacaacgcagaggccattgaagtcctcagtggcctggagccagttcgtcgccgtccaggaatgtacaccgataccacccgtccgaaccatcttgcacaggaagtgatcgataacagcgtggacgaggctctggctggtcacgcgaaacatattgaagtgatccttcacagcgatcagtctctggaagtgatagatgatggccgtggtatgccggttgatatccatcctgaagaaaaagtttctgctgttgagttgatcctcactcgtctgcatgcaggggggaaattctccaataaaaattatcagttttccggtggcctgcatggtgttgggatctctgtggtcaacgccttatccagaagggtggaagtgacggttcgccgtgacagccaagtccatcagattgcctttgaaagtggcgataaagtgcaggaactggaagtcatcggcagttgtgggaaacgtaatacggggacgagtgtccatttttggccggatgagagttatttcgatatccctcgtttctctgcatcgcgtttgacccacttgctgaaagcaaaggcggtattgtgtccgggtgttgagattgtctttaaagataagctcgcgggtacagaacaaaaatggtgctatgccgatggtctgactgattatctgctggaagccgtcaatgggttggtgacattgccgcagacaccattcgtaggggtattacgcggtgataccgaagcggttgactgggcgttgctctggctgccagaaggcggtgaattgctggccgaaagttacgttaacctgatcccgaccatacagggcggaactcatgttaatggcttgcgccaaggtttgctggatgctatgcgtgaattttgcgaattccgcaacatattgccgcgcggagttaaactctctgccgatgatatctgggatcgctgtgcttacgtgttatctctcaaaatgcaagatccccaatttgccggccaaaccaaagaacgcctctcttcacgtcagtctgcggcctttgtttccggtgtggtgaaagacgccttcagcctgtggctgaaccagcatatccaagacgcggaacaacttgctgaaatggcgattgccagcgcacagcgcagaatgcgggctgcgaaaaaagtcgtgcgcaaaaagctgaccaatggccccgctctgccaggcaaactggcggattgtacctcgcaggatctgaaacttaccgaactgtttttggtggaaggagattccgcaggcggctctgccaagcaggcccgtgatcgtgaatatcaggcgatcatgccactgcgcgggaagatcttgaacacatgggaagtctcttcggatgaagtgctggcttcgcaggaagtgcatgatatttctgtcgctattgggatcgatccggacagtgatgatctcagccaattgcgttacggcaaagtctgcatactggcggatgcggattccgatggtttgcatatagcaacgctgctgtgtgctctgtttgtccgccatttccttactctggtgaaacgtgggcatgtctatatggcgatgccgccactgtatcgcattgatcttggcaaagaagtgcattatgcactggatgaaggggaaaaaggcgccatactggaacgtttaagtcgtaaacgtggtaagccgaatgttcagcgcttcaaagggttgggggaaatgaacccaatacagttgcgtgaaactacactggatcccaatactcgccgtctggtgcaattgactatcgacgatgacaattatcaggaaaccttctcagtcatggatatgcttctggcgaaaaaacgctcggaagatcgccgtaattggctacaggagaagggaaattccatcgatattgaagtatag

SEQ ID NO: 4852 - DNA, 2256 bp, Xenorhabdus bovienii
  Coding sequence Name=Xb4151_4152.C444.gene27.dna; Position on contig =27126..29381bp; Strand=+
atgagtgagataactcacgatggtgtggagtgccagccgctgcacacattcaccgaaaacgcctatttgaattactccatgtacgtcatcatggacagggcgctgccttttatcggtgatggtttaaaacctgttcagcgccgtattgtgtatgcgatgtcggagctggggctgagcaacagcgctaaattcaagaaatctgcccgtaccgttggtgacgtgctcggtaaataccatccacatggcgatggcgcctgttatgaggcgatggtattaatggcacagcctttctcttatcgctatccactggtggatggtcagggtaactggggggctccggatgatccgaaatccttcgcggcgatgcgttataccgaatcccgcttatccaaatatgcagaattactgctgagtgaacttggtcacggtacggtagattgggtgccaaactttgatggcacgttgcaagagccgaaaatgctgcctgcgcgtctgccgaatatcctgctgaatggcacaacgggtattgccgtcggcatggcgacagatatcccgccgcataatgtccgtgaagtagtcagtgcgttggttgctatgttggataatcccaattgttcgcttgatgatgtaatggaatacatcaaagggccggattatccgacagaagcggaaatcatcacgtcaaaagaagatatccgcaagatctacaaaaatggccgtggctcggtgcgtatgcgtgcggtgtggtcaaaagaagaaagtaatgttgttattacggcgctgccacaccaagtatcgggtgcgaaagtgctggaacagatcgccagccagatgcgggcgaaaaaactgccgatggtcgatgatctgcgtgatgaatccgatcatgaaaatccgacccggctggtgattgtgcctaaaaacaatcgtgtcgatgttgagcaggtgatgaaccacctgtttgtgacaaccgatctggaaaaaagttatcgcgttaacctcaacatgatcggactggataaccgtcccaacgttaaaggtttggttgagatcctcagcgaatggttggttttccgccgagagactgtgcgcaatcgcctgaattatcggttggaaaaagtccttaagcgcctgcatatcctggacggtttgctgaaggcctatctcagcattgatgaagtgattcagatcattcgcaatgaagatgaaccaaagccagtgttaatgcaacgttttgaactaactgaaacccaagccgaagcgattctggaactgaaattgcgtcacttggctaagctggaagaagtcaaaattcgtggcgagcaggatggactggcaaaagagcgtgacaaacttcaggcgatcctcggttctgagcgtaagctgagtactctgctgaaaaaagagattattgctgatgctgagaactatggagatcatcgccgttctccgctgaaagaacgttctgaagcgaaagcgatgagtgatcacgatatcctgccttcagagccgattacggttgtgctgtcagaaatgggctgggtacgcagtgctaaggggcatgaaatcgaccctgctggtttgaattacaaatcgggtgacagcttccgtagtgcagcacgtggtaagagcaaccagcccgtcgtctttatcgatacgacagggcgcagttattccgttgatccgttggatttgccctctgccagagggcagggtgaaccgctgacgggtaaactattggcattaccggcgggagcatctattgagcatcttctgatagctaaagaagagcagaaattcttgatggcatctgatgcgggttatggttttatctgtacattcagtgaccttatagctaaaaaccgtgcgggtaaggcgcttataaccctgccagaaaatgctaaggtcatgcagccactggagattaccaacgagcaggatgatatgttgttggcgatcactaaagagggtcgtatgctgatgttccctgtggcggatcttcctcagctttcgaaaggcaagggcaataaaattgtttccattcctgcagcacaggcggcatcaggggaagatatgttgagctggttgttagtcttgccagtacaatcctcaatcacgctctactttggcaagcgtaagttactgcttcgtccagaagacttacagaagttccgggctgagagagggcgcaagggaacctcgttaccacgtggattacagcgtgttgagcgtattgaagtggaaatgccccggtcatag

SEQ ID NO: 4853 - DNA, 732 bp, Xenorhabdus bovienii
  Coding sequence Name=Xb4151_4152.C444.gene28.dna; Position on contig =29470..30201bp; Strand=+
atgttagcaatcattcgtggaattattgtttttctgttatcaatcctgatatgtctatttggtagtatctactgtttattcagcccccgtaatccgagtcatgtcatgacctttggtcatgcatttggcaaattgcacaaaatatttggcattaagatgctggagcgcattcctgaagaagcgaagcaatatgggccaagcatctacatcggtaatcatcagaataattacgacatggtcaccatgtcgaatgccgtgcagccccgcactgtaaccgtgggtaaaaaaagcctgttattcattcccttttttggtccgctttactggctgacgggcaatattttgatcaacagagaaaaccgctcaaaagcacacggcacaatttcacaggttgttcaacaaatcaaaaaaaggcatatttctgtctggatgttcccagaaggcacccgcagccgtggccgtggtctgctgcctttcaaaacaggtgcttttcatgcggcgattgcagccggcgtacccatcgtgccagtctgtgtttcttccacacatgatcgcatcaaattcaatcgctggaataatggcactgtcattgttgaaatgctgccccctattgatacgacgaaatatactaaagatcaggttcgccagctggcagagcattgccgtcaaatgatgcaagccagaattgaagagctgaataacgaagtcgaagtaatggataagcgcaaataa

SEQ ID NO: 4854 - DNA, 1422 bp, Xenorhabdus bovienii
  Coding sequence Name=Xb4151_4152.C444.gene29.dna; Position on contig =30480..31901bp; Strand=+
atgtcactgagtcggcgccaatttatacaggcttctggtttggcaatgtgtttaggtgcgctcccttttgcggttcgggccaataaatatcaacaaacggcactgccgatcccccctttactggaatcccgtggtggccaacccttgtttttagccctgcaaaagacgcattggtcttttgatggcaaaaataaggtgcaagtttggggaatcaatgggcgatatttagggccaaccattcgggttcgtaaaggggataacgtcaagctgatatatagcaatcgtttgtctgaacctgtatcaatgactgtaggagggttgttggttcccgggacattggtaggaggctcggcgcgcctgatatcgtcaaatgaaaattggtctccgattatccctattaatcagccggcagcgacttgctggtatcatgccaacacgccaaaccggatggcacagcatgtttatgccgggcttgcaggtatgtggttggtggaagatgaaaacagccgcagcttacctctacccaaaaattatggcgttgacgattttcctgtcattttgcaggacaagcggttagataattttggtgtacctcagtataacccggcgatcaatcaaggttttcttggcgatacattgcttattaatggtgttgaaaacccttttattgaggttgccagaggctgggtcagattacgtttattgaatgcttccaatgcccgccgatatcaattgcaactcagtgatgaccgtcctttctatatggtaggtactgatcagggattgttgcctgctcctgtgacggtacagcaattgtcacttgctccaggggagcgccgtgaggttttggtcgatatgtcgaaagtggatagcgtagccattaccgcaggagaatcggcaggcatgcttgaccgcctgaaagggctgtttgagtcttcaaccaaattgttgtcaacgaccgtcctgactatcaaggccagtgggctgctttctctcgtgacagatcaattaccgacgcagctcgtggcggatactacggaaattaactcatccattcataatcgtcagtttgttttgggggatgcgactcaggggatcaatggggtattgttgaataggaatcgaatcgacatcagcagccagcaaggtgcgtgggagcgctgggtagtcactacttcagttccacagcctttccatattcaaggggggagattcaaggtcatcagccataatggaaatcgaccatttccacaagattatggctggaaagatacggtttggattgagggtagaaccgaattactggttaatatgatgcagccgtcttatgagatctttcctttcaagtactacagtcaaatattggaaatggcggatgacggagtggctggccaaatggttgtcactccagccacgagctaa

SEQ ID NO: 4855 - DNA, 486 bp, Xenorhabdus bovienii
  Coding sequence Name=Xb4151_4152.C444.gene30.dna; Position on contig =32161..32646bp; Strand=+
atgaatatcagcttgattgctgcgatggctatggatcgagttattggtatggaaaatgccatgccgtggactctgccaggtgatttagcctggttcaaacgcaatacactcggaaaatcggttgtgatggggagggtaacttacgaatcgataggacgccctttaccgggacgcttgaatatcgtgataagcagtcagccagcacgtgatgatagtgtcacttgggttcgcactatcgaagaggctttggccgcagcgggtgatgttgatgaaattatggtaatggggggaggcaaaatttatgagcagtttattcctctggctcaccgtatgtatctgactcacattgatgcggaagtcattggtgacacccatttccccgattacgcacccgatgagtggaattcagtctttaccgaatatcatgatgcagacgagcacaactcacatggctattgcttcgaaattctagaacgccgtgaatga

SEQ ID NO: 4856 - DNA, 132 bp, Xenorhabdus bovienii
  Coding sequence Name=Xb4151_4152.C444.gene31.dna; Position on contig =32643..32774bp; Strand=+
atgagcggcagcagtaaaaaacaatcacaaaaaacagttgtagtcagcacaacaaatcaaatttcatctacggagtgtcgcaaggcactccggcgtcacaggttttattccgtaggctcattaacgatttag

SEQ ID NO: 4857 - DNA, 819 bp, Xenorhabdus bovienii
  Coding sequence Name=Xb4151_4152.C444.gene32.dna; Position on contig =32763..33581bp; Strand=-
atggctacataccttattggcgatattcacggctgctatcatgaatttcgcgctttattacaacaagtttcttttcatcccagcaaagatacattatggctcacgggcgatctggtcgcccgtggcccttattcgctggaagtgcttcgctttatcaagcaactcggcccagcggttaaactggtcttgggcaaccatgaccttcatttactggccgtttacgccaaaatcagccgtaataagccgaaagaccaactggataaattactctcagcaccggatgttgatgatttaattaattggctaagaaagcagccaatgctacagattgatgatgaactaaaactggtcatggcacatgcaggattagcaccccaatgggatctagacaccgccagaatatgtgcccgtgaagtggaagccattctccgcagtgacagctatcctttatttctcgatgctatgtacggtgatatgcccaataactgggatcccgaactgagcgggcttgctagattgcgttatagcactaatgcactgacacgaatgcgttactgctttccaaatggtcagctggatatgatctgcaaatctaaacccgaaaatgtttctgccccactaaaaccctggtttgaattgccgtgtaacatccctgaagaatattctgttgcattcggtcactgggctgcactggagggcaaaggtacgcctgccggcatctatgcgctggatacgggctgctgttggggaggtaaattgacaatgatgcgttgggaagataagcagtatttcagccaatcatcattgctaaatcgttaa

SEQ ID NO: 4858 - DNA, 378 bp, Xenorhabdus bovienii
  Coding sequence Name=Xb4151_4152.C444.gene33.dna; Position on contig =33584..33961bp; Strand=-
atgctcaacgaaccaagaattcatatccaagtacagagtacttacgtagaaagccaatcagaaccagagcatcagcgttttgtgtttgcttatacaatatcaattcacaatcttgggcattcccccgtgcaacttatcagccgttattggcgtataaccaacagtgatggacaccgaacagaagttcagggagaaggggttgtaggaaaacaacccgttatccttcctggaacagattatcgctacagcagcgggactattctggaaacgcctttaggcacaatggaaggccattatgaaatgcgtgatcatgatgggcgtccatttcgtgtcgccattccggtgttcagactggctattccaacactgataaattaa

SEQ ID NO: 4859 - DNA, 825 bp, Xenorhabdus bovienii
  Coding sequence Name=Xb4151_4152.C444.gene34.dna; Position on contig =33990..34814bp; Strand=-
atgaataataaagtccatcaagggcactacgcccgtaaacgcttcgggcaaaactttttaaccgatcaatttatcattgaaagtattgtcgatgcgatgaacccacagcctggtcaggctatcgtggaaataggccctggtctgggtgcactgaccgagccagtgggtgaacgcatggataaaatgactgtcgtcgaacttgaccgtgatctggcagctcgtctgcatgttcatcctaagctaaaagataagctgactatcattcagcaggatgcgatgaccgttgattttggccaactggccaaggatcagggacaatccctgcgtgtatttggtaatttgccttataacatctctacgccattgatgttccatcttttcagctatgctgatgctatcgctgatatgagttttatgctgcaaaaagaagtggtgaaccgtctggtcgctgggcctggctgtaaagcctacgggcgtttgagtgtaatggcacaatattactgtcaggttatccctgttcttgaagtaccacctacggcatttacgccagcccccaaagtggattcagccattgtgcgtcttatgccgcacaaagctatgccttatccggttaaagacattcgcatgttagcccgagtgactactcaggcatttaaccaacggcgcaaaactatccgcaatagccttggcgatctcttttcagttgagcaattatctgaactgggcgttgatccgggcacacgggctgaaaacatttctgtcgagcaatactgtaagatggcaagttggttatcatctcaagcaaaaactgcccgaaatcaataa

SEQ ID NO: 4860 - DNA, 1002 bp, Xenorhabdus bovienii
  Coding sequence Name=Xb4151_4152.C444.gene35.dna; Position on contig =34807..35808bp; Strand=-
atggtagcgatgcacaacaataaacccatcattatcacccccggcgaaccagccggggttggccctgatttagtcattgccctcgcacaaaaagagtggcctatccaactcgttgtatgtgctgatcctgagttaatgctcttacgagccaagcaactcaacctaccccttcaactacaaccttactcccctgaatacatttccccaacacaggccgccggaaccctgactattctgcccgtttccctccattcacctgtcattgccggtgaattgaaccgggaaaacggtatttatgtcacggaaacgctggcaaaagcctgcgagggttgtctgaatggcgagttttctgcactggtgacaggcccggttcacaaaggtgtcatcaacgaggcaggggttccttttaccggacatactgagttttttgctgaccacagccaatgctcaagagtcgtcatgatgctggcaacagaagagctacgggtggcgctggcaacaacgcatctgccgattatggatgttcccaaggcaattacgtttgattcactgagagaagtagtcactattctcaatcatgatctgaaaaccaaattcggtatccgccgcccccatatctatgtttgtggcctgaatccacatgcaggggaaggtggacacatggggcatgaagaaatcgacgtgatcattcccgcattggacagcctgagggcagaaggtatctggctagaagggccgctgccggccgataccctgttccagcctaagtacttggatcatgctgatgccgtactttcgatgtatcacgatcaagggttacccgtgttaaaatatcaaggttttggcagagccgtgaatatcactctcggactgccatttatccgaacgtctgtcgatcacggcacagctctagagctggcagggacaggccaagcagatgtgggaagttttattaccgcattaaatttagcaattaagatgatacaaaacagtaatgaataa

SEQ ID NO: 4861 - DNA, 1308 bp, Xenorhabdus bovienii
  Coding sequence Name=Xb4151_4152.C444.gene36.dna; Position on contig =35786..37093bp; Strand=-
atgaagaactggagagcactcattctcggattgatgttttcagtgaatactgtcgcaatggcagcaccacaggaactcaatagggttgctgccgttgtcaacaatggtgtcgtactggaaagtgatgtcgacgagcaattacaatccgttaaactcagtgcaaaacatgctggtcagcaaataccagatgaaaaagccttgcgtcaccagatccttgagcgtttaattatggatgacatcattttgcaaatggcaaaacagatgcagatcactatccccgatcaagtcctggattccaccatcgcaaacattgccgcccagaaccatatgggtctggacgaattgaaaaaaaatctgactgccgagggtctcaattttaatacctaccgcaatcagatccgcaaagagatgattattgccgaagtacgcaataatgaaattcgtcgccgcgtcacgatcctgccacaggaagttgaggcgctggccaaaaatcttagcagcgaaaataatcagaataccgagttgaatgtcagcaacattctgattccattgcgagaaaatccaagtcaagcacaggtagaaaaagcgacggcgatcataaacaagattttatctgagctcaaaaatggtgccgattttggtaagctggctatcacctattccggcgatacacaggccctgaaaggcggcaatatgggttggagaaaattgcaggaattaccttctctgtttgcagaacagctccagtcagcgcataagggacagattattggcccaatccgttccggcgttggtttccatatcctgaaaattaatgatatccgcggtagcaatatgccacaggttgcggccactgaagttaatgcccgccatattctgctgaaaacttcacctatcatgaccgatgatcaagcccgcagcactctgatgaaactcagagaagaaatcttaagtggtaaaaccacatttaatgcagcagcggagaagtattctgaagatccgggcacagccatgcgtggtggtgaactgggctggaatgtgccaagtacttatgcgccagctttccgtgatgccttagtgaaacttaaaaaaggtgagctcagccagcctgttcactctactttcggctggcacttaatccaactgattgatacccgcaaggttgacagaacagactcggcacagaaagataatgcctaccgcctgctgttaaaccgtaaactcggtgaagaaacacaaaactggatgcaggacttacgtgcctccgcttatgtgaaagttttagatggtagcgatgcacaacaataa

SEQ ID NO: 4862 - DNA, 2334 bp, Xenorhabdus bovienii
  Coding sequence Name=Xb4151_4152.C444.gene37.dna; Position on contig =37169..39502bp; Strand=-
atgaataaatgttatcccactctgctggccacaatggtatgggcagcaatttacagtcagcaagcacatgctgaccttgcagcacagtgtatgctgggcgtacctgtatacgataaacccattatcacggctgatcccaaccaaattcccgttaacattaagtctgatgatacacacggtgaatatcccaatgcggtcgaatttgtcggcaatgttgatattcgacaggggaataaaacgctgacagccgataaagtgcggctcgaacaaacacaagatgaagttcctgtcaggaccgtgaccgcaacaggcaatgttaactatgatgaccctcagattattttgaaggggcctcgtgcctggtctaacctgaacaataaagatacggacatggaacacggcaaataccaaatggttggccgtcaggggcgcggtagcgcagataagttgatggtgcgcgatgaaaaccgctataccattatgaataatgggatatttacctcatgtctgccgggcaacgatagctggagcgttgttggctccgaagttatcctcgaccgtaaagaagaagtcgctgagatctggaatgcccgtttcagggtggccaacgtgccggtattttacagcccatacctgcaactccccattggtgacaaacgccgttctggttttctgatccccaatgccagctactccaataaagaaggctttcaattcaagctgccgtattactggaatattgcccccaattacgatgccaccattacgccaaatctgatcagtaaacggggtcttaagctggataacgagttccgttatttaacaaaagccggggcgggtacagtagcttttgattggcttggtcatgatcgcctgtatgcagatgataaaaaacttgataaaaatctgtcagatcgggagagcaataaccgctggttattctactggaaccacagtggcgtactcaatcaagcatggcgtttcagtgccgattacaccaaagttagtgatcccaaatatttcactgattttacctcgcaatacggcaccagtaccgacggttatgccacccagaaattcagtattggctatgcccaacagaactgggatgcaaccttggcaagcaagcaattccagatctttactgccggaaaaaatagaaaagcttaccgtgcagagcctcaacttgatctgaattactacaaaaatgatctggggccgtttgatttccgaacccacgctcaaattgccaagttcaccagcgtaggcaaagattacccagaggcaacacgttggcatgtggaaccgactatcaatctgccgctctccaatcgctgggcaagcctcaataatgaatttaaattgatggcaacccactatcagcaagatattcctgccacgacacagaactctacgctagagaaatcagtcaaccgtgtcctgccactgtttaaatccgatgcgaaaatggtgtttgagcgcgccatgtatatgaacaagtattacacgcagacgctggaaccccgggttcagtacctttatgtaccttataaaaatcaagataatatcaacaacttcgattcttccctattgcaggctaactattccggattgttccgggatcgcttcttcagtgggctggatcgcatttcatctgctaatcagtttaccagtggcatcaccacccgcatttatgatgaagatttagttgaacgttttaacctatccgtaggtcaaatctactactttgaaagtccgcgtacccaagatactgacctcaaagactcaaccaaaaaaagtacaggtacgacaacatgggccggagatgttgagtggaaaatcaatgattcatggggatttaaagggggtatgcaatacgatacccgtctgaacagtgtggcaatgggcaatacggtgctggaatatcgccgtgatgctgaacgtctggtacagttgaattatcgttttgttaaccgcgactatattcaggctacgcttggaagccaagcgccgtcattccagcagggcatttcgcaggtcgggctagtggcaagctggccgctggcggatcgttgggcgttcgtaggttcgtattattacgataccaaagagaaacagccggcaagccagctggttggcctccaatacaacacttgctgctgggcggtgagtgtcggttatgaacgtaaaatcgtcagctggaaggacaacagcagtgaatatgacaacaaatggtcattcaatgttgaacttcgtggcttaagtagcaatcaaagtttgggtagccagaagatgctggagagaggtattctgccttaccagcgcgcattctga

SEQ ID NO: 4863 - DNA, 810 bp, Xenorhabdus bovienii
  Coding sequence Name=Xb4151_4152.C444.gene38.dna; Position on contig =39685..40494bp; Strand=+
atgcagtattggggaaaattatttggattgatatttggtattgcttctggtgctggcttttggggcatagtgattggcctgttgctcggtcatgtacttgataaagtcaggatgcgcaatcaaagactttctgacaaaggcccaacccggcaggcactgttttttcgcagtacctttcaggtcttggggcatttgaccaaagcaaaaggccgggtgacagaaacggatatccagctcgccagccagttgatggataggatgcagttacatggtgatgcaagggttgccgcacagcaggcgtttcgtgagggtaagcagctccggtttcctctgcgtgaaacacttcggcaattgcgacgtgcctgttttgggcgttttgacctgattcggatgtttttggaaattcagttacaggctgcgttttcagatggcgaactgcatcctaatgaaagaatagtgttgtttgttattgctgaagaactgggtatttctcgtcctcaatttgaacaattcctcgccatgatggaaggtggccgccattttggtgggcaatatcagcagcatggccgttatcaggagcatgggcagccgcgggcgactctggcagatgcctgcaaggtgctgggtgttaaggaacatgacgaggcgacagtcattaagcgggcttatcgaaaactgatgagtgaacaccatcccgataaactggtggcaaaaggcttaccgccagaaatgatggatattgccaaacagaaagcacagtccatccaatccgcttatgatttaattaaaaaagaaaaaggttttaaataa

SEQ ID NO: 4864 - DNA, 654 bp, Xenorhabdus bovienii
  Coding sequence Name=Xb4151_4152.C444.gene39.dna; Position on contig =40501..41154bp; Strand=-
atgctggaatcttataatcccccgactgatccctggttacacgtgctttatcaagacgagcacattatggtcgttaataaacccagtgagttgctttctgtaccgggcaaagcagaggaccataaggacagtatcatgacgcggatacaggccgagtttccaacggctgaatctgttcatcgactagatatggcaaccagtggtgtcatggttgttgcactgaccaaagcggctgaacgtgagctaaaacgtcagtttcgtgaacgtgagccgaaaaaagtctatatcgcccgggtatggggaaaattagaacgggaaaaaggtctggtagatttaccactgatctgcgactggccgaaccgcccgaagcaaaaggtctgttttgaaaccggaaaatcggcacagacagagtatcaagtgctggaatatgaagctcaggccactcgcgtcaggcttgctcccatcactgggcgatcccatcagctacgtgtacatatgctggcgcttggcaaccccattctgggggacaggttctatgctcatcagcaggcaagagaactggcacctcgcctgcaattacatgcacaagagttgtcgattactcacccggcctacggcactccgatgcattttgaatgcaaggccgatttttga

SEQ ID NO: 4865 - DNA, 2910 bp, Xenorhabdus bovienii
  Coding sequence Name=Xb4151_4152.C444.gene40.dna; Position on contig =41289..44198bp; Strand=-
atgccatttacccttggtcaacgctggataagcgatacagaaagcgaacttggattaggaacagtcgtagcgcttgatacgcgcatggtgacgttacttttccctgccagcggagaaaaccgcctttacgcacgcaatgattcacccattacccgcgttatgtttaatgcgggcgataccctgaccagtcatgaaggctggaaactcaaggtcgatgaagttcagcaagataatggcctgttaatctatatcggtactcgtctggatactgaagaggaaaatatcaccctgcgagaagtttttctggatagtaagctgacgtttaataagccccaggatcgtctgtttgccggtcagattgaccgaatggatcgctttgcgctgcgtttccgcgcccgtaaacatcaaagtgagcaatttcgtctggctgaaagtgggctgcgtggcattcgcgccagcttaatccctcaccagttgcatattgccaatgaagtcggcaaacgccacgctccccgtgtgctgctggccgacgaagtcggattaggtaaaaccatcgaagctggcatggttattcaccagcaactcatggccggtcgtgctgaacgtgtgctggtcatcgtgccggaaagcctccagcaccaatggctggtagaaatgctacgccgtttcaacctgcgcttttccctgtttgatgatggtcgttattccgaagccctgcacgatagcgataatccatttgaaacagagcagttgattatctgttctctggattttgttcgccgtaataaacagcgttttgaacatctgctggaagcgagctgggatttaatggtcgtcgatgaggctcatcatctggaatggagcgaaaaagcaccaagtcgcgaatatcaggtcattgaagagttagccgagcagatcccatccgtgctgctgctgacagcaacacccgagcaattaggacaggaaagccattttgcccgtctgcgtctgctcgatcccaatcgtttccacgattatcaggcgtttattgatgaacagcagacgtaccgtccggtcgctgatgccgtcaccctgctgctgtctggcgaaacactgaacaatgaccagcagaacctgattgtcgaactgattagcgagcaggatattgaacctttgctgaaagcggcaaacagtcatcaggatgaagagagtgaaaagtcccgccgtgaactgatcgctatgttgatggatcgccacggtaccagccgcctgctgttccgtaatacccgcagcggcgtcaaaggctttccacaccgtgaactgcacgaaatcaagctaccattacccgctcaatatcagacggcaatcaaagtgtctgaaatcatgggtgccaaaaaatccgtagaagcgcgcgctaaggatatgctctacccggagcggatctatcaggagtttgagggcgaaaatgcgacatggtggaacttcgatccccgtgtggaatggctgcttggttttctgctggcaaaccgtgatgaaaaagtgctggtgatctgtgccaaggcagaaactgccctgcaactggagcaggtgctacgcgaacgtgaaggtatccgcagtgccgtgttccacgaagggttatctctgttagaacgcgaccgtgccgcagcttatttcgcttccgaagatgaaggagcgcaagtgctgctctgttctgaaattggttctgaagggcgtaacttccagtttgctaaccagcttgtcatgtttgatctgcctttcaacccagatttgctggaacaacgcattggtcgcttagatcgtatcggccaaagccggaatatcaagatcagcataccttatctggaaaataccgcgcaatcgattctcctgcgctggtatcacgaaggtctgaatgcctttgaacagacctgcccaaccggtcgccccatctatgacaaatattatgaaactctggtgaatttccttgccaagccaaacgaacaggctggcttcacgccattcattgctgagtgtcgtgagcatcatgagcaactcaggcaggagctggagcaaggccgtgaccgtctgctggaaatgaattccaatggtggcgagcagggacaaaagctggcagaaaccatcgccgcacaggataacgatacagatctggtgagttttgctctgaatttgttcgatatcattggcattaatcaggaagatcgcagcgacaatattattaccctgaatccatccgatcatatgctggtgccggatttccctggcttaccggcagacggttgctcaattacgtttgatcgtgaaaaagccttgtcccgcgaagatacccaattcctgagctgggaacacccgatcatccgtaacggcttagatctgattttgtctggagataccggaagctgtgccgtttccattctgaaaaacaaagcactgccagtcggaacgctgttggttgagttaatttacgttgttgaagcccaagcgccgaaacacctgcaattaacccgcttcctgccaccaacaccagtgcgcctcttaatggatctgaaaggaaccaatctggcacctcaagtggaatttgaaagtttcaaccgccagctaaatgccatcaatcgccataatgccagtaaactggtcagcgcggtgcaaaaagaagttcacgctattttgcagcaatctgaaccgctggtggaacaacaagcccgtgaggtgattgaaaaagcgaaaaaagaggcagataacgtgctgtctgctgagttgtcacggctggaagcgctgaaagcggttaacccaaatatccgtgatgatgagctggaagcggttgactctgaacataagcatctgctgctcaatcttgatcaggcaaattggcgtctggatgccattcgcctggtggtggtctctcatcaataa

SEQ ID NO: 4866 - DNA, 2346 bp, Xenorhabdus bovienii
  Coding sequence Name=Xb4151_4152.C444.gene41.dna; Position on contig =44417..46762bp; Strand=-
atgcaaacaaagcatgttgaacaaggtttcatactcacccgtcactggaaagatacgccatccggtattgagttagtatattggctggcgacggatcagggtgctcgccgcatcactatttctcaccaaaaagcggtggcttttattccccagcatgatttgcagaaggcaaagcgtatcatcgaccaagaaccgcgttgtgaactcaagcctctaccgttgaaagatttcaatcgccaacccgtaactgccttatattgcctgcaatatcgtcaattgcaacagctggaaaagaccctgaaagaacaggatattccactctacgaaaccgatatccgcccacctgaccgatttatgatggagcgctttattaccgcacccgtctggttcaatcagaaaccggatggcagctatcaaatgaaaccgaatcccacctatcgccctaaactgaaatgggtttcactggatattgaaaccagccagcatggggagctgtattccatcggcttagcgggttgcggtgagcaaacagtgtttatgctggggtcagaaaacgggagcaggcaagatagggatttcaagctggagtacgtcgccagccgtccgcagatgctggaaaagctaaacgaatggatagcattttacgatcccgatgccattattggctggagtctgatccagtttgatttaaaagtattacagaaacatgctgaacgctataacgtaccgctgaaactcggtcgtcgtcatggtttgctggaatggcgggagcacggtttcaagccggggcattttttcgcctcggctgaaggccgcctgattattgatggcattgatgcactgaaaaccgcaacgtggaattttccttcgttcagtcttgaatatgtcgcacaggcgttattgggggaaggaaaagccattgatagcccctatgatcggatggatgaaatcaatcgccgctttcaggaggataaacctgctctcgcccactataatttgcaggactgtattctcgtcaaccgcatttttgataagacggatttgatgacgttcctgctggagcgcgctacggtgacaggattggcagtggatcgcagcggaggatcagtcgccgcgttcacacacctttatctgccgagaatgcaccgcatcggctatgtctctcccgttcatgcaactgactccggtgatagccccggtggttttgtgatggattcgtttccggggctgtatgattcagtgctggttttggattataagagcctctatccttctattattcgcacttttctgatcgatcccgtgggcatggtagaaggcctcgcccagcccgatagtgaacatgccatacccggttttcggcaagcgtttttctctcgcactcaacattgtttacctgatatcatcacgcaaatctggcatgaacgtgacaaagccaaaaagcaacaaaacgccccgctctcccaagctctgaaaattatcatgaatgcgttttatggcgtactgggggcgtcaggctgccacttttttgacccccgcctgacgtcctctattaccctgcgcgggcaccaaatcatgcaccagacccgtgagttgattgagtcacaagggtatcaggtgatttatggcgatacggactcaacttttatctggctgaagcaccctcattctgaagcagaagccagtcaaataggtcattcgctggcgcaatttgtcaatcaatggtggcaaagccatctcaaaacgcagttcaatcttgaaagcacactggaactggaatttgaaacccattatcgccgttttctcatgccaaccgtgagaggcactgaacaaggcagtaaaaaacgctatgccggattgagtggcgataagatgattttcaaagggctggaaacaataagaacggattggacaccgcttgcacaaattttccagaatgaactgtacacccttatttttcaccagaagccttaccaagattatatccgtgattacattgccgacacgctggcaggaaaattcgatgaccgtctcatttaccgcaaacagctacgtcgcaaactgtctgattaccagcgtaatgtaccacctcatgtccgggcagcacgtctggcggatgagtataaccagcagaataatcgcccattgcaataccaaaatgtcggttggatcagctacctcatcacgcaatcagggcctgagccactggaaaaccagaccacgctgccggattacgaacactacattaataaacagctgatgccgattgcagacgccatcctgccatttattcaagataactttatgaccctgctgacagggcagatgagcatatctttcgaataa

SEQ ID NO: 4867 - DNA, 1566 bp, Xenorhabdus bovienii
  Coding sequence Name=Xb4151_4152.C444.gene42.dna; Position on contig =46748..48313bp; Strand=+
atgctttgtttgcataatatttctgcaactgcttttgtgttgagggcaaagagccgcctctacattgtaatgaatagtagcctaaattatagcacttgtagtggttatttatacagtggttttttaataaagtcagaatatagggtttttatgatgaaaaatgcattgaataaaaaacaatctgagttacttgccagttttaataaagaagaattacttgaaatcatccatgcattaatcagaaataatgagctggctcaaatcacattagtcagtggatatttgctggagtctgaagacattctgaaactcattgaaaaagagtataaaaaacgcagcaagagcaaacgatttttcgattattatgaaacggataccttcttcaatgaactacataactctatggcaacgcttttgaaccgggttattcctttaaaaccagtagaatcagaagtgttactgtcatatatgttacaagactttgaacgcatgagtgaaactaaagacacctccagtggtggctggcaggattattactactaccttgttgaatcttggattaaggcgttatctctgcaaaaagatactgataaggttacggtagcaaataagcttttcaagattttccaaggcgaatattatttctctttgtcccagttgggtgaatataaatctactttgggtcttgatattcttcgccagctaagagatatattttatcagcacaaaaaagatgatgaagcactggagttgagttattccattaaagatattgaattctttaaaacgtatctcgataagaagaaaggatttttatatccaagatattatctggattacgctgaattgctgattgaagatgtcagatctgatgaagctattgtgttgttggaaaatctcagagaaaaaaacaacaaactgccagttgaactcaatgatgataagataatggaattattgattaaggccaatattgaagagggcaagaaagaagaagccagacaactttgtattgacgctttcaaggagtattataaccataaattttataaattatatgaaaatactcttgataaggatgagaaagggggggctataaaattatttttggatatagccaatcaatatgaagaaaaccgtttcttttatttactattcctaatagaagtggaaagattcgacgtgatcaatgattacattttgaatttgggaaaagataatgtaataaaaattaccgattctattattcccagtacggcgagaaaagtgtcaagtttgctgtataaaagtggttttcccttttctgcgacgctcgtaagacgtgcgcttgttgaagatgtacttggtcgtggagcaagtaagtattataaatattccgtttctgatcttaagaaaagcttggattatggagaaaaaatacaaagtacggacgatatttcctctaatcaaacctatttaaccgccctctacgcaaagcataagaaaaaagtctcattctggtctttggcggaagaaaaaattaagaatgtttcgatggataacgatggcgtttattatggaaagtga

SEQ ID NO: 4868 - DNA, 345 bp, Xenorhabdus bovienii
  Coding sequence Name=Xb4151_4152.C444.gene43.dna; Position on contig =48891..49235bp; Strand=-
atgagccttcatgtttcatttcgccatactgatattcccgaattaatgcttaatggcagcacactcagcgatgctggatttagtgcggatgcgttatttcatatctcacaattgtccaatgggataattatctctctcgttgatcctgatgttgatcttgttagtttgatccatgaagtggaagatcatgcagatcaaggtatcgacaacattcgtgaaaacggtgagctttatattgctggtgattggctgacgagcagtcagttagtggagcaaccgatcaatattgaagtgacgcctggtaagattattcttaaacccaaattgacggaattgttagattaa

SEQ ID NO: 4869 - DNA, 537 bp, Xenorhabdus bovienii
  Coding sequence Name=Xb4151_4152.C444.gene44.dna; Position on contig =49933..50469bp; Strand=+
atggcaaagattgatgtgacttgcccctcttgttgctcagttaaagggatctatcgcaacgggcgctcacgttctggtcattcgtcatttaaaaaactcaaacccaaatcggtaacagaagccattaaacttggcaccgaagtgattgtctgctgtgaaagggatgaacaatggtcgtacgtaaaatcaaagaagccgcctcgttggcttttttatgccgacgacaggataagacgaaaagtgatcgcccatgtttttggtcccagaacaaaaaagacattaatgcgcctactggctttgctgactcctttcaatattattatttatatgacggatagttggcaaagttatgaaaaggcgttagcggggaaactgcatgtggcctgcaagcgttatacccaacgcatagagaggcataacctgaatcttcgacagcatttggcaagactgactcgcaagacattgtctttttcaaaatccatagaaatgcatggcagaattatagggtattatctgaacattcatcacgatcaataa

SEQ ID NO: 4870 - DNA, 690 bp, Xenorhabdus bovienii
  Coding sequence Name=Xb4151_4152.C444.gene45.dna; Position on contig =50748..51437bp; Strand=-
atgttcagatcaaaatcttttattaatcgatccttgtcatttaattcgttgcctctctctcaatccacttcgaatattgaaaaaactgtttacagtgtcaatacgttgatcacagtaaaaaaagttagtgcagaagaagcagttaaagcaattgatataatattaacaaaaaacatgatggaggaatggagtttttgtgattttcatgaccagcttgatgttcaacatgatgttaaccagaaaaaatggagagaaagatatatgaattcacatcatatttttcataatataaaggatcatgctgaagattatatgaaaaaagccaaatcaaacgatgatagattattttttattgtttattttggtagtgttcccatagggggactacaattgagtcttaaaaacttatctgagtctaatttaatttttcctaaattacctgaagtcgagtatatagtaacccattgtggtattagaaattgtggtattattctaatggaacaagcagtaaacgaatcccaacagttaaatatgggtggaaaactaatgctttatccattgccagacgctgtgccagcatatttgaaaatgggttttacgaaacagaatggaacatatttgtatcttgacccaagtgaaagtagtgtatggcacattgtaaatggttgttataaatataaaaaatgttaa

SEQ ID NO: 4871 - DNA, 144 bp, Xenorhabdus bovienii
  Coding sequence Name=Xb4151_4152.C444.gene46.dna; Position on contig =51687..51830bp; Strand=+
atggcaaagattgatgtgacttgcccctcttgttgttcagttaaagggatctatcgcaacgggcgctcacgttctggtcattcgtcatttaaaaaactcaaacccaaatcggtaaagaagccattaaacccgtcaccgaagtga

SEQ ID NO: 4872 - DNA, 276 bp, Xenorhabdus bovienii
  Coding sequence Name=Xb4151_4152.C444.gene47.dna; Position on contig =51856..52131bp; Strand=+
atggtcgtacgtaaagtcaaagaagccgcctcgttggcttttttatgccgacgacaggataagacgaaaagtgatcgcccatgtttttggtcccagaacaaaaaagacattaatgcgccatcttcgacagcatttggcaagactgactcgcaagacattgtctttttcaaaatccatagaaatgcatggcagaattatagggtattatctgaacattcatcacgatcaataaattggagtcatgacccatttcgtatcgagattaaaaccgattga

SEQ ID NO: 4873 - DNA, 633 bp, Xenorhabdus bovienii
  Coding sequence Name=Xb4151_4152.C444.gene48.dna; Position on contig =52779..53411bp; Strand=+
atgctaaaacgtaaatatttaacccattctgaaattgaacagctattagctgaattggaaaaagggccaaatgcagagcgtaatatctgcatgttttttatgggtttcattcacggttttcgagtttctgagcttttgaggcttcgaatgtctgatgtggatctacgtgaccgtagtttgagtgttaaccgtttgaaaaatggcttttctactatccatcccatgattgccagagaaattcaactaatacgtaaatggatgacaattagaaagaaacttgaaaaatttggtaagagtgaatggctttttatttcccgaaccggggagccgttatcacgtcagcaattctataaaattattagaaatacaagtatcaaggcagaaattgcgatttgcgcgaatcctcacatgttgcgtcattcgtgtggttatgcactagcagataatggtgtcgatacacgattgattcaagattatttaggccatcgcaatattcgtcatacagtcatatataccgcgagtaacgcaggtcgctttgatggaatttggagagcaagagggaagagaagaagggtgatatttagtaccaagctgttaactgccgatgaattttctggttcagagttgtcctga

SEQ ID NO: 4874 - DNA, 576 bp, Xenorhabdus bovienii
  Coding sequence Name=Xb4151_4152.C444.gene49.dna; Position on contig =53508..54083bp; Strand=-
atgggtgtatctctggttaaaggcggcaatgtatcactgacaaaagaagcccctgcgatgaatattgcgctggtgggtcttggctgggatatgcgtgccactgacggagcggcattcgatcttgatgcctcagttttcatggttggggaagatggcaaagttctgtcagacggccactttgtcttcttcaacaataaagtcagcccttgtggctcagtcaaccatcaaggggataaccgtacgggtgaaggcgccggcgatgacgaacagattaaaatcgatctggcgaaagtgcctgctgacgtgaaaaaaatggtgtttgcagtcactatttatgacgcagacaacaacaaacagaatttcggtatggtaagcaacagctttatccgcgtagtcaacaacgacaacgatcaggaaattgcccgtttcgacctgtctgaagatgcgtcaacggaaacagccatgattttcggtgaactgtatcgccacaatacagagtggaaattcaaagccgtaggccagggttttgccggaggcctctctgcccttgctattcagcacggcataaccatttaa

SEQ ID NO: 4875 - DNA, 579 bp, Xenorhabdus bovienii
  Coding sequence Name=Xb4151_4152.C444.gene50.dna; Position on contig =54161..54739bp; Strand=-
atgggtgtatctctttctaaaggcggtaacgtttctctgagcaaagaagcgccaacaatgaaaaatgttctgatcggtcttggctgggatgcccgtgccaccgatggacaagattttgaccttgatgcttctgcatttctgctgtcagcaaacggcaaagtacgtggtgatgccgatttcattttctacaataacctgaaatctgctgatggttccatcatgcacactggcgacaaccgtaccggtgagggagatggcgatgatgaatcactgaaaatcaaactggatcaggttccggccgatgtggaaaaagtggtgtttgttgtgactatccatgacgcacaaacccgtcatcagagcttcggacaagtttccggtgccttcatccgattggttaacgatgatactcaggttgaagttgcccgctacgacctgactgaagatgcttcaacggaaacggccatgctgttcggtgaactgtatcgccacaatacagagtggaaattccgtgcagttggtcaaggttatgcgggtggtctggcatctgtttgcgctcagtacggcattaacgcttcctga

SEQ ID NO: 4876 - DNA, 1032 bp, Xenorhabdus bovienii
  Coding sequence Name=Xb4151_4152.C444.gene51.dna; Position on contig =54858..55889bp; Strand=-
atggtatccacgcacataggttttccgatggaaaccgttgctgtattcattattctgtcggttggcgcgctctttatcgacctctttatgcatcgtcatgataagccgatttcgctgcgcagcgctgccctctggtccattttctggatcgctattgcctttgttttcgccggattcctgtttgttcatcacggtgctgaaaccgcgagcctgtttgttaccggttatgcactggaaaaagtgctgtctgtcgataatctgtttgtcatcatggcgattttctcctggttcgccgttcctgatcgctaccgccatcgtgtcctttactggggcattatcggtgcaatcgtcttccgtggcatctttgtcgctatcgggacaagcctgctgacgctcggcccttgggtcgaaatggtttttgccgttatcgtgggctggactgcggttatgatgctgaaaagcggtgatgacggtgatgaaatcgaggattattcacagcaccttgcctaccgtctgataaaacgctttttccctatctggcccaaactgcgcggccacgctttcatgttgaatcaaaaggaagtgaatgccgaactcaccaaaccggaaaacgcagatgtaaaagtgggtcgtacgggcaaagcggcgctttacgccacaccactgatgttatgtctggcggtagtggaactgtccgatgtgatgtttgcctttgactctgtacctgcggttattgctgtcagtcgggaacctttaatcgtttacagtgccatgatgtttgctatcttaggcctgcgtacactttacttcgtgcttgaagcactgaaaaagtatctggttcacttggaaaaagcggttatcgtcctgctgttctttattgccatcaaactcggcctgaacgcatctgaacatatgttccaccacggttattcaatttcggcgacaaccagcttgttcgtggtgattggagtactgactgtcggtattattgtcagcctgctgtttccccaaaaagaagaaaatgaaagttaa

SEQ ID NO: 4877 - DNA, 456 bp, Xenorhabdus bovienii
  Coding sequence Name=Xb4151_4152.C444.gene52.dna; Position on contig =55918..56373bp; Strand=-
atgtcctttttaaacaaaatcaagacggctttcagcgcgggccgtgaagagctgaccaatcaggtcggccgcttcaagaaccgcaagttcatggaaggcaccgtagccgtgtgcgcacacattgcgatggcaagtaacggcgtcagctcagaagaaaaacagaaaatggtagggttcatcaaaaactcccctgaactgaaagtcttcgataccactgaaattattgaattcttcaacaaactggtcagcagctatgaatttgatgctgacattggcaaaggtgaagccatgaaattcatcatgattctgaaaccgcagccggaagcggcacagcttgccttgcgcgtaggtattgccgtcgccaaaagtgacggcgattttgataacgacgaaaaaacggctgcccgtgaaatttgtacaactctgggctttacacccgcagatttcgaactgtaa

SEQ ID NO: 4878 - DNA, 1167 bp, Xenorhabdus bovienii
  Coding sequence Name=Xb4151_4152.C444.gene53.dna; Position on contig =56405..57571bp; Strand=-
atgaacctgacccccgggggaaatgcccccgtatccaaccagactcttacggtgagagtactttcaggcacggccgtggatgtatccgccttccgcctgtacgccgatggcaaagttcagggcgatcccgacatggtgttttatggccagccggtcaatgatgacaacaccatccgtcaggcaggggggaacgttaatacctcgttctttgttaacctgcctaccctgcgtcacgatgtccaaaaagtggcgtttacagtgacctgcgacggcaaccagaccatttccagcctgcggactctttctattcaggtagaactgaacggaagcatcgttctgcagggcagtgttgacgttcagggtcggacagaatccgctttgatcctcggtgaattatatcgccgcaacaatgaatggaaattccgctttattgctcagggttttaatggtggccttaaaccactggcggagcattttggtgtgaatatcgttgatgatgcgccagctaaaacgcctgtaccaccccctgctcccactccagcaccaaatagcgtcaatttaagcaaggtttcgctcaccaaagaaaaaccggcgattagcctgagcaaacgtgacaatttcggtgaaattcgcgtcaacctgaactggaatcaggctgcttctccggcaaaaaaaggggtattgcagggcatattcagcgccaacaaaggcgtggatctggatctcggcgcattcattcggctgcatgacggagaacgttatgtcgtgcaggcgataggcaaaagctttggggattatcatcgggaaccctacgtaaaattgcagggtgatgatcgaactggtgccgtccgtgatggtgaatggctccacattaatgggctcgaatggaaaaacatcagtgaagtgttagtttatgccttgatctatgaaggcgttcccagttgggacaatacagacggcgtggtcacaattcatatcagtggccaagcccctatcgaaacccgcatgacggaaggcaataaccagaaacgtatgtgtgcggtcggccgccttgtcaatgaaaacggtgcaatcaaagtagaacgtatcaatcagtacttcagcgggcataaggagatggaccgagcattcggctggggctttcgctgggtcgcaggcagtaaataa

SEQ ID NO: 4879 - DNA, 588 bp, Xenorhabdus bovienii
  Coding sequence Name=Xb4151_4152.C444.gene54.dna; Position on contig =57571..58158bp; Strand=-
atgatttcgttaagcaaaaatcagtcaatttcgctcgccaagcagagcgcttcactggctaaagttgattttggtctagggtgggatcctgtctccaagaacaaaggctttctgtctcgtatgttcggcggtggcaatgacgaaattgatctggatgccagctgcatactgctcgataacgctggcaagactatcgacacagtgtggtttggtcaactggactcactatgtggttccgtggcacacagtggcgataacagaaccggtgaaggcagcggcgatgatgaaaccatcagtgtcgatctgatcaaactgcctgccagtgtcgaatatctcgtttttaccgttaacagtttccgtggtcaaacctttaatgatgttgaaaatgccttctgccgtgtcgttgaccaaagcggcaaagagctggctcgctaccaattggatgagcagggcgcccacaccggcattatcatctcttccctgcgccgcaataggggtcaatgggatttcacggcacatggtgccgcttgtcgcgggcgtactattgacgatatgtatccccaaatcgttgagacggtggtgcgctaa

SEQ ID NO: 4880 - DNA, 1155 bp, Xenorhabdus bovienii
  Coding sequence Name=Xb4151_4152.C444.gene55.dna; Position on contig =58578..59732bp; Strand=+
atgacagcatttaatgatacgcagagttatcaaggccagatttccaaatggaagttgaacagcgggacgttgactgtaacggcagcccgtggcaccgcatctctggaaaccctgtttgatattgctgaacgccgtaaccccaaaagggcatttttatttgtcagcaaggtattgggacgccacattccggtcagtccatcgatcatgcgctcggtttaccggcagttatctgaacaatttccgacccacattcccggccctgtgctgtatatcggtatggctgaaacggcagttgggctggcagccggggtttttcaagaaacccggaaacaggctgaagctccggtatttttgacgtcgacacgtcatcccgttgagggtgacctgctgtgtgaatttaaagaaaatcacagtcatgccacggatcatctgatttactggccggaagaaaacagattgcgccaacgggtggttaatgcccgtacccttgttctgatcgatgatgaagcgaccacgggaaatactttccttaatttactcaatgcactgagtcatgccggccttaatcagattgaacatatcgtcaccgtgacgttaacagattggagtggcaaatctgttatagaacgttgtcctctgccagtctctacggttgctctgatcgagggaaactggcattgggatgcagatatttccgccccgatccccgtcatgccgcaagtcaatgtcacggcgcggggagatgccggcattattggtaagcagagttggggacggctcggattggatgacattcagtgtgatatcggcaccgaaattcatgctaaagcgggtgaaaaagtgctggtgctgggttccagtgagtttgtctggcagccatttttgctggctgaacggctggagcaggaaggcgcacaggtgaagtttggttccacaacccgctctcccatttcctgcggccatgccattcagtcagtgatgtcttttacggataattacggattggggatcccgaattttctctacaatgtggcacatcagcaatttgatcgcatactgctctgccttgaaacgcctaaaaccgccgtcgatccggcactgatgacgcaacttgcccgtgtttccccgattgtcgagattgtctcctatgattaa

SEQ ID NO: 4881 - DNA, 795 bp, Xenorhabdus bovienii
  Coding sequence Name=Xb4151_4152.C444.gene56.dna; Position on contig =59725..60519bp; Strand=+
atgattaagcccgtttttttgactgatcttgatgacacgttatttcaaacgcgtcggaagataaaaaaagcaccggatattgagtcttgtcgtgtgggcgcattggatcggaaatattctccttgcagctatatgaccgaagagcagtcaatattgattgactggttgctggcttatgcggaggttatccctgtgacggccagaaatacagagcaacttagccgggtgaaaatccctttcaattcatggcggattgcggcacatggcgcagtgctcttgacgccagaaagtacgctggatcaggagtggcaggcacatattctggcagaactgacgccttaccgtgatcagtttcgggaactggagcacttgagtcatcgcttgattgctgctcatggtatagaagcatgggcgcggattgattatgaatatggcgatgttcccgtctatctggtgattaagcacagagactgtaatcggttggaaggccttgatgtgcttgctgaaaatattacccaagaaatggctgatgtttttgattctggtaatttttatcttcatcaaaataataacaacctgactttgctgccaaagtgcattgacaagggattggcaacccgtcaccttttgacaaggcttcgtactgagagaggcgtttttcctatcattggtctgggggatagcctgagtgaccaccgtttcatgaaactgtgtaattggttcggtatgccccagcacagccagtttgctaacaccttgatgacctctttattcggaactgtaaataatgaatag

SEQ ID NO: 4882 - DNA, 1002 bp, Xenorhabdus bovienii
  Coding sequence Name=Xb4151_4152.C444.gene57.dna; Position on contig =60590..61591bp; Strand=+
atgacaccggttgatatcaaagagcagcttattcagtctggcgttcgtcactattcagagatgttgagtcaagagccagagccaacaccttatcatcttgatttatttgacagagcgcttgaacaaggtgcaattcgtctggcgaccgaagtggtgatgctcgccaatgcgttgatatcacgctttggtgatacgccgatagtgttggtgagtctggtcagagcaggggttcctctgggggtgatgttgcaccagacactcagaaaaatgggcaggcaatcttatcactatggcatcagcattatacgggatcgcggtatcgacagtacggcgctgtcgtatattgagcagcaacatggcacggatgggctggtgtttgtggatggctggacaggtaagggcgcaattatggctgaattatcccgttctctggcgggtcggtctggctattcaggcatcccccgtctggtggtactggccgatccttgtggatgttcatggctggcggccagtgatgatgattggctcattccctttggcattatgggagcgcctgtatcgggtctgatatcacgttcgatctggcgtgaggaaggaatgcacggctgtgtgcaatgtgaccacctgagtgagtttgaatgtagtcgtctgctggtggataccgttgctgattgtcgcgatcgcttggatctgggtacgataccggtggtggattggcagccgcaggaaaagatatctttgctggaattgagcaaaaccgtgatctcaacccttaccgaagtgtaccgggtcgacagcattaatcgcatcaagccgggcattgcagaagcgacccgtgcggtattgcggcgcgttccggaacatgtactggttcgatctcaatatgatcctgatgttgctctgctggttcatctggcacgtcagaaaaacgtcgttattactgaagtcggcgatctgataggacaatatcgcgccgtgactatcattaagaaggtagcttga

SEQ ID NO: 4883 - DNA, 954 bp, Xenorhabdus bovienii
  Coding sequence Name=Xb4151_4152.C444.gene58.dna; Position on contig =61591..62544bp; Strand=+
atgaaaccgatcccttccccacatcaacttggtgcaacgctgtacattccggccactcgtcaaggtattgcagaaattgtactacacaataaaattcccggtctgcgttctctggtgatctgcctggaagatgccgtcagtgatcaggatattcccgccgctattgagaatcttgacggtgtactacaatcactggcgggagctgatatctcttcttcccatacagagcgtgactaccccctgatttttatccgcccccgcaatgaagagatgggacgttatctggtagacaacgttaacctcagcgccgttgatgggctggttctgccgaaatttacccgcgcttcattagctggctggtggaatatcgtgggttcgacccatctcagcatgatgccaacgctggaaaccgaagaagtctttgattcccggcagctgaatcagctagcggacagtcttaaagcccatccctgttataagcgtattatcgccctgcgcattggcggcaatgatctgatgaacgtgatatccctgcggcgttcgcgtgacttcaccttatatgaggggccaatgggatatgtgataaaaatgctggtgactatttttgctgcgcggggtttctccctgactgcacctgtttgcgagcatatcgatgatttgcggttgcttgagaaagaactggtattggatattgctcatggtcttgtggggaaaacggccatccatccggggcagattgaatatatccagcgggcgttgatggtcaatgggcatgattatgcggatgctctgcgtatcctcaattccagtcaggctgtattcaagtctcagggaacgatgtgtgagcctgctacccatcgacgttgggctgtgaatatcctcgaccgggcgaaatactatggtattgcgcctgaattcaatgaagaaagctgtaaaacttttaatttgttttga

SEQ ID NO: 4884 - DNA, 477 bp, Xenorhabdus bovienii
  Coding sequence Name=Xb4151_4152.C444.gene59.dna; Position on contig =62643..63119bp; Strand=+
atgttacttagccccaagcaatttagaaatttcaggttgaccttattactctcgcatgagaaacccgttagcaaagtgagaatgattcgagagctgaattgttcagaaccgacactgacccgtgcattgagggagctacgcgatctctattgtgccgatatccggttcagcaaaatggggaatacctatcaattggtcgataaaggcacactgactaaaaaagatgtgcgcagaattgaagagttgctcatccagaataatagtctcaaggccgaagaagctatcagccatgttttccttgataaggagaagaaaaagccggtttctctctccttgaggatgtccgttattcgaaaaattgacgggctggccaatcggcttgagacaacccgaagtgacgtggtcgaaatggtggtagacaggtttatggagacactacagaaagaggccatggacgtggattcgcagaaaagataa

SEQ ID NO: 4885 - DNA, 495 bp, Xenorhabdus bovienii
  Coding sequence Name=Xb4151_4152.C444.gene60.dna; Position on contig =63195..63689bp; Strand=-
atggaacgctttctcgaaaacataatgtatgcctcccgctggctgcttgccccagtttattttggtttgtcactggcactgcttgcccttgccgttaagttctttcaggaaattattcatatcctgccgcatatcttttccattgctgaatccgacctgatcctgacactactttctctgattgatatggcgttggttggcgggctgctggtgatggtcatgttttctggttatgaaaactttgtttcaactctggatatctacgaacacaaagagaaattgagctggctggggaaaatggatgccacttctctcaaaaataaagtagcggcctcaattgttgctatctcatccattcacttactgcgtatctttatggatgccaaaaatattccggacaataaactgatgtggtatgtcattatccatctgacttttgtgatgtccgcatttgttatgggctatcttgataagcttacccgccacaagcactaa

SEQ ID NO: 4886 - DNA, 459 bp, Xenorhabdus bovienii
  Coding sequence Name=Xb4151_4152.C444.gene61.dna; Position on contig =64209..64667bp; Strand=-
atgagtaataaatattttggtgatataaaactgagacctatcgagcatgacaatgatgtacaggcggtagtcgatgtttggttcaatacttcgattaagtgtcatgcatttgtatcagaagatttttggcactcatgtaaaacggatatgaaggaaatttatattccgaattctgagacagttgtcgcgacgataaacaacgaagtcgtcggttttattagtcttcttgacaatattctggcctcaatttttatacttcctgagtaccaaaaccgagggatcgggttacaattgttaaatcatgcatttgaagtccgtaattctttaacactaaatgtctatgaaaaaaataccaacgctcgaaagttttatgcaagccagggttttgaagaaaaagagcagggtattgatgaacataccggtgagcctgaaattaccatggtatggaaccgttcatag

SEQ ID NO: 4887 - DNA, 135 bp, Xenorhabdus bovienii
  Coding sequence Name=Xb4151_4152.C444.gene62.dna; Position on contig =64873..65007bp; Strand=-
atggtagtcttatgtcaccgtttctataggaaagttgttcttggtgattggcgggatgcgagagagtacctcccccatttgattaaactgaccaaacagcagagaagaggagccggttatgatgtgaagccatag

SEQ ID NO: 4888 - DNA, 3123 bp, Xenorhabdus bovienii
  Coding sequence Name=Xb4151_4152.C444.gene63.dna; Position on contig =65383..68505bp; Strand=+
atgaataagcgatacagaatattccagcagattccggttgctgggcgtttgtcggtcaaaaccgagtcacgtatccttttccgtgccgtggcctgctgtctggctgccgtcagcgcgagtgcatttgcggggagttataatgatcctggcaggctgaatgatcctgccagctggcgtaccagtgagttccgagctgactgggggcttggcgctattcatgctgacgaggcttatgcccgtggctataccggtaaggggatcaaactagggatattcgatcagccggtttataccaagcaccctgaatttatgagtccggataaggtgatcacccttgccacctcggggatccgtgaatataccgatccctatattaaagtgaaaaaaggggataaatttaattataatggcacaccgaccgtaggttcatccggtaagctgggggcgcacggcactcacgttggcggtactgcggccggtatccgggatggcgagaagatgcatggtgtagcctataatgcacaaatcatcagtgccgataatggtgatcctggccctgaagacggcatcatcttaggtaacgatggcggcgtgtatcaggccggctggaatgcgttgatcgggagtggcgcccgtattattaacaacagttgggcgattggtattaccaaaaaatttacactgggaggctataacccagcctatccacactttactgtagcagacgcccggaagcagtttgatgaaattaaattgattctggggacaaaaccgggtggtgcgtatcagggcgcaattgatgccgcacgtggagggattgtgacgatttttgctgccggtaacgatggcaatctgaataatccggatgccatgtctggtctggcttggtttgtcccggagatcgccccgaactggctgacggttgccagcttgcagcaggatcttaagagcactaacagtgtgccttattccatcagttatttctcctctcgatgcggctataccgccagtttatgtgtcagcgcgcccggcagtcatatctacagcgcaatcatcagtggaacgggcatggataatctgacgactggctacgctcactacgacgggacttctatggccgcccctcatgctgccgggagtattgccgtgttgatggaacgttttccgtacatggcgggggatcagatcgcatccgtgcttcgcaccaccgccaccgacatgggtgaaccgggtatcgatgcgctttacggctgggggatgattaatctcggcaaagcgatacacggccccggtatgttctataccgcagaagatattccacaggctttccgtatccctgatcccgacggtgtggcctatggcagtagccagtttattgcggatatttccggtattgggactgtactcgataaaggcaaaccgaccgagcgtatctgtgatagccagcagtgtgcgcaggatatctggagcaatgatatcagtggtcacggtggactcaccaagcaggggagcggaacgcttattcttgctggtaagaacacctattcagggccaacgttggtcagacaggggttattagatatcaacggtgaactgacctcctcagtttcggtactggagagcggtgtgctcggtggtaatggcactatcggcgcactcagcgtgcaacgcggtggtacggttgcaccgggtaactctgtcggcactctcaatgtttcccgcgacgttgcttttgaagccggttctcattacgccgttgaaatcgctgctgacggacgcagtgatcatattcaggcggctggccgtgcacagcttcgcggcggtgacgttgccgtttccctcgaaaacagtgctaatcttctttcccgcaatgaggtacgcagtttaattggtcaacagtaccgtatcctcagcgcaaaacagggcatcaacggccgttttgatcaggtagccccgaactacttcttccttggtaccagactgtcgtatcagcctgatgaggttacgctccatgtcgggcgtaataataccgcttttgcggatgtggctaaaacgccaaacgagcgcgctgtggccgcagcagcggatacactcagtgttggcaatccggtttacgagagtatcctgagttttacttctgtggatcaagctcgtcaggccttcagtcggcttgatgggcagatccattctgatattacctcctcgctggtcaatgacagccgttatctgcgtgataccctgaatactcgtctaagtcaggctgaaggccgtgcttcatcgtccgatatccgcgaagatgataatggtgcatgggcacgtctgctcggtgcgtggagtcacgcttcgggtacgaataacagtacgggttatcaggcttccacttacggtgtactgctcggatttgatgcgcctactgatgcttacagccgtctgggtatcgcgaccggctacacccgtacctcccttgatggtggctacgactccagtgctgacagcaataactaccacctcgccctctatggtgaccgtcagttcggtgatctggcactgcgtgtcggcggtggatacacttggcatcgcattgatactgctcgttccgtcagctacggcagccagttcgatagtcagagtgctaaatacagtggccgtacggcacagttgttcgcagaggctgcgtacaatctgcctgccgggtcagtgaactttgaaccattcgtgaatctcgcctatgtcggcttccgcaataatggcattaacgagaatggtgcggcagcggcgctccacggtgataaacagcacaccgaggccaagctctccacactggggctgcgtgcgaaccacagttggcaggcaatgggaggaacttcggttgctttacagggtgaattaggctggcagcatcagtatggtgatcgtgaacgggttactagtctggcgtttcgcggcagcgacaccagttttgtgacccgcagtgttccggcctctcgcgatggcttggtgctgaaggccaatgcggagatgacagccagtgataacgtgtcattgacgcttggttacagcgggttgctatccagcagccatcaggacaacagcgttcacgcaggttttaactggcggttctga

SEQ ID NO: 4889 - DNA, 636 bp, Xenorhabdus bovienii
  Coding sequence Name=Xb4151_4152.C444.gene64.dna; Position on contig =68628..69263bp; Strand=-
atgtttgataaacaaactctcgttgagatcgcggaaattgccaaagtactggggaatacccaccgcctgacattgcttgaatgtttggccgataccgagcaatccgtcgaacgtctgtcggatttatccggtctgtccgttgccaacacttcccagcatctacagcacctcaagcgcgtaggactgcttcagtcccgcaaagaaggcaagcatgttctttaccggcagggagaaggcccgctggcagatattctctcggcactcctgcaatatgctgaatttaaccgcacagaaatgcgcaggctgattgatgatacaaataatcaggaatctatttcatgggaagaactgctggatcggatcaaagaaaaaagcatgacattgcttgatgtcaggccaaaagaggaatttgaacaaggtcatttgccgaacgccatcaatattccggtcgatgaattgggaagcagactggacgagcttgctaccggtcaggaacttatcgcctattgtcggggcccttattgcgttctctctgccaatgccctcgaattgctgcgtgctaaaggcgttcgcgcccgccgctttaaaaaagggttctcaggctggaaagatgcgggaatgcataccgaagtatga

SEQ ID NO: 4890 - DNA, 498 bp, Xenorhabdus bovienii
  Coding sequence Name=Xb4151_4152.C444.gene65.dna; Position on contig =69398..69895bp; Strand=+
atgaatgaagggctggagttgattgttcgttctgtattgatcggggctggtgcaacggttgtgatggatctttgggcggttttcataaaacgcagctttggagtgccatcactgaattattccatggttggtcgctggattgggcatattccaaaagggatatttgtccataaaagcattgtacaggctgaacccgtgaaaggtgaaacggggattggctggttcgcccattacctgattgggattattttcgcgggacttttattattgatttgggggctggattgggcgaaaaatcccactttgatccctgcattgattgttggtatcgttactgtcgtcgcgccttattttattatgcagcccggtataggaatgggaattgcagcatccaaaacccccacgcctaatatcgccagattaaaaagcttgatggcgcatacgtcttatggtgttggtctttatttagctgcactcctcctgacattattttcttaa

SEQ ID NO: 4891 - DNA, 279 bp, Xenorhabdus bovienii; identical to SEQ ID NO: 890
  Coding sequence Name=Xb4151_4152.C444.gene66.dna; Position on contig =70378..70656bp; Strand=+

SEQ ID NO: 4892 - DNA, 321 bp, Xenorhabdus bovienii
  Coding sequence Name=Xb4151_4152.C444.gene67.dna; Position on contig =70607..70927bp; Strand=-
atgtcggcgcaccaccaaaagacattccccagacaattaatccgaaccacacaaaaaggctattataactcgataaaatggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 4893 - DNA, 318 bp, Xenorhabdus bovienii
  Coding sequence Name=Xb4151_4152.C444.gene68.dna; Position on contig =70843..71160bp; Strand=+
atgaccattttatcgagttataatagcctttttgtgtggttcggattaattgtctggggaatgtcttttggtggtgcgccgacattattgcaaacagcacttgctgacgtggcggaagaaaatgcagatgtcgcccaatctatgctggttactatttttaatctagcagtcgcagggggaggtattatcgggggaggtttactcaataattatggtatgacttcttttccgattaccatgattgctctttcattatttgcattaagtttagtctggcgagccaagaaaaatggtttcagacccggccaaagaagatag

SEQ ID NO: 4894 - DNA, 129 bp, Xenorhabdus bovienii
  Coding sequence Name=Xb4151_4152.C444.gene69.dna; Position on contig =71221..71349bp; Strand=-
atgcctgaggatctccacaattttattttctttagcaaaaactttgatcgtgcctcaggcactttagttcccttcttaagcaaatctcaggttagtcaagtttctgtttctcagccatctatgttttag

SEQ ID NO: 4895 - DNA, 582 bp, Xenorhabdus bovienii
  Coding sequence Name=Xb4151_4152.C444.gene70.dna; Position on contig =71611..72192bp; Strand=+
atggccgagcgtggcattgaggttgaccactcgacacggcaccgctgggtaactcgtttggtgccgttattggataaagcctttcgccggtacaagcggcctgtcggacgtcgatggcgaatggatgagacgtatatcaaagtgaaaggccagtggaaatatctgtatcgagccgtcgatacgaccggacagactatcgatgttctactgacggcaaaacgggatgcgcctgcatcattgcgcttctttcacaaagcgatacgccaccacggtgagcctgaggtggtgaccattgataaaagcggtgccaacaccgcggcgctagacaagctcaacgccgataagccggaagaagaaatgataaccatcagacaaaacaaatacctgaacaaccttgttgaacaagaccaccgcaatatcaaacgtcggacaggctctatgctcggatttaactcgtttcgtcgagcccaaaccctgttagcggggatcgaagtcgtttcgatgttgcgtaaaggtcaatatatacaacccaaagataatacattatctcccacagagatgttttaccgtttgattgcctaa

SEQ ID NO: 4896 - DNA, 1050 bp, Xenorhabdus bovienii; identical to SEQ ID NO: 483
  Coding sequence Name=Xb4151_4152.C444.gene71.dna; Position on contig =72307..73356bp; Strand=+

SEQ ID NO: 4897 - DNA, 270 bp, Xenorhabdus bovienii
  Coding sequence Name=Xb4151_4152.C444.gene72.dna; Position on contig =73608..73877bp; Strand=-
atggctttgctagatttcttcctgtcgagaaaaaaaccgacagccaatattgccaaggagcggctgcaaatcatcgtggcagaacgtcggcgcggtgattccgagcctgcttatttgcccgaaatgaaacgggatattctggccgttatatgtaaatatgtacaaatcgacccagaaatgctctctgtgcagtttgagcaaaaagatgatgacatatccgtactggaacttaatgtaacattaccggagactgaagaatcgccaaaataa

SEQ ID NO: 4898 - DNA, 813 bp, Xenorhabdus bovienii
  Coding sequence Name=Xb4151_4152.C444.gene73.dna; Position on contig =73881..74693bp; Strand=-
atggcacgcattattgttgttacatctggtaaaggtggcgttggcaaaaccacttcaagcgcggccattgctaccggtctcgcccaaagtgggaaaaaaaccgtagttatcgattttgatatcggtctacgaaatctcgatctgatcatgggctgtgaacgccgcgtggtttttgacttcgtgaatgttattcaaggtgatgccgcattaaatcaagcgcttattaaagataaacgtaccgagaatctgtatattctgcccgcgtctcaaacccgtgacaaagaagccctcacccgtgaaggcgtcgaaaaaattctgaatgaattggatcaacaagggttcgagtttattatctgtgattcaccagcaggtattgaaagcggagcattaatggcgctctattttgccgatgaagcaattatcacgacaaacccggaagtttcatctgttcgtgattctgatcgtatcttaggtattctggcctccaaatcacgccgcgcagaaaaatctaatgaaccgattaaagagcatctcctactgactcgttataatccggggcgtgtgaaccggggcgatatgctcagtatggaagacgtgctggaaattctgtgtatccctttgcttggtgttatcccggaagatcaatctgttctgcgttcatcgaaccaaggggaaccggtcattctggataaagaatctgatgcgggtaaggcatacgaagataccgttttacgtctactcggtgaagaacggcctttccgttttatcgaagaagaaaaaaagggctttttaaaacgcttgtttgggggataa

SEQ ID NO: 4899 - DNA, 684 bp, Xenorhabdus bovienii
  Coding sequence Name=Xb4151_4152.C444.gene74.dna; Position on contig =74717..75400bp; Strand=-
atgtcacagtcgccaattgagctaaaaggcagtaattttacgctttcggtcgttcatttgcatgatgaccagccggaagtcattcaaagggcaatgcaggaaaaaatggagcaagcaccagaattcctcaaaaatgccccggtcgtaatcaatatatctgatcttccagccggtgccgatctcctcgcactctatcgtgctgttgaatctgtcgggttgcgcattgttggcatcagcggctgtcaggatgaagatcaacgaaaaattgttctaaaatctgggctacctttactgaaagaaggtaaaagtcagaaaattcctactcaagaaaataaaccgactgaacctattttcaaaaaaactcgtataattaatacgccggttcgatcaggacaaagaatttatgcgccaaatagcgatcttattgtcaccagtaatgtcagcgctggcgcagaattaatcgctgatggaaatattcttatatatggtgtgctacgtggacgagtattggcaggcgcatctggtgataaagaaagccagattttctgcacccatttaaacgctgaactctgctctattgcaggtcaatattggctcagcgaaaatattccagaaaattttgttggcaaggctgcaaaattacgtttggtaattaatgaattaactattgaaaccttagtctag

SEQ ID NO: 4900 - DNA, 270 bp, Xenorhabdus bovienii
  Coding sequence Name=Xb4151_4152.C444.gene75.dna; Position on contig =75530..75799bp; Strand=+
atgatttgtgtaatctacagaagcccaaaacgtgaccagacatttctctatgtcgaaaaaaaaggtgatttttcacgcgttcctgaagcgttgctgaaaacattcggtgaacctcaatactccatgatgatttcgttatcaggaagaaaaaaactcgctaatgcagatattgaaaaagtaaaaattatgctgagcgagcagggtttttacctgcaagtccccccaccagtagaaagtttgatgagtgaacatctggctgtaaataagtga

SEQ ID NO: 4901 - DNA, 1086 bp, Xenorhabdus bovienii
  Coding sequence Name=Xb4151_4152.C444.gene76.dna; Position on contig =75850..76935bp; Strand=+
atgaaattaatatctggtgtggccttaatgacagtaacactgttggtagggtgtacttcatcgaatggaaaagtgttgcaggatcaatccagacaggcggttgtgatacagaaagaaatcagggtattggatggacaatttcccattgcttctcgtgaaccatcacaatttcctacctatgtggctttactgaaacaacaagctaaagagcagggtttcagtgaaaaaacattggatcgtgcatttgctgatattcattttatctcgcgggttattcaatctgatcgtaatcagccggaaaaaaaaattacgttggctgattaccttaaccgcgtcttgtcagcccggaagattgaacagggcgtcatccagtatcagaataacctgccccagttagagataatcagccgcaaatacggtgtaccgaaagactatattgttgctttatgggggttggaaagtggttttggcaaaattcagggaaaggaagatgtcatatcggcattatctacgcttgcctttgaaggtcgtcgggaagatctttttataaaacaattaatggcagcacttgaaatcatagaaaagaaatatattgatgaacatcaaactttgaaagggtcttgggcgggagcgatggggcaaagccagtttatgccgacctcgtacttgaattatgctgctgacggtaatggcgatggcaaaatcgatatctggaacagtaaggaagatgtatttgcctcaattgccaattatctggcgaaggaaggttggcaacaaggattaccgtggggttatggggtttcactgcctgctggtttcgatcaaaacttggaaggcgttaagttagagcagggaaaaacgattatccaatggcagacattgggtgtttcatcccccaattttgccagtctgccggtaaataccaagggttggattgtgataccaaatgatactgaacagcgggcattctgggtaacgcagaatttccgtaccatcatgcactggaaccgttcttacaattttgcccttagtgttggtatgatggcagatcatattggccagaaaacccattttctcactcactga

SEQ ID NO: 4902 - DNA, 657 bp, Xenorhabdus bovienii
  Coding sequence Name=Xb4151_4152.C444.gene77.dna; Position on contig =76971..77627bp; Strand=+
atgtaccagcatcgagactggcagggtgtactgctggattttcctgccaataaagtggtttgtgtcggcagtaattacgagaggcatatgaaagagatgggctctaaagtgaccgaagagccggttttatttctcaagcctgaaacggctctttgtgatctctgtcagccggtttccatcccgcagggattgggagctgtgcaccatgaaattgaattagcagtcttgattggtacgacactcaagaatgccaatgaggaacgggtcggcaaggcgattgcaggttttgcggtagcactggatctgacattgcgtgatttgcagcataaattcaaacaatctgggcaaccgtgggaaaagagtaaggcgtttgacggttcatgccccatatcggggtttattcctgtcaaagtctttagtgaaccacaaaatgcccagctttccctgacagtgaatggcgaatcacgccaaaacggtaatacgagtgacatgcgaatgcccatcatcccattgatcagctatatgtcgcgtttttttaccctgcgccccggcgatattatcttaacgggaacgcctgaaggtgtagggccactacaatctggtgatgtactggacgtctctcttaatgagcacgttttaacaaccagagtgatttaa

SEQ ID NO: 4903 - DNA, 447 bp, Xenorhabdus bovienii
  Coding sequence Name=Xb4151_4152.C444.gene78.dna; Position on contig =77637..78083bp; Strand=+
atgactgaacttatgtctcaacctttctggcaggcgaaaactctggaacagatgacagaccgagagtgggaagcattatgtgatggctgtggtcagtgctgtctgcataagctaatggatgaagatactgatgcaatctatttcactaatgttgcctgtaatcaattgaatatcaaaacctgccagtgcaagaattatgcagatcgttttagatatgagcctgattgcatcaaattgacgcgtgagaatatggtcacgtttgaatggctaccgatgacttgtgcttatcgtttgattggtgaaggaaaaaaactccttccttggcacccattagtcagtggttcaaaatcagccatgcatgcagagcgtatttctgtcagacacattgctgtgcgtgaggctgatgtggtggactgggaagatcatattatgaacaaaccagagtag

SEQ ID NO: 4904 - DNA, 147 bp, Xenorhabdus bovienii
  Coding sequence Name=Xb4151_4152.C444.gene79.dna; Position on contig =78118..78264bp; Strand=-
atgaaatatatatcttataatcattatcttaatttgttaactataccaatgaatttcgatttgcagtacgacggcaagaaaacgaaccccgggagtataaggatttatttctcatgccccaccgatacccaaaatacagccatatga

SEQ ID NO: 4905 - DNA, 639 bp, Xenorhabdus bovienii
  Coding sequence Name=Xb4151_4152.C444.gene80.dna; Position on contig =78528..79166bp; Strand=+
atgtctattgaaaatataaatatcaatgagcaaaaaattggtaaagattcagttgtacttgggcatgcggaagcattggcaatacatgctgtcgccattggtgcttcaccacgaaattctaaagccatcagtgaagcggctattgctattgggcaaaatcaacttgccggtaaacagggagatgcgaccgttgtttggccaattgcaattggtgctgattctgtatccagtggcctggcttccatcgctttggggcaaaaggtaactgccagtgcatctcaggccgtagcgattggccaacattcctctgcaacagaaaaaggaagcgttgcattgggggcagattctattgcgaacaaaccgaatgttgtttctgtaggaaaatctggtcatgaacgtaaaatcgtgcatgttgccgtcggtgatatttcaaatcatagtactgatgcggttaatggtcagcaattatattctgaaaccgcgaaaattaatgtattactggatgaaaaaaataagcaattggaaaatagaatcgaaactcttgagagtaatatagccaatctcactctattaaataagaataatgcagatgatattgaattattgaagcaacggctctttgatgcattaaattattaa

SEQ ID NO: 4906 - DNA, 318 bp, Xenorhabdus bovienii
  Coding sequence Name=Xb4151_4152.C444.gene81.dna; Position on contig =79256..79573bp; Strand=+
atggttatccattcgatagggatatttttacgaaaggtatctatggattcagggtggttaaactttgtaatgatttgtaatttacgaggtaggtcagacataaaaatttggtctcaaattattgtttgggaccaattatgtgtgcgcataccggacatcaccacacatcggattgccatgaataccggattttcctctcatatttcttgcttttatcagccaagaaaaactgataacttgtctgctccacagtcaatacaaggaatgataaatggcaagttatttggttcgtgtagaactttatggcacgggttctga

SEQ ID NO: 4907 - DNA, 294 bp, Xenorhabdus bovienii
  Coding sequence Name=Xb4151_4152.C444.gene82.dna; Position on contig =79527..79820bp; Strand=+
atggcaagttatttggttcgtgtagaactttatggcacgggttctgatggctatgagaagttgcataacagaatgacagcaaataagttcaataaatcgatacaatttcctaatggaaaatggcatcgtcttcccagtggaacttatattggtaactcatcgctggaatcccttcaattagcggaaaaaatcaaatcaatcgcgacccctttctcaagcaaagaaccgtcgatatttgtctgtatttacagcaattggagtgcagcattgtatcccgataaaggaaccggctga

SEQ ID NO: 4908 - DNA, 435 bp, Xenorhabdus bovienii
  Coding sequence Name=Xb4151_4152.C444.gene83.dna; Position on contig =80326..80760bp; Strand=-
atgaagaaagcgatttcgtttgcgatcgcgaccctgctactcacagcatgtcagtcttcgggggttagcgccacggggaatgttacggtcagggatctacaacatcgtaattttgctttaatcagtgtcaatggtgcaactgtttcgaataaagaagacagtaaactttctattgcatttagtgaaaaaatgtttgtttcagcaactatgtgcaatcattttatgggaataggtaaattaaagaagcgtgttctgactgtcagtattttagaaaaatcccagatgttttgtgtcaatgaacagcttcatcaatgggatcaagtgatttatgatgtactgactgagggagctacggtcagattaaagagaaaacagcttacattaactaatgacaaaaacacgctggtttatgttttgagggatattacccaataa

SEQ ID NO: 4909 - DNA, 996 bp, Xenorhabdus bovienii
  Coding sequence Name=Xb4151_4152.C444.gene84.dna; Position on contig =80785..81780bp; Strand=-
atgaaattggttgtttatagtaaaaaacaatatgaccgtaaacatttcgaaatgctcaaccaaagacttgggcttgattaccatatcgaattctttgatttttccttaagcccacaaacggccaaaaatgccattggtgcagatgctatctgtattttcgtcaatgatgacgctgggcgtgaagtgctggaagaattggcagcaatgaatatcaaaattttggcgttacgttgtgcgggattcaataatgtcgatctggatgcggccaaagagctaggcattcaagtcgtccgcgtcccggcttattcacctgagtctgttgctgaacacgcggttggattaatgctgtgtttgaatcggcgtattcaccgagcctaccagcgtacccgcgatgccaatttctctctggaaggactgactggcttcaacatgtataaacgcacagccggtattatcggtacggggaaaatcggcctggctacactgcgaattttgaaaggttttggtatgcgtttgctggcacatgatccctacccaaataaggaagtgttagaacttggcgtgaaatatgtagatttagataccttgtacgccgaatctgacgtgatttctcttcactgtcctatgacgccagaaaaccatcacttactggatgaaacagcatttaataagatgaaagatggcgtgatgatcatcaataccagccgaggggcactaatcgattcaattgctgctattaacgcgttgaaacagcagaaaattggtgcattgggtatggatgtatatgaaaacgagcgtgacttgttttttgaagataaatcgaatgatgtcatccaagatgatatttttcgccgcttgtcttcctgccataatgtgttattcacaggccatcaggcatttttgacagaagaagcattaaccagtatcagtgaaacgactttacaaaatatccagcaattaacctccggcaagtcttgcccgaatcttgttgggtaa

SEQ ID NO: 4910 - DNA, 2619 bp, Xenorhabdus bovienii
  Coding sequence Name=Xb4151_4152.C444.gene85.dna; Position on contig =81982..84600bp; Strand=+
atgaccaagatattcaaagtgtttgcggtgatgataacactgctggtgttattggtgttggctggttggtacacacttccgcattggctgccattgattgccagtcattggttgccacagggcgttactctttctctcagtcaaccaaaatgggaaaagaatacattacggctggatgatttggcattgaaagcaaaaggctgtgaatgggtcaatgtgtccgggctgtctgtgggatacccacgcaaagaacaaaccaaagagcactactggaatattcatgcttttagtgttcacagcaatagcccgtgtctggtgcagttgccagcgacagaaaacccgtcagcaccattatcgattgaggatatattatcctccattcctgcggttaaacttgtcgttgatcactttgaacttacgccgtggcaggagtttgccggcaaactccaatttgattcatcacgtcaagggcagacattttcctatcaaggcaagcaattaaagctgaatgttcatacggcagataaaaagacattagttattcaccaattccttgtgaaattacctgaacaggaaatcagcctgaatggggatatctcgttgccattggatatagacgcactacccgcacaaggtcagataacagggaggctatccatcagtcaatatcctgatcctttgcagataatattaaaatggcaggggcagggaggaatgctcactattagggaagagaggcaacaacggatattggcagagttgccatggtcattcaatcaatctcaatttttgataactgatggtaaatggcattggatggatatggggcagccactgtcaggaggtgtgaatctgacctttgatcactggaaagaaggtatgggtggcatgttagtcagtgggcgagtgaatttgatcacccaaaatgaactaggtaagggcaatatcgttctttctataaaaccggcacttatcaatatggcgaatgctcatatcccgtttcagttaaccggacaaatgaaccatgggcagatggtcataacgatgtcattgcccgctattgtgacgggcccgctggtggcacctaaaatcacatttcagccgggtgcgctgtttcgtgcgtggggaaaagtaagcgaaacctttacggttaaggaagcgcgtttaccattggcggggacttatctgacccgtgatggtcttacgggtcgtctgcaagctatcgtgactgcacaggatagctattggggaaaattcaaactgcatctcgatgggaatgccgaggattttatccctgataagggaaattggcattggcgttattggggcaatggacacttacccccgctgcaagccaaatgggatattgcaggcacaggaagctggaatcgttcacaggtaacggtgaatgcgttaaacacgggttttgatgttatccaatacggccttgtgcaggtggaggcaccgcgtttgcaacttatcaagccgctggtgtgggaacgttccgcaactcaaccgacattcatgggggacttgcagttatccaccttaagaacagattttcgttctggcggttttttgcctcctttcgattttaaggcgaccgtgacaggtcagtcgccggataattttattctgaatgggaaattatcccccaaaggtattgagccaatcccattttatggtcgctgggacggtacgcgattgcggggagaggctcgttggccgagtcaatctctattagcacttcagtccttgatccccgcagatttggggatgatggtgcgtggtggaaacctctatgctcaagcggcattttcggctgcgaaggggcagggattacgtgctggtggtcattgggtagtgaaaaatgcgagtgtttggctaaaggatggcgaaattgacggcttgaattttgttttgccgtggcgtttgcaggaacatacttggcaattgggggtcacatcacctgtccaactcagggtcaatgaaattaagggcttgtttggtatgcagaatgtgacagccgatttgctgggtttctacccacccactgaaacccagccgttgacgttattcaatgtgaatgtggacatgctggatggtaaacttgggctggataaacttcaattaccccaaaaacaggctgcggtactacgatttgataaattaaatctgagcaaattgttcggtgttctgaaagttaagcaaatagctatgtcgggcagaatcagcggggaattgccactattattgaatgataaaaattggattattcagcagggctgggtatccaatgatggatctctgacattgaggttagataaagatacggttgactcgatagggaaaaatgacctgacggcaggtatgacaatggattggctgagttatttggaaatcagccattcaaaggcacatgtgacactggataatttgggcactttgatactgaattcagaggtcatcggcgttaatcccagagtggataaaaaacgagaagtcagacttaattatcgccatgaagagaacacttttcagttatggcatagtctgcgctttggcagtaatctggaagagtggttacagaaaaatatatctgtaaggagtgacaaatga

SEQ ID NO: 4911 - DNA, 210 bp, Xenorhabdus bovienii
  Coding sequence Name=Xb4151_4152.C444.gene86.dna; Position on contig =84597..84806bp; Strand=+
atgataacaaaaactgggctcaggttgtcggtgggcatagcgagtctgatgttggccagcataattttgacgggatgcatcaggctggaggtagcgacaccggataaaccgatcaagatcgagatgaatgtgaagattgagcatgaaattcatattaaagtcgatagacaaattgaagatatgctcaaaaataactccaacttattttaa

SEQ ID NO: 4912 - DNA, 321 bp, Xenorhabdus bovienii
  Coding sequence Name=Xb4151_4152.C444.gene87.dna; Position on contig =84817..85137bp; Strand=+
atgaaaaaagcaggagtaatatttctggcgagtctgctattcagttcttttgctgtaggcatgacattgagtgaagcaaaacagcaagggctggtaggagaaacgttcagtggctatttggcacctgtgaagaagaccagggatactcagtccgtgatccaaaaagtcaacgaggagcgggaaaagaaatatgctgaaattgccgcgcaaaataatatgacaacgaatcaggttgctaaaatggcgggtgaaaagttggtgaaccgtgctggggcaggtgaatatgtgcttggtattaatggtaactgggtgaagaagtaa

SEQ ID NO: 4913 - DNA, 615 bp, Xenorhabdus bovienii
  Coding sequence Name=Xb4151_4152.C444.gene88.dna; Position on contig =85222..85836bp; Strand=-
atgaataaagtacttgttctgaaatcgagcattctggcgcagcattcccaaagcaacaaaatggctgattactttatcgaaaaatggcaggccaaccacatagatgataacgttactgtgcgcgatttagctgaaaacccagtaccagtgcttgatagcgaattggtgggagctttgcgtccaagtgatgtcgagatgacagcacgccagaaagctacattagccttatcggatgaattgattgcggagttgaaagttcacgatgtgatcgtgcttactgccccaatgtataatttcactattccaacccaattgaaagcctattttgacctgattgcccgtgccggttcgaccttccgctatacagaaaccgggccagaaggtttgctgaaaaacaaacgtgccattgtgctgaccagtcgcggcggcattcataaagataacccaacggatttgataacaccgtacctgcgtacttttttgggattcatcggtattaacgatgttgaattcgtctttgcagagggtttcggattgggtgcggaatcggcagaactggctcaccaatctgcccagaataccataaatgatatgatggcaaaaatttcagcttaa

SEQ ID NO: 4914 - DNA, 3906 bp, Xenorhabdus bovienii
  Coding sequence Name=Xb4151_4152.C444.gene89.dna; Position on contig =86178..90083bp; Strand=+
gtggaatcacctttgacagcatcgtttgctgaattattcgctgaacttgagcacacgccactgcgcgatcagttccggttgaaaaaacgtctgcatggggcagcaaaaatcaaaaatcaggcctccttacaggccgtggcacaatccatttctggagatatcgccactgcaaaacagaaagttatcaatcgtcaagcctcatgtcccccgattaaataccctgaaaacctgccggttagccagaaaaaagacgatatctacaaagcaattcgggataatcaagtggttattatcgcgggagaaacgggttcaggtaaaacaacccagatccccaaaatctgccttgagttgggaagaggggttaaagggttaattggtcatacgcagcctcgtcgcctggcagcacgctcggttgccagccgtattgcggatgaactggaaactccgcttggctcaaccgttggttataaagtacgttttaatgatcatgtcagcgagaatacgctggtcaagttaatgacggacggtattctgctggcagaattgcagcaagatcgcctgctgctgcaatatgacacgctgattattgatgaagcgcatgaacgcagcctgaacattgattttatccttggctacttgcgccagttgctgcttaaacgtcctgatctaaaaattatcattacctccgcgacgattgatcctgagcgtttttcccgccatttcaacaatgcaccaattattgaagtctctggccgtacttatccagtggaaattcggtatcgtccggtggcaggcgatgataatgacagcgatcgggatcaactcgaagctattattggtgctgtagatgaattggggcatgaaagttcaggcgacattctggtgtttatgagcggggagcgggaaatccgtgatacggcggatgcactagataaacagaactttccgcatactgaaatcctgcccctgtttgcccgtttatctaacagcgaccagaaccggatatttcagccgcatgtcgggcgcagaattatattggccactaacgttgcagaaacatcgctgaccgtgcctggtatcaaatatgtcattgataccggttttgcacgtatcagccgatacagttatcgaaccaaagtccagcgtctgccgatagagccgatttcacaggcatctgctaatcagcgcaaaggccgctgtggtcgtgtttcagatgggatctgtatccggctctactcggaagacgattatttatctcgtccggaatttaccgatcctgagattctgcgtactaatttagcttctgtcattttgcagatgacctccattggtttgggcgatgtgagcgcattcccgtttgttgaagcgccggataaacgtaatgttcaagatggtgtccgtttgctggaagaactgggagccattgatccggaatccctgtcaggcggaacttaccggctgacacaaatggggcagcaacttgcacaactgcctatcgacccaagattggcgcgtatggtgttggaagcaagagcgcatggttgtgtccgtgaagtcatggttattacctctgcgttatctattcaagatccacgggaaaggccgctggaaaaacagcaggcttctgatgaaaaacaccgtcgtttcgcagataaagattctgatttcatcacattcctgaaattgtgggattttctggttgagcagcagaaagcgctttccagctcacaattccgcaaactgtgccgccaggactatctgaattacctcagagtgagggagtggcaggatgtctatactcagcttcggcaggttgttaaagaaattggcctgccgataaacagtcaagaagcggattaccgcagtatccatattgcgttgttgacgggtctgttatctcatgtcggtcagaaggataccgataaacaggaatatactggtgcacgtaatgctcgtttttctgtatttccgggctcaggattattcaaaaaaccacctaaatggggaatggtggctgaattggtggaaaccagccgattatgggggcgtattgctgcacgtattgaacctgaatggatcgagccattggcagcacatttaatcaaacaccattacagcgaaccgcattggcagaaatctcaaggtgcggtgatggcaacggaaaaagtgacgttgtatggtttgccgattgtggcgggacgtttagtgaattatagccagattgatccaatgttatgtcgggagttgttcatccgccatgcattggtggaaggagactggcagacccgccactcatttttccgtgccaatctcaagttacgcgaagaagtcgaagaactggagcataaatcccgccgtcgggatattctggtggatgatgaaaccttgttcagtttctacgatcagcgaatcggtaaagaagtcatgtcttcccgacattttgatcgctggtggcaagtcgccagtaaagatcaacctgaactgctcaactttgaaaagagcatgttaatcaaaggggatgcagataaaattagtgcttcggattatcccaactattggtatcaagacaatttgaaattccgtttgagttaccagtttgagccaggaacggatgcggatggtgtcaccgtgcatattccgttgccgatcttgaatcaagttaaggatgaaggctttgactggcaaattccgggaattcgtcatgacctggtcgttgcattgattaaatccctgccaaaacccgtacgtcggaattttgtgcctgcacctaactatgcacaggcatttttggagcggataacacagccgcaggctaccttactggatagttttgagaaagaactccgtcgtatgacgggggtgacagtgtcacgtgatgattggcagtgggatcagattcctgatcatctgaaaatcacattccgtatcattggtgagaaaaacaaaccgctggcggaaggtaaggttctgtctgcactgaagctgcaattgaaagggaaagtacaggaaacactctcggcggtagcggatgatggcattgaacaaagcggactgcatatctggagctttggcgaattgcctgaacgttacgagcagaaacgcggaggttattctgttaaggcatttccggccttggtggatgaaaaagacagcatcggtattaaacttttcgagactgaatctgaacagcaaaacgcaatgtgggaaggaacccgtcgattgctgctaatgaatattccgtcaccgattaagtacctgcatgagaaattacctaacaaatctaaactggggctgtactttaatccctatggaaaagtgctggatctgattgatgactgcatttcctgcggtgtagatagattaatcgcagaaaatggtgggccggcatggaatgaagaagcatttgcaagtttacagaataaagttcgggctgacttaaatgatgcagtggtcgatatagccagacaggtcgagcagatcttgacgactgttttttctattaataaacgtttgaaaggaagggtggatatcgcactcgcgcttgccttgtcggatattaaagaacaaatttccggtttagtttttaatggttttgttaccgctcacggctggaaacgtcttgcggatgttttgcgttacttgaatggcattgaacgtcggctggaaaaattggcgattgatccaaacagggacagggtgcacatgagccggattgaaaatatccaacggcaatggcagcagtggctggcgaaactgtctattcagcagaaacaattacctgaagtgaaagaggttcgctggatgatagaagaactgcggattagcctgtttgcccaacaattgggaacagcatacccaatttcggataaacgtattttgcaggtaatggaaaatatcgctatgtag

SEQ ID NO: 4915 - DNA, 3111 bp, Xenorhabdus bovienii
  Coding sequence Name=Xb4151_4152.C444.gene90.dna; Position on contig =90157..93267bp; Strand=-
atgctggaacatcacaatgtcgtgagccttatccatgctcaatgccagatcagtaagcccagcttgggcgaccgtattctgcaatttgtaaccgtatcatttgatatttcggtgtcagatattttccccacccttgcatcaggcgccacactggttctgcgtccaccccatatcaaaataccaaatgtcacttttgtcgatttcttacgcgaacagaaaatgactatcatcaatatcccgaccgccttctggcaccattgggtacaagagatcatggcaggacgcggtggtttcagcccctatctgcacaccgtgattgttggcggtgataaagtagaacaccgttatttaatggactggttgtcgtgcccagaaacgcaatcctgccgttggttcaacgcctatggccccacagagataaccatcactgccacggcactgatgatagatgacaaacagactccatctatgaccgacaacgttccgattggtcgcccgctgtccaatacccgcatctatattttggatgcgctcggtcagccggttcctgtcggcgtgagcggcgaaattcatatcggtggtatgggcgtcgcccgtggttattcgaaccaaccggaactaaccgcagagaaatttgttgtcgacccattcagcaaccaccccaacgcccgtatgtataaaaccggcgacttgggtcgctggcggactgacggcaatatcgaatacctcggtcgcaatgattttcaggttaaaatacgcggtttccgtatcgaactgggggaaatcgaaaccagattgctacaatgccacggcgtgcgtgaggctattgtgcttcatcgagaagtccttacctgtgaaggtatgccgggcgacaagcgcttggttgcttatctgctcgccgaaccgaatgcggaactggtgccagcggaattgcgccagcagctcgcgcagcaccttgccgaatatatgctacccagcgcctttgtaacactcgacgccttcccgctggcacccaatggcaagctcgatcgtcaagcactgccgacgccggatcaggcagcgatcgtaacccgtgtttatgaagcgccagtcggcgacatagaaatggcactggccgagatctggcaagcgttattaggtctggaaaaggtgggtcgttatgatcacttctttgaactcggtggccactcgctgatggtggtgagcctgatcgaacggctgcgtgggcaaggttggagccttgacatccgcaccgtgttcgccacacccgtgcttaccgaaatggcgaaagtgatgctgatagccggggataacgcggctacatttaccgcaccgtccaatctcattcctgatggctgtaccgccatcaccccagacatgttgcccctgatctccctgacgcaatgcgagattgatgccattgctgctacccttcccgctggtgctgctaatatccaggatatctacccactcgccccgttacaggaaggtatgctgttccaccacctgctgcaaacacaaggggataattatctgttacatatcttgcttactttcgacacccgcgaacgtcttgatgcctttctgacggcctttcaacaagtcattgaccgccacgatattctacgcaccgccttctgctggcagaaattaccccagccagtgcaaattgtctggcgtcaggcgcccctgcgcatcgacacctttgtgccggacagcgacaaggacattcccgctcagttactggcacacactgacccgtaccgacaccgccttgatatcagtcaggctccactcttatccaccgatatcgcccatgatccgcatcaagataagtggttactggctctatgctgccaccatatactcaacgaccatatgtcattagatctcatcatcaatgaaattaacgaactgctgtaccatcgtacaggggacttacctcctgcactaccttaccgtcactttatcgcccagtccctgcgtgtaccgatgtcagatcacgaagcctatttccgtgagatgctcgccgacgtggatacaccgactgcgcctttcggaatactggatgtctacagtgggaatcgaccggtaactgaggtcataaaaccacttcgtgcagcactggccagagctatccgcacgcaagcgcgccgtcagggagtcagtcccggtgtgctgttccatgtcgcgtgggcgcaggtgctggcaaaaataagcgggcgggatgatgtggtcttcgggacagtcttgctggggcgcatgcagggaagcgccgacattgagcggactctaggtctgtttatcaatacgctgcccgtgcggatccaacttgcagggaacagtgtacaggagacggtgaaagcggcttatcgtagtttgacacggttgctggaacacgagcaggcaccattggcgctggctcagcgctgtagcggtgtaacgccacccctgccacttttcagttcactccttaactatcgccatagccaatcggatataacccgcactctatgggagggcatacatctgacgactgcacaggagaggactaactatcccctctacttgactgtggatgatttgggtaaaggctttctgttggcggctcagaccgtaccgggtatcgatccggcgggtctgatcgcctatatgactaccgccttggcgggtctggttgaggcgttggaaaccgaacctcaacggccgatcctgagcctctccattctgactgcctccgaacatcggcagttgcaagataccttgactcagcacttcacccaatcccacggagtgcgtgaagaaactgccgtggctcgcggctatgaagcccccatcggtgacatggaaacggcactggcacaaatctggcagaagctgctgaaacgggaaaaagtcggccggcatgacaatttctttgagttgggcggccattcgctgacagcgatacaattgctggctcgtatgtatgagcaaaatatggagattccgttagcggcagtgttcactcaccccactctgtgtgagctggcctcaactgtgggtaagccgacttccccacttgtcgctgagctatggacaaaattagcaaagaatttttattctaaataa

SEQ ID NO: 4916 - DNA, 8439 bp, Xenorhabdus bovienii
  Coding sequence Name=Xb4151_4152.C444.gene91.dna; Position on contig =93212..101650bp; Strand=-
atgtcacacagccaaaatcgctcctcagaaatttccttagccgttgataacaacaacactcttcttcctcatgtacatccgttgagttctcctcagcaagtcatctggctcgatcaggttatccatcccggttctcccaattacaatatcggtttttttatctgcatcgatggtgaattggatgaagccttgttcactcgtgcttttgaagctgttgtttatcgtcatgacacactgcgtttacagctcatcaacacccacaccttaccgctgcaagaggtggctggtacgctccctgcgtccatagacatacacgatttatctccgcatatcgacgcagaagcccaagccaaacaacatatcaatgccgagttcatgcgtccgtttcacttggatggagcactatggcgtaccgaattattacgggtgagccatacacgtcggtactggcatttttgctgtcatcatttgatcatggacggtattagtttatccatactcagtgaagatgttatcgatacctacaatcgcctaatgaggggagaaacactgaacaaaactgccccttcttatctgaatttcattacggatgaccgagattatctggcttctcaacgctactcacacgatttgcaattttgggtgaaacgctatgaaagtctgccgccgccattactcccaccagcaaattccaacaaagcagaaaatcacggacaagccaaacctattctttggcaagtagacaaggcgctttttcaacgtatcgaagacaccgtgtcccggcaaggattatctatcctgcattttatgtatgccgttctggctagctatttcagccggacgacgggggaggatgaaattgtcatcggcattcccgtgcacaaccgtaaaaatgcccaacaaaaacgcactatgggaatgttcgcatccgttattccgattggcgtaacaatttcgccagaagacacgttccttgatgttatgcacaaagcctctaccgaattgcgtcgttgctataagcaccagcgtttgcccatttcggagatcaaccgacaaacacatatccagcagaaaacggggcgtgttcaattatttgacattacattgtcactcgaaccgttcaaagctaacctgcatatggcaggagaagataccaatatccaattagtggatatacaccatggtgtaccctatcctctttcgatcatcatcgaacagtacacaaccggtcttgacgatgaccttcaatccatcacaattgaattcgatttctctaccgattatctgagcaccacagaggtcatggctctccaatctcgtcttgccgtcttgatcgacgccgccatcaccgctctggatacgccgatagtgaatttgcccatcttgcccgaagatgaacgccaacagatattggtggatttcaatgccactcaggccaatttcccgcaaaatgcattgattcatcaactattcgaagcacaggtgcaacgcaatcctgacgccatcgccgtggtcttcgaagaccaatccctaagttatgacgaattgaaccgccgcgccaatcgtctggctcatcatctgatttcgctgaatgtgcgtccagacgatcgggtggcggtgtgtgtcgaacgcagtctggatatggtggtcggtttactgggtatcctcaaggccggtggagcttatgtgccgctcgacccggcctatcctgccgaacggctggcgtatatgcttgatgacgcggcaccgatggttctgctcacacagacggcgctgctcgacacgctgagcaccaccatacctacgctggtgctcaacgagccagaatcaaccatggcaacgcaaccgacccataatccggacgtgcaggcactcggcctgacgtcacaccatttagcctatgtgatctacacttcaggatccaccggactccccaaaggagtaatgatcgagcatcacggcctgagtaatctgatctcgacacagcaggatgttctggcaatcgagccaggcagtcatatcctgcaatttgcttcaaacagctttgacgcctgtatctgggaatgttgcatggctctactaggaggtgcctgcctccatcttgcccatcgcatacatctcctacccggtacagcactatcggataccttggaagccaatgccattacccatatattgctgtcgccaacagcgttagctgcactggattcaattcctgtgacactacagaccctgatcgtaggtggagaagcctgcccatcctcactggtcaaacgctgggctaccagtcgacgcatgattaatgcctatgggccgactgaaagtaccgtctgttcagctatttatctgtgcgataaccaagaagaaaggactccgcctatcggccgtccaatcgccaatactcgtatctatatccttgatccgtatgggcagcccgttcctcttggcgtggtcggcgaaattcatatcgccggtgccggcgtagcccgcggctacctgaaccgtcctgaattgacggcggaacgcttcctgcccgacccgttttccggtataccagcagcacgtatgtacaaaaccggcgatctggggcactggctacctgacggcaatatcgaatacctcggtcgtaacgattttcaggtcaagctgcgcggcttccgtatcgaactggcagaaattgagtctcaactggtgcaatgccacggcgtacgcgaagcggtcgtccttgcccgcgaagacatttccgatgaaaatacgccgggcgaaaaacggcttgttgcttatctgctcgctgaaccgaatgcggaactggtgccagcggaactgcgccagcagctcgcgcagcaccttgccgagtatatgctacccagcgcctttgtaacgctagacaccttcccgttgacgcctaatggtaaactcgaccgccaggctcttccggcacccgatcagacggcggtcgtagcgcgcatctacgaagcacctgccgataaaatggaaatggcattggctgagatttggcaagcattattggggctggaaaaggtgggacgttatgaccatttctttgagctcggtggtcattcgctaatggcggtgaacctgatcgaacgactgcgtagccgaggttgggttcttgacatccgtaccgtgttctccacaccgatgctggccgaaatggcgcaggccatgctgcttgctcaagacagtattgctgcttttagcgtgccacccaatctcatccctgacggctgtaccaccatcacacctgatatgctacccctgatatccttgtcccagcgcgagattgatactcttgccgccaccatccccggaggtgccgctaatattcaggatatctacccactcgtgtcattacaggaaggcattctgtttcatcacctgttacaaccgcaaggtgatatttatctgttacgcaacatgctcgctttcgatactcgtgaaagtctcaatgccttcctgacagccttacaacaggtcattaatcgccatgatattctgcgtacagcagtctactggcaggggttagcacagccagtacaagtcgtctggcgtcaggctcttctgcacaccgacatatttgtaccgaccagtgacaaggacgtccaatctcaattgctggcacacaccgatccagatcagcggtgcctcaatttgtgtcaagctccgcttttctccatcgatatcgcccatgatccaatccagaacgagtggttgctggctctgtgcttccaccatctggtcagtgaccatatcaccttgggacttatcatcgctgaaatcagcgaattgttgcaaaatcgtgccgaaaacttacccgcaacacagccttaccgcaattttgtcgcccagtccctgagcgtaccggcttcagagcacgaaactcacttccgtgagatgctcgccagtgtagatgcgccgaccacacccttcgggatactggatgtccacagcgggaatagacagatgactgaagccacgcatctacttgacgcgatactggccagagccatccgcacgcaggcacgccgtcaaggtatcagtcccagtgtgctgttccatgtcgcatgggcgcaggtgttagctaaaaccagcgggcgggatgatgtggttttcggtacagtcttactggggcgtatgcaagggagtgccggcatcgatcggagccttggcctgtttatcaataccctgcccataaggatccggctggcaggaaacagcgtacaaacgaccgtacaaacggtctaccgcgatttgacgaggctgctggaacacgagcaggcatcacttacgctggcgcaacactgtagtggtgtagcaccatccctgccactcttcagcgcactgcttaactatcgccatagtcaaccagagacaacctttgccacgtgggaagataaaggtatacgtctgttggcagaacaggagagaaccaactatcccctcaccttgtccgtggatgatttgggtgaaggcttccggctggttgcccagactgtgccggatatcgaaccggctcgtctggccgcctatatgaccaccgctcttacagggctggttgaggcgttggaaaccgaacctcaacggccgatcgggaaccgctctattctgcccgccaccgagcaccagcaactgctggtcgatttcaacgccactcaagtcgatttcccacagtatgcgttgattcatcaactgttcgaagcgcaagtacagcgcacaccagacgccaccgccgtcgtctttgaagaccaatcgctgagttataacgagctaaaccatcgtgccaatcgtctggcgcaccatctaattacgttggggatacgccctgatgatcgggtggcactttatgtcgaacgcaatctggctatggtagtcggtttattgggtgttctaaaagctggcggagcctatgtgccactcgacccggcttatcccgatgagcggctggcgtatatgcttgaagacgcgacaccaaaggtgatgctaacccagaagatgctcgccgatcgtctggccagcacggtgcctacggttatgcccataataatactcgacaacccagaaccattgattgaggctatgccaaccgataatccagatgtgcggtcactgggtctgacgtcacgccatctagcatacgtgatctacacctcaggctctaccggtctgcccaagggagtggcgatcgaacaccgcaatacggtgaatttcctcacctgggtacaacaagctttccgccctgaagagctagcccacactcttttcgctacctcgctcaattttgacttagccgtgtacgaatgttttgcacctttaatctccggtggcacagttcatcttgtttctgatgcactttcgctggttaccaaaaaaccatcggtcagcctaatcaatacggtgccatcggctatcacgaatttgatcgacactaacgcgatccctgcggctacccgaacagtcaatttggctggtgaagcactgaaacctcacgttgtcgaacaattgtttgcttgttcttctgtacaggaggtgtgcaatttatacggcccttcggagacgacaacctattcaacctggatacgcatgaaccggatgactggctttgtcgctcatattggtcgcccaatcgccaatacccaaatttatatcctcgacaccgacagtcaacctgtcccgctcggtgttacaggggagatctatatcgctggtgccggtgttgcccgtggctatctgaaccgccccgaactgacggcggaacgtttcctgcccaatcccttcacaacaatagccggagcgcgtatgtacaagaccggcgatctgggtcgctggctgcccgacggcaatattgaatacctcggccgcaacgattttcaggttaagctgcgcggcttccggattgaactcggagaaatcgaagccagattggtgcaatgccacggtgtgagcgaggcggttgtgattgcccgagaagatatttctgatgagaatagtacaggtcagaagcgtctggttgcctatctgctgcctcaggccggcgttgaactggtgccggccgaactgcgccaacaacttgcccaacaccttgccgagtacatgcagcccagcgcctttatgacgctcgacgccttcccgctgacccccaacggcaaactcgaccgacaagcgcttcctgcccccgacctgtccgctatagtgacacgcggctatgaagccccgattggtgaaatagaaatcgcactggctcagatctggcaagcgttattagggctggaaagagtgagccgttacgaccatttctttgagctcggtggtcattccctgctcgcaacccagcttacttcacgagtacgccagacgctggggttggaactgtccttatcccaactctttgcctaccctgtcctcactgatttggctgccgtactcatcagcgcatcagtgaccacgcaaaccgtcattctgaccgccgaccgccgtcagtcactaccgctctctttcgcccagcaacgcctgtggttcatcgcccaactcaatcctaaggccagtctggcctaccatattcctacggttcttcgcctgcacggacagttagaccacaccgcatttacagccacactcgataaccttgttgcccgacaagaaagcctgcgtacacgctttgtcctgattggcgaacagccttaccaacaaatcgacgacgcagatatcggttttaccctgatctgtcaggatctgcgcggattagacgaggcttcccgcctaacccgtattgacgaattgatggaactcgaaacacaaaccctgtttaattttgccagcgaaccgctggttcggggtcaattgctgcaattggcggacgaagagcatgtgttgatcctcacccagcaccatctcatcactgacggttggtcagtgggggtattgatccacgaactgagagcactctactgtgctgctcttgaggggcatggtgatcctttaccgcccctgtctattcaatatgccgactatgccgtctggcaacgcgaatggttgcagggtgatattctcactgcacaacgggatttctggcgagagcgacttcagggcgcaccgacgttgctggcactgcccaccgaccgaccacgcccaccagagcagcgttacgtcggcagtcatgtgcctatccatctggatgctgacttattgactgccctcaaagcgctcgggcagcgtcagggcacaacgttatttatgactctgcttacggcttgggggatagtgcttagccgtctgagtggtcaggacgatatcgtcatcggcacccccgtcgccaatcgaccacggagtgaacttgaagggttgatcggctttttcgtcaataccctacctttgcgtatcgaattggggcagtgcaacacagtggcggaacttagcgtggcagaactgctcgcccacgtccgtgagcgagcgctggcagcctatgctcatcaagacctgccttttgaacaaatagtggaaatcctgcaacctgagcgtagtatgagctacagcccgatctttcaggtcatgctggcgctgaacaatacccccacccaaccctttgaattacccggtttatccgtttcgttggttgaacaaacacatcacagcgcgcactttgacctgacattgtcactcattgaaaccgtggatgatctcaatggttatctggaatatgcctcggatctgttcgaccgtgcgacggttgagcgcatggtgggttatatcactcaagtactgaccgccatggcggccgatgaaacgcaagccattgcccgtctgccgatgttgtctgttgccgaacgtcagcagttgttggttgatttcaacgccactcaagttgacttcccgcaacatgggctgattcatcaactgttcgaagctcaggtgcaacgcacaccggacgccgctgccgtaatctttgagaaacactcactgagttatagtgaactcaaccgccgcgccaatcaattggcacacagcctgatagcctttggcgtgtgccctgatgatcgtgtggcgatttgtgttgaacggggtttggatatgatcatcggtctgttcgggatcttaaaagccggtgccggttatatcccactcgatccagaatatcccactgaacggctggtttatcagttgtcagacagcaaacctgtcatattgctgactcagaagcatttacaaacacgcttctcaatacaagacctgtccatctggctgctggatgataaaattcatcaaaatagcgtagcgaaacaacctgcacataaccctgacaggacaaatgggctcaccgcccattgcctaatatccactcggctcaaccggacacccaaaaggcgtcatgctggaacatcacaatgtcgtgagccttatccatgctcaatgccagatcagtaa

SEQ ID NO: 4917 - DNA, 1002 bp, Xenorhabdus bovienii
  Coding sequence Name=Xb4151_4152.C444.gene92.dna; Position on contig =102131..103132bp; Strand=-
atgattagcggcttaaaattattattagcaagtacgtttatcgtgggcataatgagtagttttgatgctctggcaaattatgactgccaatattcgccggggttttcagccggcactacctacgtctcttttggcactatcgttattcctagagatcatcctatcggaacaaccatcaaggaaattcggctggatcatgtggatgaaaaaggcgatatcgccatctgtaatacgctcactcctacatcatgggagaaaccggattttgatccggcacactacaactatgatgcaatttatgaatctggagtgccgggtgtcggtatccgtatcaatacatgggctcccggctatggtattgattggctacccagaacagcaacatacccagtcacttgttccccgccgcgtcagtttcaaaataaaaagcaatattgtggccgaacatggggttatttgaccgttcaattaatcaaaattgcacccgcaaccggttcggggccaactcatcagaaactgctaaccaaagccaaattgggactcaatctccctattcatactttctttttgacaaatacttatatcatgactcagggatgttccctcaagcaaaaaacgaccttcgtcaatatgggagaaatcagaaccagtgcatttcgcggcataaatagcacagccggtatgcgaaatttcgaattaaatctggattgcgatgccaatgttaaagtcggcgtaacgctggatggacgacctgcaaaaagcaatgccaataatatctgggcattggattataatagtgacaacgtcacagcaaccggaattggtttacagatcttatatcaaaatcaaccgttatcaatgggttctccgcttatgattcactccgtccaagcaataagaaattttgctattccactgcatgcccgttatatccaaacagaaggacgggtggcaccaggcaaagcagatgcaacggcaactattacgttgacctatcaataa

SEQ ID NO: 4918 - DNA, 2550 bp, Xenorhabdus bovienii
  Coding sequence Name=Xb4151_4152.C444.gene93.dna; Position on contig =103181..105730bp; Strand=-
atggataactaccgtcattatcttcaacataacatttctgataatttggtattatttatcaagccaagcaaagtgtttttatatgctgtgacaatcacatggcttttcactcattataatgaggcttatggtgaagaatattttaatattaatgcgttggaaactcactccggctttccagaagatattgatctgtcaattttcactcaagatgatcagcaactacccggccgctattgggtggatatttacctcaatcgggaaaaagcagacactggaaatgtcgattttatcattgtaaaccataagctatcgccgaagattaacctacagcggttaaagaagatgggtgtaaatattgattcatttccctctttgcgtgatttaccacaagaaacagaaatagccgatcttgggcagcatattccatctgcgtcatcttttttcgacttcaataagcagcggcttgatatcagtattccccaagctgctctgaatagccaagtcagggattatgtttcatctcatttgtgggaacaggggttaacctctctgctggttaattataactatagcggttcaaccaattggctgaataatcaacccggatcgacaagtaataattttctcaatcttagaacaggcgccaattgggaagcatggcggttgcggaattactctacttacagcagccaaaaccacaaatggcaaagtcttaacacttacctgcaacgtgatgttcataccctgaaaagccagttggtatttggtgacagttatacaccttccgccatttttgatggttttcagtttcggggaatgcaattggcttctgatgacaacatgctacctgatagcctgaaagggtttgcgcccacgatacggggaatagcccaaagtaatgctcaagttaccattaaacagaatggttatatcatttatgaaacctatgtttctgccgggccttttgtcgtcagcgatctctacccaaccacatccagtggtaatctggaaatcattatcaaagaagcggatgggagagaacatcgttctgtacagcctttttcagccgttcctatcatgttacgggagaatagtttgcgatattccctgactctggggaaatatcaatctttcactcatcgtggcaaagaaccttattttatgcagggtacggtgatatatggtatttccaaccgtgtgacggtttatggtggaacaaccctctcaaaagattatcaatccgctgcttttggtacaggatatagcttttctgattggggctctctatcctttgatgtcactcatgcaaaatcagatttagctgaaaatatcagtgattcagggcaatcatatcgtttccagtatgcaaaagatctttcccagacaggtaccaacctcactttagcgggttatcgttattcaactcaccgcttttatgattttaaggacgccaatgagatcgatattacaaacaacaaggacaatcgcagcaacaccaataaacgcagtaaattgcaactacacatcaaccagtcactggggaatttgggaagcgtttatctatctgcttttcagcaagattactggtatcaacaaggttacgaacggaacatcagcgcgggttacaataccagttatcattcaattaattacaatctgaattatacctacagtgaattccccggttcaaaacacaatgatcagattttatcattcagtgtgcaaatcccgcttgatcgctggctgaaaaatagctgggtaagttataacctgaccaatagtaaaaacagggatacatctcatcagatcagtctcaatggtacagccctggaagataacaatctgatttatagtatccagcaaaattatacccaccacgataaagatattggcgggaatatcagcgcggaatataaaggtgcatatggccagatcaacgcgggttacaattacgataaacaatccaagcaactgaattacggcttaaatggcgggattgttgcacatccttacggtgttacgctttcccaatcattgggagatacactggcattagtacgtgcccatggtgccaaaggggttaaagttcagaatcataccggtatttcaacagactggaacggctatgccatcgtcccttatgtcagtagttatcgtaaaaaccgtattgctctggatacttattcaatgggcaacaatgttgatattgatatcaatacacaaaccatcatcccaacccaaggttcattggctttagccaatttccaaacccgtattggctatcgcgttttgatgatgctttcccataaaggtaaagagattccatttggcgcaacagcaacactggaaaaacaacatgacatcgatgacaccaacagcaccatcatcagtaatgatggacaggcttatctcagtggtgttcctaaaacaggtcggttatgggtgaaatggggacacaaagatattcaggaatgtcatgtgaattatcaacttcctgatgaaataccgatatcaggtttgtacatggtgaatgcggcctgtgaataa

SEQ ID NO: 4919 - DNA, 723 bp, Xenorhabdus bovienii
  Coding sequence Name=Xb4151_4152.C444.gene94.dna; Position on contig =105770..106492bp; Strand=-
atgaatatgaaaaataataatatattgtttggagcaaccattttgaaatattttcgtatttttattattctttatattttcagtatcaatatttcttttgctggtgtcgttatcggtggcactcgcattgtgtatattagtgaccgaaaagaagcatcaatctccattagcaaccctgaaacagatgtttcttatcttattcaatcatgggttcaggatgaaaataatgaaaccaaagttccttttattatcactcccccactcttcaaattaaccgccgggaatgagaatattctgcgaattgtaaaaaccggcgaaaacttgccaaatgataaagaatctcttttctggcttaatgtcaagtctatcccgggaacagtaaaatcagatcagaatcaattgcaaatcaccgtgaaatctcgctttaagctattttatcgccctgtcggtttagcagacaacgccagtattgcctacaaagcactgaagtttaaaaccgtagggcataagctaatcgcagagaacccaacaccatactatatctcattttctgatctaaccactggaaataattcaataaatcatgaaatcaaacccgctggtatgatatcgccttatagtcaattaagttgggatattcccattaaaaatatcaactatgtcacttggaaaaccatcaatgattttggcggtgtaacgccagaagaaaaacgcatgttctga

SEQ ID NO: 4920 - DNA, 534 bp, Xenorhabdus bovienii
  Coding sequence Name=Xb4151_4152.C444.gene95.dna; Position on contig =106535..107068bp; Strand=-
atgaaaaccaatctaattatttcctctttatttttatcatctgcacttgtatcggcagcatatgccgccgatggacaaatcaaatttacaggcgatattaccgcgactgcatgtaaaattgatcctagttctgcaaaccaaactgttaatatgggtactatcagttcaagttcattcaatggggtaaatagcacatcagctgcaacgcgtttcagtatcatactgactgactgtcctacagaagctaattatgcccaagttaaatttgatggaaacccggacagccgaaataataaccttttggcattaagcaacgacaattcaaagaaaaaagcggctggcggagttgcactcggtctttatgaagccgatagcgcaactcttatttctctggcgcagtcatccataactcagaaactgactaataagtccaaacaagagttaaattttattgctaaatatattgctacaaattcaactgttaaccctggttccggtgatgcggtagccaactttactattgtctacaactaa

SEQ ID NO: 4921 - DNA, 138 bp, Xenorhabdus bovienii
  Coding sequence Name=Xb4151_4152.C444.gene96.dna; Position on contig =107144..107281bp; Strand=-
atgtcgagttattatttttatctttgtcaattaatcgctactatattcttcgaaatgtctgtcgataaagaaacgtcatttaacgtttctttatcgtgcttcggtataaattcggacaaattacttgttatatcataa

SEQ ID NO: 4922 - DNA, 150 bp, Xenorhabdus bovienii
  Coding sequence Name=Xb4151_4152.C444.gene97.dna; Position on contig =107693..107842bp; Strand=+
atgtttatggattgcataactatcatccatatttcttttgttttagttacaacatacattttaagcttaaaaaacaaatcccataaacaccgcaaaaaaaagcttaataagggttctatttcaaccaaaaaaattaaggagagaagttga

SEQ ID NO: 4923 - DNA, 1470 bp, Xenorhabdus bovienii
  Coding sequence Name=Xb4151_4152.C444.gene98.dna; Position on contig =107902..109371bp; Strand=-
atgtccaatatgtgttcgatagtcagaacaagcgttctgactaatcgtgtcgattatattactttcaggaacctatctttggaaaaaaaattaggcctcacatctctgacagcactggtacttagttccatggtgggagccggtgtattcagcttgccacaaaatatggcacaagtaggcagtcctgctgcattaatgatcggttgggggattacaggcgtaggtattctctttttagccacttctttactattgctttcacgtcttcgccctgacctcgacagtggaatttttacttacgcaagagaaggatttggcgaattagttggtttctgttctgcatggggatattggttttgtgccattatcgccaatgtttcttatctggttatcgtcttcgcggcattaagtttttttactgacaccgaatattcagttattttcggtgatggaaatacctggcaatctctgattggtgaatctattttgctttggtttgttcattggctcgtactccgaggagtacaaactgcagccagtatcaaccagttggccacggtagccaaattgttaccattgggtatgttcattattttggccgtgattgcattcaacatggatgtatttacgtttgacttcactggcattgaaatggggatacctgtctggcaacaagtcaaagatacgatgctgatcaccttgtgggtatttattggtgttgaaggtgctgttgttgtttcagccagagccaaaaagcgcaaagatatcggtattgcaactgttctcgctgttgtttcagcattaggcgtttatattctggttaccctgctctctcttggattggtagcaagacctgaattagcggcaatgcgtaatccttcaatggcaaatctgatggtagggttaattggctctacgggtgaaattgttattattgctggcctgatcatttccgtttgcggtgcctatctgagttggacaattatggccgcagaagtccctttcatcgcttccttgcatggctcatttcctaaggtattcaataaacaaaacactaaaaaagcgcctgagtcatcactgtggataactaatggagctgttcagatttccttgattttaatctggttaagtggcagcaattacaatatgttgctttccattgcctcggaaatgatacttgtcccctattttctcgttggtgcatttttagccaaagtggcatttcagcgcagcaaccggattttgttgttgatttctgcaggagcctgtacttatggtgtgtggttactttatgcatctggtttaatgcatttgcttctttcagttgtattgtatgcgcctggattgcttgttttcttgtatgcacgtagacagaatcaaggacaaaaaccactgaatatgctggaaaaaacagctatcgtgattttaatactaatgactatcccttctacatggctactaatacattaa

SEQ ID NO: 4924 - DNA, 126 bp, Xenorhabdus bovienii
  Coding sequence Name=Xb4151_4152.C444.gene99.dna; Position on contig =109372..109497bp; Strand=-
atgcataaaatttatatttttttgcatagtcacccattgcatacaatcctttcactccgtagaatcgccctgtttttggatttaacgactgaatcttctgtgcaatccagagtatggatgcaataa

SEQ ID NO: 4925 - DNA, 165 bp, Xenorhabdus bovienii
  Coding sequence Name=Xb4151_4152.C444.gene100.dna; Position on contig= 109456..109620bp; Strand=+
atgcaatgggtgactatgcaaaaaaatataaattttatgcataaaataatgtacgttaggcgggatataaaagaacgaattattcaaaaaacgtattttggcaataataaaaaggcacaaatgatgatttgtaccttttccatcaataacagattaattatttga

SEQ ID NO: 4926 - DNA, 978 bp, Xenorhabdus bovienii
  Coding sequence Name=Xb4151_4152.C444.gene101.dna; Position on contig= 109613..110590bp; Strand=-
atgcgcaaggcgaaaggattttttatgaagctgaaaacaacgatcatcgctacagcgatgctctcgctaacaacgattactgctgcacatgcggctaaagaattaacgccagaacaagctgtagagctgaagccatttgaacgaatctcagtcactggccgtttcaatgcaatctatgaagctgctgatgcgatttcccgtcaggcggataaaaaaggcgcctatagtttctatattcaaagtctcgacgattttaatggtggtggcaatttacgtgttgtagccgatttgtatcataaagatgcagaaaaatccgataaaataactaactatcgcatttatcgtggaattaaagaactgcctaaaactgaagccattacgctggaaccttttgataccgtaaccgtgaatggttacttttctactgctcctgatctgaaagaggccatcgctaaggctgctaaaaagaaagatgctgcctctttctttattgtccgtgatatttctcccaataatggaggaaaccaaatagttactgcatatgtttataaaacagatgcaccaaaacgtcagatacagtctaataatgcggttattccagcagattcggaggctggccgtcaggctctggctcaaggcggcgaagaagccgagaaagttgaaattccaggtgttgcttcctcaacatctaccagcaatttggttggacgattttttgaaacccagtcatcaaaaggtggtcgttacacggtcacgttatctgatggcacaaaaatagaagaattgaataaggcatctgccgctcaaatggttccttttgactcgattactttctctggctattacaccacagatccagaaatttcttatcaagttgctaaacgtgcagcaaaaaaaggtgcgaaatactaccatgtcaccagagagtggcaatctaatggtggtaacattactgtcagcgccgatttattcaaataa

SEQ ID NO: 4927 - DNA, 1533 bp, Xenorhabdus bovienii
  Coding sequence Name=Xb4151_4152.C444.gene102.dna; Position on contig= 110934..112466bp; Strand=+
atgcatattggtgtaccaaaagagcgactttccaatgaagctcgcgttgctgccacaccatcaacggtggaacaactgcgaaaattgggattcagcgttagagtggaaacaagggctgggcatcttgccagttttgatgatattgcttatcaaaaagcaggagctgatattgcagaacatcatgaagtttggcaatcagatattatttttacagtgaatgctccggaagataaagaaattgccctgatgaaagaaggggcgacgctggttagttttatctggccagcgcaacacccagaattaatggcaaaattgtcaaaacgtagagtaactgttcttgcaatggatgctgtaccacgaatttcccgtgcgcaatcattagatgtcctcagttcaatggcaaatattgctggttatcgggctattgttgaagcggctcatgaatttggacgcttcttcactggccaaattacagcagcaggcaaagtaccaccagctaaagtcatgattatcggagctggtgttgcagggctggccgctatcggggcggcagggagtcttggcgctattgtccgagcttttgatacccgtccagaagttaaagaacaggtacaaagcatgggtgctgaatttttggaattgaatttcaaagaagaagctagcggtggtgacggctatgcaaaagtcatgtcagaagcctttatcgaagcagaaatggaattgttttctgcacaagcacaagaagttgatattatcgtcacaacggcattgattccgggaaaacccgcaccgcgactgatcaccaaagaaatggttgagtccatgaagcctggcagtgtcattgtcgatttagctgcgcagaatggaggtaactgtgagctgacggaggctgataaactcattgtgacaccaaatggtgtaaagatcataggctatacagacttgcctagccgtttacccactcaatcgtcacaattgtacggcacaaatttggttaacctcgcaaagttattgtgcaaagagaaaaatggcgaaatcactatcgattttgaagatatcgttgtacgtggcattaccgtaattaaagagggagaagttacatggccagcccctcctattcaagtttccgctccacccaccaaacctacgacgctgaagaagaaagaagataaaccagcaaaaaatccgaggtctccatggttgaaatatggtctgtttgctcttgccattattctgttcggctggttggcaaacgttgcaccgaaggagtttctgtctcactttaccgtatttgctttgtcttgcgtggttggttattacgtcgtctggaacgttagccattcattgcacacacccctgatgtcggtcactaatgctatttcagggatcattgtcgttggggcagtcttacaaattggtgaaggtggatgggtgagttttttctcattcatcgcggttttgattgccagcatcaatatttttggtggtttcacagtcacccaacgtatgctgaaaatgtttcgtaaagggtaa

SEQ ID NO: 4928 - DNA, 1389 bp, Xenorhabdus bovienii
  Coding sequence Name=Xb4151_4152.C444.gene103.dna; Position on contig= 112477..113865bp; Strand=+
atgtcgaacggagtagttacagcggcatatattgttgctgccattttatttattttcagccttgccggcctttcccgccatgaaagttcgaggcgaggtaatatctttggcatagccggtatggcaattgcgctgattgccactattttaggacccgatgctggcaaagtaggttggattattttggcgatgatcatcggtgccgtcattggtattcgcttggccaaaaaagtggaaatgaccgaaatgcctgaattgatcgccatcttgcacagctttgtcggtctggcagcggttttggtcgggttcaacagctttattactcatgatatttttgctactcccattatggaaaacattcacctgacagaagttttcttggggatcttcattggttcagtcacctttactggctcaattgtggcattcggtaaattgcgcggcaaaatttcatccaaaccgctgatgttaccccaccgccataaactcaatttggccgcgttgattgtttcctttgtactgatagttatctttataaaaactcaaagtgttggtttgcaagttttcactatgctagtgatgactgctatcgcacttgctttcggttggcacttagtcgcgtcaatcggaggggcagatatgcctgtcgttgtttccatgctgaactcatactcaggctgggcagccgcggccgctggtttcctgttaagcaatgacttgctgattgtgaccggtgctttagtaggttcttctggtgcaatcctttcttatattatgtgtaaagcgatgaaccgttcttttattagcgttatcgccggtggttttggtactgatggtacttcaacgggggatgaacaagagatgggcgaataccgcgaaacaaatgcggaagacgttgctgaactgctgaaaaattccacttcagttattattacgcctggctatggtatggccgttgctcaagcgcaatatccggtacatgacatcaccgcaaaattgcgtgagaagggcgttaaagttcgctttggcatccatcctgttgcgggacgtttaccgggtcacatgaacgtgttgcttgctgaagccaaagtttcttacgatattgtcttggaaatggatgaaatcaataatgattttactgagacagataccgttctggttatcggagccaatgacacagtaaacccagcagctcaagaagatccacacagtccgattgctggaatgcctgtactggaagtttggaaagcacaaaacgtgattgtctttaaacgctccatgaatacaggatatgcgggagtacaaaacccgttattctttaaagaaaatacccagatgctattcggtgatgcaaaagccagtgtcgaagcgatcctccgtgcactgtag

SEQ ID NO: 4929 - DNA, 279 bp, Xenorhabdus bovienii
  Coding sequence Name=Xb4151_4152.C444.gene104.dna; Position on contig= 114141..114419bp; Strand=-
atgaccatccatgattttgtgtcttcatcacttccatcgttatattcatctgggttttggtggttcaaaatttcctccttgttgctgatttcaatgtcttccgttcaaacaagctcaaatcgaatttttacaaaacaagcgtgtcggataatggaacttatcttattagccctatttttgagcataattatgatttcgctatgtaaaaaatgtggctcattaccaatacaatcctattgtagaaaagctactttttcaaatgtatattttaataagtag

SEQ ID NO: 4930 - DNA, 918 bp, Xenorhabdus bovienii
  Coding sequence Name=Xb4151_4152.C444.gene105.dna; Position on contig= 114451..115368bp; Strand=+
atgccattgtctgtatctggccagcagatacataacaatcccgcgattgcatatcttgttagtcttggctcaaagcgaagtcgccagactatgaaatcgtttcttaatattgtggcaaaaatgcttgggtatcaaaatgtacaggactgtacttggaatgcactacgtcgccatcatgtgcaagctatcatggaaatgctctccgattccggcaaagctccagcgacgatcaatacctaccttgctgcgttaaaaggcgtggcgctggaagcttggacaatgaagcaaatcgataccgacagttttcaacatatcaaacaagtgcgttctgtcagggggaatcggttgccgaaaggaagagcgctcgaccgttatgaaatcaaaacgttattttttacttgtgaaaatgatttcagcacaaaaggcttacgtgatgcagccatcattggtgtacttgtcggttgcggactccgtcggtcagaaattatctcgttggatttgaaacatgttattcgtcgtgaacaagcattgagagtcatgggaaaaggaaacaaagaacgtttatcctatatgcctgaaggaacgtgggaacgtttgaaccgttggatagatgaaatccggggtgattatgccgggccattgtttacccgtatccgtcgtgatgatgatgtaacagataaccgtctgtcagatcaggcaatctatcacatactggaaacacgtagaattgagagtggactggaaaaatttgctcctcatgatctgcgtagaacattcgcatcagccatgctggacaatggggaggatattgtaacagtgaaagatgcaatgggtcattcaagtatcactactacccagaaatatgatcgacgaggcgatgagcgtttaaaaaatgcagccaaaaatttgaatttttaa

SEQ ID NO: 4931 - DNA, 945 bp, Xenorhabdus bovienii
  Coding sequence Name=Xb4151_4152.C444.gene106.dna; Position on contig= 115517..116461bp; Strand=-
atggcaaactaccaaaacctcttagttgcaattgacccaaatcaggatgatcagccggcattaagacgcgcagtatatatcgtgcaacgtaatggtggccggattaaagcatttttacccatttatgacctctcatatgaaatgaccaccttactttctccagaagaaagaaatgccatgcgtaaaggtgtcattggccaaagaattgcttggataaaaaagcaggcacactactatcttgaatcaggtattgacattgaaatcaaggtagtttggcatggccacccttatgaagccattatccaggaagtcatcacaggaaagcatgatttattattgaaaatggcacatcagcattctttattggaatccatgatttttacgccgctggactggcatctattacgtaaatgcccttgtcctgtctggatggttaaagatcaggcctggccagaaaaagattctgccgttgttgcggttaatttatcgaatgaagaatcttaccatactgcactaaatctgaaattggtgaaagaaacgcaagatctcgctaaccgaattgtaaaagaacctctgattcatcttgtcagcgcttatcctaccgcgcctttaaatattgcaatggaattgcctgattttaatcctagtgtatataatcaggcattacgtgggcagcatttggttgcaatgaaagagttgcggcaaaaattctatattgatgaacaacagactcatgttcacgagggactacctgaaaaagtcattcctgaaatttgtgatgaattgaatacgggggtggttgttctgggcattcttgggcgaactgggttatccgctgcatttcttggtaatacggctgaacatgtcatcgataagcttaaatgtgacctgctggcaattaaaccagatggttttgtttgcccgattagtgtggatgaagagtaa

SEQ ID NO: 4932 - DNA, 756 bp, Xenorhabdus bovienii
  Coding sequence Name=Xb4151_4152.C444.gene107.dna; Position on contig= 116588..117343bp; Strand=-
atgatcccggaaaaacgtattattcgtcggattcaatctggtggttgtgcaatccactgtcagaattgcagcattagccagctatgcattcctttcaccttaaatgaacatgaactcgatcagcttgataatattattgaacgtaaaaaaccaatccagaaagggcaaactttgtttaaggctggtgatgcattaaaatcactctatgctatccgttctgggactatcaaaagttatacgatcactgaagaaggcgatgagcagattaccggttttcaccttgctggcgatttagtagggtttgatgcaatcataaatactgagcatcccagttttgcccaagcattggaaacttccatggtgtgtgaaattccatttgaaacactggatgatctttccggtaagatgccaaatctccgccagcagatgatgcgcttgatgagcggcgaaataaaaggcgatcaggaaatgatcctcctgctatccaaaaagaatgcggaagaaaggcttgcagcatttatctataacctgtcaagccgttttgcgcagcgtggtttttctcctcgcgagttccgtttgaccatgacacggggcgatatcggtaattatcttggtctgactgttgaaacaattagccgcctgcttggccgtttccagaaaaatggcattttaggtgttaaaggtaagtacattgcggtcgaaaatatggagaaactgacggaattggcaggaaaagcccctgcttgcgtgtcctaa

SEQ ID NO: 4933 - DNA, 192 bp, Xenorhabdus bovienii
  Coding sequence Name=Xb4151_4152.C444.gene108.dna; Position on contig= 117423..117614bp; Strand=-
atgtgcggaatgcggagtgatatgaatatggaaaggtttcatttcgagactatgaatgtgagcatgttttacctaacaaaaaacgtgacgccgtcactaactgtgttatgtagaacagggggaagtggaaagttacccaatcaaggtagaatggcggttacatttttgcgtgatgatttatacagttattaa

SEQ ID NO: 4934 - DNA, 1950 bp, Xenorhabdus bovienii
  Coding sequence Name=Xb4151_4152.C444.gene109.dna; Position on contig= 117910..119859bp; Strand=+
atgactaagcctctttataccaacttaaatgtagatgcgttgtttctaggcccaaaatcagaaaatgcagtttttttcagagaaatgatggactatgcagtcagcgaacacatgcactggcgttcaggatttcacccagaagatgctaccttggttacatccgttgatcgttatgagcataattacagagaaactctctatcggacagaaggaatattgaatcaactatcagcaaaactaaaaaacacttcgattcctttcttctccccccgttatctaggccacattaacagtgacactttgatggtttccaatctcgcctatgtaatggcaatgatgtacaaccccaacaattgtacctacgaagtatcacccacaacaacagaactggaacttgaatccgggttagatctctgccggatgcttggttatgacccccagcgcgcatgggggcatatcacttccggtgggactgttgctaactatgaaggtttgtgggttgccaggaacttaaaaacattgccttttgctgtatcccaacatcctgagacaaaagagttggttagtcataagtcacaaaaacaattaatgaatatgccaacagctgaagtgctcgatttaatcagcgaattacaaagacgtggaattttcgatgaaatacgtaatatgacatgtcgtggtacagggagtaaaactgaaattttaggtaaactactcgtaccacaatccaaacattattcctggatgaaagcagcagatattttggggatcggtcaggaaaatattatcccattgcctgtgaatgaacactatcaaaccgatattggcaaaatgcgtgaaatcacctttgatttaatcgagaagggtgagcctattttggcgatgattggtgtagtcggtacgactgaagtcggtgccattgatcggattgatgaagtgattgcattgcggcaggaatgtgaagaacgttatggtgaatcattctatatccatgttgatgctgcttatgcgggatacgcctgttctatgcttctcaatgagcaaggtgaatttatggaatatgatgatctggttaactatcatcacacgctaggcatcatacctgaaaatatcagttggccaaaacctgaggtttaccagagcttcaaggcattgcgatatgtcgattcgattacagttgacccgcataaggttggatttattcaatattcagccggggcaatttgtatgaaagacaaacgtattctcgatttgatttcttcacgtgccctttatgtctttgaagaaaatgacaatcaaagtaattttcctgccagtaaccgagggatacttggcgcttccataatggaaggttcgaaagcgggagcaaccgcagcagcactttgggccgctcatcgattattgcctttaaacatcagtggttatggaaaagtgatagccgctggcatagtcaccgcgaatcaactattagataaaatggcaaatatgctccccattgaagtcggtgagtaccggtttaaaatgtatattatgccaacaccggattttcacatgatcaacttcactttcaaagaagtcggaaacgccagccttatcaaccacaatgcacttaacaagcgaatttatgaactgtgttcatattcttcaggacgtgcatatagcaacgattttctcacatcttcaaccatactggattacaaagagtacggtgatacaccgtggtactacgccgaaaaatgtggctttagccgtagtgagtgggaaaacacacaccgtgtttatgtattacgtgcggcagtaatgacacattgcttacgcaatccagagcacttcgatgagtactggaaacaactacaaactattttcgccaaaaaattaactcaattggttgatgaagaagaaaaaaaatcacgccagattttgaatcgtgaggaatcttttcttaattaa

SEQ ID NO: 4935 - DNA, 171 bp, Xenorhabdus bovienii
  Coding sequence Name=Xb4151_4152.C444.gene110.dna; Position on contig= 120145..120315bp; Strand=+
atgccatttacgctcaaacccgctaaagaacactttggtgcatatgtgacgtgccagaatgtttccgaactgtcgtttgaagagtatgaaatactgaaattgcatctatacgcaattaacttgaagatgcgggttttaaaatctggaagttatcagtcaaccgagtggtga

SEQ ID NO: 4936 - DNA, 1050 bp, Xenorhabdus bovienii; identical to SEQ ID NO: 1176
  Coding sequence Name=Xb4151_4152.C444.gene111.dna; Position on contig= 120260..121309bp; Strand=-

SEQ ID NO: 4937 - DNA, 294 bp, Xenorhabdus bovienii
  Coding sequence Name=Xb4151_4152.C444.gene112.dna; Position on contig= 121465..121758bp; Strand=+
atgtttgcgaatggtttttcaactatgatttcgggtttttttggttcgactcccaatacaacttatggtgaaaacattggtgttatggcgattacccgagtgtacagttcatgggtgattggtggagcagcgatactggccattctgctttcttgtgttggcaaactggctgcggcaattcaggtcattcctgtcccggttatgggcggcgtttctttgttgctatacccgtcgtcattgaagatgcttgatttttcatttgtatcagatcatgattgcgcccatgaaaattaa

SEQ ID NO: 4938 - DNA, 876 bp, Xenorhabdus bovienii
  Coding sequence Name=Xb4151_4152.C444.gene113.dna; Position on contig= 121736..122611bp; Strand=+
atgattgcgcccatgaaaattaatctaacagatgcccaaaaagacgccctcgaattgatgcatgatacgactcgcgatggacgagtacgtgaccgcatcaaggccgtgcttttggcctcagaaggctggactgcccagatgattgctcaggctttgcggatccatgaaagtacggtgagccgccatctgaaagattacttctctgaggaaaaactcgcccctgaaaatgggggctctgaaagccgtttgtctgccgaacaaacaacagaattagttgagtatctgatggcaaatttgatgcacactaccgcacaaattgtggcctatgttcgggcacgatggcaggtgactttcactgtcgcaggaatgacgaaatggcttcaccgtcaaggtttcagctacaagaagccaatgggtgctccgcataaatttgatgcggataaacagcaacagtttattgaaacctacaacgcgctgaaagaagaatgtggccagaatgcgcctattttatttattgatgcggttcacccgaccctgtccacaaaattaagttatggctggatgaagagcgggcggaagcacgtcaaagtggttgaaaccacaggcagtcgtactcgactcaacatcatgggtgcccttaatttacaacggattgaagagactattgttcgtgaatatccgacgattaacgcgaaaaatgtcgtcctttttttcggctcaatccgggaaacctatccactttcgcaaaaaatccacattattctggatggtgcgggttatcaccgttccggagtcgtccaattttttgccgaggttttgaatattgagttgcactacctgccgccttacagtaagcgtacggggaaccccacctag

SEQ ID NO: 4939 - DNA, 348 bp, Xenorhabdus bovienii; identical to SEQ ID NO: 4746
  Coding sequence Name=Xb4151_4152.C444.gene114.dna; Position on contig= 122653..123000bp; Strand=+

SEQ ID NO: 4940 - DNA, 354 bp, Xenorhabdus bovienii
  Coding sequence Name=Xb4151_4152.C444.gene115.dna; Position on contig= 122997..123350bp; Strand=+
atgaaaatgtttgtggatgtgccggaggtgtatttgtgccgctcatttatcgacttccgaaaatccatcaacgggctggcggtctgggtggagctggaaatgcaactgtctccgacgcaaaccgcgttattcctcttttgcaacaagaagcgggataaactcaaaatcctctactgggataaaaccgggtttgcgctctggtacaaacggctggagaacgcgaaattcaaatggcccaccgccgtcaacagtgcctccctgaccctgacagagcagcaactgcacggattgttatcgggttatgatgtcatcgggcaccagcccttctccgtacaggattgccatgtcgcctga

SEQ ID NO: 4941 - DNA, 1506 bp, Xenorhabdus bovienii
  Coding sequence Name=Xb4151_4152.C444.gene116.dna; Position on contig= 123421..124926bp; Strand=+
atgaaaattgatattgatgccctgcccaatgaccccgctgaactgaaacggctgctgattaagcagtcgcagcggctggcctttttggaagagcagttccgtttagcccaacaaaaacggtttggggcttcctcggaagcgttccccggccagggggagttgtttaacgaagcggaagaaattgcgctgccggctgaaacggccgccgcacaggaaaccctcacacctccccgccgtaagccgacacgcaaccccctgcccaaagatttaccgcgcgaaaccgtgttccatgatatcgccgaggaagaaaaacagtgtgcgtgctgtggcggcaggttgcatcagatgggggcagatcgcagtgaaaaactgttgttcattcccgctcaaatcagggtggttgagcatgtccgccccaaatacgcctgccgtgaatgtgaaaaatccggcattcagacgcctgtcaaacaagcctccttgccagcgatgcccatcaagaaaggcatggcgaccagcagcctgctcagccagcttatcaccagtaaatatcagtatgggttaccgctgtaccgtcaggaaagtgtgttcaaacagtatggcattgacctcagccgccagacccagagtgactggatattaaaatccgcacagttgtttacgccgttggtggccaggttcagggaaatgctgttgcaacaaccggttctccatgcggatgaaaccccggtgaagggggtgacgtctgaaaaaacgacccattacatgtgggtctattgtgtgggcactgatacccccgaaccggcggcgctcacaccgaatattgtgctgtatgaccaccaggccagccgttcaggcacctgcgctgctgactatctcgccggttttcaaggttatctgcaggtggatggctatcaaggctatgagcagaccggtgcccggctggtcggttgcatggcccatgcccgccgtaaatttatggaagcgaagcaggcgcagggaaaaaacaaaacgggcaaagccgatatcgcgctgagcctgatccagtcactgtaccgggtcgagcatcaggtcaaggggttaagcccggcagaaaaataccggatccgccaggaaaaagcgcttcctatctgggataagttatcggcctggctggttaaaacccgatcccaggtgatccccaaaagcaagctgggtgaggccgtcacttatctgagcaatcaatgggcaaaactgatccgctatcgtgaggatggccgcttgtcaatcgacaataaccgggccgaaagggcgatcaaaccgtttgtcatcgggcgaaaggcgtggctgttcagccatacctcgcgcggtgcacaagccagtgcgatcctctacagcgtcattgaaacggccaaagccaatggattgatccctttcgattatgtcatgacttgcctggatgagttatgccaacccaccccggatctggaaaaactactgccctggaaaaaagtgataagcaaggtgtag

SEQ ID NO: 4942 - DNA, 249 bp, Xenorhabdus bovienii
  Coding sequence Name=Xb4151_4152.C444.gene117.dna; Position on contig= 124996..125244bp; Strand=+
ttgtcaatcgacaataaccgggccgaaagggcgatcaaaccgtttgtcatcgggcgaaaggcgtggctgttcagccatacctcgcgcggtgcacaagccagtgcgatcctctacagcgtcattgaaacggccaaagccaatggattgatccctttcgattatgtcatgacttgcctggatgagttatgccaacccaccccggatctggaaaaactactgccctggaaaaaagtgataagcaaggtgtag

SEQ ID NO: 4943 - DNA, 219 bp, Xenorhabdus bovienii
  Coding sequence Name=Xb4151_4152.C444.gene118.dna; Position on contig= 125250..125468bp; Strand=+
ttgacgcttacgccttacagccctaatctcaacccgattgagcgattatggaagtatgtgaatgagcaggtacgaaacaatgtctattttccggataccaaaacattccgtgaaacgctgcgccacttttttcatgtcacattgccagaaaaagcgaaagaactcaccactcggttgactgataacttccagattttaaaacccgcatcttcaagttaa

SEQ ID NO: 4944 - DNA, 11823 bp, Xenorhabdus bovienii
  Coding sequence Name=Xb4151_4152.C444.gene119.dna; Position on contig= 125465..137287bp; Strand=-
atgttgatattactgaaagaactaaataaaaaccgcatgtcagtatgggtctgtgaaaataagttaaaactggcgtttacaggagaaacaccccctgttcaattaattgataaagtaaaagagaaaaagcaaagcgtaatagatttcttaaatgaaagaggtattttttctgaagaggattttcaaggttttatttttaataaagatcagtctaattttgatataaattttgttgatcccagccaatatcctggaaataaaattgaagcgatatttcctgccaccagtttgcagcagggttttgtttaccatcatctggctcagccgcaggatgatgcctatcgggtgcagttgctgctggattatcacgacaggctggattttgcggcttaccagcaggcctggacactggcttcactgcgtttccctgtcctcaggacggcctttgactgggaaggagaggtgttgcagattgtgacggcgggtgccagtatcgggccggccaatttcacgatcaaagatatccgttcattaccggcagaagagtgggatcgggcgattgaagcactccagcaaaatgaccggacccagccttttgatttaagccagcccgggttaatccgcttcaccttaatcaggcagcaggcacaacgggtgacggtactgatcactcagcatcactgtattgccgacggctggagtaccccgattttattgcagaccgtgcatgaatattacaatgcactggtacagggacggcgacccccggaaggggtggatacggcttatctggcaacgcaacagtatcatctggatcacaaggaggcctctgaggcgtattgggtggagcgtaaagcccggtttcagggggcgaatgatctttctgcgctgttaagccacgggattgacctgacacagataaaaacggttgaaaaaccggcggagcagagactgacggtagagggaaacgcctataaccagctcaagacaatgtgccgggagcaggggataacgctgaatgtggtgctgcaatttgcctggcataaattactgcacagttactgtggggatgagcagacccttgtcggcaccgtggtgtccgggcgagatgtgccggtagacgggattgaatccagcgtcgggctgtatatcaacaccctgccattgaccgtgcagtgggaacctgccggcagtgtgctggccgttttacacgcaatccagaacgatatcgcggcactcaacagtcacagcgcggtgtcactcgccagtttgcagcccgacggggcacgtttattccacagcctgctggtttttgaaaactacccggcaccggtgatgagcggggacgggacagggattgaaaacaaactggcattccgtcaggccatcgaaaaagtggattacccggtgttactgatggcctatgaacagggtgacagcctgaccatgaaattgagttatggcgaagactggctggcgggtgaacaggtgcggcgcttactgtgccagcttgagcgcatcctgcataccgtcacccgcgatccgcaccagccgcaccggttagtgaagttcctcagtgacgacgagcgccataccctgctgcaccgctggaaccagaccgacgtaccgtacccgcaaagccacaccctgcaacagcagttcgaagcgcgtgcggccgccacaccggataacgtggcgctggtgtttgagggagcagcgctgacctaccggcaggtcaatgaacaggcgaaccaattggcttttgtgatccgtgaacgctatcagcagcagtgccatgcgccgatgccggcagacatgccgatagcgctgtatctggatcgcagtctggaaatggttatcagtatgctggcggtgctgaaagccggcggtgcttatgtgccagtctcaccggcctacccgccggagcgaacccaatttattctgaccgacaccgcagcccggtgcgtggtgactcagcagcggcatctgacagatctgggggaatacagccccgcgctgtcactgattgtggcggatgatccgtccgtgaccagaggccagtcagtggataatccggtgccggtgaatacctctgcggatctggcatacatcatctatacctcgggaacgaccggccagccgaagggggtgatggttgaacacgccagtgtaattaatttatcccggtttattgcccgaacgcatttactgggggaaacggtaaaggcgttattcttttccaattacgtgtttgatgcatcggtgtttgaactcttcccggcgctgatggccggctcggcgatttttatcgcgccggcggccgtgacggcggacagtgaccaattgctgtcgtttatcaatacgcacgaaattagcaaggcatttattcccaccgccttgatgaatcattttgccgacgaattatcccgttcaaccttgcaggtcatccataccggtggcgaggagttgaatgcgctgagtttaccgccggacgtcacgctgtttaaccagtacggccccaccgaaatcactgtgtgtgccacccagcacttgttacgggacggggatcgggcgatcggtaagggaattgataacacccgtctgtatgtccttgatagtgagggtaacctgtccccgatcggtgcgccgggggaactgtatatcgggggcgcggggctggctcgcggatactggaaccggccagcgttgaccgccgagcgttttgtggtgaacccgtttgccacggcggaagatcaggcgcggggttacacccgcctgtataaaaccggtgactgggtacgctggcggccggacggtaatctggaatatcgggggcgcaatgattttcaggtcaagatccgtggctaccgtatcgagctgggggaaatcgaaagcgcactggcttcgcacccgcaggtgaaacaggcggtggtgattgaccacgagcatgaaagccataaagtgctggccgcgtatctggtcacggacggggagccgtcggatgacaccctgatggaacatctgtccgcccgcctgccggactacatggtgccggccagctttacccggattgagacgatacccctgaccctgaacggcaagctggatcgccgggcgttgccggcgccggtgtgggtgagccgggacggttacgtggcaccgcgcgatgcgctggaaacccggctgtgtgccgtctggcaggatgtattgggactggagcaggtcggcattgaggataacttcttccgtatcgggggagattcgattgtcagtatccggctggtgtctaagctccggcaggcgggattttcgttacaggtcaaatcgatttttgatgccccgacggtggcacggctggcgaagttgctgacccaggtatccgcgacggccggaatcattgccgagccgggattattaagcggggagtttggcttattgccgatccagcaggcgttcttcgaccggaacttgccgtgtccgcaccattggaatcaggcatttatgatgcagcttcccggagaaatccggcacgctgatattgagcaggccctgaaccggctggccgggcggcacgatatgctgcgcacccgctttgtctgtacgcaagacggttaccgccaatgttatcaggctgagatgccatccgggctgcccgcattacaccgcgctgagatcagcgagctggagaaggcggcattacatcaacagttaacgcagtggcagggcgggtttgattatgctgccgggtctttatggcaggccggtcatctgaccggatacgctgacggcagcgcccggttattcttcgcctttcaccacctgattattgacgcggtgtcctggcgtattattgcggaagatatgcgtttattactgcaaggtgcaaccctgccaccgaagaccagcagctaccgccagtgggtggctgcggtgcatcactatgcggcgcttcatcaacaggaaataccttactggcagcgggtgatggccggcaaagagacggaaccggcagccggtgaagccagtcagcaccggctggcactctctgccggactgactgataccctgttacgggaggccaattccggttatcacacggagataaacgacttactcctgagtgcgctcactctggccttgtcggccagtttttcacgcccggtaaatcacatcattctggaaggacatggccgggaacccatcgataacacgctcgatgtttcagaaactgttgggtggtttaccacggtgtatcccgtgcgtctggaaatgcagccggaagtgacggaaaccattattcacaccaaagagatgctcagggcggtaccgaataaagggatagggtacggagccttgcatcaggccggggatttagccggtgagttgccggcgataagtttcaactatctcggccagctggggggagacgcagggcagagccgtcatcaggactggtcactgactgacgatgattgtggtgccgtggtggccagcaataaccccagccccttgttgctggatatcaatggcgcggttcaggcaggtagcctgcaattcaatgtgttatcgcgtttgccacagacccagactcaggtatttatcacggcatttgagcaggctctcaccacggttatcacggccggccaaaaacaggcccgcttggggggaataaaaacctccagtgattatggcattcaaggcgtttcagtcgagcggttaagccgttttcagcagagatatcaggttgaagcgatatttcctgccaccagtttgcagcagggttttgtttatcatcatctggctcagccgcaggatgatgcctaccgggtgcagttgctgctggattatcacgacaggctggattttgcggcttaccagcaggcctggacactggcttcactgcgtttccctgtcctcaggacggcctttgactgggaaggagaggtgttgcagattgtgacggcgggtgccagtatcgggccggccaatttcacgatcaaagatatccgttcattaccggcagaagagtgggaccgggtgattgaagcactccagcaaaatgaccgaaccctgccttttgacttaagccagcccgggttaatccgcttcaccttaatcaggcagcaggcacagcaggtgacggtactgatcactcagcatcactgtattgccgacggctggagtaatccgattttattgcagaccgtgcatgagtattacaatgcgctggtacagggacggcgccccccggaagaggtggacacggcctatctgacgactcagcaatatcatctgaaccacaaggatatctctgaggcgtattgggctgaacgcaaaacccggtttcagggggcgaatgatctttctgcgttgttaagtcacgggattgacctgacacagataaaaacggttgaaaaaccggctaagcagagactgacggtagagggagatgcctatgaccagctcaagacaatgtgccgggagcaggggataacgctgaatgtggtgctgcaatttgcctggcataaattactgcacagttactgtggggatgagcagacccttgtcggcaccgtggtgtccgggcgagatgtgccggtagacgggattgaatccagcgtcgggctgtatatcaataccctgccgttgaccgtgcagtgggaacctgccggcagtgtgctggccgttttacacgcaatccagaacgatatcgcggcactcaacagtcacagcgcggtgtcactcgccagtttgcagcccgacggggcacgtttattccacagcctgctggtttttgaaaactacccgacaccggtgatgagcggggacgggacagggattgaaaacaaactggcattccgtcaggccatcgaaaaagtggattacccggtgttactgatggcctatgaacagggtgacagcctgaccgtgaaattgagttatggcgaagactggttggcgggtgaacaggcgcggcgcttactgtgccagcttgagcgcatcctgcataccgtcacccgcgatccgcaccagccgcaccgattagtggagttcctcagtgacgacgagcgccataccctgctgcaccgctggaaccagaccgacgtaccgtacccgcaaagccacaccctgcaacagcagttcgaagcgcgtgcggccgccacaccggataacgtggcgctggtgtttgagggagcagcgctgacctaccggcaggtcaatgaacaggcgaaccaattggcttttgtgatccgtgaacgctatcagcagcagtgccatgcgccgatgccggcagatacgccgatagcgctgtatctggatcgcagtccggaaatggttatcagtatgctggcggtgctgaaagccggcggtgcttatgtgccgatctcaccggcctacccgtcagagcggatccaatttattctggccgacaccgcagcccggtgcgtggtgacccagcagcggcatctgacagatctgggggaatacagccccgcgctgtcactgattgtggcggatgatccgtccgtgaccagaggccagtcagtggataatccggtgccggtgaatacctctgcggatctggcatacatcatctatacctcgggaacgaccggccagccgaagggggtgatggttgaacacgccagtgtaattaatttatcccggtttattgcccgaacgcatttactgggggaaacggtaaaggcgttattcttttccaattacgtgtttgatgcatcggtgtttgaactcttcccggcgctgatggccggctcggcgatttttatcgcgccggcggccgtgacggcggacagtgaccaattgctgtcgtttatcaatacgcacgaaattagcaaggcatttattcccaccgccttgatgaaccattttgctgacgaattatcccgttcaaccttgcaggtcatccataccggcggcgaagcgctgaatgcactgagtttaccgccggccgtcacgctgtttaaccagtacggccccaccgaaatcactgtgtgcgccacccagcacttgttacgggacggggatcgggcgatcggtaagggaattgataacacccgtctgtatgtccttgatagtgaaggtaacctgtccccgatcggtgcgccgggggaactgtatatcgggggcgcggggctggctcgcggatactggaaccagccagcgttgaccgctgagcgttttgtggtgaacccgtttgccacggcggaagatcaggtgcggggttacacccgcctgtataaaaccggtgactgggtacgctggcggccggacggcaatctggaatatcgggggcgcaatgattttcaggtcaagatccgtggctaccggattgaactgggggaaattgaaagcgcactggcttcgcacccgcaggtgaaacaggcggtggtgattgaccgcgagcatgaaggccacaaagcgctggtggcgtatgtggtcacggacggggagctgtcggatgaagttctgatggagcatctgtccgcccgcctgccggactacatggtgccggccagctttacccggattgagacggtacccctgaccctgaacggcaagctggatcgcccggcactgccggcgccggtgtgggtgagccgggacggttacgtggcaccgcgcgatgtgctggagacccggctgtgtgccatctggcaggatgtattgggactggagcgggtcggcattaaggataatttctttcgtatcgggggaaactccctgatcgcgattaagctgacagccgctattcgccgtgctttggcagtggagattcctctggcgcaggtgtttgagttgaaaaccgttgccgggctggccgcccagatgggacagcaggcctgcacggtgatcccccacgtcgagctggcgcgctacccgctgtcatttgctcaggagcggatgcggtttattgaacagtttgagcagggaacccatgcctatcatatcccttatctggtacagctccatgatggggacggcttatccctgctggaaaccgctattcatcaggtggttgagcgccatccggtgatgaagacggtctaccgcaccgacgaggcggggcaggcctaccagcaggtactggaaggtaatctggttctccggtcacagtcttgtgaggcgtttgacgcactgctgcaagcggtgcgcacggagctgaccaccccgttcgatctgacggccgagccggggctgcgcctgtgtcactaccggatggacgaacatcattatctattgctcctgtggcaccatattgccattgatggctggtctatcgatgtttttatggatgaactggcggcaatttacgctgccctgcgggaaggcggtgacagcctgctgccgccactggagatcacctacggggattatgcccgctggcagcgtgactatttacagggggaggtgggggaacgccagctggcttactggcagcaggctctggccggttatgagccgctgtctttgccgacggacagaagccggccggcacaggtggattatcaggggcaggatttcaatttcgcgctgggaagcgggctttcagagcaactgagggcgctggcgaaaacgcaggaaaccaccctgtataccgttttgctcagtgcattttatgtcacgctggcgaaactgtccggccagcacgacatcgtgctgggaaccccgaccgacaaccggcaccatgcgcaaacccagccgctgattgggatgtttgttaactcactggtcctgagggcgcaactggagcccgccggcagcgtggaaacgctgatcaaacagacccacgcagtgattactcaggccaaggcgcatcaggacatgccgtttgagcagctggttgatgcgctggagattgagcgcgacaccgcccgccaccccatttttcaggttatgttcggggtacagaatttggctgagggcgggcaaagcagggcaagcctgccgttcagcccggtgaaactggacggggtgctatccagcccggccaagtttgacctgagcctgtttatggccgaggagccggccaatattgccggtggtataaattacgcggtcagtctgtttgacgagtcctcaatagcgcggatggcggatatctatcagcgggtattgacggcgtttgtcgccgatcagacgcaatcgctggccgggcttgacgtgttatccgcacaggagcgccataccctgctgcaccgctggaaccagactgacgtgccatatccgcagagccggacgttgcagcagcaattcgaggctcaggtggtcgccaccccggataacgtggcactggtgtttgccggcgcgacgctgacttaccggcaggtcaatgaacgggcaaaccagctggccgccgtgatccgcgaacgttatcagcagcagcgtaatgtgccgatgccggcagacacgccggtggcgctgtacctcgatcgcagtctggagatgatcatcagtattctggcggtactgaaagccgggggtgcctatgtgccggtgtccccggaatatccgccggagcgaacccaatttattctgaccgataccgcagccccgtgcgtggtgacccaacagcggcacctgacggcactgggggaatacacgccggtgttatcactgattgcggcggatgatccgtcggtgaccgccggccggccaatggacaatccggtgccggtaaacggagccacggatctggcgtacatcatctacacctcagggacaaccggccagcccaaaggggtcatgctgacgcaccaaagcgtcatgaaccgcctgtgctggatgcaatcccaatatgccttaaaggcggcggataacgtgctgcaaaaaaccccctatacctttgacgtctcggtgtgggagttgctggcggctaactgggtcggtgcccgtattgtgattgccccgcctgacagccacagacagccggaaaccctgcataaactgatgcaggaaaccggggtaacggtggttcactttatcccgccaatgctcagtgctttctgccagtcgttacaggccttaaatcagcggttggcggccactgtccgttatgttttctgtagcggggaggcgctgaccggatcacaggtcagggcgtttaagacgattaatccgggtgccagtgccttaattaacctttacggaccaacggaagcggcgattgaagtcacctattttgatactgccggtgaatttaatggcaatgtgccgatcggccgggcgattgataacacccgcctgtatgtacgtgaaggtgggggcaacctgtcccccgtcggggcgccgggtgagctttatatcgggggcgcgggagtggcccgcgggtactggaaccggccggaactgacggcagagtattttgtggcgaacccgtttgccacggcggaagatcaggcgcggggctacacccgcctgtataaaaccggcgatctggtgcgctggcgggcggacggcaatctggaatatcgggggcgcaatgattttcaggtcaagatccgcggctaccgcattgagctgggagaagttgaaagcgtgctggccgcgcatccgcaggtgaaacaggcggtggtgattgaccgcgagcatgagggaaataaagcgctggcggcgtacctgatcacggaggggatactgtcggatgagctactgatagggtacatgtctgcccgcctgccggactacatggtaccggccagttttacccggattgagtcggtgcccctgaccctgaatggcaagctggatcgccgggcattaccggcaccggtgtgggtgagccgggacggttatgtggcgccgcgcaatgcgctggaaacccggctgtgtgctgtctggcaggatgttctggggctggagcgggtcggcattgaggataacttcttccggatcggcggtaactccctgatggccattaagctgaaagcggctattctccgtgaaacagaaattgatattcctttgagcattctgtttagtcacaaatgtatttcgttattaacagaatggctggaaacagggagtttaaaatataatttacttaatttattaaccccagaatcaatagcaacgaataagttatttatgatccatgcggctggttgtggtagtgaggtatatgatgatttagcaaaagcattgtctgatgtttataactgtataggtatcgataattataatctttttacggataatcatatagagtcactacagaagatagcccgaatctatttggaattaattttgacggaaacttctattgataaacctattaaaattttaggatggtcattaggagggcaattagctatggaaattgcatttcaattagaacagatcggtgcaaaagatattcagttgttcttattagatacaataattaatacgacacaattaactgaaattaaaaatcaattagatatgtcatatgcacttaatgaggctgaaataaaattgcagaaaataggtgctgataatgcttatatcaataaagtactgagtgcaatgccttttgaacaccaaatggttaattgtaatttgggtggaaaattaatgcatacaaatattactttatttaaagcaggtcaaatgaatacagagtataaaggagatatcggattaacggtaaatcaattaatagcaaaaatgccggataataatatttcggcatggatggtgaatccattagtgattaaattaattaatgaccgttctcacgccgatattcttgaatcgacttccattattagtgcggaaataatcgacaagttatcaattgaggaaaatatacgcaattaa

SEQ ID NO: 4945 - DNA, 14061 bp, Xenorhabdus bovienii
  Coding sequence Name=Xb4151_4152.C444.gene120.dna; Position on contig= 137292..151352bp; Strand=-
atgagaacatctgaaagctcgttgaactcgaacttatataaccttcatcccgctcaagaggatgtgttttacgagcaggcactctatgaaaataacccattacacaacctaggttggtatacattgatagaggaaaatgttgatatagtaacttttcagcaagtgtggaatttactacatcaacatattgatatgttacgattacgcatatcggttaattcggacaatgaagctatacaatatatccaagatcaaggtgtacctgaagaaattatattttatgatgctgcaatgcagcctgatcctgaaaaaaaagcacaactttggatgcagcagcaaatagataatcctataaattttttacaggaaactccatatcagatttcattgattcgtatgacagaggaaaaatattattttttcactatatttcatcatattatgattgatggtgtagggttatttcgactccatgagtatgttaataaattgtacggatgtattaaaaatggaacatcaacagcttggttgttagaaattccgcaatatttagatacaataactaaagcaaggaaatatctgaattcttctcattacgaaacggataaacactactggtgtgattttttaaaagaacatgaaatataccctttaacgccttgctatcaaaatacgggtagtggtgttggttcgctaacattaccttctgagatgacatcagatttacgtattttttgtagagaaaataatactaatgtttttgctgtcttttcgagtctagtcatcatcatgatggcagaacttacggggcaacaagaattgacatttagtactatcacacacggaagaaaaagaagattagataagcatgtcattggaatgcatgcaaatatttacccagtgcattgccaggtttcgcactctctaagtgtgattgaacagattaaattaatagacttatcgtacaaaaatagttatcgccactgtaaatttccccattctcaccttattcgaatcgccaataactttgggattcctttacctaatttatttattttctacgatcgattttcagagtcagcatctgaaataactcaaaataaatataatcatatagaaggaaccgctaatatttatcctattgtttttcgattcaaggattatggcggcactgatcaggaactaaaaataaatataaattatttgcaggcgtattttagtgatcaggatgtagggaaaatatttgaacgtttgaaaaatttatttgctgcgttgattaaaaaaccttctttattagttaatgaattgcctattttattagaacaggaacgtcacactttactgcacacttggcaccagaccgatgcgctgtatccgcaaaatcaaaccctgcaacaacaattcgaagcccgtgcggctgccatgccagataatgtagcactggtgtttgaaggagaaacgctgacttaccgccagctgaatgagcgggcgaaccaactggcctttatgatccgcgagcactatcagcaacgacacaatcaagcgatgccggcagatacgctggtggcactgtacttggatcgcagtctggagatggtcatcagtattctggcagtactgaaagccgggggcgcttatgtgccgatgccccctgaacatccgccggaacggattcagtttattttggaagatacccaatctccgtgtgtggtgactcagcagagacacctgacgacactgagtgaatgcacaaaagttctgattgaccagccggcactgatagcggcagatgacaaggcggtgacggacggccggtcagtggataatccggtgccggtgaacggagccgctgatctggcatatgtcatttacacatcaggaacgactgggcagccaaaaggggtattacagactcatcataatgctgtgcgtttatttgctatcacccaaggggattatcaatttgatcaaaatgatacttgggttctttttcatgcctatacctttgatttcagtgtctgggaattatggggagcattaatatatggtgggcgtttaattattccaaccgtcgattgcacgaaagattttgtcagctttagccgcttgtgctcacaccaaaaagtcaccgtcctgaatcaaactccaggcgcattttatgcttttattgatgcctcgttgagtattggcgctaaattcccctgtcttcggtatgtgatctttggaggagataaacttaatcctgttcagttgaagccctggtgggatagttatggggatcaatcaccaactcttgtcaatatgtatgggataacagaaacaacggtacatgttacctatcagaaattaataaaagacgacgttataacggcatcctgcattggacgaccgttaaatgacatgcatgcctatgttttgaatgactcaggtcatctcgtccctatcggtgccccaggagagctgtatatcgggggcgcggggctggcacgtgggtatttgaaccggccagcgttgaccgccgagcgttttgtggtgaacccgtttgccacggcggaagatcaggcgcggggttacacccgcctgtataaaaccggtgactgggtacgctggcggccggacggtaatctggaatatcgggggcgcaatgattttcaggtcaagatccgtggctaccggattgagctgggggaaattgaaagcgcactggcttcgcacccgcaggtgaaacaggcggtggtgattgaccgcgagcatgaaggccacaaagcgctggtggcgtatgtggtcacggacggggagctgtcggatgaagttctgatggagtacgtgtccgcccgcctgccggactatatggtgccagccagctttacccggattgagacggtgcccctgaccctgaacggcaagctggatcgccgggcactgccgatgccgatgtggggaaaccgggacggttatgtggcaccgcgtaatgcgctggaaacccggctgtgtgttatctggcaggatgtattgggactggagcgggtcggcattgaggataactttttccggatcgggggagactccctgatcgcgattaagctgacagccgctattcgccgtgctttggcagtggaagtctcgctggcacaggtgtttagcttgaaaaccgttgccgggctggccgcccagatgggacagcaggcctgcacggtgatcccccacgtcgagctggcgcgctacccgctgtcatttgctcaggagcggatgcggtttattgaacagtttgagcagggaacccatgcctatcatatcccttatctggtacagctccatgatggggacggcttatccctgctggaaaccgctattcaccgggtggttgagcgccatccggtgatgaagacggtctaccgcaccgacgaggtggggcaggcctaccagcaggtactggaaggtaatctggttctccggtcacagtcttgtgaggcgtttgacgcactgctgcaagcggtgcgcacggagctgaccaccccgttcgatctgacggccgagccggggctgcgcctgtgtcactaccggatggacgaacatcattatctattgctcctgtggcaccatattgccattgatggctggtctatcgatgtttttatggatgaactggcggcaatttacgctgccctgcgggaaggcggtgacagcctgctgccgccactggagatcacctacggggattatgcccgctggcagcatgactatttacagggggaggtgggggaacgccagctggcttactggcagcaggctctggccggttatgagccgctgtctttgccgacggaccggagccggccggcacaggtggattatcaggggcaggatttcaatttcgcgctgggaagcgggctttcagagcaactgagggcgctggcgaaaacgcaggaaaccaccctgtataccgttctgctcagtgcattttatgtcacgctggcgaaactgtccggccagcacgacatcgtgctgggaaccccgaccgacaaccggcaccatgcgcaaacccagccgctgattgggatgtttgttaactcactggtcctgagggcgcaactggagcccgccggcagcgtggaaacgctgatcaaacagacccacgcagtgattactcaggccaaggcgcatcaggacatgccgtttgagcagctggttgatgcgctggagattgagcgcgacaccgcccgccaccccatttttcaggttatgttcggggtacagaatttggctgagggcgggcaaagcagggcaagcctgccgttcagcccggtgaaactggacggggtgctatccagcccggccaagtttgacctgagcctgtttatggccgaggagccggccaatattgccggtggtataaattacgcggtcagtctgtttgacgagtcctcaatagcgcggatggcagatatctatcagcgggtattaacggcgtttgtcgccgatcagacgcaatcgctggccgggcttgacgtgttgtccgcgcaggagcgccataccctgctgcaccgctggaaccagactgacgtgccatatccgcagagccggacgttgcagcagcaattcgaggctcaggtggttgccacaccggataacgtggcactggtgtttgccggcgcaacgctgacttaccggcaggtcaatgaacgggcaaaccagctggccgccgtgatccgcgaacgttatcagcagcagcgtaatgtgccgatgccggcagacacgccggtggcgctgtacctcgatcgcagtctggagatgatcatcagtattctggcggtactgaaagccgggggcgcctatgtgccggtgtccccggaatatccgccggagcgaacccaatttattctgaccgataccgcagccccgtgcgtggtgacccaacagcggcacctgacggcgctgggggaatacacgccggtgttatcactgattgcggcggatgatccgtcggtgaccgccggccggccaatggacaatccggtgccggtaaacggagccacggatctggcgtacatcatctacacctcagggacaaccggccagcccaaaggggtcatgctgacgcaccaaagcgtcatgaaccgcctgtgctggatgcaatcccaatatgccttaaaggcggcggataacgtgctgcaaaaaaccccctatacctttgacgtctcggtgtgggagttgctggcggctaactgggttggtgcccgtattgtgattgccccgcctgacagccacagacagccggaaaccctgcataaactgatgcaggaaaccggggtaacggtggttcactttatcccgccaatgctcagtgctttctgccagtcgttacaggccttaaatcagcggttggcggccactgtccgttatgttttctgtagcggggaggcgctgaccggatcacaggtcagggcgtttaagacgattaatccgggtgccagtgccttaattaacctttacgggccaacggaagcggcgattgaagtcacctattttgatactgccggtgaatttaatggcaatgtgccgatcggccgggcgattgataacacccgcctgtatgtacgtgaaggtgggggcaacctgtcccccgtcggggcgccgggtgagctttacatcgggggcgcgggagtggcccgcgggtactggaaccggccggaactgacggcagagtattttgtggcgaacccgtttgccacggcggaagatcaggcgcggggctacacccgcctgtataaaaccggcgatctggtgcgctggcgggcggacggtaatctggaatatcgggggcgcaatgattttcaggtcaagatccgcggctaccgcattgagctgggagaagttgaaagtgtgctggccgcgcatccgcaggtgaaacaggcggtggtgattgaccgcgagcatgagggaaataaagcgctggcggcgtacctgatcacggaggggatactgtcggatgagctactgatagggtacatgtctgcccgcctgccggactacatggtaccggccagttttacccggatagagtcggtgcccctgaccctgaatggcaagctggatcgccgggcgttaccggcaccggtgtgggtgagccgggacggttatgtggcgccgcgcaatgcgctggaaacccggctgtgtgctgtctggcaggatgttctggggctggagcgggtcggcattgaggataacttcttccggatcggcggtaactccctgatggccattaagctgacggcggctattcgttatgctctggcagtagaagtcccgctgatacaggtatttgaactgaaaaccgttgccggtctggccgcacagatggggcagcaggcctgtacggtgatccctcaccttgaactggcgcgttatcccctgtcgcctgtgcaggaacggattctgtttatcgaacagtttgagcaggggagcagtgtttatcatgtcccctatctggtgcagctggatgatggcgactgtttacccctgctggaaaccgccattaatcgggtagtcgagcgtcatccggtgatgaaggcggtctaccgcactgacgatgcggggcaggtctaccagcaggtgcttgagggcagcctgattttccggtcacagtcttgtgaggagtttaacgcgctcctgcaagcggtgcgcacggagctggccaccccgttcgatctgacgaccgaaccgagcctgcgcctgtgtcactatcgggtggccgaacatcattacttattgatgatgtggcaccatattgccattgatggctggtccattgatatttttatggatgagctggcggagatttactgtgctctgctggcatcccgcgacagccaattgccggccttggatattacctatggggactatgccaaatggcagcgtgactatttgcagggtgagatccgtgagcgtcagctggcctactggcagcaagctctggccggttatgagccgctgtctttgccgacggacagaagccggccggcacaggtggattatcagggacggaatttcaattttgcgctggggaatacgctttctcatcagttaaggtctctggcaaaaacgcaggaaaccaccctgtataccgttctgctcagtgcgttttatgtcacgctggccaaactgaccggacagaacgacatcgtgctgggaacgccgaccgacagccggcaccatgcacaaacccagccattgattgggatgtttgtcaactcactggtcttgagggcgcaactggagccaaccggcagcgtggaaacgctgatcaaacagacccacgcagtgattgctcaggccaaggcgcatcaggacatgccgtttgagcagttggttgatgcgctggcaattgagcgcgacaccgcccgtcatcctattttccagatcatgtttggggtgcagaatttgggtgagagcctgccagacagggcaggtctgccgtttaatccggtgagactggatagagttctacacagccccgccaagtttgacctgagcctgtttatgtcggaagagcagtccagtattgccggcggtataaattacgcggtgagcctgtttaatgaatctacgatagtacggatgacggatatctatcaacgggtgctggcggcgtttgttgccgatcagacgcaatcgctggccgggattgatgtgttgtccgcacaggaacgccataccctgctgcaccgctggaaccagaccgacgtaccgtacccgcaaagccacaccctgcaacagcagttcgaggcgcgagcggccgccacaccggataacgtggcgctggtattcgagggagtagcgctgacctaccggcaggtcaatgaacgggcgaaccagttggcttttgtgatccgtgaacgctatcagcagcagtgccatgcgccgatgccggcagacacaccgatagcgctgtatctggatcgcagtccggaaatggttatcagtatgctggcggtgctgaaagccggcggtgcttatgtgccagtctcaccggcctacccgtcagagcgaacccaatttattctgaccgacaccgcagccccgtgcgtggtgacccagcagcggcatttgacagatctgggggaatacagccccgcgctgtcactgattgtggcggatgatccgtccgtgaccagaggccagccagtggataatccggtgccggtgaatacctctgcggatctggcatacatcatctatacctcgggaacgaccggccagccgaaaggggtgatggttgaacacgccagtgtgattaatttatcccggtttattgcccgaacgcatttactgggggaaacggtaaaggcgttattcttttccaattacgtgtttgatgcatcggtgtttgaactcttcccggcgctgatggccggctcggcgatttttatcgcgccggcggccgtgacggcggacagtgaccaattgctgtcgtttatcaatacgcacgaaattagcaaggcatttattcccaccgccttgatgaaccattttgccgacgaattatcccgttcaaccttgcaggtcatccataccggcggcgaagcgctgaatgcgctgagtttaccgccggacgtcacgctgtttaaccagtacggccccaccgaaatcactgtgtgcgccacccagcacttgttacgggacggggatcgggcaatcggcaagggaattgataacacccgtctgtatgtccttgatagtgagggtaacctgtccccgatcggcgcgccgggggaactgtatatcgggggcgcggggctggcacgtgggtatttgaaccggccagcgttgaccgccgagcgttttgtggtgaacccgtttgccacggccgaagatcaggcacgcggttacacccgcctgtataaaaccggtgactgggtacgctggcggccggacggcaatctggaatatcggggacgcaatgattttcaggtcaagatccgtggctaccgtatcgagctgggggaaatcgaaagcgcactggcttcgcacccgcaggtgaaacaggcggtggtgattgaccacgagcatgaaagccataaagtgctggccgcgtatctggtcacggacggggtgctgtcggatgacaccctgatggaacatctgtccgcccgcctgccggactacatggtgccggccagttttacccggattgagacggtacccctgaccctgaacggcaagctggatcgccgggcactgccggcgccggtgtgggtgagccgggacggttacgtggcgccgcgcaatgcgctggaaacccggctgtgtgccgtctggcaggacgtattggggctggagcgggttggcattaaggataatttcttccgtattggtggcaactccctgatagccattaagctgacagccgccattcgccgtgttttggcggtggagattccattagtacaggtgtttgagttgaaaactattgccggattgacttcacagatggggcagcaggcctgcacggtgatcccccatgtcgagctgacgcgctaccccctgtcgcttgctcaggagcggatgcggtttatcgaacagtttgagcaggggagcagtgtctatcatgttccttatctggtgcaactggatgacgaagcgaacctgctcctgctggaaaccgccattaatcgggtggttgagcgccatccggtgatgaagacggtctaccgcactgacgatgaggggaatacctaccagcaggtgcttgagggcagcctgattttccggtcacagtcttgtgaggcgtttgacgcgcttctgcaaacggtacgtgctgaactggccaccccgttcgatctgacgaccgaaccgagcctgcgcctgtgtcactatcgggtggctgaacatcattacttattgatgatgtggcaccatattgccattgatggctggtccattaatatttttatggatgaactggcggagatttaccctgctctgctggcatcccgcgacagccaactaccggctttggatatcacctatggggactatgccagatggcagcgtgactatttgcagggtgagatccgtgagcgtcagctggcttactggcagcagactctggccggttatgagccgctgtctttgccgacggacagaagccggccgacacaggtggattatcaggggcaggatttcaatttcgcgctggagagcgaactttcgcatcagttaagggcgctggcaaaaacgcaggaaaccaccctgtataccgtactgctcagtgcgttttatgtcacgctggccaaactgaccggacagaacgatattgtgctgggaaccccgaccgacaaccggcaccatgcgcaaacccagccattgattgggatgtttgttaactcactggtcctgagggcgcaactggagccagccggcagcgtggaaacgctgattacacagacccacgcagtgattgctcaggccaaggcgcatcaggacatgccgtttgagcagttggttgatgcgctggcaattgagcgcgatacctcccgtcaccctattttccagattatgtttgggttgcagagtcttggcgaggatcagccaaacagggcaggtctgccgtttagtccggtaatactggagggcgctttgcacagccccgccaagtttgacctgagcctgtttatggcagaaggtgcaggcagtattgccggtggcataaattacgcagtgagcctgtttgacgagtctacgatagcgcgaatggccgatatctatcagcgggtattgacggcgtttgtcgccgatcagacgcaatcgctggccgggcttgacgtgttatccgcgcaggaacgccataccctgctgcaccgctggaaccagaccgacgtgccgtacccgcaggacaaaaccctgcaacagcagttcgaagcgcgtgcggccgccacaccggataacgtggcgctggtgtttgaaggagcagcgctgacctaccggcaggtcaatgaacaggcgaaccagctggcagttgtgatccgcgaacgctatcagcagcagcgccatgcgccgatgccggcagacacgccgatagcgctgtatctggatcgcagtccggaaatggttatcagtatgctggcggtgctgaaagccggtggtgcttatgtgccgatctcgccggcctacccgccggagcgaacccaatttattctgaccgacaccgcagccccgtgcgtggtgacccagcagcggcatctgacagatctgggggaatacagccccgcgctgtcactgattgcggcggatgatccgtccgtgaccagaggccagccagtggataatccggtgccggtgaatacctctgcggatctggcatacatcatctatacctcgggaacgaccggccagccgaagggggtgatggttgaacacgccagtgtaattaatttatcccggtttattgcccgaacgcatttactgggggaaacggtaaaggcgttattcttttccaattacgtgtttgatgcatcggtgtttgaactctttccggcgctgatggccggctcggcgatttttatcgcaccggcggccgtgatggcggacagtgaccaattgctgtcgtttatcaatacgcacgaaattagcaaggcatttattcccaccgccttgatgaaccattttgccgacgaattatcccgttcaaccttgcaggtcatccataccggcggcgaagcgctgaatgcgctgagtttaccgccggacgtcacgctgtttaaccagtacggccccaccgaaatcactgtgtgtgccacccagcacttgttacgggacggggatcgggcaatcggcaaaggaattgataacacccgtctgtatgtccttgatagtgagggtaacctgtccccgatcggtgcgccgggggaactgtatatcgggggcgcggggctggctcgcggatactggaaccggccagcgttgaccgccgagcgttttgtggtgaacccgtttgccacggcggaagatcaggtgcggggttacacccgcctgtataaaaccggtgactgggtacgctggcggccggacggcaatctggaatatcgggggcgcaatgattttcaggtcaagatccgtggttaccgtatcgagctgggggaaatcgaaagcgcactggccgcgcatccgcaggtgaaacaggcggtggtgattgaccacgaacatgaaggccacaaagcgctggcggcgtatgtggtcacggatggggtgctgtcggatgaagttctgatggagcatctgtccgcccgcctgccggactatatggtaccggccagctttacccggattgagacggtacccctgaccctgaacggcaagctggatcgcccggcactgccgacgccggtgtgggtgagccgggatggttacgtggcaccgcgcgatgcgctggaaacccggctgtgtgccgtctggcaggatgtattgggactggagcaggtcggcattgaggataacttcttccgtatcgggggggattcgattgtcagtatccggctggtgtctaagctccggcgtgcgggattttcgttacaggtcaaatcgatttttgatgccccgacggtggcacggttggcgaagttgctgacccaggtatccgcgacggccggaatcattgccgagccgggattattaagcggggagtttggcttattgccgatccagcaggcgttcttcgaccggaacttgccgtgtccgcaccattggaatcaggcatttatgatgcagcttcccggcgaaatccggcacgctgatattgagcaggcgctgaaccggctggccgggcggcacgatatgctgcgcacccgttttgtctgtacacaagacggttaccgccaatgttatcaggctgagatgccatccgggctgcccgcattacaccacgttgatgtcagcgtgctggagaaagcggcattacatcaacagctgacgcagtggcagggcgggtttgattatgctgccggatctttatggcaggccggtcatctgaccggatacgctgacggcagcgcccggttattcttcgcctttcaccacctgattattgacgcggtgtcctggcgtattattgcggaagatatgcgtttattactgcagggtgcaaccctgccaccgaagaccagcagctaccgccagtgggtggctgcggtgcatcactatgcggcgcttcatcaacaggaaataccttactggcagcgggtgatggccggcaaagagacggagccggcagccggcgaagccagccagcaccggctggcactctctgccggactgactgataccctgttacgggaggccaattccggttatcacacggagataaacgacttactcctgagtgcgctcactctggccttgtcggccagtttttcacgcccggtaaatcacatcattctggaagggcatggccgggaacccatcgataacacgctggatgtttcagaaactgtagggtggtttaccacggtgtatcccgtgcgtctggaaatgcagccggaagtgacggaaaccattattcacaccaaagagatgctcagggcggtaccgaataaagggatagggtacggagccttgcatcaggccggggatttagccggtgagttgccggcgataagttttaactatctcggccagctggggggagacgcagggcagagccgtcatcaggactggtcactgactgacgatgattgtggggcgatgatagccagcgataactccagtcctttgttgctggatatcaatggggcaattcagtcaggcagcctgcaattcagtgtgagctcccgtttgtcacagacccagactcaggtatttatcacggcactcgagcaggctctcaccacggttatcacagccggccaaaaacaggcccacttggggggagtaaaaacccccagtgattatggcattcaaggcgtttcaatcgagcagttaaatcaactgactcatcgtcttgatcatgtgaataacgaaaatgtgtctatccatttggaaaagaaaacaattttggatgtgtaa

SEQ ID NO: 4946 - DNA, 624 bp, Xenorhabdus bovienii
  Coding sequence Name=Xb4151_4152.C444.gene121.dna; Position on contig= 152239..152862bp; Strand=-
atgtttttatctggggcgcgttttgctcaattgaaacacggcgtatcttcattgggaaaacttaagaaaaaatctcaatttggtgggtttgggttgttacttgatggggttttatttgccattagttcagatggtgaactttatttacgaggaaatagtcatgctgaggtattatttaaagccagaggcatggagaaatttattttttcaaaaaggggcattcctgtgactttacgatactaccgggttaatgagtcactttggcaggatcaaaagcagttgtttgaatatgtcaacttagcttatcaatatacaatggcagaaattatcgataagcaaaaaatgccccttaggttaaaagatctccctaacttgggaatgactttagaacgccaactatggaaagtcggcatatctaaagtagaagagttgcatatgctgggagcaaaagcggcttaccttaaattacagcaacacagaaaacagacgaatgtcagcatattgcttgcgttggctggtgcgatagaaggttgccatgttgccgtattaccagagaaagtccgtgatgatttgctgctctggcataaggaattagacccgcgtaattcgggttatcattcttaa

SEQ ID NO: 4947 - DNA, 594 bp, Xenorhabdus bovienii
  Coding sequence Name=Xb4151_4152.C444.gene122.dna; Position on contig= 153102..153695bp; Strand=+
atgggcattcgatcatcttggggatatctgattgagaagaaaacggcagtgaacggaacggagaaagaacaaaaaacagacaattatccggttttcaaaatagacaaaatgacaagtctcaaaactgccagtcggctatcttttgtcgaatcatcccaatctgattcacaagtagtaaaaggaatggtcagtgaactgatctactgtgagcaccagccagctatcaatcaccttctgcttcctttactccgtcaatccgggcatgaaaatcgctggttactctgggttacacccaataaaagattgagtcgtcagtggctgatgagttctggtttacctttagataaagtcgttcaattaaatcaaatccgtcctgttgcatcaattgatgccatggaaaaggctctggcgagtggcaactacagtgtagttctgggctggctaccagagctatctgagtatgacgtgcaaaagctacaactggccgcccagaaaggtacggcgttgggatttattatgcgcccacaaaactcggctcatcatttcaaaccaccagtaaacaggttacaaatctattctgtttactatcattga

SEQ ID NO: 4948 - DNA, 1122 bp, Xenorhabdus bovienii
  Coding sequence Name=Xb4151_4152.C444.gene123.dna; Position on contig= 154051..155172bp; Strand=+
atgaaaaagacagctatcgcagtagcagtggcagtggcagctttcgcaactgttgctcaagcagctccaaaggataacacctggtataccggtgctaagctgggttggtctcagtaccatgacgtgaatttttacggcaatggatatgataaccaaatcggtaacggccctactcgcaaaaaccagctgggtgcaggtgcctatgttggttatcaggcaaacccatatctaggatttgaattgggttatgactggctgggtcgcatggcatataaaggcagcgtcaacaacggtgctttccgtgctcaaggcgttcaactggcggccaaactgagctacccagttatggataatctggatgtctatactcgcctgggtggtatggtatggcgcgcagactcttccgctacttataatgctaacgcattaggtggtgcaggtgataaagatcagcgcagactgaaaaacaacgacacaggtgtttctccactggctgccattggtgttgaatacgctctgacgaaagatctggcaacccgtctggattaccagtgggtcaacaacatcggcgatgcaggcagtgtcggtgcccgtccagataacggtatgctgagcgttggcgtttcttatcgttttggtcaagatgacgtggctcctgtcgttgtacctgttgctccggttattccaacgcctgcgcctactgttgaaaacaagagctttactctgcgctctgacgttctgttcaatttcaacaaatcaacgttgaaaacagaaggtaaacaagagctggacaacctttacacccaactggccaaaattgacccaaatcaaggcagagttctggtaatcggccacactgatcgtatcggtagccagcagtacaacttgccattgtcccagaaacgtgctgaatccgttgttgattatctggtagctaaaggcatcccggcagccagcatccaagcagaaggccgtggtaaagaaggttctgtcactggctctacatgcgataacatcaaaggtcgcgctaaactcattgactgtctggctccagaccgccgtgtagttatcaatattcagggtactaaagagatcgttactcagccaaaagcggcacagtaa

SEQ ID NO: 4949 - DNA, 450 bp, Xenorhabdus bovienii
  Coding sequence Name=Xb4151_4152.C444.gene124.dna; Position on contig= 155247..155696bp; Strand=-
atgaaatatcagcaattggaaaatctggaatgtggctggaaatgggcttatttagcgaaaaaatatcgtgaaggtgagctaattactaaatacattgaaaagagcgcagcgcaggatgcgatcattgagttgatgcagttagagcgtgagccaattaaggtactgaaatggatttcgcggcatatgaacccagatttatccaaccggatgaaacagacgattcgggcgcggcgtaaacgtcattttaatgcggaacatcaacattcgcgaaaaaaatccatcgatttggatttccgggtttggcagcggctttctgctctttcccgacgtcgtggcaataccttatcagaaacgatagtgcaattgctggaagatgcagaatatagagaaaaatatacccatcaaatgtcgagtctaaagcaggatttggaagctattttggggaaataa

SEQ ID NO: 4950 - DNA, 1731 bp, Xenorhabdus bovienii
  Coding sequence Name=Xb4151_4152.C444.gene125.dna; Position on contig= 155902..157632bp; Strand=+
ttgacgaatataaaattagactggcaggcattacagctaaacagtacgccttatcaagcactcttcaattctgtcgctgaattagcacccgtcactatggatgcaattcaatccaggttacacaatgggttaaccctcttttgtcaggccgatctgcgtcagccttttatgttagtaaaggcggatgagagtgatatttatctgtctcatttatctgatactatctcagctttactgccggaaagtcgtccaaaaatcggtggttactatcagatagaacaccaaaccattacttggcgttcttctggtgaaggctcctttgcaccaactgaacgggttgcttatcgcgaatggattgaaccggagcaattattcggcaacatctacacccatcaaggtgcacttcagctacaacctggccttatccatcaggtcaatggcggtgtcctgattttgcctttacgtaccctactttctcagccattaatgtgggttcgtcttaagcagatgattatccagcgccgttttgattggctatcacacaatgagaatcactcactgcccctgcctgtaccttcaatgccgttgaatttgcagctcgttctggtgggagatcgcctgagtattgaggaactacacgctcttgagccagaattggccaacaatgctctgtatggcgaatttgagttggatatgccatttcatgaagaagatgatctagcgctatggtgccgctatgttaacagaataattcagcagcaaacattgcctccattaagcgctgatgcatggcctgtactgctcaaacaagccattcgttataccgaagaccaactcagcttacctttggatattcagtggttacaacaaaaactggaaacagccgccgcttaccaacaggaaaatcaaatcacatcgcattcgatgcaacaagcggaagataatcgtctctggcgtcatggctatttggctgaacgtagcatagacgaaattctgaaaggtcagatactgatccgtacacaaggctcagtaattggtcaaatcaatgggttatccgtgctcgaatatccagggcatccagatccgatgggcgaaccttcccgcatcagttgcgttgctcatttaggagacggtgaatttattgatgtggaacgtaaagtggagctaggcggcaatattcatgcaaaaggcatgatgatcatgcaggcgtacttgatttctgaattaaaactggatcagccacaaccgttttctgcttctattgtgtttgaacaatcttatggcgaagttgatggcgacagcgcctcactggctgaattgtgtgcattaatcagcgctctgtcacaacaacctattgatcagcaaattgccgtaacaggggctgtagaccaatttggctatgttcaatccattggtggcgtcaatgaaaagattgaaggtttcttccgtttgtgtaactaccgggagctgacaggtaagcaaggcgtgattatccctacgtccaatgtgcaacacctgtgtctgaatcaagacattatcgacgcggtaaaaaatgggcaattccatatctggacagttgagcatgtctctgaagcagcatcactcctgacaggtattccctattacgatccacaaaaagaacacttgttagccattatatacgaacgcattacacaggctaatagtcaagagcggcctaaacttccttggtttcttcgctggttaggttaa

SEQ ID NO: 4951 - DNA, 519 bp, Xenorhabdus bovienii
  Coding sequence Name=Xb4151_4152.C444.gene126.dna; Position on contig= 157717..158235bp; Strand=+
atgtttaacaaacaagagtcctatacaaaagaagaacttcaaacctctggacaaggagagttattcggtgaaaatggcccgccactacctgctgacaatatgctgatgatggatcgcatcatcaaaatgacagaaaccggaggtgcctacgataaaggctatgtcgaagctgagttagatattaatcctgagctgtggttcttccgttgccattttgtcaatgatcccgttatgccaggttgcctcggccttgatgctatgtggcagctcgttggcttcttccttggctggatcgggggtgaaggtaaaggccgtgcgcttggggtgggtgaagttaaattcacaggccaagtgttaccaacggcaaaaaaagtcacctatcgcattaattttaagcgaattgttaaccgtaagctcattatggggctagctgatggtgaagttttggtagacggtaaactgatttataccgcaaaagatttgaaggtaggattatttaaggacaccagtgccttttga

SEQ ID NO: 4952 - DNA, 159 bp, Xenorhabdus bovienii
  Coding sequence Name=Xb4151_4152.C444.gene127.dna; Position on contig= 158343..158501bp; Strand=-
atgaaaagacagaaaagagaccgtttggcaagagcactttccagaggttatcaagctggaattcacggacggccgcgggagaattgcccttatcattcattggatgcgcgttcacattggttgggtggctggcgtcaagcgatggaagaccgtgcttga

SEQ ID NO: 4953 - DNA, 603 bp, Xenorhabdus bovienii
  Coding sequence Name=Xb4151_4152.C444.gene128.dna; Position on contig= 158637..159239bp; Strand=-
atgaaaaagttgatgtcaagattggcgttttttatttctgtctgtgtttttgctgttagtagcgtatttatttcagggtgcagcagtagtcagccacaaaaaacttactatcagctaccggctttaacgagtacatcacaggaaagtagatcaggtgtcaaagatgaacgacagttatgggtaaaaggcgtaactcttgctgattaccttgcatcaccgggtatcgtttatcaaacaggggacgtgatctatgtcaatgcttcgaatcacttgtgggctagcccattagaacagcaattaaagcaggttttgatcaccgaactaagcgcggcatttcctcaaagactgattgccggacaaccgctggagaaaaatgcggatactctggatatcacaataaccgcttttcacggacggtatgacggaaaggtgatgattcaaggatattggatgttatttaatcagggaggcgtgattaagcagccattcaagcttgagttggaacagaaaatagatggttatgctgaattagtacgcactttggcaacaggttatagtcagttggctcaatccatcgctagtcagatagctacttccgtataa

SEQ ID NO: 4954 - DNA, 1665 bp, Xenorhabdus bovienii
  Coding sequence Name=Xb4151_4152.C444.gene129.dna; Position on contig= 159239..160903bp; Strand=-
atgaggagtcgtaaggtgacggataaagaagaagatctgactcaggccagaatcagtaaactcaagagttggtcacctgtatggattgtgccaattatcactgtgcttattggcgcctggatattgttttatcatttcagtcatcaagggcctgaagtgacattgatgacatccaatgcggagggcattgaagcaggcaaaaccaaaataaaaagccgtagtgttgatgtcggtgtagttgaacgtgtgtcactgagtgataacttaggccaagttatcatcaaggctcgtctgaatgatggcatggaacggctattataccaagatactgcattttgggtcgttaaacctcaaattggccgtgaagggatttctggcttgagtacattactgtccggggtatttattgaattacagccaggcaatcaaggcggtgaagagaataaattttcattactggactcacctccgctggcgtctcctgatgcaaaaggaatgcgtctggttttaatcagtgaaaaagcagggcagctaactcccggtgatccggtgctatttcgggggtatcgggtaggttcggttgaaaccagtacctttgatcccaaatcgcggttgattcgctaccagattttcgtcaatgcaccctatgatggattgttgaccacgggtgtcagattctggaaagacagcggtgttgctttcgacatgtcctcacaggggttacgggtcgaggttgcatcattatccactctgtttggcggcggtgtcagttttgatgtaccgaaaggttgggatttaggcaacccggttaaagaaaaagaaactttcaaactttatgacagtgagaaaaatatccaaaattcactctatacaaagcataaagacttgttgttgtttttcgctgattcagttcgtggcttgcagctgggagcgccagtcgaatttcgtggtatacgggtgggaactgtggcaaaagtgtctttttacactgaaggcgttagacagcgacttgataatgactttcgtattcccgtattgattcatattgaacctgagcgttttgagaaagagattggtagtggtttttatactgataaggaacttgaggaaattattgcgcgcggcctgagagcctctttgaagccaggaaacttactgacaggggcattattcattgatttggacttttaccccaatgaggaaaaatggataggtccatatgaaatcgcaggttatgaaattttgccaacagtaagtggtgggttggctcaaatccagcaaaaagtcattatggcactggataaaattaataatattccgattgagcccgtatttgttcaagctacccggacattagaagaaagccagaaaaccatcaaggcagctcaaaaaacaatggatgaattaaatcgcatccttgcgagtaaagaaactcaggggcttcccaaagatatacaaaatacactgcaagaattaaaccgcagtatgcagggcattcaacccggatctccggcttacaataagctgattgataatatgcaacggttggatcaagtcttgcgtgaattacaacctgttttgaagacacttaacaataaaagcaacgcattggtatttgaagctgaagagatgaaagatcctgaacccaaaaaggcgcgtaactaa

SEQ ID NO: 4955 - DNA, 1215 bp, Xenorhabdus bovienii
  Coding sequence Name=Xb4151_4152.C444.gene130.dna; Position on contig= 160890..162104bp; Strand=-
atgctggtggccgtgcctaacttggaacaagggaacaaagcggcttgcccacgatgtgaaactttgctgacagcaaagtggaaagagccacgtaatcagccaacaggctatgcagcgagtgcattattgatgctgttcctcgccaacctctttccgtttgtcagcatgaatatcgcgggtattgttagtgaaatatcgctgcctcagatcccgaaagtgatgtttagcgaagactattcaagcatcgcggtgtttttcctgatttttgttcagctcgtaccggcatgttgcatggtcgccattattctcttgtgtcagaacattaaaatggcgcgtcgcttgaaaattgagctggcgcgtattctgtttcagatgaaaacctggtgcatggcagagatcttccttgcaggagtgttagttagctttgtcaagttaatggcttatggcgacattggtattgggttgagtttcttgccttattgtctgttctgcctgtttcaggtcagagcatttcaatgtcttgacagacactggttttggaatgaaatagagccagcgcctgaagtgtgtatacctttacaggcaggtaaaccgggtttggtgcaaggtgtcaggctgtgtctgtgttgtaccgccatcttgccagcccagcagccgcagtgttcccgctgtcttactacggggcatgcccgtcgtcgctatagcctccaatacactatggcactattgataacatccgccatactttatattccagcaaacctgctgccgattatggtgactcaggcattgagtagccatattaactccaccattctggaaggcattattctactttggagcacaggttcttatccggttgcaatggttattttcatcgccagtattatggtgcctatactgaaaatgctggctatcagttggctgtgctgggatgcgaagagtcagagcagtcatgattctgaaacgatgcattttatctatgaaatggtcgaatttgtcgggcgctggtccatgattgatgttttcgttattgcggtgctatcagcgctggttcgcatggggcagttcatgagcgtctatcctgccaccggagcagtcctgtttgctctggttgttattttgacgatgtttgcgtcaataacatttgatccgcgcttaacttgggacaaagccaatcataaatttgagttacagaaaaatgaggagtcgtaa

SEQ ID NO: 4956 - DNA, 1911 bp, Xenorhabdus bovienii
  Coding sequence Name=Xb4151_4152.C444.gene131.dna; Position on contig= 162320..164230bp; Strand=-
atgtcattgattaatctctccggtgcctggttatcattcagtgatgcgccgctgttggatgatactgaactgcatatagaagaaaacgaaagagtgtgtctggttggtcgcaatggagcagggaaatcaaccctgctgcgcgtactggcaaaagagcagccattggatgatggtcaggttatttatgagcaggatttgattgttgcccgtttacagcaggacccacctcgtgatgtagaaggcacggtatttgattttgtgtcggaaggggtaaaggaacaggcggattgcatcaaggcatttcaccatgcttcccgtctggtggaaactgatcctagcgacaagaacctcaatcggctagcagaattgcaggaagtgctggatattcagggactttggttactggatagccggatcagtgatgtcttgaaacaactttctctgccagcagaagcaaaattgtcctcactttccggtggctggctgcgtaaggccgcattgggaagggcgctagtcagctcgcctaaagttctgttccttgatgaaccaacaaaccaccttgatattgatacgattgagtggttggaaaattttttgaaagacttcaacggaagccttgtttttatttctcatgaccgctcattcattcgcagtatggcaacgcgcatcattgatttagatcgcggaaaactgacttcgtggccaggaaattacgataaataccttgaaagcaaggaagaggcattgcgggttgaagaattacaaaatgccgaatttgataaaaagctggctcaggaagaagtttggatccgtcagggcattaaagcacgacgtacccgtaacgaagggcgggtcagggcgttgaaagcgttgcgcgtggagcgttccgatcgccgtaatgttatgggtacggcgaaaatgcaggtcgaagaagcgacacgttccggtaaaatcgtgtttgagctggaaaatgtgaattaccagattggtgataaatcattggtcaagaatttctcagcgcaagttcagcgtggcgataaaattgctttggttgggccaaatggttgtggaaaaacgacattattgaaactgatgctgggagatttgctgtcagatagtgggcgcattcattgtgggacaaaacttgaagtggcctactttgatcagcatcgtgccgcattagatccggacagaactgtcatggataaccttgcagaaggcaagcaggaagtgatggtgaatggacgctcccgtcacgtactgggttatttgcaggacttccttttccatcctaagcgagcgatgacgcctgtgcgggctctctctggcggtgaacgtaaccgactgttgctggcgcgcctgttcctgaaaccgagcaacttactcattcttgatgaaccgaccaacgaccttgacgttgaaacgctggaattactcgaagaattggttgatggctatacaggtacggtaattttggttagccatgatcgtcaatttgttgacaattccgtgactgaatgctggatttttgaaggcaatggcgaaatcaataactatgtaggaggttattacgatgcccaacaacaacggacgcagactatctctttacaccagtcttcagagaaaaaaaatagtatcgagacgaaagcagtaaagtctaaagaaacatctaaacgaacaagcaataagataagttaccatttactgcgagagttagaacaactaccatcattattagaaacgttagaggaagaaatagaacaattgcaatcccaggtcggtgattctgaattcttcaatcaaccacacgcaatcacacaaaatgttctgaatgaattggcaaataaagagcagaagctggaaaaagcttttgatcgctggcaggaactggaaatgataaaaaatggatga

SEQ ID NO: 4957 - DNA, 2118 bp, Xenorhabdus bovienii
  Coding sequence Name=Xb4151_4152.C444.gene132.dna; Position on contig= 164235..166352bp; Strand=-
atgaactctctctttgccagcacggcacgtgggctggaagaattattaaaaaatgaattggaaatgctgggagcacaatcctgcaagattgcccaaggtggagttcattttcaaggtgatgatcgggtgatgtataaaagcttgctctggagcaggctggcatcacgtatcctgatgccgcttaacgaattcaatgtttatagcgatttggatctctatcttggggttcaatctgttgactggagcgaaattttttcagtcgatagcacattttccgtgcatttcagtggcacgaatgaggaaatcagaaacacacaatatggcgccctgagagtgaaagacgccattgttgatagctttgtacgtaaaataaagcaacgtcctgatgttgccaaacaacagccggatattcgcattgatgtttttttgaataaggaaaaagcaaccctgtcgcttgatctgagtggagaagggttgcatatccgtggctaccgtgatttggctggccaagctccgctgaaagaaacacttgcagcggcggttgttttgcgctctggctggaaagcggaaacgccgctgattgatccgatgtgtggttcaggaacattgttgatagaagcggcaatgatggctgccgatggcgctccgggtttgcaccgtcagcattgggggtttacatcatggctgaaatttgaccaagaaatctggcgtgaaatgatggctgaagcgcaggtacgtttccgtaaagggctacaggaaacgacttctcgcttttttggttcggatattgatcgtcgggtcatggatatggctcgctcaaatgcccgcagagcaggcgttgcccaattaatccagtttcaacaaggggatgcgagtaagctggaaaacccattgacggagggcgttgtgggaacaatactgagcaacccgccttatggtgaacgtcttgaaagtgagccggcactggttgccttgtacagcatatttggacgaataatgaaaagccgcttcccaggctggcgtctctcattattcagtgcttcgccagagttgttgagttgcttgcaattacgcgctgaacgagagtttaaggctaaaaatggcccgctggattgtgtccagaagaattatcaactttcggacaaaccgcaatcactggatgccggtattgcagatgattatgctaaccgtttgcgcaaaaatgagaagaaactcagtaagtgggcgaagcagcagggtattgactgttatcgtttatatgatgcggatttacccgaatacaacgttgcggttgatcgttatgcggacaaagtcgtcgttcaggaatattcgccacctaaaaccgtagatgccaacaaagcccgtcaacgcttgttcgatgtaataagtgcaaccatgaatgtgctggaattgtcatctaaccaactgatcctgaaaacgcgtcagcgtcagacaggcaaaaatcaatatgaaaaaatggccgaaaagaaagaattctttttggtgaacgagtatggcgcgaaattctgggtcaacttgacggattatctggataccggtctgtttcttgatcatcgtattgcccgcagaaaattgggtgaaatgagccaagggaaagatttccttaacctgtttgcctataccggttcagcgacagtgcatgctggattaggcggtgcgaggtctacgaccacggtggatatgtcccgcacttatcttgaatgggcagagaagaacctacaggctaatggcttgtccggacgccagcatcgtttgattcaggctgattgtttgggatggctggcgcaaagtcgcgagcaattcgatttgatctttatcgatcctccgacattttctaactctaagcgaatggaagactcattcgatgttcagcgtgatcacattactctgatgaaacagcttaagtgtctgcttcgtcgtggcggaaccctgatgttctccaacaataagcgaggtttcaaaatggattttgctgaacttgataaattaggactggttgcagaagaaatcacagagaaaacggtatctcaggattttgcccgtaaccgccagattcataactgctggttactgcgtcacgccggcgaggaaaaataa

SEQ ID NO: 4958 - DNA, 1113 bp, Xenorhabdus bovienii
  Coding sequence Name=Xb4151_4152.C444.gene133.dna; Position on contig= 166476..167588bp; Strand=+
atgataactctgtcacgtctctatacttacccagtgaaatcaatgcgtgggttgcagctctcacactctcttaccggtgaaagtggcttgatgtttgatcgcaattttatgattactacaacagacggcattttcatgaccgctcgccagtatccccaattagtgttatttacccctttcatgctcaataacggcatttacttacgagcgcctaatggggaaagtgccacagtactctacagcgattttaaagaagagcgccatcctactgaggtttggaacaaccattttactgcgttggtcgctcccgacgaggtgaatatctggctgagtagcttttttgatacacctgtgcaactccgctggctcagtgaagagttaacccgccgagtgaagcaattccctgatatctcactgtcatttgctgatggttttccctacttaattataaatgaagcttcttttcatgcgttgcagcaacgttgtcccgccagtatcaaaatagaacaattccgtgccaatattgtcgttacaggcgcagcacctttcgaagaagatagctggcaaaccatccagatcggtaatattatctttgacctgccaaaaccatgtagccgctgtattttaactacaataagcactgaaaaaggccgtaagaatccgaaaagcgaaccactggccacattacaatcattcagaactgctaaagagaatggcgcagttgattttgggcaaaatgccattgcccgcaatagtgggattattcgcgtaggtgataacgtcactattttagaaaagaaaatacctcgtgaatatggcaacggtgagcaagcaaaggatttgaatatacagaaagctgctgaacaagctatttcaattgaattcaacggtcagcgttttactggaaataatcagcaaattattttagagcagttggaaaaacaaggtattaaaatcccctattcatgccgcgcgggaatttgtggttcctgtaaaatatcgctgatcgaaggtaatgtgtcaccattaaaatcgaccgctattagagataatgggaaaattctggcgtgtagctgtattccccaaaatgatttggttattgaattaaactaa

SEQ ID NO: 4959 - DNA, 552 bp, Xenorhabdus bovienii
  Coding sequence Name=Xb4151_4152.C444.gene134.dna; Position on contig= 167836..168387bp; Strand=-
atgaaaattagacctgatgatcagtggcgctggtactttgattccgagcacagccgtgtcatgctcgatctcgctaatggcatggttttccgttcccgttttcttgccaaaatgctgactgattatgccatcacgatggaagaaatgcctttttctgtcgatgatgcagcactttattatgctttcgaagaacatttccgttgtattaatattgcatcagaactccgggctgaattagctctgaatggcgtagttgcatttcgttttatgaaaccacaaatgccaaaaagctggtatttctccagtttctctgtaatgacaaaaccggaacagggggaaattgttcaagttcgtttacaggattgtggtactgaagtgctattcatggtggcagaagtcggtgatagcgccagtttgtgtttattagcacaacaaaaattagaactcagtgatcgagtaatgaatttttgtgatcccattaagataatgaatgaccgtttaatgccttatgttgaaccgactcgggaaacgatatatggcagagtgatttaa

SEQ ID NO: 4960 - DNA, 1011 bp, Xenorhabdus bovienii
  Coding sequence Name=Xb4151_4152.C444.gene135.dna; Position on contig= 168548..169558bp; Strand=-
atgtattattcgctactacggaaggcattgttccagcttgatcccgaacaggcacacgagcttacttttcgccagctcaaacttgttaccggtactcctttcgaatttcttatccgccagtcagttgccactaaacccgtcacttgtatgggcttatctttcaaaaatcctcttggtttggccgcaggccttgataaaaacggtgattgcattgacgcatttggtgcaatgggttttggttttgtggaaatcggaacggtaacaccgcgtccacaggttggaaatgacaaaccaagattgttccgcgttattgaagcggaaggcatcatcaatcgaatgggttttaataaccttggtgttgataatttagttgagaatgtcaaacgggcaaaatacgatgggattattgggatcaatattggcaaaaataaagataccccagtagagaatggcaaagacgattatttaatttgtatggataaaatttatcctcacgcaggttatattacgattaacatttcgtcccccaatactccaggtttgcgaacgttacagtatggtgaagcgttggatgatcttttatctgcgattaaaaataagcagagtgaacttcaacagaaattccaaaaatatgttccgattgctgtgaaaattgcaccagatctgacagaagaagaattaatacaagttgcagacagtttaatgcgccatcgcattgatggcgttattgctactaataccacattggacagaaagctcattgaagggttgaatcattgccagcaggctggtggattaagtggtcgtcctgtgcaacttcgcagtacagaaataattcgatgcctttctcaagaattaaaaggtaaaatacctattattggtgttgggggaattgattccctgattgcggccagagaaaaaatggaagcagggtcttctttggttcagatattctctggttttatctataaagggccaaaattaatcaaagatattgttaatcatatctga

SEQ ID NO: 4961 - DNA, 2619 bp, Xenorhabdus bovienii
  Coding sequence Name=Xb4151_4152.C444.gene136.dna; Position on contig= 169716..172334bp; Strand=-
atgacacaacagcgactcgttaaacatcgtctggattatcaagcaccagattacacgattacggacattgaactcgattttgatctgcatgccgataaaacaactgtgacggcaatcagtcaagtaaaacgcctgaatcatgataccactccattgattttggatggagaaaatctcacgctgaaaagcattcatattgacggtaaagcgtgggaacattatcacgagcgggatggcagattatccattgaacagttgccagcccagttcaccctgacgatagtgaatgaaattcatccatcggcaaacacggcgcttgaagggctgtatatatctggcgatgctctatgtactcagtgtgaggcagaaggtttccgcaatattacttattatctggatcgtccggatgttctggctcgttttactacccgcattgcagcagatagatccaaatatccatatctgttgtctaatggtaaccggattgaacagggagaactgagtgatggccgccactgggtgaagtggcaagatccattcccaaaaccagcctatctgtttgccttggttgcgggagatttcgatgttctgcgtgatacttttgttacccgcagtggccgcgaagtcgcattggagttgtttgttgaccgtggcaatttagatcgcgccgattgggccatgacatcgctgaaaaattcgatgaagtgggatgaaactcgctttggtttagaatatgaccttgatattttcatgatcgtagccgttgatttcttcaatatgggcgcgatggaaaacaaaggactgaacgtttttaactccaagtatgttctggcaaaaaccgaaactgcgacagacaaagattatcttggcattgaagccgtgattggccatgaatacttccataactggacaggaaataggatcacgtgtcgtgactggttccagttaagcctgaaagaagggctgacggtattccgtgatcaagaattcagttctgatctgggctcacggtctttcaaccgtatcaataacgtgcgtgtcatgcgtgctgctcaatttgctgaagatgccagcccgatggctcacccgatccgtcctgaccaagtgatggaaatgaataatttctatacgctgaccgtctatgaaaaaggctcggaagtgattcggatgattcatacgctattgggagaagaacaatttcaggcggggatgcagctttatgtacaccgccatgatggcagtgcagcaacttgtgatgattttgttcaggcaatggaagatgcttcaaacgtcgatttgacgctattccgccgttggtacagccagtctgggacaccgatactgaccgttcatgacgagtatgatgcagaaaaacagcagtataccctgcatgtcagccagatgacaccgccaacgctcgaccagaaagagaaacagccgctgcatatccctcttgacattgagctttatgatgagcacggcagtgtgatcccattacgccgtgatggccagccaatacatcatgttttgaatatcatcaatgcagaacagacgtttgtgtttgatgatgtgccatcattgcctgttccttctttattacgtgaattttctgcgccagtgaaattgaattacccatacagtgacacacaactggcatttttgatgaaacatgcgcgtaatgaattctcccgctgggatgcggcacagtcactgctggctaattatgtgaaactgaatgttgcccgttatcaacaatcccagccattggaattgccaatacatgtgattgatgctttccgtgcggtattattaaatcaagatattgatccggcattggcggcacaaatcttgaccctgccgtctgaaaatgaaatggcagaattgttcacggtgattgatccgaaagctattcatgatgtacttcatgcaataacacgtggattagccaacgaaatggcggatgaattcactgcggtttaccacagtactcacacaggtgcataccgagttgatcatcaagatattgcgaaacgggcgttacgtaatacctgtctctattatctggctttcattgatgacaaggaacaggtggatgaattagtggcggcacaatattatcaagctgataatatgaccgacactgtcgcagcgctgtctgccgctatgtctgctgagttgccttgtagttaccaattgatggatgagtttgagcagcgctggcatcaggatggtctggtcatggataaatggtttgccctacaggcaactaatcctgctttcgatgcacttgataaagtacgtagcttgatgaacaaccgttctttcagtttgagtaatccaaaccgggtttattcgttgctgagaacgtttttcgctaataaccttgtggcctttcatgctgaagatggccgcggttatcaattcctgcaagaaattctgactgaattgaacagccggaacccgcaagttgcgtcacgtttgatagaaccgttgattcgttggagacgttacgatgaggctcgccagtctttgatgcgtgctactctggagcaattgaaagtgttagaaaacttatctggtgatttgtttgaaaaaatcaccaaggcgcttgagagctga

SEQ ID NO: 4962 - DNA, 192 bp, Xenorhabdus bovienii
  Coding sequence Name=Xb4151_4152.C444.gene137.dna; Position on contig= 172474..172665bp; Strand=+
atgaaacctcttttttcggatgttaatcaattagtaaataaaggtgaaaatgatgtaagcaggatattaatgctttcgtgcgaattgtcatctcatatctcatgtaacatgatattatctgcaaatggattaaccttaatcgttactgtccggaaaaatatatgcggttatgtggctttaataacagaataa

SEQ ID NO: 4963 - DNA, 1215 bp, Xenorhabdus bovienii
  Coding sequence Name=Xb4151_4152.C444.gene138.dna; Position on contig= 172737..173951bp; Strand=+
atgaatttagacgctaccccaatcatcaaatcactgcttgatactgatgcctataaatttcatatgcagcaagcagtgtaccaccattacaggcatattattgtcgttgcggaatttcgctgccgtggtgatgaactgctcggcgaatatgccgagacgttacgccatcagattgacatgatggctgatctaacactgacagaacgtgaagccaattatcttgccagccttccgttctttaaagaggattacctgaactggttcaaatcattccgttttaatcctgaacaagtcaaaatatcggttaccaatgaaggtcaactggctatccgtatctcaggcttatggcatgaggttattctgtgggaagtccctttattggcactgattagcgaactggttcatcgccaccgttctccggaaataaaaccggaagtggccgtcagccaactcagaaaactgattgagctattccatcaagacgcggcgaaagaaaatatcgatttgtctggtttcaaactgatggactttggtacccgccgtcgtttttcacacgaagtacagtatgccatcgtcaatgagctgaaaaacaatttcccttatctgatcggaaccagtaattaccaactggcagaacagcttagtctggctcctcttggtacacaggctcatgaatggtttcaagctcatcagcagattagcccagagcttgccaacagccagcgagcagcattgcaaacttggctgaatgagtatccagctcagctgggcattgccctgactgattgcattactatggatgccttcctgcgcgattttgacaaaccctttgctaccgcctaccaaggcctgcgccatgactccggtgatcctatcgaatggggtgaaaaagcgattgctcactaccaatcactggatatcgacccaatgacgaaaacactggtattttcggatagtctggacttgcagaaatctttgaacctgtatagccgtttccacaagagaatcaacgtcatgtttggcattggtactcgactgacctgcaatattccgggggtaaaaccactgaatatcgttatcaaacttgtggaatgcaacggcaaaccagtggcaaaactttcggacagccccggaaaaaccatctgtgaagatgatgaatttgtcgataggttacgtcgagcgtttgacattccctacatagaaaaagcagtataa

SEQ ID NO: 4964 - DNA, 954 bp, Xenorhabdus bovienii
  Coding sequence Name=Xb4151_4152.C444.gene139.dna; Position on contig= 174160..175113bp; Strand=+
atgagcgttgcgcctgtagtcgatgtactgcaaggccgcgtcccggttgacagcgaagtcaccgtccgcggttgggtacgtacaaggagagattctaaagctggtatctcgttcctcgccgtctatgacggttcctgctttaatccagtacaggccgtcgttaatagtaatttacctaattatcaggatgaagttctgtatttaaccactggctgttctgtggaaatcaccggtacagtcgtggcatcacaaggcaaaggccaaaactttgaactacaagccaccaacgtggttgtagttggcatgatagacgatcctgatacttacccgatggcagccaaacgccacagtatcgaatatctgcgtgaagtcgcacacttgcgtccacgcacgaacctgattggtgcggttgctcgcgttcgtcatacactgtcacaagccctgcaccgttttttccatgagaaaggcttcttctgggtatcttccccgctgattaccgcatcagataccgaaggcgctggcgagatgttccgcgtttctacattggatctacaaaacctgccacgtaccgataaaggcgacgtggatttcagcaaagatttcttcggacgtgaagccttcctgaccgtatcgggtcagttgaacggtgaagcttacgcctgtgcattgagcaaaatctacacttttggcccgactttccgtgctgaaaactccaataccagccgtcacttggcagagttctggatgcttgagccagaagtggcttttgccgatctgaacgatatcgccagccttgccgaagagatgctgaaatatgtcttcaaggcagcattggaagagcgtgctgacgatttagcattctttgcagaacgtgttgacaatgaagttgtcagccgtttagagaaatttgttgattccgatttcattcaattggattacaccgcatgccattga

SEQ ID NO: 4965 - DNA, 336 bp, Xenorhabdus bovienii
  Coding sequence Name=Xb4151_4152.C444.gene140.dna; Position on contig= 175228..175563bp; Strand=+
atgaaaaactatccaaaagacatcaaagccttctacatgcgtatgaatgaagatggcaaaaccgttgcagccatggacgttctggctccgggcatcggtgaaatcatcggtggctctcagcgtgaagagcgtttggatatgctggatcagcgcatggaagaaatggatctgaataaagaagattactggtggtatcgtgatctgcgtcgttacggcaccgttcctcatgcaggttttggtttaggcttcgagcgtctggttgcttatgtgactggcgtgtccaatgtgcgtgatgttattccattcccacggacaccaagaaacgcaagtttctaa

SEQ ID NO: 4966 - DNA, 1125 bp, Xenorhabdus bovienii
  Coding sequence Name=Xb4151_4152.C444.gene141.dna; Position on contig= 175871..176995bp; Strand=+
atgaaacgcaatcttcttgcagtggtaatcccagctctgctggtcgctggtacggctaacgcagctgaaatttataataaagacggcaacaaactggatctgtacggtaaagtagacgttcgtcatcagttcgctgacaaaagaagcggtgaagatggtgatgattcctacgcacgtctgggcatcaaaggtgaaactcaagttaatgaccaactgactggctacggtcgttgggaatacaacatgaaagctcacaaagaagagggtaaacaagactatgctactcgtctggcttacgctggtctgaaatttgctaactacggctcactagattacggccgtaactacggtgttgtatatgatgttaacgtatggactgacgtactgcctattttcggcggtgattccatgtctcagactgataactttatgactggccgttctactggtctgctgacttatcgcaacactgacttctttggcctagttgatggcttgggctttgctctgcaataccaaggacaaaacagcgatcgtaccaaaaacgagcgtactgaaccaactaaagccaatggcgacggttatggtttatctactacttatgacgtaggctacggtatctctgttggtggttcttatgctaactctgcacgtaccttaaacagtcagcagcataacgccgatgctttcggcaaacgtgcggaagcatggaacatcggtgctaaatacgatgctaacaacgtatatttggcagctatgtacggcgaaactcgcaacatgactagcgccaaagtaagcggttttaacgacgaaggtaaactagttaaaggtgatcttatcgctaacaaaactcaaaatgttgagttagttgcccaatactatttctctgacttcggcctgaaaccatctctggcttatgttcagtctaaaggtaaagatctgggtgaaggtgaagacagaatcaaccacgatctggttaaatacgtttctgtaggtacttactactactttaacaaaaacctgtctacttatgttgattacaaaatcaacctgcttaagaaagacaacgatctgggcatcaacgctcgcaacgtattcggcgtaggtctgacttaccagttctaa

SEQ ID NO: 4967 - DNA, 1191 bp, Xenorhabdus bovienii
  Coding sequence Name=Xb4151_4152.C444.gene142.dna; Position on contig= 177240..178430bp; Strand=+
atgtttgaaaaaattacagcagcacctgccgaccctattcttggtttagcggatagctttaaagctgatcctcgtgaaaataaaatcaatctgggtatcggtgtttacaaagacgaaactggtaaaacccctgtcctgaccaccgttaaaaaagcagaaaaattcctgctggaaaacgaaaccaccaaaaattatctggcaattagtgggttacctgaatttggccgcgtcactcaggaactactcttcggcaataccagcactatcattactgacaaacgcgcccgtactgtacaaagcccaggcggaaccggtgcactgcgcactgccgcagattttattgctaaacagaccaatgcaaaacgtgtctggatcagtaacccaacatggccaaaccataaaggcgttttctctagcgctgggttagaaatccgcgagtaccaatattacaatgcagaaaagcatgctctggattttgatggcatgttggctagcctgtctgaagctcaagcaggtgatgttgttctgcttcacggttgctgccataacccaaccggtatcgatccaacggctgaacagtggcagaaactggcagatttatctgcggcaaatggctggctgcctgtgtttgatttcgcttatcagggttttgccagaagtttagatgaagatgcagaaggcctgcgtatttttactaaaaaccataatgaactgatcgttgccagctcttactccaaaaattttggcctgtacaatgagcgtgtaggtgcctgcaccatcgttgcaactgacagcgataccgcagaaaaagcattcagtcaggcgaaatctattgttcgtactaactactctaacccaccggcacacggcgcttctgttgttactacaattctgtccaatgacgaatttaaagcagaatggattcaagaactggcgactatgcgtgaacgcattcgtcgtatgcgtcagctgtttgtgaacaccttgcaagaaaaaggtgcaaaacaagactttagctttattattagccaaaatggtatgttttcattcagtggtctgactaaagaacaagttgatcgtctgcgtgaagaattcggtatttatgcggtcagctctgggcgcattaacgtagcgggcttaacactggagaacatggttcctctgtgtgaagcgattgttgcagtactctag

SEQ ID NO: 4968 - DNA, 633 bp, Xenorhabdus bovienii
  Coding sequence Name=Xb4151_4152.C444.gene143.dna; Position on contig= 178515..179147bp; Strand=-
atgaattatcacattatccctgtaactacggtgatgcaaaattgtacgttgatctggtgtgaagaaactctggaagcggcaattgttgatcccggtggtgaggctgaaaaacttatttctgaaatagagcaacgtggactgaaattaacgcaaattctgttaactcatggccactatgatcatgttggcgctactgttgacgttgctacacacttcaatgttcctgttcatgggcctcataaagcagatgctttttggatagaagcgctggaagttcaatgccagatgtttggtgttgaggcatgcccatcttttacaccagaacgctggttggatgaaggggatacattgcagattggtaatatcgaattctctgttttgcattgcccagggcatacgccagggcatatcatctttgtcagtcataccgataaattaatctcaatgggagatgtgttgtttaagggtagtattggccgcacggattttccgggtggtaattatgatgatttgattcaatccattaaagaaaaagtaattccaataggtgatgatttccactttattcccggacatggttcgatgtcaacattgggtcatgaacgtaaaactaacccattcctgcaagattga

SEQ ID NO: 4969 - DNA, 549 bp, Xenorhabdus bovienii
  Coding sequence Name=Xb4151_4152.C444.gene144.dna; Position on contig= 179193..179741bp; Strand=-
atgaatgatattgactatagccgccgaaagtggcttggtataggtgcagctgcgttggggttaagtttattacctcaacacgcattggccgcattgacaacaccacgtcctcgaattttacgttttgataatttgcacacgggggaaacactcaaagcagaattttttgatggtcgtcgctataacaagtcagaattggctcgtttgaattatttattccgcgattatcgccaaaataaaatcaaatctattgatccgaaactgtttgatcagatttatttattgcagatgatgataggaataaataaacctgttcaattggtgtctggttatcgttcattgacgacaaataatatgttgcgtcaggctagtggtggtgtcgcaaaacgtagctatcatacccgtgggcaagcaatggattttcatatcgatagtgttcagctcgcacatattcgtaaagctgcactgaagatgagagcggggggcgttgggttttacccaaagagtaattttattcatatagatacaggcccagtcaggacgtggtaa

SEQ ID NO: 4970 - DNA, 1719 bp, Xenorhabdus bovienii
  Coding sequence Name=Xb4151_4152.C444.gene145.dna; Position on contig= 180150..181868bp; Strand=-
atggtgaagaacacggtcaggttactgaaagtttcttttatctgtagcgcgttggcggtatcagaggaaacctttgcaagtcaacaaaatggactgatagtaaatgatacccaacaatttttggaggaacaaaaaaaggaagacgtagttgtttcaccggatcagattattcctatatcttcagtaaattcgattgaagaaaaccgaaaacagatacaaagttggttaccgcaacaagtaaaaccaatattcattgaccgtttggcaacgttatatgcagtcaataaaatgaaaccgctatggcaagataaaaatacggttcaacagtttgaacagcaattatttgaactatcattggccggggttcaaccccaatttggaaagtggctgactcaacttcattctgctgaattaagcgatatgggacgtgatgttattttatcagatgccatgttgggctatctgcattttgtcaatgatgttaagaaaaaaggagattcgtggttatacagtaaaaaatcttataagattaatttaccgcctcctgatttaattgataaatggcaacagcatattactgataataatgtattttcttacatcactgcattgtcaccaaataaccctatgtataaaaatatgcgtaaggagatgctgaaacaattggctgataaacagcagtggtctgatttttcaatgaaaggaacattaagaccgggacaaaatagtgaaagtgtcgtggcgttaagggaaatattaattcgttccgatactttggattcgttaacagtcaaacctgaaaacaaggtctacaataaagaattagtggctgccgtaaaacgttttcaagctttacatggattatcggctgatggtgttattgggcagtcgacgaaagtatggctgaatactacgccacaaacccgcgctcgaattatggcattgaatatacagaggctgcgtattattccagataatattcctacgggtatactggtcaatattcccaactactcattattttattatctggatggtaaagaagtattgaattctaaagtcgttgtcgggcgaccgagcagaaaaacgcctatcatgagcagtaatctgaataatgtggtgattaacccaccgtggactgttcctaccagtatgacacggaaggatattgcacctagagcaatgcgtgaccctagttattttcgtagtcgtggttataccgttttttccagttggagcaatgatgccaaggttatcgatccttcatcaattaactgggacgtgactacaccaaataattttccttatcgtatacggcaggcgcctggtccaactaattcactagggcgttttaagttcaacatgccaaactcagaagcgatttatttgcatgatacgccaaatcaggcttcatttggccgggaaatgagagcggtcagttcaggttgtgtacgtgttaataaggctcctgaattggctaatatgttgttggggaatgcaggttggaataaggatcgggtaagtaattccttaaaaacatggacaacagcatatgtgaatattccgaagaaaattccggtatttctctattatcaaacggcttgggttgatgaaggaggagtgcctcaataccgcgcagatatttatgattatgatatgagtgccagagagcagtctgaacttttatccgagatcctagcaactcgaaatgattcataa

SEQ ID NO: 4971 - DNA, 714 bp, Xenorhabdus bovienii
  Coding sequence Name=Xb4151_4152.C444.gene146.dna; Position on contig= 182125..182838bp; Strand=-
atgcgtaaagtaacgttagtattcagtgccattgcgtttgcttttagcttaaacggtgtcgtacaggcgaaagtacaaatgccagaatcagtcagctcaggggtaactacagtagaactttctcagcgtcaggctgtacattgggtctcagtagagcagattgaaaaaagcctgcaagatcagccgccaatggcgatagggtttgatatcgatgacaccgtattgttttccagccctggtttttatcgtggtaaattgaaatattcaccaaatgacaatagctatctgaaaaatccggcattttgggaaaaaatgaataatgaatgggatgaattcagtatgccgaaacaaatcggtattgaattggttcagatgcatttaaaacggggagataatatttatttcattacagggcgtacgaaaactaaaacagaaacagtaacaaaatatttgcaggaagacctacatattcctgctgacaaaatgaatgtcgttatttttgcaggtgatgatccaggaaaaaataataaaatcagctggatgaaagaacataaattaaagctctactatggcgatgcagatgctgatattgctgctgcccatgaactgaatatcagaggtattcgtattttgagagcatcaaattcttcttatcagcctctgcctaaagctggccgctttggggaagaagtagtcattaaatccgaatattaa

SEQ ID NO: 4972 - DNA, 636 bp, Xenorhabdus bovienii
  Coding sequence Name=Xb4151_4152.C444.gene147.dna; Position on contig= 182961..183596bp; Strand=-
atgaatgagaatcaaaaacattggtcacaagttgaatatttacattcaacagtaaccaaccccaatataaagattaaaggcacacacagttattatagtcactgctggagtgatagttttgagaagagtgttgtccgttatcttcatggtgatgaaatcagccttggatgggaacctttaggtgtcgttgataagctttatataggaaattatgtctgtattgcatcagaagctgtcattctgatgggaggcaaccatactcatcgaatagactggttttctgtctatccttttttggaaggtattaaagaatcctatcaacattccggtgatacaattttgtctgatgggtgttggattggtatgcgttcaatgatcatgcctggcgtaacgattggggagggagcggttgttgctgcggggagtattgtcacgaaagatgtttctccgtataccgtagtgggtggaaatcctgcccgattcattaaatatcgttttgaaccttctgttatatcgagattgctggcgttgaaaatgtatgatctggatgaagatatggtggaaaaattgctcccttatttgaaaggggatgatatagattcccttgaatcagcttattattcttttaataaataa

SEQ ID NO: 4973 - DNA, 4452 bp, Xenorhabdus bovienii
  Coding sequence Name=Xb4151_4152.C444.gene148.dna; Position on contig= 183920..188371bp; Strand=-
atgattgaacgcggtaaatttcgctcactgacgctagttaactggaacggtttttttgccagaacgtttgatcttgacgaactcgtgaccaccttatccggtggtaatggtgcaggtaaatccaccacgatggcggcgtttgtaacagcgttgatccctgacttgacgctgcttcatttccgaaacaccacggaagcgggcgcaaccagtggctcccgtgataaaggcttgcacggtaaactgcgtgccggggtctgttattctacactggatgtcgttaactcccgccaccagcggatcattgcgggggttcgcttacagcaggttgccgggcgcgaccgcaaggttgatatcaaaccattcatgatccagggtgtccctgcatcgatacagccaacgcagttattgaccgaaaacattggcgaacgtcaggcgcgggttctgccattaaatgagctgaaagagcgccttgatgagatggaaggtgttcagttcaaacaatttaactctatcaccgattaccattccctgatgtttgatttgggggtgattccaaaacgtctgcgttcggccagtgatcgtagtaagttttaccgtctgatagaagcatcattatatggtggtatttccagcgcgatcactcgctcactgcgtgattatttactgccagaaaacagcggcgttagaaaagcgtttcaggacatggaagcggcactgcgtgaaaaccgcatcacgctggaagcaatccgcgttacccaatctgatcgcgatctgtttaaacatctcatcacggaagcgacagcttatgtttctgctgactacatgcgtcataccaatgagcgccgtatccacctagatgaagccttggctttgcgtagtgagttatttggtagccgccgtcaattagtggctgaacagtatcgccatgtcgaaatagcacgggagcttacagagcagagtggtgcgtcttctgatttggagatggattatcaggcggctagcgatcatctgaatttagttcagacagccatgcgtcagcaggagaaaatagatcgttatcaaggagatattgaagaactgacttatcgcctggaagaacagactgaagttgtcgaagaagcgaaagagttacaggcagaatatgacgccgtgtctgaggcggctgaacaggaagttgatgaattaaaaagccagcttgctgactatcagcaggcgttggatgttcaacaaactcgctcgatccaatatcaacaggcgctgcaagcactggaacgtgcccgtgagctttgtcagctcccggatttattgatagataatgctgatgagtggcaggaaacctatcaggccaaagaacaacaggcgactgaaaccttgctggcgctggagcagaagctgagtgtggcagatgctgcccatagtcagtttgagcaggcttatcaactggtgaaaaatattgttggtgaggtgagccgtagctcagcatggcaaagtgcccgtgaagtactgcgcgaatggccatcccaacgccatctggcggatcgtgttcagcctctgcgtattcaattagctgaattggaacagcgtctgaacagccagcaaaatgcagagcgcttactgggggaattctgtaagcgccacaaccagcagtaccaaccggaagatttagaagcgttgcagggcgaattggaagcccgctcggaagagttaagcctgaatgccagtgaaagcggcgagcgccgtatgcagatgcgtcagcagctggaacagcttaagcagaaaattcagggattgacaacacgagcaccagtttggctgacggcacaggatgcattgaaccaactttgtgagcagagcggtgaaacgttcgaaagtgccaatgatgtcactgaatacatgcaacaattgttggagcaagaacgcgaaactaccgtcgaacgtgatgatgtgtcagcacagaaacgtgagcttgaaaagcatattgagcgtttgagccagccaagtggtgccgaagacagtagattgcttgcattggcggaacgttttggtggtgttttgctgtcagaaatttatgatgacatcaccattgatgatgcgccttatttctccgcattgtacgggccagcccgccacgctatcgttgtgccggatctttcgttggtaagtccacatctggaagcactggaagattgcccggaagatctttatctgattgaaggcgatccgcaatcctttgatgatagcgtcttagatttcgaagagcggaaaaatgctgttctggtaaaatcatcggatcgtcagtggcgttattcccgttatcctgacgttccgctgtttggaagggctgcaagggaaaatcgcctggaaatactgaattttgaacgtgatacgctggcagaacgctatgcaacgctttcgtttgacgtccagaaaatccagcgcgcctatcaggctttcagccgttttgtgggcaaacatctgtcagttgcatttgatgacgatccagaagctgatattcgtagcttgaatcagcagcgaattgaactggagcgcgaactctctcaatttgaagcacagactcaacagcatcaccagaaactggttcaggtaaaagagagtctgtcagcgctgaaccgcctgatcccacaaattaccctcttgctggatgaaacgctgattgaccgtgtggaaacggtgcgtgaagaaatgagtgaagcacaagatgcggctcgttttctgcaacagcatagtcatgcactgaacaaactcgaaccgttggtttctgtcctgcaaagtgatccacagcagcatgagcagttgaagcaggattatgagacggcgaaacacacccagaataaagcgaaacagcaagcttttgctttgacggaagtggtgcagcgtcgtgcgcatttcagctatagcgattctgtggggatgctcagtgacaatgctgatctgaatgataaattgcgccagcgccttgaacatgcggagtctgatcgcagccgcgcgcgtgaacaattgcgccagcagcaatcacaatacgcccaatttaatcaagtattggcctcattgaagagttcctatgacactaagcaggatatgttgaaggaacttgagcaggagatgaaagacatcggtgttcaggccgatccgaatgcagaaagtcgagcccgtgaacgtcgcgatcagcttcacgctgccttgagcaccaatcgttcccgcatcaaccagcttgagaaacagatcgcattttgtgaggccgaaatggaaaacctccagaaaaaattgcgtaaaactgagcgtgactattatcagaaacgcgagcaggtggtttcttcaaaagctggctggtgtgctgttatgcggctggtgaaagataatggtgttgagcgtcgcctccatcgccgcgaactggcctatatgaatggagatgagctgcgttcaatgtcggataaagcgctgggagcattgcgtctggcggtggcaaataatgaacacctgcgcgatgcactgcgtttgtctgaagatcccaaacgtccagaacgtaaaattcaatttttcgttgctgtttatcaacatctgcgtgagcgtatccgccaagatattatccgtaccgatgatccggttgatgccattgaacagatggaaattgaactggctcgtttgacggaagaattaacggcgcgtgaacaaaaactggcgatcagttccaagagtgtggccaatatcattcgcaagacgattcagcgcgagcagaaccgtattcgcatgttgaatcagggattgcaggctgtttcttttggtcaggtaggaggagtgcgtttgaacgtcaatgtacgtgaaagccattcaatcttgctggatgtgctttctgaacagcaggagcaacatcaggatctgttcaagagccagcgtctgactttctcggaagcgatggcgaaactttaccagcgtctgaacccacaaattgacatggggcagcgtttaccgcagaccattggtgaagaattactggattaccgtaactacctcgaattggacgttgaagtcaaccgtggctctgatggttggctcaaagctgaaagtggggcattgtctacgggtgaagccattggtacagggatgtcaattctggttatggtcgtgcagagttgggaagaggaatcacggcgcctgcgtggtaaagacatatcaccatgccgtctattgttccttgatgaagcggcgcgtttggatgcgaaatcaatcgccacgctgtttgaactgtgcgaacgtttgcagatgcagttaattatcgcagcgccggaaaacatcagcccggaaaaaggtacaacgtataaattagtacgtaaaatatttaataatcatgaacatgtgcatgttgttggtctgcgtggttttggacaggatgctcccgccattgaacagcttcaacccatcttggcagagtaa

SEQ ID NO: 4974 - DNA, 723 bp, Xenorhabdus bovienii
  Coding sequence Name=Xb4151_4152.C444.gene149.dna; Position on contig= 188368..189090bp; Strand=-
atgtcatcgacacatattgaacaatttatgccggtcaaactggctcaggcattatccaacacactttttcctgaattagacagccagcttcgttcagggcgtcacattgggatggatgatcttgataatcatgctttcctgatggattttcaggaggagctggaaacgttttatgctcgctataatgttgagttaatccgtgcaccagaaggttttttctacctgcgtccacgctcaacgacgctgatccctcgatctgttctgtctgaaatggacatgatggtaggtaaaatcctgtgttacctctatctcagccctgaacgtctgtccaatcagggaatatttacctttcaggaactgtatgacgagctattgtcgctcgctgacgaaagtaaactgatgaaattggtgaaccaacgttcgacaggctccgatctggataaacaaaaactacaggaaaaagcacgaacttccctaaaccgcctgcgccgtttgggaatggtctatttcctgcagaatgacagcaataaatttacgattactgaaacggtattccgctttggagcagatgtacgtagtggtgacaacccacgtgaagcacaattacgaatgatccgtgatggtgaagcgatgtcggtggaaggcaatttatcgcaggaagataatgaacacgaagaagtatcagagcattcagcagaaggtgcggaggatgaacagtcatga

SEQ ID NO: 4975 - DNA, 192 bp, Xenorhabdus bovienii
  Coding sequence Name=Xb4151_4152.C444.gene150.dna; Position on contig= 189071..189262bp; Strand=-
ttgggggcagtactgcgcgattatcttgctcaatatccacataaccgccatttcgatgtggcgcgtattctggtggatcaggcagtacggctgggcgttgcagaagcggatttctctgggttgccagcggaatggttagcgattaatgattacggagccaaggtgcaggcacatgtcatcgacacatattga

SEQ ID NO: 4976 - DNA, 1056 bp, Xenorhabdus bovienii
  Coding sequence Name=Xb4151_4152.C444.gene151.dna; Position on contig= 189338..190393bp; Strand=-
atgagtgaatattcccagactgttcctgaacttgtgtcctgggccagaaagaatgatttttcgatttcattgccaccggaacgcttggcttttttgatggcaatctcagtgctgaacagtgaacgttttgatggcgaaatgagcgagggagagttggttgatgcgttccgtgaagtttgcaaaggttttgagcaaacgtcagaggcggttgctgtccgggcgaataatgccattaacgatatggtacgccaaaagctgattaatcgctttaccagtgaattagcggatggcaatgctatttatcgcttgacgccattgggtattggcatcagtgattattatattcgccagcgcgaattttccacgttgcgcctttccatgcagttatccattgtcgccaacgaactacatcgggcggctgaagctgctgaagaaggtggcgatgagttccattggcaccgcaatgtttttgcgccgctcaaatattccgtcgctgaaatttttgacagcatcgatatgtcacagcgtactatggatgaacagcaaaacagcgtaaaaatagacattgctgcgctcctcaatcaagattggcaggctgctatcgctaattgcgagcatttactgtctgaaacgtcaggtacattgagagagcttcaggatacgttggaagctgctggtgataaattacaggccaatctactgcgtattcaggatgctaatatgggtagcggtggcttagaattggtggataaactggtttttgatctgcaaagtaaactcgaccgcattattagttgggggcaacaggctatcgatctctggattggctatgatcgccacgttcacaaatttatccgtaccgctatcgatatggataagaaccgcatatttgctcaacgtctccgccaatctatccaacactattttgatcatccgtgggtgctgaccatcgccaatgcagagcgtttgctggatatgcgcgacgaagaactgacattgcgcaatgaagaggtaatgggagaattaccgccagacatggaatatgaagaattttag

SEQ ID NO: 4977 - DNA, 786 bp, Xenorhabdus bovienii
  Coding sequence Name=Xb4151_4152.C444.gene152.dna; Position on contig= 190390..191175bp; Strand=-
atgcgggatcgcaatttcgatgatattgcagacaaattttcacgtaatatttacggcacaaccaagggtaaaatcaggcaggccgttgtctggcaggatatcaacgaattgctgaatcatttacctcaacgccctctgcgcattttggatgcgggaggcggtgaaggaaacatggcttgccaattggctgcattaggccataaggtcatattatgtgacctctctgaagaaatgatcttgcgggcgaaatgtaatgcacaagagcggggtgttctccatcagatgcaatttattcaaagcccggtacaggatattcgtcaacacattaaacaacccgtcgatttaattctatttcatgctgtattggaatggatcactgaccaaaaagatgcaatagaaacattgggggagataataacacccggtggagcactttcattaatgttttataatgctaatggactggtcatgcgtaatgccatcttgggtaactttcatttggcaacgccaaatattcagcgtcgccgaaagcgttctttatcgccacagaacccattagtacccgaacaggtatatcagtggcttactgaactcaatatggaaataacaggcaaaacaggtgtcagggtttttcacgactacctgcaaagccgccaattacaaaatacagattttccggcgttgcttgaacttgaacaacgttattgcagacaggagccctatatcagcctggggcgttacattcatgtgatggcacgcaagccgactttaaagagtgaattatga

SEQ ID NO: 4978 - DNA, 807 bp, Xenorhabdus bovienii
  Coding sequence Name=Xb4151_4152.C444.gene153.dna; Position on contig= 191329..192135bp; Strand=+
atgttatttctgcttaaaaaatatgttggcgcgctattaatgcctttgcctttgattattcttgtttctttgacagccctgctatttctgtggttcacccgctggcaaaaaacgggtaaagctttactgtcactgagttggcttgcgctacttttatttagtttacagccgattgctgacaaacttttacttcctatcgaggggaagtatgttcaacgctacgagcctgacaaagcatatattgcccccgtaaaatatattgttgttctcggtggcggtttcacttacaacccacaatgggcgcccagtgccaaccttatcagtaatagtctgcccagagtcaccgaaggtattcggttatatcaccttaatcctggcactaaaatgatttttacgggtggtaaaggtgttaactcaatcagtagtgctgaaatcgctgctatggtagcacaatctttgggaattcctgtagaagacacgattgcattaagagagcctttagatacggaagaggaagccgctgaagttgaaaaagtgcttgggcaacaaccttttattctggtcacttccgccaatcatatggaacggtcgctcaagttcttcgaacggcgtggtatgcaccctatcgccggccctgccaatcaactggctgtgacaactccattgtatgcatgggaaaaatacattccatccgcctattatttttcacatacagaacgagcttggtatgaaacgttgggtaaaatctggcaggcaataaagccagtaactaaagaggcagcaaccgaaaaaacagaaaactcttaa

SEQ ID NO: 4979 - DNA, 750 bp, Xenorhabdus bovienii
  Coding sequence Name=Xb4151_4152.C444.gene154.dna; Position on contig= 192225..192974bp; Strand=-
atgtttaccgttatcatcccagcgcgttttgcttcaactcgcctgcccggaaaaccgctggctgatattcatggcaagccaatgattgtgcgcgttatggaacgggctatccgctccggtgctaatcgggtgattgtggcgacagataaccaagccgtttttgatgccgtcactgccgcaggcggtgaagcttgcatgacaagtgcgcatcaccattcaggtacagagcgtttagctgaagtcattgatcaataccaattttctgatgacgaaatcatcgtgaatgttcaaggtgatgagccacttatcccagaacaaatcatcaagcaggtcgccgataatctggcagaaagtgatgctggaatggcaacacttgcagtacagatccaagatgcagaagaagcatttaaccctaacactgtaaaagttgtgatggatgcgcaaggttatgcgctctatttctcacgcgccacgatcccgtgggaacgtgatcgctttatgcagtcaaaagaaacagtcggggataacttcctgcgccatatcgggctttatgcatatcgggcagggtttatccgtcgctacgtgcagtgggcgccaagcccattggaaagcattgagatgctcgaacaactgcgggtgctttggtacggtgagaaaattcatgtcgccaaagcgctacaagcgccaggtgcaggggtagatacacctgaagatttggaagccgtcagaaaaacctttgctgagtgctga

SEQ ID NO: 4980 - DNA, 180 bp, Xenorhabdus bovienii
  Coding sequence Name=Xb4151_4152.C444.gene155.dna; Position on contig= 192978..193157bp; Strand=-
atggatcaccgtttactcgaaatcattgcttgtccggtatgttacggtaagcttaattacgataaagaaaactttgaactgatttgcaaacttgaccgcctcgcttttcccgtccgtgatggcattcctgttctgttagaaaatgaagcacgggccctgccagcagaggaagaaaaataa

SEQ ID NO: 4981 - DNA, 996 bp, Xenorhabdus bovienii
  Coding sequence Name=Xb4151_4152.C444.gene156.dna; Position on contig= 193266..194261bp; Strand=-
atgattgaacgcatatggtccggccgttcatggctttacatcttgttattgccactgtcagccctttatgggctgataagcggtctgcgttgtttaggctataaactggggttgatccgttcctggaaagcgcctgtacctgttgttgtagtgggtaacttgacggcaggagggaatggcaaaacaccaatcgtcatttggttggttgaacaattgcagcgaacaggctatcagattggtgttgtttctcgcggttatggcgggaaagcggaacattacccactgttgataacaggtgaagtgacaacggcacaagcgggagatgagccagttttgattcatcgccgtactggtgcacctgttgcggtcgcaccgaaacgcgccgacgctatcaaggcgttattaatgcatttccccgtcgatattatcatcaccgatgatggcctccaacattatgccttacagcgtgattatgaaattgtggtcattgatggtatccgtcgcttcggtaatggctgctggttaccggcagggccgatgcgggaactcgctggtcgtctaaatacggttaataccattattgttaatgggggagtgccggaaacaggcgaattgcccatgacattaaaaggtgaactggcgattaacctgctgacgggagaatcgcgtcaggtcagtgatattcccaatggggtggcaatggcgggtattggtcatccaccgcgtttttttgcaactttgcagcagttgggagctgttttgcaggaaacacacgcttttgctgatcatcaatcttatgataaaactcaattgtcggctctgaccgatgatgggcagaatttgctgatgacagaaaaagatgcagttaaatgtttccaattcgctcagcctaattggtggtatttaccggtttctgcacattttccagaagaaaaagagcaaaaaatgctggatgaaatttgtgctttacttcctaaattgaatatgcgcagataa

SEQ ID NO: 4982 - DNA, 1746 bp, Xenorhabdus bovienii
  Coding sequence Name=Xb4151_4152.C444.gene157.dna; Position on contig= 194258..196003bp; Strand=-
atgaatgataaagacctttctacctggcagaccttccgccgattgtggccgctcatcacaccatttaagctaggcttggcagtggcggcgattgcgctggttataaatgctgccggtgatacattgatgctttctttgttgaaacctttacttgatgagggttttggcaaggcagacatgagcgtattggagtggatgccgctggttgttatcgggctgatgcttttgcgtggcatatcgggttttatatcaagttattgtatatcttgggtatctggcaaagttgtcatgcaggtgcgccgtcgtctgttcactcatatgatgggtatgccagtttccttttttgaccagcaatctacgggaacattgctttcccgcattacatacgattcagaacaggttgcttcttcttcttccggcgcgctggtgacagttgtcagggaaggagcatcaattattggcctgttcattctgatgttttattacagttgggagctttccctgatcttgattgtcattgctccgattgtcgctcttgttattcgtcttgtttcggtacgttttcgtaatatcagcaaaaatatgcagaacagcatgggaatggtgacaaccagcgcagaacagatgctgaaagggcacaaagaagttttgatctttggtggtcagaagattgagactaaacgttttaaccaagtcagtaaccatatgcgtcagcaaggcatgaaaatggtgtcggcgtcgtctatttctgaccccattattcagttaattgcctcttttgctttagcgtttgtcctctatgctgccagtttcccggaaattatgggcgcactgactgcgggtaaaatcaccgtggtattttcatccatgatcgccctgatgcgcccattgaaatcgctgactaatgttaacgcacaattccagcgtggtatggccgcttgccaaacattatttgcgattctggatatggaacaggaaaaagatgaaggtaagctggagctgaaaaaagcaaaaggtgatcttgaattccgtaatgtcacattctgctatccaaccaaagatcatcctgcgctgaaaagcatctcaatgaccattcctaaaggtaaaactgtcgcattggtggggcgttctggttcaggaaaatcgacgattgccaatcttctcactcgtttttacgatatcaatgaaggcggcatcatgttggatgggcatgatttgcgtgaatactcattgtcttcactacgcagccagatagcgctggtatcgcagaatgtccatttgttcaatgatacggttgctaataatatcgcttatgccagcgaaggaaaatttagccgtgaagaaattgaacgagctgcggaaatggcctatgcgatggattttatcaagaaactggatcagggtcttgataccatgattggtgaaaatggtgtcctgctttcaggcggacaacgtcagcgtattgccattgcccgtgcgttgctgcgtgattccccaattcttattctggatgaggcaacctcagcactggatactgaatctgagcgtgccatacaagcggcgctggatgaattgcagaaaaacagaacttctttggtcattgcccatcgcctttctaccattgaaaatgcggatgaaattatcgtcgttgaagacggttttatcgtcgaaaaaggtaatcattcggttctgttggaaaaagatggcgcatatgcccaattacatcggatgcaatttggtcaatga

SEQ ID NO: 4983 - DNA, 2346 bp, Xenorhabdus bovienii
  Coding sequence Name=Xb4151_4152.C444.gene158.dna; Position on contig= 196042..198387bp; Strand=-
atgtggcctatcattttttttcccttgaattatattctctccatttggcgaaagccgctgcttattatcagtctgaatcaggctgctatagcaattattctgggaatgttccccttattattgctcgctgaactacctcaacagagggaaatttatttcctgattgggctggcattttgtttatggtttgttccccggaaatccgctcggataacttcgctgatgttatggacatttatttttggatgttggcatggtcacctgatattgaatcaaatcacttatttcagcgaaacatcccgctctgcaacggtcatgattgagagcgtatctttagatgctgagaaaaataatgcggaagaaacagaacgtcatcgcatcagattcattgaaagtgatggaaaatatatttttcctgcattatttgcatcggtactatggaattcttctgaatcgctgtgtgctggtcagatatggcaggtcacaatgaaactcaggccggttcatgctcaattgaaccatggaagctatgatagccagagatatgcactttcgattcgtcagccacttaatggcaaaattactaaggctaggttactaagaggtcagtgcagttttaggcaagatttgataaataaactggtgccagaaatccaaccattgaaatattcagggatcgctctggctcttacctttggtgaaagaaagtggctggatcaacaaaccagactgctgttgcagcaaacgggcatcgctcatcttatggctatttcagggttgcatatcgcaatggccagtttattcggctggagccttgccaggggcattcagtttttctttccggcaaggtgggtgagttttcgtttcccgcttctcatggggtggctgaccgcagtgttatatgcttggttgtcaggctggggaattccggctgtccgggcaatattaggattaacactttggatttatctgcggtgcagaaatcggttttgtttttcatggcagtgggctttatggagtgcagctctgattttattgtttgatccactggcaatcctttctgacagcttttggctctcatttactgcggtgatggcgttgttattttggtttcactggatgcccttaccggagggcattcgttatggctggcattggagttggctacgtgggctgcatatgcaattgggaatgatgctaatgttgttgccgttgcagcttttactgtttcaggggctgaatattgcatcattggttgctaatttatgggctgtaccgatagtttctttcttgtctgtgccactggtgatgttagcgttatcctgtttctttcttcctgttattcagccaattttgtggcagttggttgattacagtattgtattcgctttggcgcctttgcaggttttaacacattcatggtttgaaacagggcatttccctatctttatcacgcttgtggggtggttttctgtcgttttttggcgtttgggctggtggaagtcttataaatggctgttaggggtcttgattggaatcattgtttgttatttaaaacgcgatgatgaataccaatggcgtttttcgatgctggatgttggacatggcttggcagtggtcattgacaagggaggaaaggcaatcatttttgatacaggaaaccgttgggaaacgggaagtatggcagaaaaagtcattgcaccttatttgcgttggcatcgtttgacaccagaacagattattctcagccacgatcatttggatcatacaggtggcgtggaatatctgcgcaaaaaatatcctgatattcaaatcaggagttctttgatcgggcaatcacatttgccttgtattcgtggtgagcaatggacctggcaggaattaacgtttcaggtcatctggccgcaagaaaaaacagcggttgtcggtaacaatcaatcttgcgtgatccgcattgatgatggtaaacacagtctattattaacaggtgatttggaaaaacagggtgaataccgcttagtcagtcttgaacgagaacatctgaatgcaacaatattgcaagttcctcatcatgggagcaatacttcgtccacagcggtatttatacgcacaatcatgcctaaatatgcattaacttcggttgcccgttatagcccgtggaagttaccttccgtgaaagtacgacaacgttataaaaacgctgaaattcaatggtatagcactgcgatttccggccagattaccggttatttttatcgtgatcacattaaattagcaggttatagacaacacataatgtcacggtggtatcatcagtggtttggtattcatagcgatcatgggtag

SEQ ID NO: 4984 - DNA, 291 bp, Xenorhabdus bovienii
  Coding sequence Name=Xb4151_4152.C444.gene159.dna; Position on contig= 198592..198882bp; Strand=-
atgaccaagtctgaattaatcgaaagacttactgagcaacaatctcacatgccagcgaaagccgttgaagatgcagtgaaagaaatgcttgatcatatggcagaaacattggccgcaggtgaacgaattgaagttcgtggattcggcagcttttctcttcactaccgggctccacgtgtgggtcgtaaccccaaaactggcgataaagttgaattggaaggtaaatacgttcctcactttaaaccaggtaaagagttacgcgatcgcgtgaatatctatagtgacagctaa

SEQ ID NO: 4985 - DNA, 1674 bp, Xenorhabdus bovienii
  Coding sequence Name=Xb4151_4152.C444.gene160.dna; Position on contig= 198955..200628bp; Strand=-
atgacagaatcttttgctcaactctttgaagaatccttacaggttatcgaaactcgtccaggtgccattgttcgtggtgtcgtcgtttctatcgataaagacgttgtattggttgatgcaggtctgaaatcagaatctgcaatccctgtagaacaattcaaaaatgctcagggcgagctggaaatccaagttggcgacgaaatcgacgttgctctggatgcggtagaagatggtttcggtgaaactatcctgtcccgtgaaaaagcaaaacgtcacgaagcatggctgatgctggaaaaagcatacgaagaagctgaaactgttaccggtgttatcaacggtaaagtcaaaggtggcttcactgtagaactgaacggtatccgtgcattcctgccaggttcactggttgacgttcgcccagttcgtgatactgctcaccttgaaggcaaagagcttgagttcaaagtcatcaagctggatcagaaacgcaacaacgtagttgtttcccgtcgtgccgttatcgaatctgaaaacagcgcagagcgtgatcagctgctggaaaatctgcaagaaggcatggaagttaaaggtatcgttaagaacctgactgactacggtgcattcgttgatctgggcggcgttgatggcctgctgcacattactgatatggcttggaaacgtgttaaacacccaagcgaaatcgtcaatgtgggcgatgaaatcacagttaaagtactgaaattcgaccgtgagcgtactcgtgtgtctctgggtctgaaacaactgggtgaagatccatgggtagcaatcgctaagcgttacccagaaagtactagactgactggacgcgtaactaacctgactgactacggctgcttcgttgaaatcgaagaaggtgttgaaggtctggtacacgtttcagaaatggattggaccaacaaaaacatccacccatccaaagttgttaacgttggtgacgttgtggaagttatggttctggatatcgatgaagagcgtcgtcgtatctccctgggtctgaaacagtgtaaatctaacccttggcagcaatttgctgaaactcacaacaaaaacgaccgcgttgaaggtaaaatcaagtcaatcactgacttcggtatcttcattggtctggacggcggcatcgacggtctggttcacctgtctgacatctcctggaacgttgcaggcgaagaagcagttcgtgaatacaagaaaggcgacgaaattgctgctgtagttctgcaggttgatgcagagcgtgagcgtatctctctgggcatcaagcaactggcagaagatccattcaacaattacctgtctgtaaataagaaaggtacgattgttaatggtaaagtgactgcagttgacgcaaaaggtgctacagttgaattagctgacggcgttgaaggttacctgcgtgcatcagaagcttctcgtgaccgcattgaagatgcaactcaagttctgaacgttggcgatgaagttgaagctaaatatgttggtgttgatcgcaaaaaccgcatagttaacctgtctgttcgtgcgaaagacgaagctgatgaaaaagacgctatcgcttctgtgaacaaacaagaagatacaaactttgctaacaacgcaatggctgaagctttcaaagcagctaaaggcgaataa

SEQ ID NO: 4986 - DNA, 177 bp, Xenorhabdus bovienii
  Coding sequence Name=Xb4151_4152.C444.gene161.dna; Position on contig= 200679..200855bp; Strand=+
atggggttgttttacatacctcgcaactactccctgttacaaggtgctttggtatgccagcatattttactgcccacataccaggattctatatacatcttcttggtgcgctgttgcaagagtacaacatgcgaaaactacaattacgcaggcaatgccaacgcgtttttcgcataa

SEQ ID NO: 4987 - DNA, 735 bp, Xenorhabdus bovienii
  Coding sequence Name=Xb4151_4152.C444.gene162.dna; Position on contig= 200822..201556bp; Strand=-
atgacccgtttgttgtgcggaaagcgctatgcgaaaaggaggaaaataatggtggcgatagcctcagtaataaccgttgatgggccaagtggtgctggcaaaggaacactctgtcaggcactggctgaagcattgggttggcaattacttgattcaggtgccatttatcgtgtattagcactggcagccattcatcatcaggtagatatccaatccgaagactcactggttcctctggctgcaaatctagatgttcgttttatgcctgcaaatggcaaactcagggtcattctggaaggcgaagatgtcagcaatgaaatccgtactgaagctgttggcaatacggcttcacaggcggcaacatttcctcgtgtccgtgaagccctgcttcgccggcagcgggcttttcgtatcgcaccggggttgatcgctgatggtcgtgatatgggaacggtggtattccctgatgcgccagtgaaaatttttctcgatgccagtgcggaagaacgcgcccgcaggcgcatgttacagttgcaggagaagggttttagtgttacttttgacagccttttgtccgagatacaggaacgggatttccgtgaccgcaatcgggcagttgcgccgttagtgcctgcatatgatgcattactcttggattcgaccagtatgtctatcgaagaagtgattgataaggctctgacttatgcgaaaaacgcgttggcattgcctgcgtaa

SEQ ID NO: 4988 - DNA, 1287 bp, Xenorhabdus bovienii
  Coding sequence Name=Xb4151_4152.C444.gene163.dna; Position on contig= 201701..202987bp; Strand=-
atgcaatccctgacgttaaaacctatttcctgtatcaatggaactattaacctgcccggctccaaaagtgtttccaaccgcgcgctgctgcttgcagcctttgccaagggaactacttgcctgaccaatttgttggacagtgatgatatccgccatatgcttaatgctttgacaacactcgaaattccctaccgtctatcagacgatcgtacttgctgtgaaattgatggcattgggggaactatcaccggaaaaggtgcgctggagctgtttttgggcaatgcagggacggccatgcgtccgttggctgcggcactgtgtctgggagacaacaatgtcgtgctgacaggggaacctcggatgaaagagcgtccgataggtcacttggtggatgcattgcgtcaaggcggagcaaaaattgattatcttgaacaggaaaattatccgcccctgcatatcaaaggtggattctcgggggggaaagttgtcgttgatggcagtgtttccagccaatttctgacagctttgctgatggctgcaccactggcggcgaatgatacagacattcatattcaaggtgatttggtttctaaaccttatattgatattactctggcgctgatggaaagtttcggcgtgacggtagaaaatcaccaatatcaagtttttcatgttaaggggcagcagcaataccaatcgccgggacattatctggtggaaggggatgcttcatctgcctcttattttctggccgccgctgcgataaaaggtggcacggttcgcgtgacaggtatcggtaagaatagcctgcaaggcgatacaaaatttgctgatgtgctggaaaggatgggggcgacgattcgctggggtcatgattttgtggaatgtgaacgtggcacattgattggtgtcgatatggacatgaatgctattcctgatgccgctatgactattgcgacaacagcactgtttgctcaaggtgaaacggtcatccgcaatatttataactggcgggtaaaggaaacggatcgtctcaatgcaatggcggctgaattacgcaagattggggctgaggtggaagaagggcatgattacattcgtgtcgttccgccacaaaagctcaatcatgctgaaattgaaacttataatgatcatcgaatggcgatgtgtttctcactggttgcgctttcggatacaccagtgacgattcttgatccaggctgtacggccaaaacattcccggattatttcaatcagcttgaaaaactgagccaatacataatgtaa

SEQ ID NO: 4989 - DNA, 1089 bp, Xenorhabdus bovienii
  Coding sequence Name=Xb4151_4152.C444.gene164.dna; Position on contig= 203104..204192bp; Strand=-
atgagtcaggtatataatttcagcgctggtccagccatgttgccagcagaagtactacgccgtgcagaacaagagctttgcaactggcatggtctgggaacatctgttatggagatcagccaccgtagcaaagagttcatggatgttgcggctgaagcagaaaaagatcttcgggatttattagcaatacctgagaattataaagttttgttttgtcatggtggtgctcgtggtcagttttcggctttaccacagaatctacttggtgacaaaacgacagccgattatatcgtcagtggttattggtctgagtgtgcagcgaaagaagcagaaaaatattgcacaccaaacgtcataaatattacgacagaagttgatggcatcagaagcgtaaagccaatgagtgaatgggcgctgagcagtgatgccgcctatgtgcattattgtcctaacgaaactattgaaggtattgcaatttttgaagagccggattttggcgatgataagattgtgattgctgactactcttcagctattctttcagccccgattgatgtgagtcgttacggtgtgatttatgcgggagcccagaagaacatcgggccagcaggaattacagtggtgattgtccgtgaggacttattgggtagagcacatcagcatactccgtcaattctggattatactgtgcaggttaaatcagcctcgatgtacaacacgccaccaacatttgcctggtatctctctggcatggtattcaaatggctgaaagagcagggtggcttacaggaaatcagcaaacgtaatcaggcgaaagcagagctcctctatcgcaccattgataacagtaatctgtatatcaactgtgttgcgccacagaatcgttccatcatgaacataccattccaactggccaacccaatgctggatggtaaatttctggaagaagcctatgcacatgggttacacgctttgaaagggcataaagttgctggtggtgcgcgagcgtccatttataacgccatgccttatgaaggtgttcaggcattggttgagtttatggctgattttgaacgccgtaacgcataa

SEQ ID NO: 4990 - DNA, 1047 bp, Xenorhabdus bovienii
  Coding sequence Name=Xb4151_4152.C444.gene165.dna; Position on contig= 204656..205702bp; Strand=-
atgagaaagactaaaaaaacagcaatagccggttttctgacgttagttagtggttctgcgcttgctctgccaaacattactgttttggcaactggtggcacaattgccggtggtggcgagtcagcaactcaatctagctatactgcgggtaaagttggtattgattcactgctgaatgctgtacccgcgattaaaaacatcgctaatttgaaaggtgagcaggttgtcagcatcggctctcaagacatgaatgatcaggtttggctgacactggcaaaaaaaatcaacgcagattgtgataagaccgatggtttcgtggttactcacggtactgacacgatggaagaaaccgcttacttcctcgatttaaccactcagtgccagaagccaatcgtaatggttggtgcaatgcgcccatcaacagctctgggtgctgatggcccattgaacctgtataatgccgtagttgtagcggcagataaaaactctgcaaaccgtggtgttttgctttctatgaatgattctgtgattcacggtcgtcatattggcaaactgagcaccactgaagttcaggcgtttcaggctatcaatagcggagcagaaggttttgttcacaatggtaaggtgagctactactctgctactgcaccagaaaaagagcataaattcgcttttgatgtcagcaaactggataaactgccaaaagtgggtattgtttataactactctaatgcctccgaattgccagcaaaagcattcgtggaaaatggctatcagggtattgtcagcgctggtgtaggtaacggtaatatctataaatccgtttttgacactttggctcaagccgctaaagatggtgtggttgttgtcagatccagccgtattccttttggttatacaaccaagaatgctgaagttaacgacagcaaatatggttttgtagcatcagagcgtttgaatccacagaaagctcgtgttcttctgcaactggctctgacgcaaacttctgatacagcaaaaattcaggaaatgtttactcaatattaa

SEQ ID NO: 4991 - DNA, 1764 bp, Xenorhabdus bovienii
  Coding sequence Name=Xb4151_4152.C444.gene166.dna; Position on contig= 205852..207615bp; Strand=+
atgacgcaaacctatatccccggcaaagacgccgcgttggaagattccattaaccacttccaatccaagctggcatcttttggttttaatatcgaagaagcctcatggctgaatcccgtacccaatgtctggtcggtacatatccgtgatcgcgactgcccactgtgctttaccaatggcaaaggagccagcaaaaaagcagcattggcctctgcattaggggaatattttgagcgtctgtcgacaaactattttttcgctgatttttaccttgggaataccgttgctaacggggaatttgtccattatccaaacgaaaaatggtttccattgccagaagatgactccctgccagagggcattttagacgagcgccttcaccatttctataaccctgacaacgaactctgtgccagtcaattgattgattttcaatccggcaatgaagaacgcgggatctgtgctctgcctttcactcgccaatccgataatcaaaccgtttatattccgatgaatattatcggcaacctgtatgtctcaaacggcatgtccgcaggcaataccatgaacgaagcccgcgttcaggggttatcagaagtgtttgagcgctatgtaaaaaaccgcattattgcagaatgcatcagcctgcctgaaatcccagaaagcgtaatgaatcgctatcctggcgtagttgaatccgtcaacaaattgcaggcagaaggcttcccactttattgctacgatgcctcactgggtggtcaatttccggtaatttgcgttgtgctgttcaatccgaataatggcacttgctttgcctcttttggcgctcatcctgattttggtgttgcgctggaacgtaccgtaaccgagcttctgcaaggccgcagcttaaaggatctggatgtctttacgccaccaagcttcgatgatgaagaagtgtctgaacataccaatctggaaactcacttcatcgattcaagcggtgcaattagctgggatctgttcaaacaggatgccgactatacatttgctgattggagtttcaaaggcactacagaagaagaatttgccacactgatggggatcttcaatacgctggatgctgaagcttatattgctgattacgaacatctgaacgtttatgcctgccgtattctggtgcctggcatgtcagatatttatccggttgaagatttgcacattgccaataatacaatgggaactcatctgcgtgatactattctggcgttaccaaatagccaatggcaaccagcagaatatcttgctttccttgaacaattggatgacgaagggctggatgatttcacccgtgtccgtgaattactggggatcgccgcaggtaaagacaacggctggagtaacctgcgcattggtgaattgaaatccatgctggcattggctggcaacgatctggaacaagcgctgatctgggttgagtggacacaggacttcaatgcttcggtcttcaccgccgaacgagccaattattatcgctgtttgcaaacactgctgctattgacccaagaagaagatcgtgacccaagccaataccatcaggcttttgtcaaaatgtacggtcaggaaacagtcgatgctgcttccgccgccattgacggcaaaaacggcttctacggcctatggtctgtagattcagagctaaaaacattgccagcacatcaggcattactcaatgcttatgaaaaactgcaaaaagccaaacgcgagttttggtcaaataaataa

SEQ ID NO: 4992 - DNA, 858 bp, Xenorhabdus bovienii
  Coding sequence Name=Xb4151_4152.C444.gene167.dna; Position on contig= 207938..208795bp; Strand=+
atgaaaactgacaacccttttaatttatttccacctgctgtaatggcacaaatcgctgatgatagtggtgtatataaagttaataaacatcccgcagtgacttatttatcggcaatcatggcaggtgtgtttatttccattgcttttgtcttttatattacagctaccacaggaacatcttccattccttatggattagcaaaattaactggcgggatttgcttttctcttggtttaatgctggtggttatatttggtgccgatcttttcacctccacagtattgactatagtttcaaaagccacaggccgtattacctggtcacaaatgctcaaaaattggattaacgtttatatcggtaatctgattggcgcactattttttgtcattttaatgtggcaatcaggccaatatgcagtcgctaatggtttctgggggctgaacgtattacagactgccgatcataaaatgcaccacacctttattgaagcactatgtttaggtattttggccaatctgatggtatgccttgcggtctggatgagctatgccgggcgcagcctgatcgataaattgtttgctttgatcctgccagttgccatgtttgtcgccagtggctttgaacacagtattgccaatatgtttttaattccgttcgggatcattatcaaaaattttgccccaactgaattctgggcaaaagtgggagccactcccgaacaatttcctcaactcactgtttcacactttattactgataatcttatccctgtaacgataggtaatattattggcggtgcgatattggttgggttgatttattggttcatgtatttacggggcggccaaaaatattaa

SEQ ID NO: 4993 - DNA, 2283 bp, Xenorhabdus bovienii
  Coding sequence Name=Xb4151_4152.C444.gene168.dna; Position on contig= 208850..211132bp; Strand=+
atgtccgagttaaatgaaaaattctctgtagcatggcaaggctttaacgagggtagctggcaaaatgaagttaacgttcgtgacttcatccagcagaactatgctccgtatgaaggtgatgaaacattccttgcaggcgccacaaaagcgactgatattttgtgggaaaaagtcatggaaggtatcaaaatcgaaaaccgtactcatgcgccggttgattttgacactgatgttgcgtctacgattatttctcatgatgcgggttatattgccaaagacctagaacaaatcgtaggcctgcaaaccgaagcgccactgaaacgtgccattattccatttggtggaatcaaaatggttgagagttcctgtaaagcttacaaccgtgaactagacccaaaactgaaacaaatttttactgactatcgcaaaacccacaatcagggagtattcgatgtttatacacctgatatcctgaaatgccgtaaatccggtgtactaacaggtttgcctgatgcctatggccgtggccgcatcatcggtgactaccgccgcgttgctctgtacggtatcgatttcctgcgtgatgaaaaatatgctcaattcacatcattacaggaaaaactggaaaacggtgaagatctggaagctactatccgtctgcgtgaagaaattgctgaacagcaccgcgctcttagtcagattaaagaaatggcagctaaatatggctgtgatatttcctatccggcgatcacagcgaaagaagccgtgcaatggacttacttcgcttatttggcagcggttaaatcgcaaaatggtgcagcgatgtctttcggtcgtgtgtccagcttcctggatatctacatcgaacgcgatctgcaagcaggcagactgacagaacaagaagctcaagaactgattgaccatctggtcatgaaactgcgcatggttcgtttcttgcgtactccagaatacgacgagttattttctggcgatcccatctgggcaacagaatcactggcaggcatgagcttggacggccgtactctcgttaccaaaaacagtttccgtttcctaaacacactttatactatggggccatccccagagcctaacatgaccatcctgtggtctgaaaaactaccaatcaacttcaaaaaattcgcagcgaaagtgtctatcgatacctcatccctgcaatatgaaaacgatgatctgatgcgccctgatttcaacagcgatgactatgctatcgcatgttgtgtcagcccaatgattgttggtaagcaaatgcaattcttcggcgcacgtgccaatctggcaaaaaccatgctgtatgcaatcaacggcggtgtggatgaaaaaatgaaaatacaggttggcccgaaagaagagccaatgagagacgaagtgctggattatgacaaagtcatggctcgcatggatcatttcatggattggctggcaaaacagtatgtcactgctttaaatatcattcactatatgcatgacagatacagctatgaagcagcactgatggcgctgcatgaccgtgatgtttaccgtaccatggcatgtggtatcgcgggtctttccgtagcggccgactcactgtctgcaatcaagtatgcgaaagtttctccaatccgtgatgaagatggtttggcaactgatttcaatattgagggcgaatatccacaattcggaaataatgatccgcgtgtcgatgatatcgcctgtgatctggttgaacgctttatgaagaaaattcaaaagctacaaacctatcgcaacgcagtaccaacccagtctgtactgaccattacttctaacgtggtttatggcaagaaaaccggtaacactcctgatggacgtcgtgctggtgcaccattcggccctggagctaacccaatgcacgggcgtgatcaaaaaggtgcggttgcctcactgacttctgttgccaaactgccatttgcctatgcgaaagatggggtttcctatactttctctatcgtgcctaatgcactgggtaaagacgatgaggtacgcaaggcgaatctggctggtctgatggatggttatttccatcacgaagcggatattgaaggaggccagcacctgaacgtcaacgtaatgaaccgtgaaatgctactagatgcaatggaaaatccggagaaatatcctcaattgactattcgtgtatctggttacgccgtgcggttcaattcgctgactaaagaacaacagcgagatgtcatcactcgtacatttacccagacgatatga

SEQ ID NO: 4994 - DNA, 741 bp, Xenorhabdus bovienii
  Coding sequence Name=Xb4151_4152.C444.gene169.dna; Position on contig= 211255..211995bp; Strand=+
atgtctgtacttggtcacatccactcttttgaatcttgcggaaccgttgatggcccaggtatccgttttatcgtgtttttccagggctgcctgatgcgttgcctttattgccataaccgcgacacgtggaatacccacggtggtacaacagtcactgttgaagagcttataaaagaagcgacaacttaccgtcattttatgaatgcctctggtgggggcgttaccgcttctggtggagaagccatccttcaggctgaatttgtccgcgactggttcagagcctgtcatgcagaaaatattcacacctgcttagataccaatggctttgttcgtcgttatgatctcatcattgacgaactgctggacgatactgatctggttatgttggatttaaaacagcttgatgatgaaattcaccaaaaattaatcggtgtttccaatcatcgcacactcgaatttgcccactatctggcaaaactcaatcaaaagacctggattcgctatgtcgtggttccggggtggtcagacgatgataaatctatccatatgcttggtgaatttactaaggatatgaagaacattgaaaaaattgaattattaccttatcacgaacttggcaaacataaatggattgctatgggagaagagtataaattggaaggagtaaagcctccttcaaaagaaacaatggaacgagtaaaagaaatcttagttagttatggacaccatgtcatctattaa

SEQ ID NO: 4995 - DNA, 669 bp, Xenorhabdus bovienii
  Coding sequence Name=Xb4151_4152.C444.gene170.dna; Position on contig= 212083..212751bp; Strand=-
ttgcatcataaaacagtttatcgattgatttataaggataaacttaatggtgataatttatggctacatcttaggattgcgaaaaaaccgtatcgtaaacgctatggaagttataagcgcagaggcaaaattaaaaacagagtcagtattgataagcgccccaaacttgttgataaaaagcagcgtattggtgattgggaaggagatactctcgtgggtaaagatcataaaagtgcattattgacattaattgaacgaaaatcgttatttactatcataattaaacttgaaaataaaacagcagaaggggtcgcaaaagcggcaacaagacatttatcactgataaaacataaaattaaaacaatgacctttgataacggcctcgagtttgccgaacacgaactgatcagtaaaaatttagagacaaaaatttattttgctcacccgtattccccctgggaaagagggataaatgagaacacgaatggattaatcagagattacttcccaaaaggaactgattttaataaggtgtcagagcgggagattaaccttgtggcaaaccgattaaataatcgtccccgtaaaacacgagatgacaaaacaccgaatgagttatttaaaggaatacccactcatttacttcgtccattacggtgttgcgcttaa

SEQ ID NO: 4996 - DNA, 132 bp, Xenorhabdus bovienii
  Coding sequence Name=Xb4151_4152.C444.gene171.dna; Position on contig= 212935..213066bp; Strand=-
atggcctataaacaactgaccgaaacagaaagatatcagattttcagcctgaaagaagccggtttttcacaacgggagatttcaaagtcactcaatcgaaacccatcaacgattagccgggaattgagatga

SEQ ID NO: 4997 - DNA, 132 bp, Xenorhabdus bovienii
  Coding sequence Name=Xb4151_4152.C444.gene172.dna; Position on contig= 213165..213296bp; Strand=-
atgcacttacctactaacgcttgggaacaggaactgcgctggttctgtcgcattaataaagaaagtttgaatgaaggtagttctgtctattatttatgcaaccaaacggtaaaacatctctgcaggagataa

SEQ ID NO: 4998 - DNA, 225 bp, Xenorhabdus bovienii
  Coding sequence Name=Xb4151_4152.C444.gene173.dna; Position on contig= 213244..213468bp; Strand=+
atgcgacagaaccagcgcagttcctgttcccaagcgttagtaggtaagtgcattgaacacctctccctcttttcaggaaaaaatgtcaggggttatcatgccacaatggggcgtacggctgtaatacgtggcagtgctaatgcgctgatcctgatattatttattttttacccatgcattgtttatattcaatatccatacatcttgcatatagccaagatttga

SEQ ID NO: 4999 - DNA, 213 bp, Xenorhabdus bovienii
  Coding sequence Name=Xb4151_4152.C444.gene174.dna; Position on contig= 213404..213616bp; Strand=-
atgaaaagattatcttatatcatattgctttgtatatcgacttttgcgttagctaatattagcttcgctgaaagcttatatcaaaatgatccatacccaaatcctcaatgcaacatacaggctcaaaacatatgccggccatccattttcaaatcttggctatatgcaagatgtatggatattgaatataaacaatgcatgggtaaaaaataa

SEQ ID NO: 5000 - DNA, 294 bp, Xenorhabdus bovienii
  Coding sequence Name=Xb4151_4152.C444.gene175.dna; Position on contig= 214396..214689bp; Strand=-
ttgagcatatttcgctatcaccaaacgtgctcctctcttcgagatcctcattccggtagcgccagtgatggtagtaaagccgctctgaggctaggcagtcgcacgttgagccattggctcacgaatgaaggccaacccgttgggcgctggaaggccagacggttaatgcaggaatgcggtctgcaaagttgtcagcagggcgctcatcgttaccgtccggcaggcgaagaacacgccacttctccccatcttttgcggcagcattttacaccggagtgcccgaacatccagtga

SEQ ID NO: 5001 - DNA, 1050 bp, Xenorhabdus bovienii; identical to SEQ ID NO: 483
  Coding sequence Name=Xb4151_4152.C444.gene176.dna; Position on contig= 215340..216389bp; Strand=+

SEQ ID NO: 5002 - DNA, 141 bp, Xenorhabdus bovienii
  Coding sequence Name=Xb4151_4152.C444.gene177.dna; Position on contig= 216671..216811bp; Strand=-
atggaacgcgttaaaacctatcccaatcgacaggtatgtgctttcaaatttctgcttttgcggctgagtttactactccctagtcacattgttatctatatgcctggggatccactcacttgctatcgcgctacaacttga

SEQ ID NO: 5003 - DNA, 564 bp, Xenorhabdus bovienii
  Coding sequence Name=Xb4151_4152.C444.gene178.dna; Position on contig= 216798..217361bp; Strand=-
atgattgatcagaagatacctaaaatattgaatataaatgacgttgcccattcccgtttattcaatattcagtctgttaatcttgagttcagcaatggtgtaaagcgagtttatgaacgcatgaaaccctccaatcgtgaagcagtactgatcattcccgtgatcggcgatgagttactccttatccgtgagtatgccgttggcattgaacaatacgaattgggttttccaaagggtgctattgatgcgggagagagcacccttgaagctgccaatcgtgaactgaaggaagaagtgggattcggggcagccaaactggaactgctgacaaaactgacaatggctccctcctatttttccagcaggatgaatattgtcattgctcaagatctttatcccgaatgtttggaaggagatgagccagaaccgctggtacaggttcgctggccaatcgcagatatgatgtctttgctggaacatcccgatttcaacgaagccagaaacgtcagcgccctgttttttgcacaacgatacctgcaagcatcaagcaatggaacgcgttaa

SEQ ID NO: 5004 - DNA, 2058 bp, Xenorhabdus bovienii
  Coding sequence Name=Xb4151_4152.C444.gene179.dna; Position on contig= 217769..219826bp; Strand=+
atggtttcctttctgactttcagatggaagcggcctgataacgcgcgttatctaccgtcaatcgccaaaacaggccatcgtaagctgaatgctgatgaatatcaggcaattgattcttatttgcaaaatgctctgtccctgatgcagccagataggagccacagatcaggccaaccagcactgtctgtcaaaaatgatacggtttataccatcaatcacaccatcaaccgcttttctgtcgctacggatgaatcgcagtattggcgctattatgttgatgaaatggagatacatcttcctgcgttacttgagtcattcattaagcagcagaatacgattgagattgttcaaaccacattcatgcctcttgttattgccgtgaatggccacttcctgaaagattatcagcaagatctgtccatcgcgcgaatcgtgaaacaaacggcacaggcttcaatccaaaaaaacggcaattccattgccaattttttgtatatccgcaaggaaacgccggaagagaatcgtctgcgtcgttcaacaggcattctggaaggcattctcatgtgtattggcttgtcgctctggtttttggctcttttcatgccaacgcccatattaccgtggctaatgttggccgctgttctgtttctgattaccagcttctggctgactttccggtcaccttctccgcgtaacattttgaatattagctgctttaatggtattccgaaacgttggggtatattcagtgaatctgaaccggaacagcggaggaatatctctctggggggtattgatcttatctatccctcacattgggagccgtacgtcgttcgtgagcttgaccaaaatactgatgttgatatatataccaattgccatgtcgttcagcaggggcgctacctctcattgcatgaggaagaaaaacactatccttatcagcgctatagaaaaaacctgatactggtggttttttccatttgtgctatgttggtactttatttttaccagcccgtgagcttatctatgcggctcagttttgcatggctgtatgggagtaatactcaggtcatcaccagcgtcactgaactgcaaaatatgcctctgaaggaaggcgatgtactgcgagttaaaggcatagggatgtgctacataccacccagactgaatgataatcccggtggaatcaaacatatatttactgcgtttgactgcactggcatctactggaataacgatagcccattgcccattccggaatcagatattatcgaaaatgcatcaacattgattacaacggtcaatgagcaattacacccgattgaacgtagccggaaaaccaactctgacctgaatgaagccattgcgaaatcgggtatgacattactcgacaatttttcgcaagtcatcttgaagacgcataatttgtgcatggacgagattgactgtattcgtctgaaaagcgcactggtcaatctgagcaatgctgaggattggaatgatctattgaaacaggctgaaagagggaaactgaatggaaccaaagtattattacgttcagtaagcgcagatgcactggaaaagttaattgataccaccacagcatcatttatttatcgggaaattgataaaataagcatactgctgaacagcccatcgccggggggcgtcctgctgatcagcgaggaagggaataaattggttgaattgccttatttaccatttcttacctatgaatacagcgcactggatcagtggagggaattacagcggttagctgaaatactgttgagtgctccatttgaagctgtcggaattgtgacgaaattgtccgaagacgcaaatgagactcgccgtatcaccttgcatagtgaacccgactccgtgactcttattcgttatctgggaagctgcttctttctggcaatactcatggcgatattgagcatcaatgccattctgataataagcaaaaggcagaaaaataaggtgcggctccagcgtataggcgagtactacgacaattgtttcaactcgaaacagccgccgatggattag

SEQ ID NO: 5005 - DNA, 414 bp, Xenorhabdus bovienii
  Coding sequence Name=Xb4151_4152.C444.gene180.dna; Position on contig= 219901..220314bp; Strand=+
atgccgaattcagacacggatcagactatgcgcctcgataaatggctctgggctgcccgtttttacaaaacccgctccatcgcgcgtgaaatgattgatgggggaaaagttcattataatgggcagcggagtaaaccgagtaaactggttgagttgaatgcagaaattaaactgcgtcagggaaatgaagagaaaatagtgactgttttagcattgaacagtcacagacgcagcgccactgaagcccagcaactttatcaggaaacggaaaaaagcattatcaatcgggaaaaaacggcattggcccgtaaaatgaatgtgctcacgatgccgcatcccgatcgccgcccagataagaaagagcggcgtacactgattaaatttaagaacacgaaattaaacgagccggaataa

SEQ ID NO: 5006 - DNA, 873 bp, Xenorhabdus bovienii
  Coding sequence Name=Xb4151_4152.C444.gene181.dna; Position on contig= 220341..221213bp; Strand=+
atgaccaagcatgatcaattacaccgctttttgttcgaaagccattctgtccggggagaactcgtttccgtcagtgaaacgtaccagcggatgatggaaaatcaccattaccctttgcccgtacagcagttattaggtgaattgttggtcgcaaccagcctgttgactgccacattgaaattcaacggagatataaccgtacagattcaaggtgatgggccagtcagactggcggtcattaatggtaataatcaacagcagatgcgtggcactgcccgtattgatggtgatgtggatgctgcgagcagcctgcgggatatggtcggtaatggttatatggttattactgttacgccaacagaaggtgaacgttatcagggcgttgtcgcgctggaaggggagacgctggcagaatgtctggatgcgtacttcaagcagtcggaacaattgccaaccagactgtttatccgtacgggaatactggatggaaaaatggcggcgggtggcatgttattacagatcctgcccggcgcacaggaaggcagtgaagacctgcttgatcatctggtacaactcactgcgaccatcaagggagaagagctgtttacgctggatgtgaaagaaattttgcatcgtctttatcatgaagaagatgtgacgctgtatgagccgcaacaggttgaattccgctgtacctgttctcaccaacgctgtgctgatacgctggtgacgctgccggatgctgatcttcaggagattttgctcaaagatggcaaaatcgatatggaatgtgaattctgtggtatgcactatattttcaatgataaagatatcagcgaaataaagattgtgaaaaaagaactgcttcactga

SEQ ID NO: 5007 - DNA, 1620 bp, Xenorhabdus bovienii
  Coding sequence Name=Xb4151_4152.C444.gene182.dna; Position on contig= 221411..223030bp; Strand=+
atgagcgttaaaggcattactgcgcaggaacttgcggtttatggtatttgtgatgttagcgagattgtttataacccaagttatgaattgttattctctgaagaaactcagccctcactgcaagggtatgagcgtggcacactgacccatcttggtgcggttgcggtagatacagggattttcacggggcgttctcccaaagataaatatattgtccgcgacgatgtgacgtgcgataccgtatggtgggctgatcagggaaaaggtaaaaacgataacaaaccgctcagtcaggaaacctggtctcagctcaagggattggttacgcagcagctttcaggcaaacgtttgtttgtcgtagatgcattttgcggcgcaaatgcggatacccgcctgaaagtgcgttttatcaccgaagtggcgtggcaggctcattttgtcaaaaacatgtttattcgcccatcggatgaagaattagttaacttcacgcctgattttattgtgatgaacggggcgaaatgtaccaacccgcagtggaaggaacaagagctgaattctgagaactttgttgcctttaacctgacagaacgtatgcagttgattggtggtacttggtacggcggcgaaatgaaaaaaggaatgttctcaataatgaactacctgctgccattgaaaggtattgcatccatgcactgctctgccaacgtgggtggagaaggcgatgttgccattttcttcggcttgtctggtacaggtaaaaccacgctttccaccgatccgaaacgcaagctgattggtgatgatgagcacggctgggatgatgacggcgtgtttaacttcgaaggtggctgctacgcgaaaaccattaacctctccaaagaagcagagccggatatttatcacgcgatctgccgtgatgctctgctggaaaacgttaccgtgctggcggatggcacagtcgatttcaatgacggttctaaaaccgaaaatacccgcgtttcttatcctatctaccatatcgaaaacatcgttaagccagtatcgaaagccggacatgccactaaagtgattttcttgaccgctgacgctttcggtgtattgcctccggtttcctgtctgacgccagaacagacccagtatcacttcctgtctggttttacggcgaagctggcgggaactgaacgtggtgtgacagaacctacgccaacgttctctgcctgctttggtgcggcattcctgtcactgcatccgactcagtacgcagaagtgctggttaagcggatgcaggcatcaggtgcgaaagcttatctggtcaatactggctggaatggcacaggtaaacgcatctctatcaaagatacccgtgcgattatagacgcgatcctgaatggtgatattgaagatgcagataccattgagctgccgatctttgacttagctgtaccgacagcattgccaggcgtggatacaggcattcttgatccacgtaacacctatgcggataaatctgaatgggatgttaaggctaaagatctggcacagcgttttgtcgataactttgacaaatatactgatacagccgcaggtgctgcattggtgaaagcagggcctaatctgtaa

SEQ ID NO: 5008 - DNA, 696 bp, Xenorhabdus bovienii
  Coding sequence Name=Xb4151_4152.C444.gene183.dna; Position on contig= 223118..223813bp; Strand=-
atgatctacttacgtaaagcttcagaaagaggtcacgccaatcacggctggttggacagctggcatacgttttcatttgctgactattatgacgccaatttcatgggattctctgcccttagggtgattaacgaagatgtaattgatgccggacaagggtttggcatgcatcctcacaagaatatggaaatcctgacctatgtgctttccggtacagtcgagcatcgggacagtatgggaaatcaggggcaaatttccgccggagagttccagattatgagcgcaggaaccggtatccgtcactctgagtataatccgcatgatagtagcaaacttcacctgtaccaaatctggatcatgccggaaaaaaatgacctgccaccgcgctacgagcaacgctgctttgattctgccaaaggtcgccagttaatcctttcgcccgatactcgcgatgactcgttaaaagtatttcagaatatgattttatggcgttgggcactgaaaaacggcgaaacagacgagtatgatatagaaaaatcgcgaaaaatctggattcaggttgttcgtggcgaagtgactatcaatggcgttcaagcgaccaccagcgatggcatcgctatctgggatgaatctcatcttcaattaattgccagccaagagagcgaaatcctgctgttcgacctgccacctaactga

SEQ ID NO: 5009 - DNA, 492 bp, Xenorhabdus bovienii
  Coding sequence Name=Xb4151_4152.C444.gene184.dna; Position on contig= 224500..224991bp; Strand=+
atggaactctgtatgtcatacatgatatatctaacattaaatggtaagaagcagggcttaatatcagcagggtgttcaacgcttgattctataggaaatcggtatcaaaaagggcacgaagatcaaatacaggtactcagcctgaatcatgcaatttcacgccagcagaacgtgagtcaccagccaatacagttcatcaaaccaattgacaagtcatcaccactactggcaatggcaatagactccaatgaatcactgaatggcggttttattttttatagaacaagccaaacagggcaattagaattattctacgaagtaaaaattacggaagccactatcacagatatctcctgtgtatacccacattctataaatgatcacgatatgatgccatatgaaaaagttacattaaactataaatctatatcatggaatcatataacggcaggtacatctgcctatatacccgtcgtcattgaagatgcttga

SEQ ID NO: 5010 - DNA, 1050 bp, Xenorhabdus bovienii; identical to SEQ ID NO: 483
  Coding sequence Name=Xb4151_4152.C444.gene185.dna; Position on contig= 225012..226061bp; Strand=+

SEQ ID NO: 5011 - DNA, 297 bp, Xenorhabdus bovienii
  Coding sequence Name=Xb4151_4152.C444.gene186.dna; Position on contig= 226062..226358bp; Strand=+
ttgcgtatatatggtgttattggtgcatcaggtattcgggtattgattgattctaaagttgattatagcaaggcacagaacctgatcctgacctccgttattttgattattggtgtcagtggggcgaaaatccagattggtacagcagaattgaaaggtatggcactggcgacggtagtaggtatcggtttgagcatgattttcaaattgatcagtgttatccgcccggaggagccttatattacttcttctgtagaatcgattgacaatgataaaaaacgtgaagctgtagagtaa

SEQ ID NO: 5012 - DNA, 666 bp, Xenorhabdus bovienii
  Coding sequence Name=Xb4151_4152.C444.gene187.dna; Position on contig= 226973..227638bp; Strand=+
ttgcccgatgatgaaatatttgccagtttctttgcaggtgagaatacttccttattagctgcaataaaactggccattagtcagtcacacggcagttatatctatttttggtcccgcgatggcgggggcaagagccatttgcttcatgcatcttgtgccgaattatcccaacagggagaggcggtgggatatgtaccactggataaacgtgcctattttgttcctgaagtccttgatggcatggaacatttatcattagtgtgtattgataatattgaatgtattgcaggcgatcaagaatgggaaatggctatcttcaatctttataaccggattgtagagattggccgcacctgcttattgatcaccggggatcgtcctccacggcaaattaatctgacattgccggatctggcttctcgtctggattgggggcagatttacaaattgcagccactgtctgatgatgaaaagattcaggcattgcaattgagggcgaaattacggggatttgaattacccgaagatgtagggcgttttgtgttgaaacgactcgatagggaaatgcaaacactgtttagaacgttagatgagcttgaccgtgcttctattgtggcgcagcgcaagctgacgataccatttgtgaaagatattcttgatctctga

SEQ ID NO: 5013 - DNA, 357 bp, Xenorhabdus bovienii
  Coding sequence Name=Xb4151_4152.C444.gene188.dna; Position on contig= 227731..228087bp; Strand=-
atgccacaagttattttttatcataatcctcgctgttcaaagagccgcgaaacactcaagctggttgaagatctcggtattgcaccagaaatcattcactatctcgacaccccaccaacggtagagcagcttaccgttttactgaagcaactgggtttcaaagatgcccgtcagttaatgcgaaccaaagaagaactttataaggatctcaatcttggtgatgacacattatcccaagccgcattactccaagcgatggaaaaataccctatattgatagagcgtccgattgttgttgtcggtgataaagctcgtctaggtcgcccaccagaacaagttaaggagattcttggctga

SEQ ID NO: 5014 - DNA, 1470 bp, Xenorhabdus bovienii
  Coding sequence Name=Xb4151_4152.C444.gene189.dna; Position on contig= 228099..229568bp; Strand=-
atgataaaaacacctaagaaatccctgatagtgacattgattagcctattattatttggaaattcacccgctttatctgtaagttccgaaaattcactacccgatatcggaacaagtgcgggggcgaccctcagtatcaaccaagaaatagaaatgggggatttttttatacgccagatacgtgctggagcgccgctaattgatgaccctctgcttaaacaatacattaatcaattaggccataaattagttaaccatgccgattcagtgaaaacgccttttcaattttatctgatcaataaccccgctattaacgcgtatgctgttttcggtggtaacgtagtgctacattccggtctattccgctatagccgcaatgaaagtgagctggcttctgtcatagctcatgaaatctcccatgtaacacaacgccacttggctcgttttatggaggatacacagcgcaaaacgccattcgcatgggcaggagtattaggatctatactgttgatgatggccaatccacaagcaggaatggcgacactcagcggcacactgggtggttttcagcaaggtattatcagttttacccagtcaaatgaacaagaagctgatcgcattggtatgcagattctcaacaattcaggttttaaccctcatggtatgcctaatttcatgcagattctggttgatcagacgcgatatagctctaaaccgccagaaatgttattaacccatccactacccgatagccgtttatccgatgctcgtaacagggcaaatcagtatccgaaaaaaaccgttccagaatcagaatctcaaaattttctgtttgcccgtgttcgcatcctgataatcagcgctacagatcagctcaattacattgaacaaattctgaataattacagtcaaggaaccgctaaagaacagctcgccgctgcttatgggcgggttctccttctgtctcaggctcaaaagtatgctgaagccaaaacagtattgtccccattactggataagcagcctgataacatctggtttatcgatgctatgacggatatcgatattgagcaaaaacagtatgagcaagcgattacccgtttacagcaagctctccagaaacatcaaaataacccggtactacaaatcaatcttgccaatgcctatattcaggccaaacactatccgcaagcatcacaactgctatttcgttataccttcaacgatcctaatgatcccactggctggtcactaatgacagaattagccaaaaaacagaaaaaacgtgataaagagctggcttcctacgctgagactatggcattgcaaggcaaatttgacatggctataaactatctcagccaagccagtgccttggtaacattaaatagtgacgatcaggctcgttatgatgcccgtattgatcaattgcgccaactgcaacaacgtcatatccaatatgacaaatga

SEQ ID NO: 5015 - DNA, 210 bp, Xenorhabdus bovienii
  Coding sequence Name=Xb4151_4152.C444.gene190.dna; Position on contig= 229735..229944bp; Strand=-
atggtgaaaaagacgccccagaaatccgccaaaaataatgacaggaattgtgacaatcaccgtgccgatataagggataagtacagacaaaccaacaaatatcgcataagtacaaatagtcagaataaccatctccgtggctttttcacgaatataattgatgctctgttgattctcatttcatgctatagattacccgctaaaccataa

SEQ ID NO: 5016 - DNA, 474 bp, Xenorhabdus bovienii
  Coding sequence Name=Xb4151_4152.C444.gene191.dna; Position on contig= 230098..230571bp; Strand=-
atgagccgattgaaagccggtgataaggccccaaaattcagtcttcctgaccaagatggcaaaaccgttggcgtatctgatttcaaaggtcagcgtgttttagtttatttttatcccaaagcaatgacgccaggctgcactgttcaggcttgtggcttacgtgacaagatgaatgaactaaaagaaatcggtgttgaagtgttgggcatcagtacagatacacccgaaaagttatcccgctttgtaaaaaaagagatgctgaatttcacacttcttgccgatattgaccatcaggttgccgagcaatttggtgtttggggagtaaaacagtttatggggaaaacctatgagggcatccatcgtattagtttcttagttgacccaaaaggtgatattgaacacgtttttgataaattcaaaaccagtaaccatcaccaaatcgtactggactacctgaaacaacattcatcataa

SEQ ID NO: 5017 - DNA, 609 bp, Xenorhabdus bovienii
  Coding sequence Name=Xb4151_4152.C444.gene192.dna; Position on contig= 230586..231194bp; Strand=-
atgtttaatgacgacacacagcaaacatctaccgtagaaaggaaaatcgctttgccaaaatcagaacagcattttttagtgatcaccgcccttggtgcagatcgccccggcatcgtcaataccattacccgccttgccagcgcatgtggttgtaatattgaagacagccgtctggcaatgtttggcgaagagtttacctttatcatgctgctatccggtagctggaacgccattaccctgatcgaatccactctgccacagaaaggggctgaactcgaattgcttattgtgatgaaacgaacccggtgcggtgtccagacaaaatttccttcgacaatttccgtcagagtggatgtggatgattcaccgggtattgttgaacgttttaccaatctgttcacgacccagaatttcaatattgctgaactggcatcaaaaactcatcccgctgtggaaaatatgcccgcccgtctgcaaatccacattacaggccataacccactggatgataatggcctcatgttcaaagaatccttttatcgcctatgtacagaattaaatgcacaaggcagtattagcgtactggatcatttaaataaaaacgattaa

SEQ ID NO: 5018 - DNA, 900 bp, Xenorhabdus bovienii
  Coding sequence Name=Xb4151_4152.C444.gene193.dna; Position on contig= 231386..232285bp; Strand=+
atggtgagtggtaactctggttttacgggcagtatggttgcaatggtaacgccaatgaattcaaacggtcagattgataaaaccagtttgaaaaaattaattgattatcatgtcgccagtggtacatcttcaattatttctgttgggacaacgggtgaatgcgcaacactcaaccaagatgagcatgtggatgttgtactgacaacactggaattggctgatggccgcattccggtgattgccggaacaggggcaaatgcgacggcagaagccatttcgctgactcgtcgttttgaaaatacgggtattgctggttgcctgtctgtgacaccttattataatagaccatcacaggaaggtttatatcagcattataaagcgatagctgacaatactgacttaccgcaaattctgtataatgtaccctctcggaccgcatgtgatttactgccatcgactgttgcccgtctggcaaaactggaaaatattgttgcgattaaggaagcgactgggaacttaggtcgtgtcagtcagatccaagaattggttaatgatgaaaatttcattttgctgagtggtgatgatgcaagttttctcgattttgtgcagcttggtggaaaaggggttatttctgtgacagcgaatgtagcggctgcggagatggcacaaatatacgaactggctcagaagggtgaatttgtgaaggcgcgtagcctgaacaaccgactgatggaattgcatcatcaattatttgttgaacctagcccgacgccagccaagtgggcctgtcgtaaactggggttgattgccgatgacacgctgcgcctgccaatgattccgttgacgcaggcgggacaagtttcggtcaataatgccttgaaattggctggattactgtaa

SEQ ID NO: 5019 - DNA, 1047 bp, Xenorhabdus bovienii
  Coding sequence Name=Xb4151_4152.C444.gene194.dna; Position on contig= 232302..233348bp; Strand=+
atggcaacattattgcaaaaatcgaaggtcatgaaggttgctggcctgtcattagttgttttgctggcagcctgttctaaagatcagcactataaacgtcaggtgaatggggatgagtcctatcttgagacgccaccgctgaaagcattgaacgttccagcaggaatgatattgccgccgcaaaatagtgaatataatatttcatcagcgaccgaaaaaggggtggtgggtaaatcccttgatattcgtccgccagtacaggctatgcagttattgacgggttcccacatgggaaataatgtacgagccggtaagttgttgattgaaaataccccagaacacagcaacctgtggtcacaagtggttagtctattggcgaagaagaattaccaaattagcgaaaaagatgataccaggcaaactctggtcactgattggatctcatggccgcgggcagatgaaaatattccttatcgtggacgttaccgtattgaagtgtctccacagggttcccaaatcgcgctgtctgttacaaatgaaagtttggaacatgatggaaaagttgtctctgatccggcaataatccaagattatgatttaatcatgcttaacgagctgtctgatggtttaaatcagcagcaggagttagcaagtttgaacagcacgaagaatacaggggcgttaatagtaaacagtggcagcgataatacagctttgccccaaatcattgtccgtgcgccttacactgtggtctggaaccgattaccgcatacactggaaagtataggcatgcgtgtcactgatcgtacgcgtgcgacgggaatgatagaggtgacttataaagagctgagttcttcaggctggaaagaactgggcgtcgaggctccttccatcagcgaaggaaattacaagttacaggtgggcgacttggataaccgaagcagcctgcaatttatcaaagagaaaggccagccgttaactcaggctgaaaatgatcaaatgatggctgtatttaaggccgcattcagcagagctacagacaagtaa

SEQ ID NO: 5020 - DNA, 714 bp, Xenorhabdus bovienii
  Coding sequence Name=Xb4151_4152.C444.gene195.dna; Position on contig= 233440..234153bp; Strand=+
atgcagaaaaaagctgagttgtatcgtgggaaagcaaaaacagtgtattccactgacaatcctgacctgcttgtgctggaattccgtaatgatacatcagccttggatggtgaacgcatcgaacagtttgatcgcaagggtatggtgaataataaattcaatcatttcattatgaacaaactggaagaggcgggtattccgacgcaaatggaacggctgctgtcagacaacgaatgcctggtgaaaaagctggatatggtgccggttgagtgtgttatccgcaaccgtgctgcgggttctcttgtgaagcgccttggtgtggaagaaggaatggtattgaatccccccctgtttgatctgtttttgaaaaatgatgccaagcatgacccgatggtcaatgagtcctactgtgaaacattcggttgggttagcaaggtgcatctggccgagatgaaacaactgagttacaaggctaacgaagtattgagcaaactgttcaatgatgctggcttgattctggtggatttcaaattagagtttggtttgttcaacggcaacgttgtattgggggatgagttttctccggacggtagtcgcctgtgggatcagcagactttggataaaatggataaagaccgtttccgccagagtcttggtggcttgattgaagcgtatgaagaagtagcacgccgaatcggggtgattttggactaa

SEQ ID NO: 5021 - DNA, 348 bp, Xenorhabdus bovienii
  Coding sequence Name=Xb4151_4152.C444.gene196.dna; Position on contig= 234341..234688bp; Strand=-
atgttcagtgtgacattaactggttgcaccactcaatgggtgccggtaggaagtcattacacgccttttaatgaagcgaattcagagtgcaatatagaagcattccagcagttccctgtgagaaacgaagttgcccaacggtcttcaatcaaaactgtaaaacattactgtcctgcctgttgtaaatctgacaaagctgataaatctgacaaagactgttatttcgatcagagtgtccctacgaccgaaagttatgttatggatgttaacgaacgctccagacatcaattatatagcagctgtatggaacgaaacggttgggaaaaacagacaaaatatctgttttaa

SEQ ID NO: 5022 - DNA, 381 bp, Xenorhabdus bovienii
  Coding sequence Name=Xb4151_4152.C444.gene197.dna; Position on contig= 235324..235704bp; Strand=-
ttgccattagcgattgccgttgcgcccgctaatattcatgatatcagacttgttatagccaccctggacggtttacagacaggacgccggggttatggaaccaaactccatctggataaagcttatgaggcggaatggctggaaaaagaattaaaaacccgtggatacgtcccctgcatacaatcaagaaaagaagaacaagatgcgctggccgaacaatatgattttaaagtgaaccgttgggttgttgaaaggacacacagttggcttaatcgttttcgtcgtattctggttcgttgggaaaaacgggttgaaaattatgaagccatgcttcatttggcttgtagtttaattgtctggaatataatcctattgggatag

SEQ ID NO: 5023 - DNA, 408 bp, Xenorhabdus bovienii; identical to SEQ ID NO: 702
  Coding sequence Name=Xb4151_4152.C444.gene198.dna; Position on contig= 235734..236141bp; Strand=-

SEQ ID NO: 5024 - DNA, 633 bp, Xenorhabdus bovienii
  Coding sequence Name=Xb4151_4152.C444.gene199.dna; Position on contig= 236271..236903bp; Strand=+
gtgaggagaaagaattgggatggtaagtatgctttcttaatacgtaacccaggactcactaatcaaacggtcaaagaaggtgattattgggcgcaagcaggtgtcgaagtgggtacccgctttaactatctgtctgacatagaacatcatgcatcatcaggcaatgtcatttcttgggttgccttaccgaatgatttagatggtaatgactgggaggtgcttacccgtgtatcagagccttccgatatagctagttattgggcgcttatgtccgtaacgccatctgaaattattcccggaaaaaaatggggggataataacgcgagaacagggactctctcttatccagattatagccttgacggtattttctggactcttgacgataagaccaatgatggtgtgttaagcctgcgttttctttaccgcaataaagaagatgcactgcagaaagctaccagtaaaaagctgacaataacagttagtggtgttgtttatcaccttggatattactctgcattgaccgaattttatgaacctcaatataggggaacggaagcgaagaaaattggtgaattgctgatgcaaaaaaatcatcctcttaaaattgaggctaagtggtataactactga

SEQ ID NO: 5025 - DNA, 366 bp, Xenorhabdus bovienii
  Coding sequence Name=Xb4151_4152.C444.gene200.dna; Position on contig= 236959..237324bp; Strand=-
atgaagtactacaaatcaacagataataaagtgtacgcgtatgaatcagacggttcgcaggattcgtggataaaaccgggtcttgtgcccattaccgaggctgaggctgacgcaattacgaattccccgcccacaccggagcagctacaacaaaatgcagagtatgagaaacgataccgaatgtcgaaagctgcaaactctatagcaccgttacagtacgccgtagacctaaaaatggaaacggatagcgaacgggcggcattgacagagtggaaaaaatatatggtgctgctcaatcgggtggactgctctaccgcccccgatgtcaaatggccggagcagccgaagtcattattgagagaataa

SEQ ID NO: 5026 - DNA, 1158 bp, Xenorhabdus bovienii
  Coding sequence Name=Xb4151_4152.C444.gene201.dna; Position on contig= 237327..238484bp; Strand=-
atgttcggactcgataacccgtcaggtatcaacgtgatgcctgccatcacccccaccaacaattctgtccccctttggtttactgaagggggcgcgggattgagtgccagctatcccggtcaggaatggtttaaccagattcaggctgaattgttgggcgtactgaaagaggcaggtatcacgccagataaaagcaaactgaatcaactggctgttgccatcaaaagtatcgttgctaatggcattacactgaccgacagaacgggtaacagcagcaaaatggccgccagtcagaaactggtgactgaagttaatgagaatgctaatagccgtatggagaaaaaccagaacggcgcagacattccgaacaagccggagtttgtgaaaaatattggtgcgctccccacaaccggcggagtattaacggggaaattgtttgtctcgggtgtctcggcggatattgaagctaaagggtgggttggggctaccaagctatacgatcgttttgatcatggcggctggtcgcgggcgtacagtgaagcatttcccccttcagcggcagtggttggcgcctattcgatgaaagaagcgaatgaccgttatgcactgaaaaaatcgcatgaaacgttttcgtgcggcggtgtggatgttgaggcgacacatgactgggcggggcttaaattaaaaaacgcaaacggttattacgttcagttctctgctaccccgcatgaaaatcccgtaatgctgacagtgtattaccgagatggcgcaaataaaacacaatattacgccagtctgcgcaaaaaatccggtgagatagcattgctatctgatgtggcagataacgcgagtatcggtattaaccagagttggcgggatgttcggtctcaacgcacggggggcaggcaatatacgaatacggcaggcaggccgatagcggtattcgttaacacgaaaaaacgagaaaaatacaatgtcgcgctggggattggtgctagcgtaaatggcgttgaggttgcgtataattggtcaggttatgacggcccgctatcaattttgagtgtattttttatcgttccggttggcgcgaattacgaagttgatgcgtacctcgcgagcgaaggcaattttatcgaatcatggtctgaattgaggtaa

SEQ ID NO: 5027 - DNA, 582 bp, Xenorhabdus bovienii
  Coding sequence Name=Xb4151_4152.C444.gene202.dna; Position on contig= 238494..239075bp; Strand=-
atggcgatgacagccaaagattaccaacgctcagggctgcaattgctgccgaatggcctggcctggtcaaaaaatcttgacagcaatctggccaaattgatgctggccactggggaagaattcgcccgggttgatgctatcaatgccgtgttgctagaagaaatctttgccgaccgggcatttgtgttactggacgattgggaagattttgtcggattgcctgattgcagcattgataaagagtcatcaatcaacagccgtcgtcaggctgtcaagacaaaattaatcatgtccggcagcctgtgcaatcagttctatgaacgtttggctgccgaccgtggctaccgcatcagactggaagagcactacccgcatcactgcctgcgtgactgccattatcccatttaccccgatatcaactggtttcgcgtgttcgtccacgtcgcggacaggataacccattttgccaccgtactggatcactgccagcaacgcttacgcattgccgatgccgccgatttggaatgcctgctggcgcgttacgcgcccgctgaaaccgaatttgtttttatttatgagtga

SEQ ID NO: 5028 - DNA, 1074 bp, Xenorhabdus bovienii
  Coding sequence Name=Xb4151_4152.C444.gene203.dna; Position on contig= 239066..240139bp; Strand=-
atgccgtataaagcccccgcactttcaacattaatcgcccgcaatcaggctgacattgaaagccggttgccgggaacctatgcccgaacggcatttcggacaacccgtgctatcgcgtatgccaatgcaggcaatgctgccggactgcatgaccatctggcgtggaccagtcggcaggttgtcccgcatcttgcggatgatgacaagctgctggaacattgcgaattctggggtgtctggcgtaaagccgccacgaacgccagcggcatattaaccgtgaccgtgtctgcggatacattaatccctgaaggcacccgctggcagcgccctgatggggtggtgttagagtctattgatgatgtccaggccatcgcgggtgataatccggtttcagtgaccgcgattgaggcaggccgtaaaggcaacaccgctgaaggcgtgccactggagttaatttctccggtggtgaatgttcagacacaggcccgttgtcgatacctcggcggcggggctgaacaggaatcgatggattcgctgcgttcccgtttgttgtttcgggtgcagtatccaccttccggcggcaaccagtatgactacgagcgctgggcgctggaagtccccggcgtcacccgcgcctggtgcattccccgttatcgtggacatggcacggtgggcgtgatgttcgtgatggatgaagagcctgacatcttccccggcacggctgacctgaacagaataaaagactacctgaccggtcatatcaaccccgtcaccaatcaggtggaaggcaagaccaccggggcggagttgatcgtgatgagtccggccgcgaaagtcaccaacttcgctattcgcctgtcacccaatacggaagaggtgcgtgatgccgtcaaaacgcacctgaaaatctatctggaaaacctgcgtcccggtggcctggcattcctgtctgaaatccgtgccgccatctcgaacgcccccggtgaaattgataacacagtcttcagcccgactggcgatattcacgccgcagaaaatgagatttttgtgctgggagatatcacatggcgatga

SEQ ID NO: 5029 - DNA, 450 bp, Xenorhabdus bovienii
  Coding sequence Name=Xb4151_4152.C444.gene204.dna; Position on contig= 240140..240589bp; Strand=-
atgaatgcaatgaatgatatcgccttacagtggcaaatcaacggtgccgatattgttatcaataatgccgatatcgcactggatgattcactcagcaccgccgtcatcatttcattattcactgaccgccgggcgctcgactccgacgaactcccgacaggctcggggacagacaggcgcggttggtggggcgatagctttaactcacggcctatcggcagccggctctggctgctggcccgtgaaaagcaactgtctgccgttctgcaccgcgccaaagcctacgccgatgaagcgctggcctggctggttgatgagcgtcacgtaagaaaaatcgatgtaatggcgacggcgcctgcatccggcgttttactgttgaccgtctctgtcacgttatttgatggcagtgtgttgccactgccttttaaaacattgttaagcaggatttaa

SEQ ID NO: 5030 - DNA, 546 bp, Xenorhabdus bovienii
  Coding sequence Name=Xb4151_4152.C444.gene205.dna; Position on contig= 240586..241131bp; Strand=-
atgattgcccagttcaataaatttaccgcgagcctgtcccgccgtatccggctactggtatcgcggggtgtggttaacttcgtgaatgacaccctgaagcaacagaatattcaggtgtcattgctggctgaagaaactgccgatgatgtcgaacgcttccagaactatggacagaccagcgttccgcctgcgggcagtgaagcgatcgtgttatccgtgggcggcgttcgccagcacctggtcgccattgccgtggataaccgccgtttccgtctggggaacctgaagagtggtgacagtgccgtctatcatctggaagggcatcacctcttactcactgaaaatggggttgttcgtattcagtgtaaacggctggaagtcgtggcggaagaaggggttgtgtttgacacgccacaaacccgcttcacgggcaatgtggatatagtcggcatcagccaggctcaggatcatatgtccggccagacgagtggtaaagaccatattcaccatgagcatgacggatacagtacgagtcccccccgatga

SEQ ID NO: 5031 - DNA, 1089 bp, Xenorhabdus bovienii
  Coding sequence Name=Xb4151_4152.C444.gene206.dna; Position on contig= 241128..242216bp; Strand=-
atggctaataccattgagttgattctgggcaataacatttattccggctggaaaacactgaatgtcacccgcagtctggaagagatgtccggccagtttagtctgggcattaccgtcagaaataacgattccccgctggtactgaaacccggtcacgcctgccagctggccattaatggccagcgggtggttaccggatatatcgatgcggttgaagtggggatcaatgccgacgagcgcacgattacgttatccggccgtgacaagacaggcgatttggtggattgcgctgccattcatggtcgggggcaatggcgcaatgtcagtctggagacgatagcgaaagacctgtgtaaacccttcggggtcaccgttcgctggcaggttaaggatgccgccgccgcaacggtgtttcgccagtggcaaatcgaacccggtgaaaccgtctttgacaacctgtcccgtgctgcccggcaccggggcgcaatagtgaccagcaatgccgcaggcgagctggtttttgccaccgcgggcagccagtccgtggcaacactggtgttgggcaatgccccgccgacaggcgtcaaaatcaaaacgctggataccgccttatcctggcaggagcggtttagcctctatcgtgtcaagggggcatcggcggcgggcggccgctggggggaaacccaaaccccggtacagtcaacggctatttatatggatgcgcgagatccggctattacgcgttatcgcccgactctctttctggccgatgacaatatgacgaaagccaaaggcaccgcccgcgccgcatgggaacaaaagcgcgccatggcgcattccacaaccgcatcggtgggcatcaggggatggttcaaacccggtggccaactctggcaaatcaatgacatggtcagattacaggccccgcaagcgggattccccgatgaacccttgttgatcgtctccgtgaattacctgctggataacgacaacggcacgataacccggctggaactgatgccccgtgacggcttcaccgaagccgccgaacccgaacaaaaagtcagagacataaggtggaaaccatga

SEQ ID NO: 5032 - DNA, 279 bp, Xenorhabdus bovienii
  Coding sequence Name=Xb4151_4152.C444.gene207.dna; Position on contig= 242264..242542bp; Strand=+
atgccattgcggcggataaatcggctaatctgcgcgacactgcctgtttcacggtataacgccaccaacgcaggttcagtcccgaccacccgaataggccgtgccgtcggcaaggggaggaaatcttcgtcaataaagacggcgcgattaaagtgcattttcactggaaccgctatgacgacccggatgacggcgcttcctgctgggtacgtgtcgcgcagggctggaacggcaacggctatggctttatggccatcccccgcatcgggcaggaagtga

SEQ ID NO: 5033 - DNA, 729 bp, Xenorhabdus bovienii
  Coding sequence Name=Xb4151_4152.C444.gene208.dna; Position on contig= 242512..243240bp; Strand=+
atggccatcccccgcatcgggcaggaagtgattatttcctacctgaacggagatattgaccgcccgattgtcaccggctgcgtttataacggcctgaaccgcccgccgctggatttaccggcgcaaaagacccacacgacctttaaaaccaaaacccacaagggcaagggttttaacgaactgcgcttcgaggatgcgaaaggcagcgaagaaatctattttcacggccagaaagattttaccgcccatatcgaaaatgatgcttactggcatatcaagcacaaccagaagagccgcatcgacagtaaccgctaccacgatatccgcgccgatgaccatcatcaggtggccggttcgcgcaaaatcaccaccgaaggggatgtgtcacaccggattgccggcagccagcatatccagaccggggatgccacagtgtttgacagcgggcaagaaatccacctgaaaagtggcggcaaagtggtactggaagcggcatctgaaatcacgctgaaagtaggtggcacgtttctcaaagtcacgccgggcggcattctgtgctcaccgattaatgtcgggcaaggttcgggtggcagcgggcgcgggctggcattgcaattgccggaaggtgtagcaccattgccgatggtggaattcccggctcatccatactgcccgttactggcacagcaggatgtcagtccggtgattaaacccgccaaaaaggaataa

SEQ ID NO: 5034 - DNA, 792 bp, Xenorhabdus bovienii
  Coding sequence Name=Xb4151_4152.C444.gene209.dna; Position on contig= 243246..244037bp; Strand=+
atgacggaagaaatgatgacagaaacagcaacaagctggcaggcatggctgaataaatccaatgatgcatcggtattctttatcctcaattcgctggcgcaacccaatccggtcgatcagttttaccataacgactgggttgagcaggcatttccgctctacagcggtacgccgatgcacaagatgctgaaacaaagcccgtggctggtacaggcgaaaagcagccggctataccagataggggagatgctggagcgccacgcactcagtgataacagttggggctgggcataccgcagtcatataccttggcaggagcagcttacccactggcaacaccggcaactggtcatgatgaatggcgaacaggtgctgttccgcattatggatgcccgtgtttttagcgcgatgatacctgccttcactccgggcgactggtcactgatgctgtcgcctgtcacagaactgatgatcgacacaccacagccggtgccgttttgccgtcccaaagattgcggagaaggtaaccctgaaattccgtttacgttaggcgaacacctgctgggcgtttggttatgctccccttacggcctgaaagtgttaaccagttcactatattgtgatttatgggaaaagcacggggcaatggcgaagcaatgggatcagcccgcaggcagtttagaaccccggattgaacagtggttgaagcaaaagctggaagccggacaacgtcttgaaaaagtatccggtcaggattacctgctggcgctggaacaggagaaagctcgatga

SEQ ID NO: 5035 - DNA, 231 bp, Xenorhabdus bovienii
  Coding sequence Name=Xb4151_4152.C444.gene210.dna; Position on contig= 244034..244264bp; Strand=+
atgagtaatgaaaactcgatttatacccatgactgtcagaaaatacttaaaaatgatttatacattaaaattatcgaagatagcacgaatacaccgataccgaatacgccttatacactgaatagcaaaatggtgcattcaggaatcagtgatggtcagggtatagatcttgcagaagggctaaccagtacgcccttcacggtcaaaatagaaccgcctcagtcagtgtag

SEQ ID NO: 5036 - DNA, 1200 bp, Xenorhabdus bovienii
  Coding sequence Name=Xb4151_4152.C444.gene211.dna; Position on contig= 244356..245555bp; Strand=+
atgatcgaaatcttaaaaaaacataaatatgatgatttggctttacaccaaagtacccaacctgtcgctgcgtgtgattgtcatttcgaagaaaaagacggaaaacagattaaagttattgatgtccctatactcacctgtgagtgtgtctggcgcaggtatcagaaagaggccgaagacattgttgcacccggtggtaaactgattgccgaccccaaagaacgcaataaacgtattaacgcggcttacgcgaaactttggctgaacgacaatcgcttccaatgggcggggcttgctgcttttgcttctaagcaggtggggtgcgggttgttgcatgcctctgagatggccaaaaagaatcaagctcatcaagatgccaacagacgtgtgcgtcaaagcgcaaaagaattagaacacacaatggataacccactttactttcttcatccaaagttaaaagctcaaggcgaaatagcaattgaagattttcctcgtgccatagaagaagccagagaagccagtagaaacaataaattatcaatattttccaatgtgccgggtcttcagccaatttcgggtctggcacagtattcattcaattatgtctatgacatgatggcgctggggaacacaacattatttttggatgtgtatccattgcatgctttttataagcaacgtgggttggaagaactcaaaacttgtataaagaagcgtgaaaatatttatggtaatagccaattcccaatattgtggccgataggacaagaaaaatttacatttggccgtttctatccagatattctattcgcgtttgaagcgatagaagcaggtgatatcgctcaaggtgttgtgcatcttgccaaccacgagcaaatcaacatattacaacccactatgtacagtgatactcgtttagtaacattcttgtttggcaatcagatttcctttgtcacaggactcccttctggtgtcgcggaatctgttgaattaacgctggcgagtcagtgcagacgtgttgatgatggccgtactatcgaatttagtgatgaggcgctggccgatctttccgatataaaacaacgtatgcctttcgtgtacaaggcagcagaacggtttgatgagatgctgcatgatagcaaccgaagtttactcgaagaatctctacaaaatattgcagcagggcgaggtgtagaatga

SEQ ID NO: 5037 - DNA, 615 bp, Xenorhabdus bovienii
  Coding sequence Name=Xb4151_4152.C444.gene212.dna; Position on contig= 245552..246166bp; Strand=+
atgagtttattacaacaaataagtcggcagcgcggtggtttaatcttcatattattaatcgttttcggcctggctagcgcttatctttaccattctttttattccgataaaccagagatagcgctggtgatcggtgaaccttacgaggatatgcggcagcgctccagtgccgatattgatccgcatcttccgggtaaaatttggcataatattcccaaaacagatgcccgtttacgctttatcgatccaaaatatggatttgttacccctccagcccgattttttactgttctatatgcgaatgacattattacgagtgtacgcatgtctccacaaatcgagccattaccctacgatgatgcaatcaagatggtcttggatttacaagatcagtggcgtaaaacgggttgggtgatggctaaagggtataaacccttagtaaatacaccagaactgcatgaaaatcttcgtcgtatgaaaggtggtgcaggaacaacctattggcaagctgctgatcagtatcagattatgctgagtttagcatttttcaaggacgacaagcatcccaatgacgaacggtatttgatcacaatggtaatttataaaccgtggtaa

SEQ ID NO: 5038 - DNA, 186 bp, Xenorhabdus bovienii
  Coding sequence Name=Xb4151_4152.C444.gene213.dna; Position on contig= 246254..246439bp; Strand=+
atgagtcttttacaacgcataggtcggcgacgttctggattaatctttgcattattaatcgttcttggtctggctagcgtttatctttaccattccttttccgataaaccagagatagcgctggtgattggtgaaccctacgaggcaatgtggcagcgatccagtgcaaatattgctcccaaataa

SEQ ID NO: 5039 - DNA, 297 bp, Xenorhabdus bovienii
  Coding sequence Name=Xb4151_4152.C444.gene214.dna; Position on contig= 246579..246875bp; Strand=+
atgtcgccacaaattaagccgttactctacaacaatgcgatcaagattgtattagatttacaagatcagtggcgcaaagcgggctggaagcttactaaaggataccattccttggttaatacaccagaattgcatgacagtcttcgtaagatgaaaggaaccggaatgaccttctggcaagcaggtgacaagtatcagatcatgctgaatatagcgcgtttcaaagatgatcggcatcctgatgaagagcgatatttgatcacgttagcaatagccacaccgtgggtaaatcagtaa

SEQ ID NO: 5040 - DNA, 117 bp, Xenorhabdus bovienii
  Coding sequence Name=Xb4151_4152.C444.gene215.dna; Position on contig= 246978..247094bp; Strand=-
atgaaatatataataaatatgctatttaccccgttattccgtgaaaatatgtgtagtggtatagagataaccaatcgtaacgattatgtttcttcgattctccgagttaccgggtga

SEQ ID NO: 5041 - DNA, 951 bp, Xenorhabdus bovienii
  Coding sequence Name=Xb4151_4152.C444.gene216.dna; Position on contig= 247366..248316bp; Strand=-
atgcccattgacgaaatcggacaaagttcgaatccgaaagaaatcgctaacagtgcctatagcctgtttaacggtgtcggaaaaattcaggggaaacgggaaggtgggaaccgtgcggtgatccgctggaaaattgccgccctttcaacaggcgaggaagatttagaaacgttcctgataaaaggtgggatcaccccaaaagccgggcagcttgtcaggttgctcagtgtgccctttattgatacggaatgtttcaatggctatgaggatggtgattctcatgcaagagccatcaaacgtgaatccaaacgctattgtggtgcagcgggtcgggcatgggttcaatggttgtctgtaaatcaggagcaggtaatcgaagtaaccgcccgtaaagaaaaagagtggcttgatggcctgccagaagaagcctcagcccaagtcaagcgcgttgctgttcgtttcgcgttactggatgctgccggagagctggcaatccatattaccggctggagtaaagaagcgagtcatgcggcgataaagcaaagtttcgatgattggttagctgattttggcatcggaaatcgggaaaaatatcaggttatcacccgtactcgtgactttatccaaaaatacgggctttcacgcttccaaccttatacctacggcaggccaaatggtgatattgatacatcacactccatgagaattagcgatcttgccgggtatctggtgcataaccgtcgtaatgatgggcaaacggaataccacattattcccagtgtatttgaagcagagatattgcagggattacagaagaaatccggttttgaggccttagaagaagccggaatgctggttaaagcggaaaaagatcgctttatcagcaaaaccatttcagtaaacggcactcaggggcgatttgtggtgctgattttcagggatgaagattga

SEQ ID NO: 5042 - DNA, 1797 bp, Xenorhabdus bovienii
  Coding sequence Name=Xb4151_4152.C444.gene217.dna; Position on contig= 248345..250141bp; Strand=-
atggctgatacacagcataaccaaactcgtcctaaatttacatctttggataaatcaagcagccaaaaaccgttcgaatttatccaaaccgtgaagcaatccgctatgtaccattgggaaaatctgttgcctgcctgtggtatcgatattcctgcaaagggtaaacatagcgcttgccctgtctgcggcggcaccgaccgttttcactttattgatgaccaccatcacggcaactggcactgtcgccagtgtgatcttccgaactacggagatggattggatttagtagcaaaaaccaaccgtatctcagttcttgaggctgctaagattgttgctaacgtactggcattacctttgtcagaactcaaaccagccaaagaaaccacttatccagtacagccaattgccgaaagagtcgcggcactgatggctcaaactgttgctgggcagtctccctatctgaccgcaaaggggctgcattgccctaatcagcggctgctgtccgataattcggcagtgttgcgactcgcaacattggacgaaaaagtaacaggtgcacagattatcaaacctgatggtgagaaaaaattactgtctggcagccagaagaaaggttcgtttatcgcgctgtctgagctaaaagataacccggatacggtgaccattaccgagggttatgctacagcattgacagttaaccagttctataaaggtactattttggcagcgctagatgcaggcaatttgctttctgtcgcaaaagccgttcgggagcgctggccggacacgaaaattattctggcagcagataacgactggcatcatcccgacgaactggataaaaacggcaacccaaaggtaaatatcggcaagatttcagcagaaaaagttgcccttgcggttaatggttgggttacgttgccctccacggaatacaaagctgactgggatgattatcgtcagcagcatggcattgagtcagcaaaacagacattcagtaatgggttgtatcaggtggtagagaacgtagcggtgtcaaaatctgtgaccgctaattcagatgaataccgagagaaagaatacgacccgctaaaaccccatatcgatattcgcaagaacggaatttactgggttgaacctaaagagcaaggtggcaaaatcgtcgaagttgaaaaatggttgagtgattacatggagatagtcggcattggcaatgatggtagcgaaggctatctcattattaagctgcatcaggaaggaacgggaaaatgtatcattgaagcgcttccccgccgtgaaatcggaatgccggtaggctgggcaagattgcgttcacggggaatgaatatcaccgtaaaaaatagcctattgcctgttttagctgagcacctgcaacgcagcggtgatcgccgtgaatggattgtgacacagaaagcaggctggcactgcggggcttatgtgatgccggacggtgaaatcatcggtcagccttatatgcctgtcgcgttcagtggcggcacatccgcaattgccggttatgtggtcagaggaacagccgaagattggaaaatgcacgttgcgtcattactgaaaggcaaccggtcaatgatgctgggcgtactggtgggattgtctgcaccacttaactcactgacaggtggtagctgctttggtgtgcattcattcgcccaatcctccgcagggaaaaccaccaccgttgaggctgccagcagcttatacggtgatcccgaagaacttaaattatcgtggcacggtactaatcacggttttaaataa

SEQ ID NO: 5043 - DNA, 342 bp, Xenorhabdus bovienii
  Coding sequence Name=Xb4151_4152.C444.gene218.dna; Position on contig= 250179..250520bp; Strand=-
atgtacctaccatttgataagaatacaaaaactaagggtagcacttgcctaccctcaacttgcttttttcaggggttagattcaatacatcttgactgcaattctctacggacaatgcgcttaatccacgcagctaaagattcatcaccatcttgtgcctgggctatttccatgagtgcccgtagttcaggatcaagtctgaattggaatgggggattgccccgacgagtatttttgtgtgttgacatgtcaattacactcactgtaatgtgtttatgtgtcattacacattacctatatcaatatgaaaaaacaacgcccagcgtgctggaacacatctga

SEQ ID NO: 5044 - DNA, 210 bp, Xenorhabdus bovienii
  Coding sequence Name=Xb4151_4152.C444.gene219.dna; Position on contig= 250525..250734bp; Strand=-
atgccaacaattacaacatctaaaaaaagtcttattcgcctgccagaagttcagcgcagaacgggctatagcaaggcatggatctacaggctgattaaagaagataaattcccgaaacaagtcaaaattggccctcggtcggttgcgtttgttgaatcagaaattgatggctgggtagatcaacgaattgctgaatctcgtggtatttaa

SEQ ID NO: 5045 - DNA, 351 bp, Xenorhabdus bovienii
  Coding sequence Name=Xb4151_4152.C444.gene220.dna; Position on contig= 251158..251508bp; Strand=-
atgcctcccactactcaacttgtactctctggaactgtttatccttcgaaggtatcccttgcccttgcaaccattggtgatgtagcaattcacccaggggttggcagaacgccatttatcgatgcaactatatttgacggcaaggtatggcgagctttggatctgaatggatttggctttagcaaaaacagtaggaattttgaccgcccgcagaatattgggtctatcatgcgtgaaattcaaataaaaatcattagttgcaaaggttcatcagtttattacgactatcccatcggaagtaaaaaacggaaatatatctatcagggtatgacattcccttcgtttacataa

SEQ ID NO: 5046 - DNA, 2274 bp, Xenorhabdus bovienii
  Coding sequence Name=Xb4151_4152.C444.gene221.dna; Position on contig= 251687..253960bp; Strand=-
atgatcggcgaaatccaaatcaattcaccactagctacctaccagaaccctgcaaggctcagtgatctccgccgcatcaattatatttttggtgcgaacggtacaggtaagacgaccattagtcgtgtaattgctcaagcacatgaccatgaacattgccaacttcaatggcaaggcggcatagagcttgagcggatggtgtataatagggatttcgttgatcgaaactttaatcaggacgaccctctacagggtgtttttaccttaggtgaaaatcagattgaagctgagcgcaaaatcgctcgtttacagactaaaatagctaaggtaaatgagcaaatatcaagccttaatatccaattggatggttcggaagagcagcccggtaaaagaaaaggcctcgaagacctcgaacctacactgcgtgataagtgttggaagcaaaaggagctccatgatgctgattttaaggaagcatactctgcagcaagtgttcggcgtaacaaagaacgattcaaagagaaagtgttgtcggaagcaaattctaatacggcggaattgctttcattagaggaactaaaacaaaaagcagaaactgttttttcaagcaatattgagcgcgtcacaccacttgggaatttgttagccgatgatcttgtcatcgttgaaggacatgtattactgcaaaaagtgattgtcgggaatcaagatattgaaattgcagctctcatcaaccgtctgggtaacagcgattgggtaaaacaaggtcgtaagtatcatgagcagaatccagagatatgccctttctgccagcagccaacggatgatcatttctctaataaactcacggcattctttagcgaagcctatgacaacgacatacaattgctaaaggagttgcaagcgaactaccagaaggcaagcgatcggttgacagctgccatacagcgcaacgtagaaattaataatccgttcctaaacatagatctgtttaatgcagaaacccaagcgcttgttgaacgattgaaagtcaatcaatccaaattggtaaacaagcttgatgaaccaagccgaaaaatggagctggaatcagttcaacccctgatcacacagttgcaggccttggtgatagaagccaatgaagcgacaacccgtcataaccaaactatggctaatattgcaacggagaagcagacactaacttctcaagtctggcgttatgtattaaatgaattagcggacgacttgcagctatatcatcaaactaaggatcgtctgacaagaaccattcaaggcatggaaaaaagccggagggaagagaaaatacagcttcgaggtctacaaaatcaagtaaaagagctggaaaaacaaactacatctattcaaccaactatttcagcaatcaacgatctactacagaaattcggtttccattccttttctatcgctgaggccgatgaagactatcactatcgaataattcgtgcaaacggtgaggatgtaggccgttcactaagtgaaggcgaaaaaacatttatcacttttttgtacttttactacctcatcaaaggggctcaatccccctcaggcattacaacaaatcgggtagttgtgtttgatgatcccatatcttcgttagacagcgatattctctatatcgtcagcagtcttatgaaaagtgtgatggatgaggcaagaaaccagagctcttcgatcaaacagatatttatactgactcataatgtctattttcacaaagaaatcagcttcaataggagcaggccagccggtggcgtactcaatgaggaaagtttctggctggtcaaaaagctacagcatggttcagttgttgagcgttatgaaactaatccaatccgttcagcctatgaacttctatgggaaaatgtgaaatcaaaaaacatttccagtatcagcctgcaaaatacattacgccgcatattggaaaactacttcactatgtggggtggaatgagtaaagatgaaatctgtacactcttcgaaggacgtgacaagttgatttgccaatctctattttcctgggtcaacgatggctctcactcaattcatgacgacctgtacatcaaccatggtgagcaaaccaatgaagcatatcttcgtgtctttcgaagcatctttggtaaagcaggtcaaattggccactacagcatgatgacaggagctaccatcgaagagctgcatgatcactctggtgctgaagatgtggctgtagggtctgaattgggagcaacatga

SEQ ID NO: 5047 - DNA, 282 bp, Xenorhabdus bovienii
  Coding sequence Name=Xb4151_4152.C444.gene222.dna; Position on contig= 254282..254563bp; Strand=-
atgacccgtggcatgggatacgacaccaaaaccgatgtttgcggacatgggttccgaacaatggctcgtggagcaatgggcgaatcgggattatggaacgatgacgccatcgaacgtcagttaagccatgtagaaagaaaaaacgtcagagcagcttatattcacacatctaagcatctggatgaacggcgactgatggttcagtggtgggctgattatctggatacaaaccgggaaaaacatatcactccgtatgattttgctaagaaacggcggaagtaa

SEQ ID NO: 5048 - DNA, 297 bp, Xenorhabdus bovienii
  Coding sequence Name=Xb4151_4152.C444.gene223.dna; Position on contig= 254503..254799bp; Strand=+
ttgttcggaacccatgtccgcaaacatcggttttggtgtcgtatcccatgccacgggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 5049 - DNA, 279 bp, Xenorhabdus bovienii; identical to SEQ ID NO: 890
  Coding sequence Name=Xb4151_4152.C444.gene224.dna; Position on contig= 254750..255028bp; Strand=-

SEQ ID NO: 5050 - DNA, 903 bp, Xenorhabdus bovienii
  Coding sequence Name=Xb4151_4152.C444.gene225.dna; Position on contig= 255737..256639bp; Strand=+
atggattattacatgttattttctctcaataaacacaaaatagaaaaccgtttacaattctgtcaaaaaagatcacaatactttctattatttaatgtactttatcgggtgcaatcaatataccatactttaaaaagtattgtttcaaaccaaataaacttgtcattgataccattattgatttttacaaatcatgctcaggcaagcgatttcgtcaattttcaatccattgacaccagcctttacctacaattcgaaaataaagttgcccctcagaaaacgatctctcccattatagaggcgtatggtgattacaaaattggcgatatgtatgtttacagtatttggcaaaattcgctgcaacatgactatcaagacgataaaagcacctattactataaattcgtccccagactcagtgccagcaagataacggggtatgatctttcctatggcccgttaaaagatgtgctgtttgcccagtggattgccaaaaccaaaaacgtaaaatacgattatttccccggtatcagccttgactggcaagtccccgggtttagctggctgcgtaccctgttttattttgaaaataatgcaaaaggaaattggaacgatcaacgaattcatattgactatgccattcctttcaataatcaattgggggattttcggatcgtagggacgttagattatacgcttgggttacacgataatcctgaaatgctggagttcaagccagaattgcattatgacttggggaaaaaactgggctatcaatcagggcatttatggacaggccttgttctgaatacaaccaagaataagtacaaaataaaagatacaccgtactatcgcacgaaccaattcagctatggcgtgtttattcgatacagctttttctaa

SEQ ID NO: 5051 - DNA, 1278 bp, Xenorhabdus bovienii
  Coding sequence Name=Xb4151_4152.C444.gene226.dna; Position on contig= 256695..257972bp; Strand=+
atgtccattcaacacgacaaattcgggcgtacttatcagtggtttttgctggtacttttaggtatggtatattttttatccacagcaacaacctttacgtcattgggcgttgttctgcccagcatgatcaacgagctgggctggaactggacgaatgcaggtttgggattctctctgcttggcctgacctgtggactttccagttttctgccaacattgttcatccgtaagattggtgtccgcttcaccctcttcattggtctgctgatttttcttgccggtttctatcatctgtataacacccatgtcattttatcttattttatcgggacagccttattgggtatcggatttacctttttagcgacagttcccggcacttatgtcatttcacggttatatgaaaaacagtcccttgcctttggtttctatttcaccatcggtgggctggggggcgtcattggcccgtggatctattttctggccacccgtgtctggggaacatggcgtatgcactggatgatttccgccattgttctgaccgtatttgtacttctgactatatttatcctgcaagaaggcaaacgggaagttgcccatgccaaggccgttaatcaaaagcacaatagccagaaccccctgaaaatttatcgcactaaacagcgctggactgcacggagagcgctgcgtacatggcaattctatgccattgccgccacttacactgcgtttttatggtgtggtattacagttaacagttttgccgttgcgcacattatcgagaatggcttcagtgaagctatcgccgcagggctgctgagttcaatggcctttatcaatgctttttcaagactggccggaggcgcggtaggcgagtggcttgatccgaaaaaattgctgattggcagcctgaccgtcatcattattggtttgatctcgctgagtatcgcgtcttcatggcctttcttgattggatttacgctatttgtcggtatgggctatgggatgactttcctcgcctccagtgtcctgcttgccaattattttggacgtaagccttatctggagttgttttcggtcatgaacctgatttctactctggcttgtctggcacctttttttgccggggcggttaaagattattcaggcagttttacttcggctttcctcattattgccatccccgtatgtgttgttcttgtcgtaacattgatgatgaaaccgcctgctcaaaaaatgaaaaagcgtttagtcgacaattccccattcaccgaatag

SEQ ID NO: 5052 - DNA, 1056 bp, Xenorhabdus bovienii
  Coding sequence Name=Xb4151_4152.C444.gene227.dna; Position on contig= 258016..259071bp; Strand=+
atgtcaaagaaagagttcggtgtattcctgcccatcgctaaaggcgggtggatcatctccaaaaacacgccgccactggatgcgtcttatcaacaaaaccgggaggctgccattctggccgatcagattggccttgatttcattatgtccatgggtaaatggcgcgggtttggcggggaaacagaccattggggtagctcactcgaatctgtcacgatgatggccggcatcgctgaggtcactcaccgcgctaagttgatcgccacggttcatgcggggctgcacaatcccgcagtgacggccaaaatgatcgccacgttggatcatatcagtcagggacgtgcagggctgaatattgtttccggctctttcaaagatgagtttgaacaaatgggcgaatgggatggcagtctggatcatgaccagcgctacgccatgaccgaagagtggacacaattggtcaaaaggctctggcgtgaaaaacatgttgatcatgaaggaacctattttcacctgaaacagtgtgtttctgaacctaaacctctttcactgccccgtccttatctggtttgtgccggccaatccgaacgtggcctccatttcagtgtacgtcatactgatgtctgttttatcgggggcaaggatgaggcagaaacccgcaaaattagtttaactgccaaacgcatcgcatcagactgcaacacaaccaccaaaactttctgcatgtgtacagttatttgtgccgaaaccgatgcctatgctgaaactctcgctcagttttatcgccaaggtttggatgtggaagcggtcagaaatatgatgcacagttttggtgtcgatgtagatggtaaaaacaatgccatggttgaacgatcacaaaatgctttcatgacccataccgccattggtacgccagacacctgttacaagcaactgtcagatttactacactcctgtgaactggatggcctgatgttaattttccctgattatattaaaggattgaaggtattcggcgatcagatcctgcccaaattgagagctgagttcggctga

SEQ ID NO: 5053 - DNA, 2433 bp, Xenorhabdus bovienii
  Coding sequence Name=Xb4151_4152.C444.gene228.dna; Position on contig= 259168..261600bp; Strand=-
atgatctggcgctggttttggcgtgaatggcggacaccatcgctattaattgtctggctgtccctgacgttggccgtggcctgtgtgctggcattagggagcatcagcgatcggattgatcagagcgttcattaccagagccgtgattttctggcgggtgatctggtattgcaggcttcttatcccgttgatgaatcctggttgaaacaggcacaggaacgagggctgacattgagccgccagatctcattttcgaccatgacctatgcgggagacgttccgcaactggctcaggtgaaagcggctgatgaacattatccgctgtatggtgaactggaaacccacccacagggattgaaaccggaaaaaggttcagtgctggtcgctccccgcttactggtgctattgggtattaaagtaggggatagtcttgacgtgggtgatgcggtattgaagatccgtggtgagctgcttcaggaacctgatagtggcttcaatccattccagctttctccgcgtattttaatcaatattgaagatgccaaagcgacaggcgcgatccaaccgggaagccgcctgacttatcgctatatgttttccggctcaccagagtccatacaatcattccagcaatggattgacccacaattaaaagcggatcaacgttggctcacattgaaacaggacagcggcgcactggctcagtctattgatcgcgcccagcaatttttgctgctgtcggcactgttaacgttgttgcttgcggcggcggcggtagctgtttcgatgacgcactattgccgcagccgtcataacctgattgcgatcttgaaaacactgggggcagggcgttgggcgttgcgtcagtggatcgtcgggcagtggctggtgatattgctcgctgccattgttgtcggctccattttaggtttgatttttgaatccgctttgattcgggttctggctgcgatgctgccaaaaacgttaccggaagcgggtatgtggccgtggatgtgggcaataggttcgctgctggggattgctctgctggtgggaattcgcccttatcgtcagctaatggcgacgcagccgtcacgggtattgcgtagtgatatcactgcggcgatctggccgttacgttactacctgcccaccgtggcgctgattatgacggggggattagtactactggctggcactaagccgctcctatggtcattgctggcgggtgtgccggttgtcgctttgctgctggcaatattgggctggggtggtttatggctgctgcgtcgcatgaaatttcgccagctcagtttacgtttggcagttaatcggctgctgtgccgcccgttccagactatgacgcaattggctgcattttcgctgtcattcatgttactggcattactcgtgatggcgaggggagatttattaagccgatggcagcagcaattgccaccggatagcccgaattatttcctgatcaacatgactcaggcacaaattccaccagtgaatgacttactggcgaaatatcaagtgaagccgactgagttctatcctgtggttctggcgcgtttgacggaagtgaatgggcagtcggcgattgaatgggctgacgaaaggcatcccaagagcacgacagtgcgtcgcgaactcaatctgacatggaaggccgaattaccccccttcaatactctcgtggaaggaacgtggccaccgaaaccgaaggaagtgtccattgagcagggcgtagcagaacagctgcaaattaatgtgggtgataaactgacatttacgggtaacacacagacatttcaggtcagtgtgagtagcatccgtaaggttgattgggaaagcctgcatccgaacttcttctttattttttccaaagagacgctggataatcagcctcagacatggttgaccagttttcattatgaaggagatgggcggcttctcacggaaataaatcgtcatttcccgaccattagtatgctggacattgggactatgcttaaacaaatacaggggatcttgcagcaaatcagtcaggcgctggaaattatggttgttctggtgatgatttgtggtgcgctgcttctgctggcacagattcaggtaggcatgagccaacggcagcttgagctggtggtttatcgtactttgggggcgagcaaaaaactgttgcggcgcacattgtggagcgaatttgccttgctgggtttcatggcaggtctggctgcggcattgggtgcggaagtggcactctggctgttgcagacaaaagtgtttgagttcccgtggcaaccgcaatggcagatgtggttcctgcttcctatcatcagtagtctgctgctttcattgtgcggtagttggttagggattcgattattacgtggtaaagggctgcaccggcgtttgccggaataa

SEQ ID NO: 5054 - DNA, 687 bp, Xenorhabdus bovienii
  Coding sequence Name=Xb4151_4152.C444.gene229.dna; Position on contig= 261597..262283bp; Strand=-
atggctgtagaaagtattcttgaagttcatcatctcactaaacatgttggtcagggggaacaggtaattaatatattgcaaggtgttgagctggttgtcgagcctgcgcagacaattgccttgattggagaatcgggatcagggaaatcaacccttctgggtattattgcggggctggatgatggcagcggcggcgaagtccacttattggggcaaaacatcagtcgtatgaacgaagaacaaagggcgcagctacgggcaaaaaatgtaggttttgttttccagtcgtttatgttgatcccaactttaaacgcgctggaaaacgtccaattacccgcgctgcttcgcggtgaatcggaaaatcaaagtcgtcagaatgccattgaattacttaaacagttaggattagggcaacgcctgaaacacatgccagcccaactttcggggggagagcagcagcgggttgctctggcacgggcattcagtacccgccccaaaatcctgtttgccgatgagccgaccggtaatcttgatcgtcaaacgggtgatcgcatcgcggatctcttattttcccttaatcacgattacgccaccacgttgattttggtaacccatgacagccggcttgcagcccgttgccagcgtcgtttacgtctggtggatggaacattgcaggaggaagtatga

SEQ ID NO: 5055 - DNA, 648 bp, Xenorhabdus bovienii
  Coding sequence Name=Xb4151_4152.C444.gene230.dna; Position on contig= 262239..262886bp; Strand=+
atgtttagtgagatgatgaacttcaagaatactttctacagccatgtatgtttccttttattattggtgctatgcagcgccagagcagccgcagcggataccctgcttatattgggtgatagccttagcgccggttatcgcctgcctgttgagcaatcctggccgactctcatggcaaaagaatggcatcaatccggcaataaaacggctattgtgaacggcagtatcagcggtaataccacggcacagagtcttgaacgcctgcctgaattgttgaaacagcacaaccctaaatgggttttggttgaactcggcggtaacgatggtctgcgtggtttttccgttcaacaaatagaacaagatttgcaaaagatcattactttgattaaacaggcagatgctcagcctttattaatgcagattcgtatttcgccaaattatggaaaacgctacacccaatctttcactaagatttatccttcattatcggagcgtaatcagatcccactgttaccctttttcatggaacacgttgctatcaagccggaatggatacaagatgatggcctgcaccccaaccaattcgcacaaccttttattacccattggatgtctaaccaactgtcagcatacatcccctttaagtaa

SEQ ID NO: 5056 - DNA, 777 bp, Xenorhabdus bovienii
  Coding sequence Name=Xb4151_4152.C444.gene231.dna; Position on contig= 262949..263725bp; Strand=+
atgcaaaaagcggttcttattaccggatgctccagcggaatcgggctggtcgccgccaaaatccttcatcaacgtggctaccgagtatttgccgcttgtcgcaaatccgctgatttagcacatatgcgcgaattgggattggaacccatagaattggatttggatgataaagaaagcgtcgaacgtgccgccgagcaagtcattcaattaacccatggacgtttgttcgggttgtttaataatggaggatttggcgtttatggcccactagaaagcgtttcccgcgaactaatggaaaaacagttttcaactaatgtatttggtactcatcaattgacctccctattattgcccgccatacgcgcttatggtaaagggaggattgttcagaccagctccgtattgggattaatctctacaccaggccgtggggcatacgcagccagtaaattcgcccttgaagcatggtcagatgcgttgagaatagaactggcagacacgggaattaaagtcagtctgatagaacccggcccaatcacgacgcgttttacagaaaatgtgaatcaaacacagcgcgatcaccctgtcgaaaatccaggtcttgcagaccgtttcagactcacccccgaggatgtggtcacgaaattgattcacgctctggaagctcctaaccctaaaatacgttatccggtaacattattgtcccatgccatgacaattctccggcgtatattacccacgagattaattgataaaatcgtgaagtggcaaagctaa

SEQ ID NO: 5057 - DNA, 879 bp, Xenorhabdus bovienii
  Coding sequence Name=Xb4151_4152.C444.gene232.dna; Position on contig= 263802..264680bp; Strand=+
atggaatcgataacgaacacgaatagccataccgcacacatcattcatatcaatgaatctaatattgcctcaatgattcagcattcactcactcagcttgtcgtgttctatttctggtctccacagaacctgcattgccatgaattggaagaaacccttgataagctggcgcatgagtatgccgggcaatttgctctggccaaagtcgattgtgaccaattacctaatgtcgctgcgcaatttggtatacgtactgcaccaaccgtgattttcgtacaagaagcccgccctgttcacggttttgagggaattcagacagacgaaactatcagagaaatgttttctcaatttctgactcaacagaaaaaatcactgttagagcaagccaatgaacgacttgcagaagggaaaaatcaggaagccttgcctttactgaaagaagcacaccaggccgagccaaaagagactgagattacattactattagctcaggtatatatttcgctcaatcaccttgaagacgcccaaaacatcttggataccctcccattagaagaacaagatcaacgctataatgatttgctggcaatccttgagtcacagaagcaggcggcaaattctcctgagattcaacaactccagcaagcgttagaaattcagccagaaaatgctgaacttgctgttcaacttgccgccaaactgcacaatgttggtcgtaatgaagaagcactggaactgctattcagttttctgaaaaaagatctttctgccgctgatggtgcagtgaaaaaaacgctgatggatattatttccgctctcgaaaccggagatacactagcatctcaataccgtcgtcatgtatactctttactttattaa

SEQ ID NO: 5058 - DNA, 930 bp, Xenorhabdus bovienii
  Coding sequence Name=Xb4151_4152.C444.gene233.dna; Position on contig= 264728..265657bp; Strand=+
atggatttactctctttcggtactgtacccattcttatcattattgcagttgtcatcgtctttacttgtgtgaagaccgttccacagggctatcagtggacggtagaacgcttcgggcgctatacccgcacactgacgccggggctgcatatcatcatgccatttgttgatcgtatcggccgtagaatcaatgtgatggaacaggttctggatatcccgtcacaggaagtaatttcccgtgacaacgccaacgtcaccattgatgccgtctgctttattcaggttgtcgatcccgtgcgggcggcctatgaagtcagcaatcttgaactggccatcattaatctgaccatgactaacttccgtactgtgctgggagcaatggaactggacgaaatgctgtctcagcgcgatttaatcaacagccgcctgctgactatagttgatgaagccactaacccatggggtgtgaagatcacccgtattgagatccgcgatgtacgtccaccgaaagagttggtctctgcgatgaacgctcagatgaaagccgagcgtaccaaacgtgcagatatccttgaagcggaaggtattcgtcaggccgccattctgaaagcggaaggcgaaaaacagtcacagatcctgaaagcggaaggtgagcgtcaatctgcgttcctgcaagctgaagcccgtgaacgtgccgcagaagcagaagcgcgggcaacaaaaatggtatctgacgccatctctgacggtaatattcaggcaattaactacttcgtcgcccagaaatataccgatgcccttacccgtattggagcagccgataacagtaaagtcatcatgatgccgctggaagccagcaacttgatgggcgctatcggtggtattgcggaattgattggcgaaagcaagaagagcaaacaggataaatag

SEQ ID NO: 5059 - DNA, 462 bp, Xenorhabdus bovienii
  Coding sequence Name=Xb4151_4152.C444.gene234.dna; Position on contig= 265660..266121bp; Strand=+
atgattgaacagattgccactctacccgtctggttctggctctgttttggtggcctgttgctgattgcagaattgctgggaacggggggatatctcctgtggacaggaacagcggccgtcgttgtcgccttgatcacatgggttttcccggagatgagctgggaactgcaaggcattctgtttgctgttctgacattgctgtctgccattgcgtggcgtagctggctacgctatcgtccacgcaaaaataacgatgagacactcaatcaaaaaaaccagcagttaattgggcttcatgcccgcttaaccagcgcgaccgaaaacggctatggccgggtcaaactagccgatggcagttggcgtgttcactgtgacagagaacttccagctaatacggaagttgaagtgatcgccgttgacgggatcacgttgaaagtgaaacccgtcgcaaatcaaccgtga

SEQ ID NO: 5060 - DNA, 405 bp, Xenorhabdus bovienii
  Coding sequence Name=Xb4151_4152.C444.gene235.dna; Position on contig= 266112..266516bp; Strand=-
atgaatatcagcgaaattgctcaaaagaccggtttaaccagcaaagctatccggttttatgaagaaaaagatctgatcactgcgccggatcgcggagataatggctatcgttattaccagcataagcatattgatgaactgaccctgttgcgtcaggcgaaagaagtggggtttacgcttgaagaatgtcgtgagctattacggttgtttcacaatcctcgtcgccatagtgcagatgtgaaaacagcaaccctgcaaaaagtggctgaaatagaaaacactatggtgaaattgcagaaaataagggaaaaattgctggcactggcggcggaatgtccgggagatgatggggcagattgccccatcattgagcaattatccagctgttgtacgcatcacggttga

SEQ ID NO: 5061 - DNA, 2748 bp, Xenorhabdus bovienii
  Coding sequence Name=Xb4151_4152.C444.gene236.dna; Position on contig= 266665..269412bp; Strand=+
atgtccacaacaactattcttacacttcaggggttaacctgtatgcactgtgtcggcagtgtcaaaaaagcattggaaaatgtatccggtgttgaacagactgatgttacccttgattatgccaaagttatcggaaatgtatcctccacagttttaattaccgcgattaccgatgccggttatgaagccgtcgtcgccactcagcccgatattgagttacaactttcaggcttaagttgtatgaaatgtgccggcaaaacccaaaaagcgctggagtcggtagaaggggttattgcggccaaagtcgatactcagactgcgaaaatttacggcaaagtagagagcaacgctttaattaaggccgtcgaacaagccggatatcacgccgagttggcggcaggtacacgcttcccaaaaactgagccgctgacaatatctgccccacaaacaccggagtttttggcagcggcagaaaacgcaactccggtcagaaatcccgaaaatacagtgagtcatgatactcccgataacgacaatgacagtattcagcttctgctggatggcatgacctgtgcaagttgtgtcagtaaggtacagaaagcgctgcaatccgtcgatggggtggaaaatgccagagtgaaccttgcagaaagaagtgcattagtcactggtgcggtatcccctaatgcgttagttgacgcagtcatcaaggcaggttacggcgcggaagtgattcaggatgaaaccgaacgtcgcgagcgtcagcagcaagttgcacaggccaatatgcgccgtttccgctggcaatcagcttttgccttggccgtcggggttccggtcatggtttggggtatgttgggtgacaatatggtgctcactccctcaaatcacgctatttggctgacgattggtttggtcacactggctgtcatggtgtttgcaggcggccatttttatcgcaatgcgtggcaaagtctgaaaaatggcagtgcaaccatggatacgctggtcgctctgggtacaggcgtcgcctggctctattctatcagcgtcaatttatggccggagatttttccatctcaagcccgtcacctttattatgaagccagcgcgatgattatcggtttaatcaacctcggccatgctctggaacaacgcgcccgtcaacgctcttccaaggcacttgaacgattgctggatttaacccctccgactgcacgggtgatcaccgaaaaaggtgaaaaaacgctgccattggcggatgtgaaacccaacatgatactgcgtctgaccaccggtgatcgcgtacctgtcgatggtgaaattattcagggcaccgtctggctggatgaagctatgctgacaggcgaaccgatcccccaacagaaatcaaccggcgatggcattcatgcaggcacagtcgttcaggatgggacggtgttgttcagagctgctgcggttggcagccagacgacactagcccggatcatcaaactagtgcgccaggcacagagcagtaaaccggaaatcggccaattagcagataaaatatcatcaatatttgttcccgtcgtcattgccatcgcactggtcgctggcgctatctggtatttcatcggccctgctccacaactcatgtactcgctggtcatcatcactaccgtcctgattatcgcctgtccctgcgcccttggattggcgacaccaatgtccattatttctggtgtgggacgagcggcagagttaggagtgctggtgcgtgatgccgatgccctgcaacaagccagtcaactggacacccttgttttcgacaaaacgggtactttgacagaaggcatgccacaagttactgaaataagtacttttaacggattcaccgaagaacaggtattgttatgggctggcgcgttggagagtggctcaaatcatcctctggcaaaggctattgcgctgaaagtggcagggcagaaattgccagaagtacagcaattccgcacattagccggattgggaatacgtggggtggttggagacacaacactgctactggggaatcagagtttgcttgagcaaaatcagattgaaactgcggaattaaaaaccttgatggcgacacaggcagaaaaaggcataactcccgtcatcttggcggctgatggcaaaatcgctgccctgttttccattcgtgatcctctgcgtcaagataccctttctgccctacaacgcttgcatcatcaaggttatcgtttagtcatgctgacgggagataatccggtaacagccaatgctatcgctaaagaagcagggattgatcaggtgattgccggtgtgttacctgatggtaaagcggcagccattcaaacactacaatctgaaggccggaaagtcgccatgatcggtgatggtatcaatgacgcacctgcgctggcacaggcagatgtaagcatcgcaatgggaggtggcagtgatatcgccattgaaacggcggcaattaccctgatgcgccatagcctcaacggtgttgctgatgctgttgcgctttccagaggaacattgcgcaatatgaagcagaacctgtttggcgcatttgtctacaatacattaggcatcccaattgcggcaggtgtcctgtatcccttcacaggaaccttgctaaatcctgtagttgcaggggcagcaatggcgttgtcttcaattacagtcgtcagtaacgctaatcggttattgcgctttaaacccaagcattga

SEQ ID NO: 5062 - DNA, 813 bp, Xenorhabdus bovienii
  Coding sequence Name=Xb4151_4152.C444.gene237.dna; Position on contig= 269567..270379bp; Strand=+
atggggaaattgatgacatatctcaacaatgtattaagactgaattcccaacggcattacccctatcctgcttttgacatcaccctgccaaaaaataggcatttgcacattgtgggtagcattcacatgggcacagaaaacatgtttccactttctgagatactactggagcaactggaacagtgtgatgccctcatcgttgaagcggacatcacgcaacccggatctcccttcaaagaaaaatttccagaacaagttgcgctgtcactacgtttatcacctgaacattttgaccgtttaacgcattactgccatgagattcagtatcctctaagatcactggatgcattaccctcatggcaagtcgctttgatattgcaggcagctcaagctcaatatttgggattgcgccctcaatatggcattgactgtcaattgttggatagcgcaaaagccatcgataaggtcattattgagttggaagggacggatactcaggttaacttactctccaacctgccaaatgggggtatttcactgttagaagatacacttacccattggaataccaatgcgcgtgctttacagacgatgattagctggtggatgaattataaacctgcgcagcaaaaccaagcattaccgcagaccttctgcgaagagctccatcagacattgatggccgagcgcaaccatcagtggaatgaacaattacacgctttacccgcaggcaaatatttagttgctgtaggagctctgcatcttcatggtgaaaacaatctgctacagatgatggaaagaatacaaggataa

SEQ ID NO: 5063 - DNA, 477 bp, Xenorhabdus bovienii
  Coding sequence Name=Xb4151_4152.C444.gene238.dna; Position on contig= 270432..270908bp; Strand=+
atgacacccgccgttattttactggaaaaacataaaattcacttcaaacttcacccttatgaacatgatacgaatgaacatagtttcggtgatgaagtggttaaaaaactcggtttggatgccaaacaggtttttaaaacactcttggtttcattgaatggcgatcccaaaaatcttgctgtcgcagttacgccggttgcaggacagttggatttgaaaaaagtcgccaaagtcttcaaggctaagaaagcagagatggcagatccccagatggcacaaaaggtgactggctatctggtaggcggcattagcccactagggcaaaaaaaacgtttgcccactgttatcgatagtcaggctcaaatcttgccaaccctatttatttctggaggcaagcgaggattggatattgaattggtgccagccgatttatgccaactacttaattgttcctttgccgatattgctaaagtctga

SEQ ID NO: 5064 - DNA, 1659 bp, Xenorhabdus bovienii
  Coding sequence Name=Xb4151_4152.C444.gene239.dna; Position on contig= 271111..272769bp; Strand=-
atgaaattttcgttcaaaacatcagcatgtgcccttgtcgtttctttgtcattgttgccgataagtgcagctgcttgggaaaagaataaaacttacgatattacaattctgcatactaacgatcatcatggccacttttggcagaacgatcatggcgagtatggtctggcagctcagaaaacgatggtagattctatccgtcaggaagttgccaagaaaggaggcagtgtgttgctgttatccgggggggacatcaatactggtgttcccgaatcggatatgcaggatgctgagccagattttaagggaatgaatttggtgggttatgatgcaatggcgctggggaatcatgagtttgataaacctttaaacgtgttgcatcagcaggaaaaatgggccaatttcccatttctgtctgctaacatttatcaaaccagtactggcaagcgtttatttaagccgtatgtgatgtttgataatcaaggcgtgaaaattgcggttattggtttgacaaccgatgatacggcaaaggtaggaaacccagccaacttccctgatgttgaattccgagtaccggcggaagaagcgaaaaaagttattgatgagctgaaaaagaatgaaaaaccggatgtgatcattgccgcaacccatatggggcactataacgatgggcatcatggcagcaatgctgcgggggatgttgaaatggcgcgcagtttgcctgcgggttatttaaatatgattgtgggggggcattcacaagatccggtctgtatgtcagcagagaataaaaactacaaacaaatggattatgtaccgggaacaccttgctcaccagatcgccagaatggaacatggattgtgcaggcacatgaatggggcaaatatgtcggccgtgctgatttccaatttcgtaacggtgaattcaaattggttcattatcaattgatccccatcaacttacagaaaaaagtaaaaaacgaagacggcagcacagggagagcttattacactcatcaaattactgagaatcctgcaatgctgaagctgttgacaccatatcaggataaaggcagccggaaattaaatgttcaggtgggcgtggtagatggaaaattagaaggtgatcgcagtaaagtgcgtttcatccagaccaatatggcgcatcttgtactggcagctcagatggaacggacaaatgctgattttgccgtgatgagtgggggagggattcgtgattctatcgaagcaggggatattacttacaaagatgtcctgaaagttcatccatttgccaaccaactggtttatgtggatttcaaaggtcgcgaagtcttgccatatttgacggctgcggcaaatatggagacggattcaggtgcttacgggcagttttataatgtcagttttgtggttgatggcaaaaagatccgtgatgtgaaaattggtggcaagccgttggatcttaataaaacttatcgtatggctacactgaactttaacgctatcggaggtgatggttatccacgtgtcgataacttacctgggtacgtggataccggtttcgttgatgctgaagtgttgaaaggctatatcgagaagcactctccgttgaaagctactgattatgagccgaaaggtgaaattgttcataagtga

SEQ ID NO: 5065 - DNA, 165 bp, Xenorhabdus bovienii
  Coding sequence Name=Xb4151_4152.C444.gene240.dna; Position on contig= 272823..272987bp; Strand=+
atgaaaattataaacctatcccatcaagacatgctacttttctacagcagtgtctatataacattatctctgctggaacaggccctaatccaacaccagaatagagtgatgcacctaggtgctaggatatattttccaatcaagattacagaattgtgtcattaa

SEQ ID NO: 5066 - DNA, 1236 bp, Xenorhabdus bovienii
  Coding sequence Name=Xb4151_4152.C444.gene241.dna; Position on contig= 273138..274373bp; Strand=+
atgagtgaacaaagcaccacaaaacgattgcctgattcatcaagaaaaacacatcagactgttttttcaattctcggtgcaatcagcttatcccatctgcttaatgatatgattcaatcgctgattttggcgatttatccactattgcaatctgaatttactctgagcttcattcaagttgggatgattacactagtttatcaggtaactgcgtccctgctacaacccctgattggtctgtatacggataaacatccacaaccctactcactgcccatcgggatgggattcactctgtctggattgcttctgctggcttatgccgaaagtttccctatcatcttactggctgcggcactggtcggtacaggatcatccgtctttcatcctgagtcatcacgggttgcgagtatggcctccggaggacgtcatggactggcacaatccctgtttcaggtaggcggcaatctgggaagctcactggggcctctgctggctgcaattttcatcgctccttatggcaagggaaatatcgggtggttttctctggcagcactgctggcgatcgtcattctgttgcaagtcagccaatggtataagatgcagcaccgagcttctaagtttctatcatccactcatatttctcagccgaatttccccagaaaaatgattgtgcgttcttttgccattctgctgctcctgattttctcaaaatatttctatctcaccagtatcagcagttactacactttttatctgatccagaagttcggcctttcagtacaaaatgcccagatccatctgttcatttttttgtttgctgtagctgcaggcactatgattggggggcctatcggagataaaataggccggaaatatgtcatatggggatcaattcttggcgttgcgcccttcactctgcttttaccttatacatcactattctggacggggccccttaccgtagtcattggcctgatattagcatctgcattttctgctattctggtctacgctcaggaacttattcctggcaaaacgggaatgattgcaggtttgttctttgggctggcgttcggcatgggtggtatcggtgcagccgttctcggttatgtagcggataaaaccagtatagagttagtttataaaatctgtgcttttctaccacttcttggtatttttactctattcctgccaaatatagaaataaaaccacaaaaaaaccatgaaaaataa

SEQ ID NO: 5067 - DNA, 1701 bp, Xenorhabdus bovienii
  Coding sequence Name=Xb4151_4152.C444.gene242.dna; Position on contig= 274584..276284bp; Strand=+
atggagcattcgacacctcttatcacgaccattgttggcggttttgtactcgcctatctgcttggcatgcttgcccaacgcctgaaaatctcacctctggtgggataccttgcggcaggtgtacttgctgggccttttaccccaggttttgttgccgatacttcgctggcacccgaactttcagaaattggcgtgatcttactgatgtttggtgtcggtctgcatttttcccttaaagatttgttagctgtcaaatcaattgccattccaggcgccatcgctcaaattgcagtcgcaaccttattgggtatgggattatcaacactgcttggctgggggctgtttagcgggatcgtctttggtctctgtctgtccaccgcaagcacagtcgttctgctcagagcgctagaagagcggcaactcattgatagccagcgggggcaaattgctattggctggttgatcgttgaagacctggctatggtactggctctggtattactacccgcagccgcaggtatactggatagccagaatgccaatatcggtcaattgctgttagaacttgctatgaccattggcaaagttgtggccttcattttattgatggtttttgtcggtcgccgtctgattccctggattttggcaaaaacagccagcacaggttcgcgcgagttatttactctggcggtactcgccattgccttaggtgtcgcttacggagccgtgaaactgtttgatgcctcatttgctctgggtgcatttttcgctggtatggtactgaatgagtcagaactgagccatcgggcagcacaggataccttaccgctaagagatgctttcgccgttctgttctttgtctctgtcggaatgttgtttgatccaatggtattgttccagcagccacttgctattctgggaacccttgtcattattattattggcaaatcattggcagctatgcttctggtcaaaatgtttggtcattcacgacgtacagccctgacgatttccgtcagtctcgctcaaatcggggaatttgcctttattctggcagggcttggcgtcactttaggattactggatggagaagcacgtaaccttgtgctggccggtgccattgtctcaattatgttgaatccgattctattcagtttgctggatcgttatctggaaaaaacagaaactattgaagaacaattattagaagaaacgctggaagaagaaactcagatcccagttgatatctgtggccatgccattatcgtgggctatggccgagtcggccgtcttctctgccagcggttgcaagaaagaaatttcccgttggttgtccttgaagatacacgtgcccgatttgaggagttaggggaaatgggcatcagtgcagtgatgggcaatgctgccagcaaagatatcatggctctggcacgactcgattgcgcctgcacgttatttctgactatccccaatggctacgaagcaggtgaaatagttgcgaatgccagagagatccggccagatatcaatattatcgcgcgtgctcactatgatgatgaagtgacctatattatggaacgtggtactaaccacatcattattggtgaacatgaaatagcaagagcgatggctgatgcactcccgacgtctgagccaatttgtccgatagagccaccagcgtcattttcgacagcaagttag

SEQ ID NO: 5068 - DNA, 1311 bp, Xenorhabdus bovienii
  Coding sequence Name=Xb4151_4152.C444.gene243.dna; Position on contig= 276368..277678bp; Strand=-
atgaaattccctggtaagcgtaaatctaaacactattttcctgtcagcctgagagatcctctactccagcccatcaaagaaatgatagatactgaaaataaccgagcctatatcgttggtatcgatcaaacactggtagacattgaagctaaggttgatgagagttttatccagcgttataacctgagccaggggcattcactcgtcattgaagatgatgtcgccgaggcactatataaagaactgacagacaataatttgattagtcacgaatttgcgggtggaaccatcggtaatactctgcataattattctgttttggctgacgataagtccgtattgcttggcactatgtgtaatagcatccaggtagggagttatgcatattgttatctctgcaatacatccagccgcatggatttgaatcatcttcagggagttgatggcccaattggccgctgttttaccttggtgactgaaaacggtgaaaggacattcgctatcagcccgggattaatgaaccaactccgtccggaaaatatccctgaacatattattgcggaagcatcagcactggtgattaccgcctatctggtgcgttgcaaatcgggtgaaccgatgccggaagcaacgatgaaagccatcgggtatgcgaaaaagcataatgtgcctgttgtactgacattgggaacaaaatacgtcatcgctgatgatccgcagtggtggcgcgattttttggcggaaaatatttcggtagtcgccatgaatgaagatgaagcccaagagctgacgggctttagtgatcctctgctggcagcagatatggccttgaattgggtggatttggtgttgtgtaccgcagggccggcgggactgtatatggcaggttataccgaagaagaacataaacgccagacttcacatccattattaccgggcgcgatcgctgaatttaatctctatgaattcagtcgggtgctatgcaaagccgattgccagaacccaatgcgggtctactcccatattgagccttatatgggggggcctgaaaaaatcatgaatactaatggggctggcgatggtgcattgtctgcattgttacatgatattacagctaatagttaccaccgaatgaatgttcccaactccagtaaacataagcgctcttatttgacgtactcgtcattggctcaggtatgtaaatacgcgaatagagtgagttatcaggtattgagccagcactcacctcgcctgatgcgtgggttgccagagaaagaagatagtttggaagaatcttactgggaacgctaa

SEQ ID NO: 5069 - DNA, 1107 bp, Xenorhabdus bovienii
  Coding sequence Name=Xb4151_4152.C444.gene244.dna; Position on contig= 277829..278935bp; Strand=-
atgagtaataaaccgattaaacaccctgatttttatgaagaaaattcaaactattatcaccctaaacaggaagatgagattgatttatttgaattattttccgtaattttccaatcaaaatatttaattatcgcaatatccgtggtttttgcggtgattggcttcagtattgcgtcatttttaccacagaaatggacaagtacagcagccgtagtgaagccgacattggaacaatttcagccattgaaaaatgcactcacggatttgcaagttttgagtcttgatccgaaagtgacagaagcatcgttatatcagcgttttgtcgaaaactataactcgcgtgtattgcgtgaagattatttggtcagcactgattacttcaaggcgttgcttgctaagatggacgatggtgcgatacagggcaaacgaaagcttattgagcaggttgtaaataaaaacatctccatttctttacctaaaaaagataatgaagaagatgacgaaagcatactctctttcagtgcgggtactgcggaagattcttacaacttgttgactgggtatatcaattttgtctcttccgttgttcgtgatcaggtgaaagatgaattgaatgatatggtgcatcagaaactggtcttttcacaaaagtcgtatgaaattgatctggctcgcatcagaaatatgcgtggtgttgatatcgaacgcttgaagtatgcgatctccattgctaactctgccggtgttaaaaaacctgtttccaatggcggcgctatgatcaaggatgacccggattattcgattgcgctgggtgcggatgcactgcaacgtaaattgcagattactgaagagattaccgatccgacccagatagatgcagatcttcgtaacagacttttatatatagaaaatttaaaagcagtgaatattaataagattgatttcgagccattcaggtatatgcagcaaccttatgaacctacagcgaaagattcacctaagcgtctgctgattctgattggtgctggttttattggctttattttatctgttatgtttgttctggttcgccatatggcgcgcggccgccagaaacaagaagcttaa

SEQ ID NO: 5070 - DNA, 966 bp, Xenorhabdus bovienii
  Coding sequence Name=Xb4151_4152.C444.gene245.dna; Position on contig= 279145..280110bp; Strand=-
atgagtagcaataagtatggtgtcttactggtgaatcttgggacgccggatgagccaacacctgtagcaataaggcgttatctggcgaaatttctgagtgaccgaagagttgtggatatcccttcgtttatctggaaaccgctgttgtacggcattattcttcctttccgttcttctcgtgttgctaagctgtaccaagaaatttggacagacgagggatcacctttgctggtttatagtcagcgccagcagaaattgctaaatgaaagattgacggatatccccgtcgttttgggaatgagttacggttttccttccttgccccaagctgtcggtaatcttctgcaacaaggtattgaccacctgattgtgcttcctctttatcctcagtattccagtacgacatcggctgcggtatttgatagcatcagcaaaatattgaagggatatcgtaccataccccatttgtatttcatccgtagctatgctacacatcctgcttatattgctgccttaaaagaaacaatcgagaagagttttgaaaaacatggtttgcctgatcgtttgcttctttcctaccacggtattccagaacggttggcaacgataggtgatatttatccgcaggattgcagggcaactacggagcttttgatacaggcattggattatcctgcagataaaattatgatgacttttcaatctcgttttggtcgtttgccgtggttaacgccctatacggataagacaatggcattattgccagaacaaggtgtggaacatgttcaggtactgtgtccgggattttcatcagactgtttggaaacactggaagaaatccaacagcaaaatcaagcgattttccggcatgccgggggtaaaaagtttgaatatatttctgcacttaatgataatgaggcacacatttcattgcttgaacaattggtaaataacgccatgaaataa

SEQ ID NO: 5071 - DNA, 645 bp, Xenorhabdus bovienii
  Coding sequence Name=Xb4151_4152.C444.gene246.dna; Position on contig= 280269..280913bp; Strand=-
atgcgtattattttgctgggcgcgccaggcgccggtaaggggactcaggcgcaatttatcatggagaaatatgggatccctcagatttcgacaggtgatatgttgcgtgccgcagtaaaagcaggcagcgagttgggtttgaaagcaaaagaactgatggacaacggtaagctggtgactgatgaactggtcattgctttggtcaaagagcgtatcaaacaagatgactgccgtagtggattcttgttggatgggttcccacgtaccattcctcaggctgatgcgatgaaagaagcgggtatcaaggttgattatgttctggaattcgctgttcctgatgcaatcattgttgaacgcattattggccgtcgtgtacacgcgccatcgggtcgtgtttatcacatcaaatttaatcagcccaaagtagaaaaccgggatgatgtgactggtgaagaactgagtattcgtaaagatgatcaggaagatacagtacgtaaacgtctggttgaataccacgcacagactgcacctttggtttcttactatcagaacgaagctcaggcagggaacacaaagtactccaaacttgatggtacacgtcaggtagctgaagtcagcgaagaattggtcggcattctgggctaa

SEQ ID NO: 5072 - DNA, 1878 bp, Xenorhabdus bovienii
  Coding sequence Name=Xb4151_4152.C444.gene247.dna; Position on contig= 281085..282962bp; Strand=-
atgaaaggtcaggaaacccgtggatttcagtctgaagtcaaacaactattgcagttgatgatccattctctctattccaataaagaaatttttctccgtgagttgatttcaaatgcatcagatgctgcggataaattacgcttccgtgcattgtcaaaacctgaattgtatgaaaatgatggtgagttacgtgttcgtcttgcttttgataacgagcataaaaccatcactatcagtgataatggtatcggcatgtcccgtgatgaagttattgataatctgggaacgattgcaaaatccggtactaaatcattccttgaatctgttggttctgatcaggtaaaagacagccagttgattgggcaattcggcgttggtttttactctgcctttatcgtggcggataaagtgactgtgcgtacccgtgcggcaggcactgcggccgatcaaggtgttttctgggaatcaacaggtgaaggtgattacaccattgctgatcttgaaaaaactgagcgtggtacagaaatcactttgcatctgcgtgaaggggaagatgaatttcttaacgactggcgtctgcgttctatcatcggtaaatattctgatcacattgcgttgccagttgaaattgaaaccaaaaacgaagaagacgataccgtcacatgggaaaaaatcaataaagctcaagcgctgtggacacgtggtaaagccgaaatcagtgatgaagaataccaagagttttataaacacatttcccatgatttcactgatcctctgagctggagccacaatcgcgttgaaggtaaacaggaatacaccagcttgttgtatatccctgctcaggcaccgtgggatatgtggaaccgtgaacataaacatgggctgaaattgtatgtacaacgcgtattcatcatggatgatgccgaacagttcatgccaaattatctgcgttttatgcgtggtctgatcgattccaatgacttgccgctgaacgtttcccgtgaaattctgcaagacagtactatcacccgcaatttgcgtaatgcgttgaccaaacgtgtattgcagatgctggataaattagcaaaagacgatgcggaaaaataccagaccttctggcagcagtttggcttggtactgaaagaagggcctgctgaagacggttcaaacaaagaagctattgctaaattactgcgattcgcaaccactcatcatgatggctcggcacaaactgtttctctggaagattacctcagccgcatgactgaaggtcaggagaagatttactacattactgccgacagctacgccgcagcaaaaaatagcccacatctggagctgttccgcaagaaaggcattgaagttctgttgctgtctgaccgtatcgatgaatggatgatgagctacctgaccgagtttgatggcaagtcattccagtctgtcagcaagacggatgaatctcttgacaaactggctgatgaaaacaaagccgagcaggaagaagaagataaaaaactggagccgtttattgagcgtgtgaaaacgctgcttggtgaccgtgtgaaagaagttaagctgacccacagactgactgatacacccgcgatagtgacaacgaatgccaatgaaatgagcacccaaatggcgaaactatttgcggcagcaggacagtctgcaccagaagtgagctataactttgaactgaatccagaacacaatctagtgaaaaaagcggctgatattcctgatgaagctcagtttgcggattggatagaactgttactggatcaggcattgtttgctgaacgcggcacattagatgatccaaaccaattcattcgccggatgaatcaattattattggctgaaaaagcttaa

SEQ ID NO: 5073 - DNA, 129 bp, Xenorhabdus bovienii
  Coding sequence Name=Xb4151_4152.C444.gene248.dna; Position on contig= 283025..283153bp; Strand=+
atggggataactcccaacaatttcaagttagggcaatcagaagaatataaaattggtttgatgaatgtacaaatcagctatggatggtggcgttatccgcaacaccatccattggaatttcccatttga

SEQ ID NO: 5074 - DNA, 609 bp, Xenorhabdus bovienii
  Coding sequence Name=Xb4151_4152.C444.gene249.dna; Position on contig= 283168..283776bp; Strand=-
atgcaaaccagtcctcttcttgaatccctgatggagtcattacgctgtttacccggtgtaggtcccaaatcagcccagcgaatggcatttcatttgttgcaacgggatcgcagtggtggcatgaggcttgctcaggcattgactcgtgcaatgtctgaaattggtcactgtcaggactgccggacatttactgaacaggaacaatgcacgatttgtggtaatccccgtcgtcagcagaatggtcagatctgtgtggtggaaacgcctgcggatattcacgccattgaacagaccggccagtttgccggtcgttattttgtcctgatggggcgcttatcgccgctggatggtatcgggccaatggatattggtttggatcgtttggaagaacgtctgtcttccgaaaccctgtcagaaattattctggccaccaacccgactgttgaaggagaggcaacggcaaactatatcgcggaaatgtgttcgcaatatggtgtgatagccagtcgtattgctcatggtgttcccgtggggggggaacttgaaatggtggatggtacaacgttgtcccattcacttgcgggtcgtcaaagaatcactgatttgtga

SEQ ID NO: 5075 - DNA, 330 bp, Xenorhabdus bovienii
  Coding sequence Name=Xb4151_4152.C444.gene250.dna; Position on contig= 283776..284105bp; Strand=-
atgtttggtaaaggtggtttgggcaatctgatgaaacaggcccagcagatgcaagaaaaaatgcagaaagtgcaggaagaaattgcaaatttggaagtgacaggtgaatctggtgcgggtctggtgaaagtgactattaatggtgcacacaactgtcgtcgtgttgaaatcgatccaagcttgatggacgatgacaaagatatgctggaagacctgattgccgctgcattcaatgatgcagcccgtcgaattgaagaaacccagaaagaaaaaatgtccggcgtttctaacggcatgcaattaccgcctggctttaagatgccattctga

SEQ ID NO: 5076 - DNA, 1977 bp, Xenorhabdus bovienii
  Coding sequence Name=Xb4151_4152.C444.gene251.dna; Position on contig= 284154..286130bp; Strand=-
atgagctatcaggtactcgcccgtaagtggcgcccacaaatattttctgatgtgattggtcagcaacatgtgctgactgcactggcgaatggtcttgagcaccagcgcctccatcatgcctatcttttttctggcacccgtggtgtgggaaaaaccaccatcgcacgtctgttggcaaaggggctgaactgtgaaacgggaatcacgaagaccccatgtggtcaatgtgcgaactgtcttgaaattgagcaggggcgttttgtcgatctgatcgaaatcgatgccgcctctcgaacaaaagtagaagatacccgtgaattactggacaacgtgcagtatgcacctgcccgtggccgtttcaaagtttatctcattgacgaagttcacatgctttcgcgccatagtttcaatgcgttactcaagacattggaagaaccgcctgaacatgtgaaattcttgctggcgacaacagatccacaaaaactgcccgtgacgatcctttcacgttgtctacaattccatctgaaagcattgaatgttgatcaaatcagtggtcagttggaacatgtccttaatgcagagcaaatagagagcgactcccgtgcgcgccatcttctggcccgtgctgcggatggtagtatgcgtgatgctctgagcctgaccgatcaggcgattgccctcggtggaggtaaactgaccgccgatatcgttagccagatgttaggcacgctggataatgatcagcctttggaaatgattgaatggctggttcgggctgatgggcaacagcttatggcgctggttgagcaaatcgcatcccgtggcgtggattgggaacatctgttggttgacattttgtcattactgcatcgcattgccatgctccagttgttgcctcagcaacctgataatgatccctcttcaatggaagggcgtttgcggttgctggcaagatcaatttctcctgccgatctacaacttttttatcaggcattgctggtcggacgcaaagatctcccttatgccccagagcgccgaatgggtgttgaaatggcattattacgcgctttggcgttccaccccaaaactatcattgaagaaacgccagcgtcaggtggagaaatcccggtagtaccgcaggtatctgcatctgcacaacgccatccggtttcacctgtacaaaaccatgtggctggtgaacgctctgagaatggttctgaacacagttctccgcaatcgatgagtacagaacctgtaatcagcagtccaacggcaaaattgctgcaagcgaggcattcgcttactcgacaagggaatacgcccccaaaaaagtctgagccggcagagcctgtgaaggcgaagtcggcaagctcggcgctggaacgattagcagccgtggccgaacagcggtcacaatcttatattcccaaagcccaggagccaaagcccataaagcaagaagcttaccgctggcggacaacgaatacgagtattgaggaaaagccggtttgtgtcacgacaccaaaagcgataaaagcagcacttgagcacgaaaagacaccagaactggcggaaaagttggcggttgaatcgaaacagagagattcatggtcagcggaaattgataaactgaatattccaaaactggttcagcaagttgcattgaatgcgtttaaagaacagattgatgaaagtcggttttgtcttcatctgcgttccaaacaacgtcaccttaattcagcatcggcacagcaaatgttgtccgaagccttaagtgaattgcatggaaaacctattgaactccgtattattgaagatgataatcctgcggtaaaaactccgttggagtggcggcaagccatttatgaagaaaaattggcacaagcacgccaatccattatttcggatagaacgattcaaacacttcagcagctgtttgatgcagaattggatgaagaaagtatccggcctgtttaa

SEQ ID NO: 5077 - DNA, 552 bp, Xenorhabdus bovienii
  Coding sequence Name=Xb4151_4152.C444.gene252.dna; Position on contig= 286228..286779bp; Strand=-
atgaccgctaatgcgcaaaaactacaatttattaaagatagtatcgaaacgatccctgattacccaaaagtcggggtactttttcgtgacatcaccacgctgctggataatcccgttgcctaccaagctacgattgatctactggtaatacattatcaagagaaaggcattaccaaaatcgttggtacagaagctcgtggtttcttgtttggcgcccctgttgcactacgtctgggagttggttttattcccgttcgcaagaaaggcaaattacctcgtgcgacgttaagtgaaacttacgatctggaatatggtactgataccttggaaatccataaaaacagtatcaaagaaggggataaagttctggtggttgatgatcttcttgcaacaggcggtaccattgaggcgaccgtaagtttgattcgacgtctgggtggagaagtttctgaagcggcattcatcattggcctgcctgatttaggcggtaccgagcgtttgaaaaaacagggtatcgagagctacacgctcatagagttccctggtcactga

SEQ ID NO: 5078 - DNA, 543 bp, Xenorhabdus bovienii
  Coding sequence Name=Xb4151_4152.C444.gene253.dna; Position on contig= 286986..287528bp; Strand=+
atgagtatacaaaatttattagtcgcacttgaaaaacagatcagtatgctggaaacagagcttgaatcactccccaaaacacctttttcaatcgcccgttttgatcaagcattattccaccaacacagcaataaactaggtggatatcttaatgaaattaaaaaaaatatgtcacaattaaagacctgtgtgaaagataatcgtaccgagcaggtcagatttctttctgaacgtttagtgacgcaaattgaagcactgaaacgcgaaatatcaacacagtcactgagaaagcaagaggataaatttgaacgtcagtcgcaagaacgggatttttaccatcgtctggctgaacatcaggattatgagcgccgtttaatggcaatgattaatgatcgggaattacagttaaataaacaagttataccgacaaaccaatataaactacaaaaagaaatcgcagcgctggcaggaaggctcgctcgctgtcgccaagcattgatgcgtatcgaaaaagcgatagaaaagcaagaaaattcagattag

SEQ ID NO: 5079 - DNA, 165 bp, Xenorhabdus bovienii
  Coding sequence Name=Xb4151_4152.C444.gene254.dna; Position on contig= 287551..287715bp; Strand=+
atggatctcgaacaagcaccacctgaagtgcaactcgcggtagatctgatttatttactcgaatgcaatgaaatttctcccgatatcgcactagctgcgttaaagatcgtcaaagacgattttcaagaaaaactgaaaaaacaagctcagcagcctgaggaatga

SEQ ID NO: 5080 - DNA, 3459 bp, Xenorhabdus bovienii
  Coding sequence Name=Xb4151_4152.C444.gene255.dna; Position on contig= 287750..291208bp; Strand=-
atggttccatttaaccgatacttgggtattttgctcaataagtgggtcttatgcgataaaaggcctgatgcattacattttcgttttgttttcatggtgagcctgtttttccttctgttatttttcttttctcctgcaatggcaacatttagcagtgaaataccaacccgcaatgatattcaaaatcagcttaagatcctgacagaacgtaaggaacacacggttgaggagaaaacatcgatagctgatttggaaaaggcactctatttctttgacaaaatagatcaagttaatctggattccgatttacttaaaaaaaacttacaggattctccgcagaaatcacgtcaaatcacggtcggattggaaaatctgaagaataacgcccagcaggatgagaatgattataaacaaacgctggaaacgttgtcgctgaagcaacttgaatccaaactgaacagtacactgaatagcttgcaacgagctcaggaaaaccttgctagctataatagccagttaattgggctgcaaacccagccggaacgggcgcaaaatttactgttccacaatgtgcaaagactgcaacaaatccgtaatcaactcaataatgagctgacagaacagccggaatcacgttacccccagcttgatttgctgcgggtagaacaatcttttctgatgcagcaaaatgagttgcaaaggacatccctacaggcaaacacacaactacagacgcttttgcaacagcaacgtgattacacttctttccaaattgatcagttagaacgttatgttcaatttattcaaaatgtggtgagcggaaagcgtttgattgtttctgaagaaacagcaaaagaagcacagaattcagacgatactaattctcatattcagtctaacccgttggttaaggaagaaatccagatcaatcgcgaactcagtgagcggctgattgccgaaacgcgggaaagtaaccaactggtacaaaaaaatattctcgttaagaatttcttggatagagccatccaatctgaacgtaatcttaaagagcaggttaaagtattacgtggcagtttattgctgtcgcgtatcctgtttcaggaacagctcaaggtaccgcaaaatgtactgacaaaggatttgccgataaaaattgctgatctgcgtttggagcaatttgaaattaaccagcaacgcgataagctttaccagtttaatgattatgtcaatcagttattgaacctacattcagatgagataaaacatgaatctaaggaagcagtaggtgaaattcgtaatgctatcgaacaaattctggaaattcgccgtgagcttttgaatcaactcaataaccagttgggaaatcaaattacacacgccatcaatttacagatggatcagcaacaattgctggatgtcagccagtcgttggaacagacgcttgtccaacagatcttctgggtcaacagcaataaaccaatgaacctggcttggttgaaatctttgcctgatttaattcaggaagagctgagccatctgaatattcatttgactctcagtggacttgccacgggattaaagaattccattcactttgtcattccccttttgctggtcggcctgtttttacgctggcagacaaaaggcattaatgagcagttgaagaaaatttctgatgaggtagggcaactgcatcgggacagccagttgcataccccattagcattaattctgacattggtaaaaacattaccacttgctcttataattttggctataggctactggtattcgaaatcaggggatgatttaggtgatttaatatggagcttttctcgacaattggcgcttttctggactatgtatcgatgtagttaccaaatcctcgccaaaggtggaataggagagcaccatttttcattgaacagcgcggattacactctgttccgcaaaaatcttgtgcggttatcgattgtattgctgccgatactgttttggataactttaggggtcaaacacccgttacgtttatctgatgatgtgattggtcagtgcacggtgttaatttgcctgctcttcgttttcatttttatttttccattctgccgtcggttatggcatgtgaaaagttcacacatgatccgaaccatggtggtgacgacattgacttttgcacctctggttctgatggtgcttatggtatccggttatttctatacaaccctgcgtttggctgaacgttggctttacagcctttacctgctgttcctctggcatatctgttatcaggcttgtttacggggattgggaattgccgcccgccgcattgcctatcgccgggcaatttcccggcgtcaggctcaggcgaaagaaggggcagaaggagacgtaatggaagagccgccaatggagctgaagcgcattaaccagcaatcattgcgtttaaccacgatggtgctgtttttgatttttttgggcgccttttactgggtttggtctgatttagtgacagtattttcctaccttgatgggattaatctgtggcagtacagcacgacaacagagctggggagtgtcctgcaacaggttaccttgaaagatctggggatttctatggcaacgctggtgatttcatgggtaatgatgagaaacttgccgggcttattagaagtgttggtattgtctcgtttacagctacaacagggttcttcttatgcgattaagacgactctgacttacctgatcattggcgtcggtggaatcagtgcattgggaacattggggctttcgtggaataaattacagtggttggcggcggctctttcagtcggtttaggttttggtttacaggaaatttttgccaatttcgtatcaggtctgatcattttgttcgaacgtcctgttcgtattggagatactgtgacgataggcacttactctggctcagtcagtaaaatccgcatcagggcgacaacaattacagattttgaccgtaaagaagtgattattcccaatcgtgcttttgttacggagcgtctgatcaattggacactttctgacactatcacacgtattatcattaaagttggcgttgcgtatggctcagatctggataaggtgaaagaagttctgcttaaagcggccaaagataaccctcgtgttatgaatgaaccaataccacaggtttattttatgagttttggtgccagtacattggatcatgaattgaggctatatgtgaaagagttgggcgatcgtagccatactgtggatgaagttaaccgcaatattgataaactatgtcgggaaaatgatatcaatatcgcattcaaccagttggaagtgtatttgcacaatgggcaaggcaatagtctgcaagaggtacagaagtcattgaacggtggtagccaccatccagatgggaaggtatctcctggcgatcagccacttttaccttaa

SEQ ID NO: 5081 - DNA, 699 bp, Xenorhabdus bovienii
  Coding sequence Name=Xb4151_4152.C444.gene256.dna; Position on contig= 291359..292057bp; Strand=-
atgtatgtaaatcatcctcaagtcaaaaataaagtttatggcacgaaaatggcacgaaaaactaaacagaaagcaaaagaaacccgccaacagattatagaagccgcgataaaggtattttctgaacgtggagtttctgctacttcattgtcagatatcgcgattgcagccagtgtgacgcgtggcgcaatttattggcatttcaaaaacaaaatcgatctgatttctgctgtttgtaaaatgcacgaaaataaaatcgacgagttagagaaagagtatcaagcaaaatatccgaataatccactccttgcattgagatctctgttgatttttctgttaaaaatgatgattgatgattccagaaatcgattactgatggaaatttttttccacaaatgtgagtttgttggagaaatgcttttattggctgagaagcttagaggattatgtatttccgattataaaaaaattgaaaatattttggaggcttgtattcagtcgggagaattacctcatgatctcgatctcaggcgttctgccatcatgctgaaagcgttggtgacaggagtattggaaaactggtcattcgcaccagacagttttaatcttaaggaacaatcgacgcatctggtggatagtctcattgatacactcaaatatagccaccacttgcgatgtaacgaggaaaataagttttaa

SEQ ID NO: 5082 - DNA, 1200 bp, Xenorhabdus bovienii
  Coding sequence Name=Xb4151_4152.C444.gene257.dna; Position on contig= 292164..293363bp; Strand=+
atgcgaaaaaacagaggggttttgcctctggccacactactggtactttcaggcagcttcattctctcaggatgtaatgacaacaaaaattctcagcaaggggctgctggcgagcatgcttctgaagtgggtattgtaacgctgaaagcagaacctctggctgttatcacagaattacctgggcggacttctgcttatcgtgttgcggaagttcgtcctcaagtcagtggcatcattctgaaacgtaactataaagaaggtagtgatattgccgcaggtgagtcgttataccagatagatccagcaacctatcaggcagactacaacaaagccttggcaaatttatctcgggtacaagccaatgagaaagtgtctcgtttaaccgttgaccgttataaatcattactgggtacacaatatgtgagtaagcaggaatttgataaagtaatttctgcacatgctcaggcagccgcagaagtgctgtctaccaaagctgagctggaaagtaccagaatcaatctagcgtatactaaagtgacctcacccatttctgggcgtgcgggtaaatccactgtcactgaaggagcgctggtttctggtgggcagccaaccgccttgacaacggttcaacaactgaaccctatctatgttgatattacccaatcaagcgatgattatttacgtctaaaaaatgaaatagccaaaggaacagttcataaagaaggcggtaaaaccaaaactcgcctaatcactgatacaggtaaagagtacagtcaggaaggctaccttgagttttccgatattacagttgatgaaacaaccggctctatcactatgcgtgcggttttcccaaatcccaatgaagaactacttcctggcatgtttgtccgtacaaaactggaagaaggcgttcgacaaaatgcgattttggttcctcagcaagcaattaccagaacacctcgtggccaggcaaccacgctgattgtcgataaggataacaaagtagaattacgtagtatcaatgctgttcaggcaatcggtaataagtggctggtcacagaaggtttgaaagccggagatagagtgatagtcacaggattgcagaaaattgctccaggagtcaccgttaaaccaatggaaactaatctggatgctaagctcacagccaatcaaactgagcctgctaaaaagcctcaataa

SEQ ID NO: 5083 - DNA, 3150 bp, Xenorhabdus bovienii
  Coding sequence Name=Xb4151_4152.C444.gene258.dna; Position on contig= 293379..296528bp; Strand=+
atgcctaagttttttatagatcgaccaatctttgcatgggtaattgcgattatcaccatgctttctggtctattggcgataatgaaattacccgtggagcaataccctgcaattgcaccaccttctatttccatttctgcggtttatccaggagctgacgcaacaacggtacaaaacacggtaacccagattattgaacaaaatatgaacggtatcgataatctggtatacatggcttccaacagtgattctgctgggcgtatgagcattacgctaacttttgaagcgaacacagatccagatatcgcccaagtacaggtacagaataaactgcaactggcaatgcccctattgcctcgggaagttcaacaacaaggtattagtgttgataaaacaactaattcattcttaatggtggcaggtttcatttctgaagatggttccatgactcaggatgatatcgctgattatgttggagccagtgtcaaagacccattgagccgtgtcagtggtgtgggtgaaacgatgttgtttggtaaccagtatgctatgcgcatttggctcgatcctgacaaactgctcaactataaaatgaccacacaggatgtcatcactgccattaaagctcaaaacaaccaagttgcagccgggcagttaggaggaaccccgcctgttcctggacagcgtttaaatgcttcgattattgctcagacccgtctgaattctcctgaagaattcagcaatattctgctgcgcatgaatcgcgatggttcacacattcgcctgagagatgtctctgtcgttgaacttggagctgaaagctacagcatcattggtcggttcaatggtaactcggcagcaggaattggtatcaaactggctaccggcgccaacgcgttagatacctcaaaagccgtcaaaaaagccctggctgagatggcaccattcttcccacatgggttgactgtcgtgtatccatacgacactacgccattcgtcaaaatttccattttcgaagtggtgaaaacgttggcagaagccatcctgctggtgtttgtcgtcatgtacctgttcctgcaaaacttccgcgccactttaatcccaactattgcggttccggttgtattgctgggtacatttgccatccttgccgcatttggttactccatcaatacattaaccatgtttgccatggtacttgccatcggtctgctggtggatgatgccattgttgtcgtggagaacgtcgaacgcgtcatgcaggaggaagggttaccaccaaaagaagccaccagaaaatcaatgggacagattcagagcgctctggtcggtatcgcgttggtactttctgcggtatttgtgccaatggcattcttcggtggagcaacaggcgcaatttatcgtcagttctcgatcaccattgtttcagcaatggtactgtctgtactggtggcgttaatcctgactcccgcactgtgtgccacaatgcttaaacccgttgctaaaggtagccatggcattcaaattggtttctttggctggtttaatcgcctgtttgaaaagagcacccaccattataccgatagtgtaggccgcatgctgcgtggtactggacgctacttgttgatctatgttgtattgatcgcaggtatggcctttatgtttacccgtatgccatcttccttcctgccagaagaagatcagggtgtattacttgcgatagttcagctaccacctggttcaactcaggatcaaacacaaaaagtattggatgaaatcaatgattacttccataccaaagaaacggaaattgttaaatctgtattcaccattaacggttttagtttcagtggtcaggggcagaatgcaggtctagtctttgtcagcttaaaagactgggatgagcgcaaagacgacaaagacaaggtgccagccattgttgaccgtgcgaatgcacatttctcacaaatcaaggaaggtatcgtatttgcgtttaatattccttcgattgtggagttagggtctgccagtggttttgacttccaattgattgataaagggaatcttggacatgaagcattaacccaagcacgtaaccagttgcttggcatggttcaaagccaccctgacatgctcacgaatgtccgccctaatggtcagaatgatacgcctcaataccgtatccatatagataaagagaaagcggaagcactgggcgtttccaccgaaaacatcaactcaacactcactacgatgtttggtggagcttatgtcaatgactttattgaccgtggccgagtcaaaaaagtctatattcagtctgatgcacctcaccgtatgttgccaagcgatatcagtaagttatatgcccgcaaccaccatggtgaaatggttccgttctctgcattcatagacatatccaaagatccgtgggtttatggttcaccgcgcttggaacgctataacggtttgccatcaatggaaatcgtgggtgaggctgttaaagggaaaagtaccggggatgcaatggttttcatggaacaacttgcgtcacaactgccaagcggcattggctatgactggactggcatgtcttatcaagagcgtctatccggcaatcaggctccagctctatatacgctatcattgattgtcgtgttcctctgtctggcagctctgtatgaaagctggtccattccattctctgtcatgttagttgtcccgctgggaattgttggtgcattgctggcaacgtcaattcgtgggttggacaatgacgtctactttaaagttggtctgttgacaacaataggtctgtcagcgaaaaacgccatacttatcgtagaattcgccaaggatctgatagagaaagaaggcaaagggctaatagaagcaactctagatgctgtcaaaatgcgtttacgcccaatactgatgacttctttagcctttatgcttggagttatgcctctagtattgagtaatggtgctggctctggtgcacaaaacgccgtagggacaggcgtattgggcggtatgattgcagctacatcgttagcaatctattttgtcccagtattcttcgtcgtcatcaaacgccgtttcagtaaaaaaagtgaggatctcgaacatatttcgacccatcgctaa

SEQ ID NO: 5084 - DNA, 369 bp, Xenorhabdus bovienii
  Coding sequence Name=Xb4151_4152.C444.gene259.dna; Position on contig= 297134..297502bp; Strand=+
atggatgaatattcaccaagaagacatgatattgttgaattaaaatacttatgtgaaaatttaattcacgaggcattttcagtgctaaatcgcgctgataatcattggattaacgatctgacttccgaaaaaagcttaaaactaaatgaattgatcgagcacattgcagcgttcgtctggagttttaaaattaaatacgcagataactacaatctcagtaccttaattgataaatacctggatgaaacatataatttgttcgggagtgataagataagctgttttgaacttacaaaatggcaaaaaacaaacgaacacttaactaacattctgttgcatgatttgaatgcctgtttaagcaaaacctga

SEQ ID NO: 5085 - DNA, 204 bp, Xenorhabdus bovienii
  Coding sequence Name=Xb4151_4152.C444.gene260.dna; Position on contig= 297551..297754bp; Strand=+
atgactaaaactgactatctgatgcgtttgagaaaatgcacttctattgaaacactggaacgtgtaattgaaaaaaataaatatgagctttcggatgatgaacttgaattgttctactctgctgctgaccaccgcttagctgaacttactatgaataagctttatgataagatcccatcatctgtttggaaatttgtccgctaa

SEQ ID NO: 5086 - DNA, 123 bp, Xenorhabdus bovienii
  Coding sequence Name=Xb4151_4152.C444.gene261.dna; Position on contig= 298172..298294bp; Strand=+
atgttcgatttcttcaacctcgtaaaaacccacgacaatcctgctactatggcaaatcaggcatttagcataaaaaccatcaataagcaaaatataaatatactaaataatcaaaaaaaataa

SEQ ID NO: 5087 - DNA, 1293 bp, Xenorhabdus bovienii
  Coding sequence Name=Xb4151_4152.C444.gene262.dna; Position on contig= 298808..300100bp; Strand=-
atgaaaaaacgacttttatccataaccagcatcactatggggattatcgctagtgtaccttcttttgcgtttgctgcgggaagtactttcgataaagctgatactgtattcatgctggtaaatacggtacttgtgctctttatgactatacctggcatagctctgttttatggaggattgctgcgtcgtaagaatgttttgtcattaatgtcacaggtgattgttagcttttcattagtctgtgtactttgggtagtttacggttatagcatgacctttgaaacaggcaatcgtttttggggtggatttgagcaagtcatgctgaaaaatatatcgataactgatttgaatggcagtttttatcaactgattcatgtcgtttttcagggggcatttgcctgtatcaccatagccttggttgtcggggctttatgtgaaagagttcgtttttctgcactgttaatttttagtgcgttatggctgacagcttcctatattcctatggcgcatatggtgtggggaggaggctggcttgctcaggatggtgcattagattttgcgggaggaactgtcgttcatattaacgcagcggttgcaggattggttggtgcttatttacttggaaagcgctcaggatttggtaaggaagcttttaagcctcataacttgccaatgacttttattggcactgcgatcctttacattggctggtttggttttaatgttggttctgctggtgctgtaaatgccatcgcagcgctagcccttataaatacgatggcagcaacagcaggtgcggtattgtcatgggttttttctgaatggctattccgtgataagccttctcttttgggagcatgttctggttgtattgcgggtttggtggcaattacacccgcagcggcaacagttggtatcggtggtgcgcttatcattggactgattgctggagttgccggtttatggggcgtggtggtattaaaacgctggttacgtgttgatgatgtctgtgatgtttttggagtacatggcgtatgtggcattgttgggtgtttattaacgagtattttcactgcatccgctttagggggaactggatttccagaaggtatgacaatgctaagacagatcggcgtgcagatcattagtatattggtttgtattgtctggtcagctgtggctgcttatctgtcattcaagattgctgatctggtggctgggttgcgtattagcgttgagtcggaaagggaaggcttggatattatttctcatggtgaaagtgcttataactga

SEQ ID NO: 5088 - DNA, 375 bp, Xenorhabdus bovienii
  Coding sequence Name=Xb4151_4152.C444.gene263.dna; Position on contig= 300116..300490bp; Strand=-
atgttccttgcaaacacagcaaaaagcgggggaagtatgaaactgattactaccatcataaagccatttaagttagaagaagtgcgtgaagcgctttccgatattggtatacaaggaatgacggttacagaagtaaagggatttggacgtcaaaaggggcactcagaactttatcggggagccgaatacaacgttaattttttacccaaagttaaaattgatattgctacccatgatgagcgagtagaagaagttatccatgtcatacagcaatctgcattcactggaaaaatgggggatggcaagatatttatctttgaattacagcatgctgtccgtatcagaacgggggaaacgaatgatgcagcattgtaa

SEQ ID NO: 5089 - DNA, 1893 bp, Xenorhabdus bovienii
  Coding sequence Name=Xb4151_4152.C444.gene264.dna; Position on contig= 300622..302514bp; Strand=-
atggcacggttgcgcagcaaggcccgcacaaacagcttattgcacaatccggttggtattctgatatgtaccattatcagcaacttgaagccgaattggatggtgaacatgactaatcatgatatgcgtaagcccagtgtgcgtaagctatggccatcattaaagcgcttattgtcttacagtaagaattatcgcaagccaattttgctggctgtactgatgtcatgggttgctgcgctaacagaagtcagtgggccactgcttgtgagctattttattgataatatggtagcaacgggcaatcttccgcttgatgttgtcagtgggcttgcggttacttttttggtattgcagtttgttgctgctgccttgcactactttcagttcctattattcaatcaggcatctgtggggatagttcagaagcttcgtactgatgtcatgaattcggcattgcgccagccgttgagcaccttcgatagccagcccgttgggcagctaatatcccgcgtgacgaatgatactgaagccattaaggatctgtttgtaaatgtgatccctacagtgtttcgctgcatttcattgatcggggcaatgctgatagctatgtttattttggattggcgcatggcatgtgttgctttgacaatatttccagcagttttgctggtaatgataatttatcagcatttcagtactccaattattagacgggttcgtagttatctggctgatattaatgacggctttaatgaaaccattaatggtatgacagtgattcagcaatttcgccagcaagctcgttttggtgagaaaatgctggcgactaatcgtgaacattatcagtctcgcatgcaagcgttgcggttggatggcattttgctgaggccgttactgagtttgttttctgctgccatactgtgtggcctgctattgttatttggtttcaaaggaacggaagtgattggtgtgggtgttttatacgcattcgtcaattatcttgggcgcctgaatgaacctctgattgaactgactgctcaacaatctttactgcaacaagcggtagtttcaggggaacgggtttttgagttaatggatagcccacagcagcaatatggcactgatcagcaggcgctgatgagtggtagaattgatattgaaaacttaacttttgcctatcgtaatgacaaagttgtgttgagtgacatcaatctacatgttcctacacatgggtttgtggctttggttggtcatacgggaagtggtaaaagtactctgactaatttgattatgggatattatccgtggcaagacggtgaaatttatcttgatggtcgtcctgtatcttccctctctcatgcggttctgcgtaatggcgtagcaatggtacagcaagatcctgtagtgcttgcagcctcatttttcgacaacatcacattggggcgggatatcagtgaagataaaatttggcaggtgttggagatggttcaattggctgattttgtccgccgcttaccagatggtctgaattcagtactaggagagcaggggaatactctttccgcagggcaaaaacaacttttagcaatggctcgagtcctggtgcaaacgccgcagattctcatcttggatgaagcaacggcgaatattgattcggggacggagcaatcggtacagcaggcattgcggatgatccgtaaacagacgactctggtggtcatcgcccatcgtctttcaactattgttgaagcagattccatattagtgctacatcgtggtgcaatagtggagcaagggcagcatcaacagctactggctaaacgtggacgctattatcagatgtatcaactccaacaggtcggtgatattttgaatgaatctatgcacgtttag

SEQ ID NO: 5090 - DNA, 1671 bp, Xenorhabdus bovienii
  Coding sequence Name=Xb4151_4152.C444.gene265.dna; Position on contig= 302399..304069bp; Strand=-
atgattgcgatgctgcaattaattcctccccgtttggtcggaattatcgttgatggcatcagtgcaaaaacgatgtcatccagtcaattattgatgtggctaggcatcatgctgttcattgcgctggcgatatacggtctgcggtatgtttggcgcgtatggctatttggggcgtcttatcggctggctgttaaactacgtagtgatttctaccagaaattgagcagccagaaccctgaattttatttgcgccacagaaccggtgacttaatggctcgtgcaaccaatgatgttgatagggttgtttttgctgcgggtgagggggtgctaactttagtcgattccttagtgatgggatgtgctgtccttatcgtgatgagtatagaaattagttggcaattaacgttgttatcactgttacccatgcccattatggcgttggtgattaaacgatatggcgaacagcttcaccatcgtttcaagtctgcacaaggagcattctctgctcttaataaccatgctcaggaaagtcttaccagcatccgtatgatcaaagcatttggtctggaagatctgcaatccagtcaatttgaagaagtcgctactgatgctggacgtaaaaatatacacgttgcgcgcgtagatgcacgttttgaccccaccattttcattgctattggcgttgcaaacctattagcgattggtggagggagttggatggtcgtacatggctctatgacactgggtgaattgactagctttgttatgtatctgggattgatgatctggccaatgttggcattggcatggatgtttaatattgttgagcgtggcagtgcggcatatacacggatccgtagcttgttacaggagccactggtgattgatgatggttctcagtccttattagttgagcgcggtacattacaggcaaatatcaataccttcatttatcccgcaaatgatagacctattttacatgatgtccgttttcaattatcaccaggtcagctattgggggtttgtggtccaactggtgcaggaaaaagcactttgcttgccttgttacagcggcaatttgatgtcactgacggtgaaattctttttcagtcacggcacgtttctacacttagattagaagaatggcgatcacgattggctattgttaatcagactcctttcctgttttcggatacagtcgctggcaatatcgcgctaggccggcctgatgcaactcaagaacaaattgaagaagttgctcgtttggcgaatgtgcatgatgatattttgcggttaccgcagggctaccaaacggaagtgggagaacgtggcgtaatgctttctggcggacagaagcaacgcatttccattgcacgtgctctgttattggatacggaaattttgattttggacgatgcactttctgccgtagatggtcagacagaacatcaaatcatgaaaaatctcagccagtggcggcgacagcgtaccgttattatcagcgcccatcggctgtctgctttaacggaagctgataacattttggttattcagcatggcacggttgcgcagcaaggcccgcacaaacagcttattgcacaatccggttggtattctgatatgtaccattatcagcaacttgaagccgaattggatggtgaacatgactaa

SEQ ID NO: 5091 - DNA, 462 bp, Xenorhabdus bovienii
  Coding sequence Name=Xb4151_4152.C444.gene266.dna; Position on contig= 304214..304675bp; Strand=-
atgttagataaaatagaccgtaagctactggagctgctccaacaggactgtagccgatccttgaatgcactggccgaagccgttaatttgacctctacaccttgttggaaacggctaaaacggcttgaagatgatgggtacattgtcggaaaagttgcattgctaaatggctctaaacttgggcttagtctgaccgtgattgtgatgataaaaactcaacagcacagtagtgaatggtatgaacagtttgtggcttttataaaagagatgccagaggttttaacattttatcgaatggctggggaatatgattacttgatacatgtagaagttgttgatatgaaaagttatgatcggttctacaaacgcatggttaatggcgtttctggtttgattgatgtcacctctaactttgcaatggaaaaaataaaatatacaacggcgttaccaataccggattag

SEQ ID NO: 5092 - DNA, 1053 bp, Xenorhabdus bovienii
  Coding sequence Name=Xb4151_4152.C444.gene267.dna; Position on contig= 304798..305850bp; Strand=+
atgtcgtcttcatgggctacaaatgccattaaagccatccaagctgattatcaacgaagtgctgatacacacctgattcacctcaatctccccgtgttttcaggaattcacctttatctcaaagatgaaagcactcatccgacaggtagcctgaaacatcggcttgctcgttctttgttcctttatgcactcagcaatggttgggtcaaagaaggaaccccaatcattgaagcctcatccggcagtaccgccgtttctgaagcctattttgcccgcttgcttggcttaccttttatcgccgtaatgccctcctgtacagctaaacgcaaggttcaggaaatcgaattctacggtggtaaatgccactttgtggaacactcagcccttatttatgaggagtcagaacgtttggcaaaaaagctgaatggccattatatggatcaatttacttacgctgaacgagctactgactggcgtggaaacaataacatcgcagaaagcattttccgtcagatgcaactggagccatttcctgaaccaacttatattgttatgagtgcaggaactggcggaacatcggcaacgctcggtcgctatatccgttatcagggatataacaccaaactgattgttgttgatcctgaaaactctgttttctacgattgttatcaccaaaatcgccgtgatatccgcggaatcaccagcagtaaaattgaaggaattggccgcccacgtgcagagccatcctttatcccaactgttatcaatgacatgctgcaagtccctgattgtgccactatcgccaccatttattggcttgaaaaattaattggcagaaaaactggcgcatcaacaggaaccaacgtttggggaactttacagctagccagacagatgcatgagaacaaccagaagggtgcaatcgtgacattgttgtgtgatagcggcgaacgctatcttgatacctattacaatccagaatgggttcgcaataatatcggtgatatcacactgtatctcacgcaactacccaagctagatggttatgagtaa

SEQ ID NO: 5093 - DNA, 699 bp, Xenorhabdus bovienii
  Coding sequence Name=Xb4151_4152.C444.gene268.dna; Position on contig= 305883..306581bp; Strand=+
atgaaacgagccgttgttgtattcagtggtggtcaagattccaccacttgtttaattcaggcactccgccaatacgatgaagttcactgtgtcacttttgattatggtcaacgtcaccgcgctgaaattgacgtggcctgtcgtattagcaaagaactgggtgccgctgcccacaaagtacttgatgttactttattgagtgagcttgcaatcagcagcctgacccgagacaacattcccgtgccggatttcagtgaaagtgaaaaaagtggcctcccaaatacatttgttcctggccgcaacattttgtttttaaccctagcggcaatttatgcctatcaggttgaggctgaagccgttatcaccggtgtttgtgaaaccgatttttctggctacccagactgtcgcgatgaatttgtcaaagccctgaataaagcagtttgccttggtatcgcccgtgatatccgttttgagactcccttgatgtggttgaacaaagcagaaacttgggcattggctgattattatcaaaaattgaatttcgtccgtacccagactctcacatgttataacggcatccaaggcgatggctgtagtgagtgcgcagcctgccaccttcgggctaatggattaaacctttatttaaataatactcaatccattatggaagagatgaaatccaaaacgcatctgagctga

SEQ ID NO: 5094 - DNA, 399 bp, Xenorhabdus bovienii
  Coding sequence Name=Xb4151_4152.C444.gene269.dna; Position on contig= 306640..307038bp; Strand=-
atgcgtacaattattaaggtcaggggctatcatattgatcttttccagcatgtgaataatgctcgttatttagaattcatggaagaagctcgctgggatttgctgacagaaagtgacacactcacgtggttaaaaactaataatgttggctttgccgtagttaatattaacatcaattaccgtctgccggcagtgtttggggatgagttggaagtgaggtctagcctcaaggaattacgtaataaaagtggtgtattttttcaggagattatacgcagaagtgataataaaatactcaccgatgctttgaccacatttgcctgtattgatttgaaaactcataaggcattaactttagagggggatatacaggaaagattagaagcatttaaagtttaa

SEQ ID NO: 5095 - DNA, 576 bp, Xenorhabdus bovienii
  Coding sequence Name=Xb4151_4152.C444.gene270.dna; Position on contig= 307193..307768bp; Strand=-
atgatgccgagattaagatggggcagattgaataaaattgcgaagcttctcgcaactatttttgcaaaacaacaattgaaaaaggccactttcgtggcctttcgcatatttgaacctttcctcttgtccataaattctgttatggcaagctttcctccgtcaacaaaacacggaggaatttatatgaaatatttaaggacattatttaattcacttgttatggttttttgtatcagtatgccgttatctcatgcgattgcagcggatgaatcacctgataaagctgtgaaacaatctaccaatcaacacaaagctgttattgaaaaaaatgatgtgaaggaggggaaagaattagcctcagaaaaggaaattcagggaaaaggaagcatcaatattaatacggcgaatgctgaacaattagtgaaggaactcaatggtgttggcgccaaaaaggctcaggcgattattgaataccgtgaaaaatatggtcaatttacggcaattgagcagttacaggaagttcagggcattggtcctgctttaatggaaaagaatcgggataaattaacctattga

SEQ ID NO: 5096 - DNA, 1872 bp, Xenorhabdus bovienii
  Coding sequence Name=Xb4151_4152.C444.gene271.dna; Position on contig= 307734..309605bp; Strand=-
atgatggacaacctacgcacggcggcaaacggtcctgtgcttaaaattgtattggctttaattatcctgacctttgttttgacaggtgtaacaggctacctgtcaagtgaaggtggtaattatgctgccaaagtgaatggtcaaaccattagtcgtgctcaattagagcaagcatttcagcaagacaaaattgcgttgcaggataggctgggagatcaattctcaactctgttaagtgatgagcagaaagtacaacaaattcgacgcagctcactggatcgcctcatcactgttattctatcagatcaatatgcacgtaagctgggcttgtcagcaagcgatgagcaggttaaagaagagatccgtaacctaccttttttccagacagacggtaaatttgataacaataaatatctgactttgcttaccggtgcaaacagaagcccagataactttgctgaacaggttcgtcaagatctgattaaccgtcaattgatgtcgatattgacgggttcagaaattgctttgccgacagagatcaaacaggaaacagcgctggcctttcaagaaagaacggttcgtttcgctacacttgagctgaaatccattgaagcacagcaaaaagtgacagataaggagctgaaaaactactatgacgttaatagcaatagtttcaccgtgcctgaaaaggtgaaagtcagctacatcaagatggatgctgcggatgaattgaaaagcgtcaccgtatctgatgccgatattgaaaaatattataaaaacaatctgccacagtatatgcaggtcgagcaaaaaaaatacagcatggttcagttggtgtctgatgctgaagctaaatcagttttggatgaattaaagaaaggcgctgatttcagcaaattggcggcagaaaaatcgacagataaattttctgctcaaaagggaggagatctgggttggatggaagaaagctccctacctgatgaaattaagtcagctaagttgatagaaaaagggcagctttctggtgtcatcaagctatctggtggatatgctatttttcgtttagatgatattaaacctcagataataaaatcactggttgaagtgcgttcggaaatagaaaaaatcgttaaacaggaaaaagcggttgatgcattctatgcattgcaaagaaaagtaagtgatgccgctgccaatgataacgaatctttgactgcggcagaaaaagcagctggttataaagctgtgacgactgactggtttgatcgtgaccatattcctgctgaaataaattttggttcggtggttcagactattttctctggaaatcttatcgatgataaaggggcatcaggaactaactccgatgttatttctgtggatggtgacagagcctttattgtacgtgttgatgatatcaagccagaaactatccagccttacgagcaggccaaaactcagattgctgaattagtaaaacgccagaaagctgaaaagcagttgcagcttgaaagtgaaaaactgctggctgctttgaaagaaggtaaaggtgagcaggcactgaaagccgctgggattcagtttggtgtctccactgtgatcaaacatttatcacaaactaatcaggctactaatgtagcatttactctgcctcatcctaaagatggcaagtctgagtatggtttagcccaagatgggtttggcaacgcagtgcttatccaattggataaagttgtcccaggttctgtttcagaagaacaggttaaacaatacatagcggcgtatcagtatcaaatcggtactttcatgctggaatccttgatgattaatttgcgtgatgatgccgagattaagatggggcagattgaataa

SEQ ID NO: 5097 - DNA, 291 bp, Xenorhabdus bovienii
  Coding sequence Name=Xb4151_4152.C444.gene272.dna; Position on contig= 309787..310077bp; Strand=-
atggggatgataagagtgaacaagtcacaactgatcgacaaaattgctgctgatgtaaatatttccaaagcagctgccgggcgtgtagtagatgcattcatttcttcagtatctgatgcattgaaagacggtgatgatgtcgttttggtagggttcggtacttttactgtacgtgaacgtgcagctcgtacagggcgtaacccccagacaggcaaagaaatcaaaatcgcagcagcaaaagtacccgctttccgcgcaggaaagggattgaaagatgctgttaatgagtaa

SEQ ID NO: 5098 - DNA, 2355 bp, Xenorhabdus bovienii
  Coding sequence Name=Xb4151_4152.C444.gene273.dna; Position on contig= 310304..312658bp; Strand=-
atgaaccctgagcgttccgaacgcatagaaatccctgtattgcctttgcgcgatgtagtggtttacccacatatggtgatccctctgtttgttgggcgtgagaagtcgattcattgcctggaagcagcaatggatcatgacaaacaggtcatgttggtcgcgcaaaaagaagcatccactgatgagccgggagtcaatgatcttttctccgtaggtacagtggcttctgtgttacagatgttgaaactgccagacggcacagtaaaagttctcgttgagggtttgcagcgtgcccgtattacaacattgacggataatagtgagtacttctatgcgcaggttgaatatcttgaatcccctgtcgttgatgaacgtgagcaggaagttctggtaagaaccgccattaatcagtttgagggttatgtcaaactaaacaagaagatcccgccggaagtattgacatcattacacagcattgaagatttagcaaaactggcagataccattgctgcccatatgcctttaaaaattaacgataaacagactgttttagaaatgtctgatgttgttgaacgtattgaatatctgattgcaatgatggaatcagaaatcgatctgttacaggtagaaaaacgtatccgcaatcgcgtcaaaaaacagatggaaaaaagccagcgcgaatactacctgaacgagcaaatgaaagcgatccagaaagaattaggtgagatggatgatgcacctgatgaatatgaaacgctgagacgtaagatcgaagacgctaaaatgccgaaagaggcacgcgaaaaggtcgaagccgagctgcagaaattaaaaatgatgtctccaatgtcagcggaagcgacggtggtacgcagctacattgactggatggtacaagttccttgggttgctcgcagcaaggtgaaaaaagatttggtcaaggcgcaggaagtgctggatatagatcattatggtctggagcgcgtcaaagagcgtatccttgagtatctggcagtacaaagccgtgtcagcaaaatcaaagggccgattctgtgcttggtagggcctcctggcgtaggtaaaacctcactgggccgttctattgcgcgtgcaactggtcgtaaatatgttcgcatggcactgggtggcgtacgtgatgaagcagagatccgaggtcatcgccgtacctatattggttccatgccgggtaaactggttcagaagatgtccaaaattggggtcaaaaatccactgttcctgttagatgaaattgacaaaatgtcatctgacatgcgtggcgatccggcttctgcattgctggaggttcttgatcctgaacaaaacgtgacatttaatgatcattaccttgaagtggattacgatctgtctgatgttatgtttgtggcaacgtccaattcgatgaacattccggcgccactgcttgatcgtatggaggttattcgtctgtcgggttataccgaagacgaaaaactgaacatcgccaagcggcatttactgccaaagcagattgagcgtaatgctttgaaaaaaggtgaattggctattgatgacggtgcgattctcggtattatccgttattacacccgtgaagctggtgtacgtaatctggaacgtgaaatttccaaactgtgccgtaaagctgttaaggcattgttgatggataagaagcttaagcacatcgaaatcaatgcggataatctgaaaaattatctgggtgttcaacgtgtggattatggtcgtgcggatactgagaaccgtgttggtcaggtgactggccttgcatggaccgaagtgggtggtgaactgttaacgattgaaacagccagcgtgccaggtaaaggaaaactgacctatacgggttcgttgggtgaagtgatgcaagagtccattcaggcagccttgactgtggttcgggctcgtgccgataaactgggtatcagttctgatttccatgaaaaacgtgatattcacgtccacgtacctgaaggtgcaacaccaaaagatggcccaagcgcaggtattgcaatgtgtactgcgttggtttcctgcctgacaggtaatccggttcgtgccgatgttgctatgacaggcgaaatcactctgcgtggtttagtactgcctattggtggtttgaaagaaaaactgctggcagctcatcgtggagggattaaaaccgtcttgattccagatgaaaataaacgagatctggaagagatccctcagaatattattcaagatttggagatccatcctgttaagcgcatagaagatgttttgtctattgctttacagtctcctgcgtttggagcagaagcagtatcactaaattag

SEQ ID NO: 5099 - DNA, 1272 bp, Xenorhabdus bovienii
  Coding sequence Name=Xb4151_4152.C444.gene274.dna; Position on contig= 312868..314139bp; Strand=-
atgacagataagcgcaaagacggttcaggaaagctgctgtattgctctttctgcgggaaaagccaacatgaagttcggaaattaatagctggcccgtcagtgtatatctgcgacgaatgtgttgatttatgtaatgatatcattcgcgaagaaattaaagaactagtaccacaccgtgagcgtagcgccttgcctactcctcatgaaattcgtcaacatctggatgattatgttatcggtcaggaaacggcgaagaaagtgttagcagtcgctgtttataaccattacaagagactgcgtaatggtgacactaataacggtgtggaattaggaaagagtaatattctgctgattggcccaacaggtagtggtaaaaccctgcttgctgagacactcgcccgttatttagatgtgccttttactatggctgatgctacgacactgactgaagctggttatgttggtgaagatgtagaaaatattatccagaaactgctgcaaaagtgtgactacgatgtgcagaaagcgcagcgtgggattgtatatattgatgaaatagataaaatttctcgcaaatctgataatccgtcaattactcgtgatgtctcgggagagggcgttcagcaggcacttttgaagctgattgaaggtacagtggcagcggttcctcctcaaggtggccgtaaacatccacagcaggaatttcttcaggttgatacctctaagatcttgtttatctgtggtggtgcatttgcaggattggacaaagttattagccagcgtttgaatgtcagctcgggtatcggttttagtgctacagttaaaggcgagtcggagaaagcaacagaaggcgaattgcttgctcaggctgaaccggaagatttgatcaaatttgggttaattcctgaattcattggccgtctgccagttgtggcaacattgactgaactaagtgaagatgcattgattcagatcctacaagagccaaaaaacgcgttgaccaaacagtatcaggctttgtttaatctggaaggtgctgaacttgagttcagaaaagaagcgctgacagcgattgcgaagaaggctatggcgcgtaagactggtgcacgtggtcttcgttcaatcgtagaaggtgttttactggatacgatgtatgacctgccatcaatggaacatgtagaaaaagttgtcgttgatgaaacggttgttgaagagaaatcagcgccattattgatatatagcaagccggatgcccaagtttctggtgagtga

SEQ ID NO: 5100 - DNA, 624 bp, Xenorhabdus bovienii
  Coding sequence Name=Xb4151_4152.C444.gene275.dna; Position on contig= 314283..314906bp; Strand=-
atgtcatacagtggcaagcaagataaatatgcacctaacatgtctttggtgccgatggtggttgaacaaactgcacgtggagaacgtgcattcgatatttactcccgtttattaaaagatcgaattatttttctgactgggccagttgaagatcatatggcgaacttaattgttgcccaaatgttattcctggaagcagaaaacccagaaaaagatattaacttatatatcaactctccgggtggggttattacagcgggtatgtctatttatgacacgatgcaatttatcaagccggatgtgagtactatctgtatggggcaagcctgttcaatgggggcattcctgttgacagctggagcaaaaggtaagcgtttctgtctgccaaattctagggtcatgattcaccagccattaggtggtttccaagggcaggcgacagatattgaaattcatgcgcaggagatactcaaggttaaagctcgcatgaatgagttgatggcgaaacatactggcaaaccacttgagaagatcgtcgaagatacagaacgcgaccgtttcttatcagctgcagaatccgtagaatacggtttggttgatagtatatttacccagcgcaactaa

SEQ ID NO: 5101 - DNA, 1305 bp, Xenorhabdus bovienii
  Coding sequence Name=Xb4151_4152.C444.gene276.dna; Position on contig= 315165..316469bp; Strand=-
atgcaagtttctgttgaaaccactcaaggccttgggcgtcgtgtatcaatcaccgttcctgctgccgacattgaaaaagcaattagcagtgaattggttaatgtagcgaaaaaagtccgtatcgacggtttccgtaaaggcaaagtgcctatgaatatcgtcaaacagcgttacggcgcttccgttctgcaggatgttcttggtgatctgatgcaacgcaatttcgtcaatgcgatcattgagaataaaattaatccagcaggcgcaccaagctataaaccagagcagtttaaagatggtgaagacttcatttatgctgttgagtttgaagtttatccagagatcgaactgaaaggtctggaagagatcgaagttgaaaaaccggttgttgaagttaaagatgcagacgttgacgctatgctggaaactttgcgtaaacaacaggcagattggaaagaaactgatgaagcagcggctgcggaagatcgcgtcactgttgacttcactggttctgttgatggcgaagagttcgaaggcggcaaatcaactgatttcgttctggcaatgggccagggccgtatgatccctggttttgaagagggcgtcgttggccacaaagcgggtgaagaatttaccctcgatgtgactttcccagaagattatcatgcagaaaacctgaaagggaaagctgcaacgtttgctatcaacctaaagaaagttgaacagcgtgaactgccagaactgaccgaagagtttatcaaacgttttggtattgctgacggcactgttgatggtctgcgtactgaagtgcgcaaaaatatggaacgtgaactgaagaacgcggttcgtagccgtatcaagactcagatccttgatggtctggttaatgcgaacgaaattgaagttccagcagcggttattgatggcgaaattgatgtgttacgccgtcaggctgctcagcgtttcggcggcaatgaaaaacaagctctggaattgccacgtgaactgttcgaagaacaggcaaaacgccgcgttgttgttggtttgttgttaggtgaagtcattagcagcaatgagctgaaagttgacgaagatcgcgttaatgtgttgatcgaagagatggcttctgcttacgaagatccaaaagaagtgatcgaatactacagcaaaaataaagaaatgctgaacaacgtccgcaatattgctctggaagagcaggctgttgaatttgttctgaataaagcaaaagtttctgaaaaagaagtcggctttaatgatcttatgaaccaaaatcaactggcataa

SEQ ID NO: 5102 - DNA, 228 bp, Xenorhabdus bovienii
  Coding sequence Name=Xb4151_4152.C444.gene277.dna; Position on contig= 316488..316715bp; Strand=-
atgtttatcacagaagtcaacgaatattgcctgcttctgtctgcaattctcgactcatactgtctgcgtcgctataatgctgcgtctgaatttttagaatggtttcgggacgcttctgatcacagggattctcggtttttaaatacgaccgccccggttcttgatgagtgttgtaatcagccagtttttcaggcattacgacattctgaagttgaccgagcactatga

SEQ ID NO: 5103 - DNA, 324 bp, Xenorhabdus bovienii
  Coding sequence Name=Xb4151_4152.C444.gene278.dna; Position on contig= 316854..317177bp; Strand=-
atggttcgtcaggaaatagaaataaagttacaggcggcatttaagccttctcatctggaagtgatcgatgaaagttatcgtcataatgtgccagcaggttctgaaagccattttaaaataattgtgatcagtaatgaatttgtcgatcatcgagtacttaaccgccatcgcgcagtatatagtgtcttagccaaagagctggaagaaggcgtacatgctttagcgcttcatacttatacggaaaaagagtgggcagaattgggagacactgttctagcttcgcctgcatgccggggaggaagaacgacgacgtcaggtttgtga

SEQ ID NO: 5104 - DNA, 648 bp, Xenorhabdus bovienii
  Coding sequence Name=Xb4151_4152.C444.gene279.dna; Position on contig= 317352..317999bp; Strand=+
atgattgcgactgtttatactaccggtattaatatatcgggtatccgtatcctgaatgagaaaatctacatgctaaaaaaaatatttacttcattgcttgcacttttctttttagctggctgtgcaaactccggcaatacattggcaattcaaccaaaaattaccctgccacccgtagatccgacaatgaaagcgatcacaatcagtattagtggggtcgatcatcgtcaatctcaagcactggctcaagttaaccgtgatgccagactggttaccctgacaccttcccgtgatttacggtttttactccaagaagcactggaaaagcaaatggtagctcgcggctatatgattggttcccccgccaatgccaacttacaagtcgttgtgaatcagctttatgccaatgtaaaggaagggagtctacgccacgatatttctacaaaagcagaaatctccattattgtttatgcccaagatggcagtcagcaaatcaaaaactatcgcactagctacaatgttcaagggccattaagtgcaacaaatgcgaaaattgctgatgccgtaaacacagttttatctgacgtgatcgcagacatggctcaagatttgtcagtcagcaccttcatcaaacaaaacgttcgctaa

SEQ ID NO: 5105 - DNA, 1503 bp, Xenorhabdus bovienii
  Coding sequence Name=Xb4151_4152.C444.gene280.dna; Position on contig= 318072..319574bp; Strand=+
atgactaatcattatctcaataagctatccacactacgcaattattacatccttcttttactaggttttgcctctggtctacccctagcactcacgggaggaacattacaggcatggatgacaattgaaaatctggatatcaaaaccatcggttttttcactttggttggtcaagcctatgtctttaaattcctctgggctccggcaatggacagatattcgccctcatttttagggcggcggcggggatggatgctggtcactcaactcctgcttatcgtcagtattgccacaatggctttcctcaaaccatctgaacatttatggtggctcgcagcattagccgtctctgtcgcattcttttccgcttcccaagatattatctttgacgcctataaaaccgacttactttcacaggaagagcgcggttccggtgccgcaatttccgttctggggtatcggatagccatgctggtttccggtggtttagcattgtggctgaccacctatattggctggcagaatatgtacttgataatggcaggtatgatgctcattggtgtttatgccacacttactgccaaagaaccaaaaattaatacagcgccaccaaaaacattacatcaggcagtattagaacccttatctgatttctttagccgaaacaatgcctggcttatcctgctattaattgtactgtataagcttgctgatgcatttgcgctctctctcagtacaacgttccttatacgtggtgttggcttcactgctgctgaagtcggtatgatcaataaaaccctcggtctggctgctaccattgtaggcgctctatatggcggctatttgatgcataaatggagcctgtttcgcgctctgatgatatttggcattctccagaccgtttcaaatttgagttattggatacttgccgttactcccaaagacatctacgtgatggggggcgctgtttttctggaaaatatctgtggtggcatgggaacagcagcgtttgtcgccctgttaatgaccttatgcaataaatcattttcagcgacacaatttgccctgctttctgcattagcagcaattggacgggtttatgtcggcccggttgcggggtggttcgctgaatctcatggctggcctatgttttatctgttctccattttcatcggattaccgggtctgtggcttttatttatctgccgtaatacactgacttataccgaaaaaaacgataatttcatttcccgcacattattcaagagctattatcggattgccttcattatcatgctgctcgccgcctccatatttataatttggttaatctgtagctgcctgataattatcatcagtagtattactcattttatcgtcctcgatggacttcaaaaagcaatttcgcccgtattctcattcagtatcgcaatgggtactgtaggacttctattgggaggagcgctggattatttagctttgaggaaaaccaaattcgcttag

SEQ ID NO: 5106 - DNA, 270 bp, Xenorhabdus bovienii
  Coding sequence Name=Xb4151_4152.C444.gene281.dna; Position on contig= 319838..320107bp; Strand=+
atgaaaagacatattttgacactcaccgcagttgctactgccttggtttctgcatcagccagcgcggaataccagtggggttttgccaatgtcagcatgaactaccttgactggaccaaacacaccactcaaaaaacagggcagacctcacataaagatgactttgcttatttggaactagaaggtggatcagagttcagttggggcgagctatatggtttccttgatttagaaaatccatttaacagcaaaactgcacagccccggtga

SEQ ID NO: 5107 - DNA, 354 bp, Xenorhabdus bovienii
  Coding sequence Name=Xb4151_4152.C444.gene282.dna; Position on contig= 320253..320606bp; Strand=+
ttgggctataacaccacactggctggtgtttggttcaaaccttttgtcgcacttcactatgttgatcaaactttttactcaggtaataatggttatgtcgtaggctgggttgcagggtacgatttccaactctggcaagaaaaattcagtattacgaactggaatgaaattgagttgaaccgtaatcagcgctacggcaacggtggccgagagggtatcaatggtgctgtcgggttatggtggactccacatccttcctttactactgggattcaatatcgctatgcggataacaaattaggcgaagatttcttgcaggatggcattgtttacagtgtaaaatataacttctaa

SEQ ID NO: 5108 - DNA, 957 bp, Xenorhabdus bovienii
  Coding sequence Name=Xb4151_4152.C444.gene283.dna; Position on contig= 320966..321922bp; Strand=+
atgaaatacaaaaaaactattgggttgtcgtcattactcgcagccactttaatgctaagcggttgtgatatggtattgatgaatcccaaaggggcgatcggcgttgagcaaaaaacgctgatactgacagcgtttggcctgatgctgatcgttgttattccggctatcgtaatggcaatcatttttgctctacgttaccgggaagccaataaatctgctacttaccgtccaaactgggcacactcaaataaaattgagcttgtcgtctggactgtgcctattctgattatcatcgtcttggcaactattacatggaaaacgactcaggaactcgatccatataagccattggactatgaagaaaaaccggtaacgattgaagttatttcccttgactggaaatggctatttatttacccagaacaaggcattgcgacagtaaacgaaattgcattccctaccaatgttcccgtgaacttcaaaatcacgtcagactctgtgatgaactcctttttcatcccacagttaggcggtcagatttatgcgatggcaggcatgcagacaaaactgcacttgattgctaacacaccggatacatataaagggttctcagcaagctatagtggcgaaggcttctctggcatgaaatttactgcaacagcaacacccgatcgtgaaagttttgaacagtgggtgcagaaagttaaggcatcacctaaaaccctggatactgtgcaggcgtttaatgacttagctgaaaaaagccaaaataatcctgttgaatacttctcaagcgtgaaaccaaagctattccaagaaactatcaccaaattcatgggtgacatgaaacatggtggtatgtttggtacggcaggtcacggcaaaacagaacatggtgaagctgcggatcataatatgcatatgagtcagccggctcatgcaggtgttgaggaataa

SEQ ID NO: 5109 - DNA, 1983 bp, Xenorhabdus bovienii
  Coding sequence Name=Xb4151_4152.C444.gene284.dna; Position on contig= 321927..323909bp; Strand=+
atgtggggaaaattaacactggatgcaatcccactacatgaacccattattgtggtgactctgattgcaatccttctcgggggactggcggttgtcggtaccttaacttatttccgtaaatggaaatggctctggagcgaatggttaaccagcgttgaccataaaaaaatcggtatcatgtatatcgtcgttgccatggtcatgatggttcgcggtttcgctgatgccatcatgatgcgtggacagcaagctctggcttccgcaggtgaagccggcttcctgcccccgcaccattatgatcaaatatttaccgcccacggcgttatcatgatcttcttcatggcaatgccgttcgttgtcggtctgatgaacatcgtagtacccctgcaaatcggggcgcgtgacgttgctttcccattcctgaactcactgagcttctggttattcgttgtcggtgtcgtactgatcaacctctccctcggtgtaggtgagttcgcacagacaggctggctggcctaccctcctctatcgggtaaattatacaaccccggggttggtgttgattattggatatggagtctccagctctccggtatcggtacattgctgacgggcgttaacttcttcgtgactatcctgcgtatgcgtgcgccagggatgtctatgatgaaaatgcctgttttctcatggaccgtactgtgtactaacgtactgattattgcagcattcccaatcctgacagtcactgttgcactgttaactctggatcgttatatgggcacccatttcttcaccaatgatatgggcggcaatatgatgatgtacatcaacctgatctgggcttggggccatccagaagtttacattctggttctgcctgtctttggtatattctctgaagtcacagcaaccttcgcgaaaaaacgtctgtttggttatacctctctggtatgggcgacgattgttattaccattctgtcgttcattgtatggctgcaccacttctttacgatgggctctggcgcgaacgtcaacgccttctttggtatcgccacgatgattatctctatcccaactggggttaagatcttcaactggctgttcaccatgtaccgtggtcgtatcgaatttaaaaccccaatgctgtggactgttggcttcctcgtcactttctccattggtggtatgacaggtgttctgctggccgtacctggtgcgaacttcgttctgcataacagtttgttcctgattgctcacttccataacgttattattggtggtgtggtatttggctgcttcgcaggtactgcttactggttcccgaaagcgtttggtttcacactgaacgaaaaatggggtatccgtgcattctggttctggatcaccggtttcttcgtagcctttatgccactgtacgcactgggcttcatgggcatgacccgccgtctgagccaagatatcgaccctgcatttcacactatgctggttgttgcagcgggtggcgttgtcttaattgctcttggtattctgtgtcaggttattcagttctacgtcagtatccgtgaccgtgaacaaaaccgtgatctgactggtgacccatggggtggccgtactttggaatggtcaacttcatctccgcctccattctataactttgctgaagttcctcatatccagactcgtgacgcatggtgggatatgaaggagaaagacactgctcataaacgtccggctaaatatgaagaaattcatatgcctaaaaacacaagcgcgggcatcattatcagtgcgttcctcctgatcttcggctttgccatgatctgggatatctggtggctggctatcgcaagtttcgccggtactatcatcacttggatcgtgaaaagctttgacgaagatgttgattactacgttcctgtagctgaagttgaaaaaactgaaaatcagcattacgaagaactgagaaaggcaggtgtgaaataa

SEQ ID NO: 5110 - DNA, 612 bp, Xenorhabdus bovienii
  Coding sequence Name=Xb4151_4152.C444.gene285.dna; Position on contig= 323909..324520bp; Strand=+
atgtcgactcaaacccttaacaacacagccgcccatgagcatcatgggcaccatgacgtaggctccatgaagatatttggcttctggatctacctgatgagtgacttggttctgtttgcaagcctgttcgccacttatgcagtactggccaacggcacggcaggcggtccatccggtaaagatatttttgaattgccatttgttctggtcgaaaccttcctgctactgttcagcagtatcacctatggtttcgccatgctgagcatgaacaaaggtaaaacaggccaagttaacttgtggctgttcattactttcttgttcggcctcggtttcgtttcgatggaaatctatgaattccataaactgatttcagaaggttttggccctgatcgcagtgcattcctgtcatccttctttgctttggttgccactcacggtatccacgtaacttgtggcttgatctggattattatcatgatggttcaggttgcacgccgtggtctgacggaagtgaatcgtactcgtctgagttgtctgagcctgttctggcacttcctcgacgtagtatggatttgtgtatttactgtcgtttatctgatgggagctatgtaa

SEQ ID NO: 5111 - DNA, 378 bp, Xenorhabdus bovienii
  Coding sequence Name=Xb4151_4152.C444.gene286.dna; Position on contig= 324475..324852bp; Strand=+
atggatttgtgtatttactgtcgtttatctgatgggagctatgtaatgagtcatccaaatacttctcattccggtgccgaccacggcagtttcaaaacctacatgattggttttatcctgtcagtcatactgaccgtaattccattctggatggtgatggatggcagtgcttcccagagcacaatcctgcttacagttatcggcatggccgtgattcagatctttgtacatttcgtctgttttctgcacatgaacacatcgtctgaagaacgttggaacctcgtcgctttgatattcacattgcttgtcatcgctatcgttgttgtcggctctctgtggattatgtacaacctgaacatcaatatgatggttgattaa

SEQ ID NO: 5112 - DNA, 885 bp, Xenorhabdus bovienii
  Coding sequence Name=Xb4151_4152.C444.gene287.dna; Position on contig= 324866..325750bp; Strand=+
atgattaagcaatacctgcaagtgaccaaaccaggaattattttcggaaatctaatttctgtggttggaggttttctactcgcttccaagggcgtaatagattacccattgttctttgctacgatgctcggagtatcgttggtagttgcatctggttgtgtatttaacaactatatcgaccgcgatatcgaccgaatcatggagagaacaaaaaacagggtccttgttaaagggcttatcgatccgaaaatcagcctgatttacgcctcagtgctaggtattgctggcatagtgctgctctatatagcagccaatgctttagcaatgcagttagccctcatcgggtttttgatttatgttggggtttatagcctctacatgaaaagaaaatctgtttacggcactctggttggtagcttgtcaggtgcagcacctccagttattggttattgtgcagtaacggggcagtttgacacaggggcactcatactgttgttaatcttcagtttatggcaaatgcctcactcttatgccattgctatttttcggttcaaagattatcaggccgccaacattccagtattgccagtaattaagggtatttctgtggcgaaaaaccacatcactctatatattctggcctttatggttgccaccttgatgctgacaatcagcggctacgcaggttacaaatacctcatcgtagccgccgcagtgagtatctggtggttaggtatggcattatcgggttataaaactgctaatgatcgtatctgggcccgtaagttatttatgttttctattgtcgctatcatgtctttaagcgtcatgatgtctgtcgattcaacagcatctccagaaactcttctgacttacgttcggtaa

SEQ ID NO: 5113 - DNA, 1368 bp, Xenorhabdus bovienii
  Coding sequence Name=Xb4151_4152.C444.gene288.dna; Position on contig= 325938..327305bp; Strand=+
atgaacgataataaaatgactccgcttgaacttcgagcaacatggggcttaggttctgttttttctctgcgcatgttaggtatgttcatggttttacctgttttaacgacctatggcttagaattacggggttccagcgaagcgctgatcgggattgccattggcatctacggcttgacacaggcaatatttcaaatcccattcggattgctttcagacaaaatcggtagaaaacccctaatcatcggtgggctgcttatctttgttctaggcagtattactgcggctttgagcgactctatttggggcattattatcggcagagccttacagggtgctggggcaatatctgctgcaatcatggcattactttctgatcttactcgcgaacagaatcgtacaaaagcgatggcattcattggcattagttttggtattaccttcgcctttgctattgttattggccctatcatcacacaccaaatagggttaaatggcctgtttggcgcaatagcgatcctggccagttgtggtatcttgatcaccttattcgctgtacctcctgctcataaacacatactgaatcgcgaatctggaattgcccgtggcagttttcgacgtgtgctctctgactctcagctactaaaactcaattttggtattctcagcctgcatactttattaatgtcgagttttattgctctccccctcatcatggaaaaagcagactttccaccacaacaacactggaaagtttacttaattactaccctcatttcttttattgctgttttacccttcattatctacgcagaaaaaaaacgccgtatgaaacaggtttttttactttgcatcggcctattattcatcgccgaattaattttatggtcagtgagctcacacctttggggaatttttgcaggtattcagatattcttccttgcttttaatatcatggaagctattttaccatcactcatcagcaaagaagcgcccgctggttacaaaggtacggcgatgggtatttactctaccagtcaattcctcggtgtcgcattgggaggtttcctcggtggaatgctctatgaactgcaaggcgcatcattggtatttatggggggtattgtgctaaccgcactctggtttattatcagcctgacactacatcaaccaccttatgtcagcagcatcagaattgtcttacccgatcaattgaataatcctgacatcttagaaaagaaaatattgtcacaggcgggtgtgaaagatattgtcatcgcattagaagaactcagtgcatatgtcaaagttgatacaaaacagaccaaccgagagcaattagaacagcttgtgctgtctcataaataa

SEQ ID NO: 5114 - DNA, 1497 bp, Xenorhabdus bovienii
  Coding sequence Name=Xb4151_4152.C444.gene289.dna; Position on contig= 327414..328910bp; Strand=-
atgtcaaagttaactcagttggatcctcgcagtgaagaatcttaccgtttagatcattttatttcggcaacagaaacaacaaaatttagttatacatctggaagagttgctttacccgtttataataaatataacgttaaaaataaacctaaggtcataggttattatactgattggtcacaatatgatagccgcctgcaaggtaatcaaactccttcagcgcggggaagaggtattgatttacaacacttgcttgataaccctttcgcctatgataaattaattatcggtttctgtgggatagtaggtgatcaaggtgagaaaaaagcgttaatttctcgggcagcaccgaagtttggtcgttacaataatggtgaagtcacatttaccgatgaatggggcgattgtcaatcttatgtaaactgtactttccctaggtggcaagacgttcaaatgcccagagatttcaagcaggacaaatctatgggagtgctaggtgggttggcaaaaatacaggatgcagcaagggcgcaaggccatgaactagtaatgtcattcagcgtcggtggttggaccatgagtaatggtttttacaatatggtcaggaacagccaattgaaatccaaatttatttccagtttgatcgatatctttaaacgcttccccatgttcactgaagtagatattgattgggaatatcctggagcgaaaggaaacgataacccgcacgacccgaaagacggtgagtattatattagcctaatccgagatttatcttctgcatttaagaatgcaggacgttctgatattaaaattagtatcgcttgctctgccgtaccagatattatggaaaaatccaaaatacctgaattattaaaggttggattatatggaattaatgtcatgacctatgatttctttggtactccgtgggctgataagttaaggcaccatactaatttgcgccgttatcctggtagtgaaaatagtgtggaaaaagcggttgagtatctactcagtgttggtgtgccatctcaagctatcaatattggttatgctggatattctcgtaatggcaaaaatactaatattaccagttattcaccattatcgggcagctatagccctgaaatgggtacgacgactgggacatttgagtccggttcaacagaatggtatgacacgatatataattatttgaatctagagtctcgtcaagatagaaatggttttaccctttatacagatgaagttgcggatgcagactatctttataaccaaaacagtaaattgtttatatcactggatacaccgcgtacagtgaaagccaaagcaaaatatgcattggaaaaaaatctaggtggagtatttacttggacagcagatcaggacagagggccattagtgaatgcagctcgtgaaggtctggggtgcccattgttgattaagaaaattgacatggagcctttctattataaaggcaaaactaacaaataa

SEQ ID NO: 5115 - DNA, 492 bp, Xenorhabdus bovienii
  Coding sequence Name=Xb4151_4152.C444.gene290.dna; Position on contig= 329194..329685bp; Strand=-
atgccatcatttgatattgtttcagaagttgatatgcaggaagtgcgtaacgcagtagagaacgcacagcgagaattaaccaatcgctgggattttcgcaacgtcaatgcgagttttgaattaaacgagaagaacgaatcagttaagattgcgagtgaatctgactttcaagtcaaccaattggttgatattcttcgtgaaaaatttgccaagcgtggagttgatggctcggtgctcaatgttgctgaaaatatggttcatagcggtaaaacctttagtgtagaggcaaccttactgcaaggtattgatacaccattggcgaagaagattgtgaagctgatcaaagacagcaaactgaaagtgcaggcacagattcagggtgaacaagtccgggttacaggcaaagcgcgcgatgacctgcaaagtgtgatgacactggttcgtggtgcagagttggggcaacctttccagtttactaatttccgtgattaa

SEQ ID NO: 5116 - DNA, 1134 bp, Xenorhabdus bovienii
  Coding sequence Name=Xb4151_4152.C444.gene291.dna; Position on contig= 329676..330809bp; Strand=+
atgatggcattaccagtcacctcctccttatcaataagttggcatgataaccgctttccattattggcaaaagatctatactcgggaggttctgcgatcttttggcatttacgctactttctgagctcgtttgatttgagatcgtttgatttaaggccgtttgaaatcagcattgtttcgaggttctccataaaagtgcctctcatctcaaggaagtatatgaaaatcaccgttcttggctgtggtgctataggtaaactgtggcttgtggccttatcccagcaaaatcatgacattcaaacatggataagggttccacaaccttttgtctcggttcgtatcgataacttcaatggtaaggtatttgatcaacaatttcctgccaatgacgaaaaacatctcaccgaaagcgaattgttgctcgtctgtttaaaagcatggcaagtttccgatgccatcaataacctcgcccctaaactttcccctcattgtccgatcctgttactacacaatggaatgggatcacaggaagaatttttacctttgcccaaccccattttacttggtgtgaccactcacggctcctatcaggaaaatggcattgtttaccacaaatcgcaaggtattacccatattggttccgcaacggctaacgccgataaattcagttttctggcggatgtcttacactatgcactacccgatgtggcatggcacaatgaaatccacaccatcagttggctcaagcttgccgtcaactgtattatcaatccactcacagtaatttatgactgcaaaaatggcaatctattgcagcatactgcgcaaatcgatttactgtgcgacgaaattcaccaagtgatggaacgcgataatctgcatacgaccaaacagatgcttgttgattatgttatgaatgtgattgaacagacttccgaaaattattcatccatgctacaggatatacgagcacaacggcatacagaaatagattacattacaggttttttactacgccgagcccgtgcttatgggttgcccattaaagaaaatactattatttatcaatatattaaacgaaaggaggaggagtatgaacgcctccgccctcatctgcctggctcacggcagtga

SEQ ID NO: 5117 - DNA, 222 bp, Xenorhabdus bovienii
  Coding sequence Name=Xb4151_4152.C444.gene292.dna; Position on contig= 330769..330990bp; Strand=+
atgaacgcctccgccctcatctgcctggctcacggcagtgaagaaaccgaagctgttaccactattgatttactggttcgagcagagattgatgttaccgaaagcggtaccgcaacagatggtaccctcatactaacgtattcacgtagcgtcaaaatcgttgccgatacaccgaaagggtcaatttgctgcacagctagtattgccacttggtgtcaataa

SEQ ID NO: 5118 - DNA, 1449 bp, Xenorhabdus bovienii
  Coding sequence Name=Xb4151_4152.C444.gene293.dna; Position on contig= 331078..332526bp; Strand=-
atgaagtttatcattaaattattcccagaaattacgattaagagccagaccgtccggttacgttttattaaaatccttgccagcaatatccgcaatgtgctgaaaacattatcagaggagattgctgttgtccgccactgggataatatcgaagttcgagctaaaaatgataaccttggtggagaaatttgtgatgcactaacacgtatcccaggtattcatcatatcctgcaagtagaagagcgagattttcgtgacttgcatcatatttttgaacaagcttacgaagcctatggccatttgctgcatggaaaaacattttgtgtgcgtgtaaagcgtcgaggtaagcatagcttcacttccaatgaagttgaacgatatgtcggtggtggcctgaatcagcacattgaatccgccaaagtgaaattaacgcatccggatgtgacggtaaatttagagattgaacaggataaactgattctggttaaagctcgtcatgaagggatcggtggttttcctatcgggacacaggaagatgtactgtcgttgatctcgggtgggtttgattccggcgtttccagttacatgctgatgcgccgtggctgccgcgtacactactgtttctttaatcttggcggttcagctcatgaaattggtgtgaaacaggttgcccattatttgtggaatcgatttggcagttcccataaagtccgttttgttgctattgatttcgaaccagttgtcgcggagatcctcgaaaaagtggatgacggccagatgggagttgtactgaaaagaatgatggtcagggcatcttccaggattgcagagcgctacggtgtacaggcaattgtgaccggagaggctttggggcaggtatccagccagactttaactaacttaaggctgattgacaatgcttctgatacgctgatcctccgccctctgatttctcatgataaagagcacatcattaagttggctcgtgagattggtacggaagattttgctcgtaccatgcctgaattttgtggcgtgatttcaaaaagtccaactgtgaaagcggtgaaagctaaaattgaagcggaagaagccaattttgattttgagattctggatcgtgtggtaagcgaagctcaaaatatggatatccgtcagattgcaatgcaggcgtgtgagcaggttgttgaagtggaaacagtcactgagttttccaccagtgatgtgctactggatattcgtgcgccagatgagcaagatgatcgcccattaagtatggatggaatcgaaattcagtcattgcctttctataagttgggcactcagtttggtgatctgccaaaagagaaaaattacctgctttactgtgaaagaggcgttatgagccgcttacaggctctttatctacgagagcaaggtttcgaaaacgtgaagatttatcggccttga

SEQ ID NO: 5119 - DNA, 258 bp, Xenorhabdus bovienii
  Coding sequence Name=Xb4151_4152.C444.gene294.dna; Position on contig= 332756..333013bp; Strand=+
atgcctaaagcaaatcaaacatcagaaatcgaacagacaccagcgtttgagacttccctgaaagagctggaggaaattatcactcgtctggaatcagggaaactccccttagaaagtgcattaaatgagtttgaacgcggtattcaacttgcaaggcagggacaaaaaaccctccaacaggcggagcaaagagtgcagattttattgaatcatgatgcacaatcgccacttgatgaattttcgcctgacgctgagtaa

SEQ ID NO: 5120 - DNA, 969 bp, Xenorhabdus bovienii
  Coding sequence Name=Xb4151_4152.C444.gene295.dna; Position on contig= 332967..333935bp; Strand=+
atgatgcacaatcgccacttgatgaattttcgcctgacgctgagtaaatttatgtctgaacaatataaggctccttttgaagagcatttaagcgcttgtcagcaacatgtcaatgacaagctgatggcaacattttcttcattaccttttttggacagcccattagcgacagctatgctgcatggcgcggtactaggtggcaagcggttgcgcccatttttggtttacagcgtaggcgaaatgtttggcctttccagagagagtcttgatgctcctgctctcgccttagaatgcattcatgcctattcactgatccatgatgatttgccggcaatggacaacgacgatttacgccgtggtcaacctacctgccatatcaaatttggtgagagtctggcaattctggctggagatgcattacagtcattggcatttgagatactggcaaagcaagatatgccaaatattgccttatccgatcgccttgcaatggttgctgaactggcaacagcgagtggtcttgctggcatgtgcggagggcagtcactggatttggaagctgagggaaaacagatcgaccttgctactctggaacaaatccatcggcataaaacaggcgcattaatatgtacagccgtcaggcttggggcttacagtgctgggcaacgtggccgtgaagtactccctttgctggatcaatattctcaagccattggcctcgcatttcaggtacatgatgatattctggatgtcattggcaatacagacgttatcggcaaacggcaggggaacgatcagcaacttggtaaaagcacttatcctgcgctattgggtttggaacaagccaagaaaaaagcgagggatctctatgaagaagcgctcgccgcactcactgaactggaaaaacaatcctataacaccgtgatcttaaaaaaactggctggttttatcatcgaaagaaacagttaa

SEQ ID NO: 5121 - DNA, 1866 bp, Xenorhabdus bovienii
  Coding sequence Name=Xb4151_4152.C444.gene296.dna; Position on contig= 334132..335997bp; Strand=+
atgagcattgatatagcgaaatatccaacattggcattggcggaaactcccgaagaacttcgcctgctacccaaagacactttgccaaagttatgcgacgaactgcgtcaatttttgctcaatagtgtcagtcgctccagcggtcactttgcttccggcctcggcactgtcgaattaacagtcgcacttcattatgtttataaaacaccgtttgacaatttagtttgggatgtcggtcatcaggcctatccgcacaaaatattgaccggacgccgtgatcacattaacactattcgtcagaaaaatgggctccaccccttcccttggcgagatgaaagtgaatatgacaccctgtgtgtcggccattcatccacttcaattagtgctggattgggcatggccattgcggcaaaacatgaagacaaaggccgcaagactgtctgcgtcattggtgatggagctatcactgctggcatggctttcgaagctatgaaccatgcaggggatatcgatcccgatatgctggttatcctcaatgacaatgaaatgtccatttctgaaaacgttggcgctttgaataaccatctggcgcatcttctttcaggcaaattgtatacaaccctgcgtgaagggggcaaaaaagtcttttccaacttgcctcccatcaaagagttactgaagaaaaccgaagaacacctcaaaggcatggtcgttcccggaactctgttcgaagagctagggtttaactacatcggccctgtcgatggccatgacgtattggcactgacccagaccctgaaaaatatgcgtgagctgaaagggccgcaattcctgcatatcatgaccaaaaaaggccgtggttatgcacctgcggaaaaagatcccatcggttggcatgctgtccccaaattcgatccggctacaggttccttgccgaaaagttcagatacccgcccgacattttccaagatcttcggtgattggctatgtgaagaagctgcccatgataaaaaactgatggcgatcacccctgccatgcgggaaggctcaggtatggttcgtttctcccgcgaataccctgaacaatactttgacgtggctattgccgaacaacactcggtcacttttgcggcagggctggctattggtggttacaaaccgattgtggcaatttactccaccttcctgcaacgtgcttatgatcaggtgatccatgacgtcgccatccagaatctgcccgtgctgtttgccatcgatcgtggcggcattgtcggcgcggacggacagacccatcaaggtgcattcgacctctcattcctgcgttgtatcccaaatatggtgatcatggcacccagtgatgaaaatgagtgccgtcagatgctgcatactggccatcactatcagggcggcccggtggttgttcgttatccccgaggaaccggaacaggtgctgaactccagccactggaagcattgccaatcggcaaaggtatcgttcgccgtcagggagaacgcattgccatcctgaacttcggaacactgctaccagacgcattgcaatccgccgaagccttgaacgcaaccgttgttgatatgcgctttattaaaccactggataaccaactagtgctagaaatagccgccagccatgatatgttggtcactctggaagaaaacgccatcatgggtggagcaggcagcggtgtcaatgaactgctgatgcaaacaagtcagcctgttcctgtattaaacctcggtttacctgatcactttatccctcagggaacacaagaagagatccgagctgatttagggttagatgccagaggaattcaacacgctatcgaaaaatatctggctaaataa

SEQ ID NO: 5122 - DNA, 735 bp, Xenorhabdus bovienii
  Coding sequence Name=Xb4151_4152.C444.gene297.dna; Position on contig= 336015..336749bp; Strand=+
atgctctttgcagcaacgcatccttttttcttctgctctttcctttcccaattcaaaatttttcaaaaaactaatcagttatatcaatcttcagtggaagaagtgatcctgagcggtggcgatcccttaatgctgacagataacaagctgaatgaatcattggcctccatccgggaaatccgcgatgacctgctaatccgcattcattcccgcgctttgaccttcaacccttaccgcattacagatgctctgatagaaacattgaaaaaataccgcatcaatgccttcggtgttcatgtctgtcatccatttgaactcagcgaagaatttcaaactgccgttcgtcgcatccaaagtgccgtaccgattgttttttccaatatgcctttcctacgtggtatcaatgataacgaaaaaacactccacaagctgtttatcgatctgtatcgcatgggcgtaaaaccctactatctatatcactttatgcctttctcaccaggttcttctgaatataaagcctcgatcaacgatgccatctctatcatgagtaaactcaaacgtcgcatttcaaatatcgccttaccggaatacgttctgccgcatatgaaaggtaaatttactgttcctctgtttactcatccacaagagatgccctattttgaaaccctcaatggcaaacgttattaccgctttatcaactggcaaaacgaacaatgtgaatggctggataactaa

SEQ ID NO: 5123 - DNA, 1374 bp, Xenorhabdus bovienii
  Coding sequence Name=Xb4151_4152.C444.gene298.dna; Position on contig= 336815..338188bp; Strand=+
atgaaaccaaacgcaattttgtttgttgatattgatgatgccgaaatcacgcgatatacctatcgggaaccgcactttaccgcagcaaaagaaatggggctgctttgcctgaccgcagcactacaaggacgccagtatgcagaacgtctttccgctgatagtgacgaagttttttatgtagaatcaatgacattgaatgccttgcgggatctagtccacgatttactggatacctacaacctgcgcgctattttatgccatgcaggccatgcctctgccagtgggcaagtcggctgtattgttgccgaaatatgtcaggaaatggagttatcgcactcttcttccaatgccattgccgtctgtaacaataaataccttatgcgtcagatactgaaaaaacatgatatccgttcagtacgctatgcattgtgcaataacgaagaggaactatcttatcaagccaatatgattggctaccctttaatagcaaaacctccctttggggcgtgctcagtctttatcaaaaaatgtaacaactgggctgaattacaggttcattaccaaacatttacagcccactacgaacattctaactacactgattttatgggtaaccaacaagaatacgtgacgcctaaaggtgaaaaatacattagcattccaggaaaaagcctgctgttggaagaatatattgatggtatagaaggcacgattgagtgtgtcattaaccaacacactatatatccagtcttgatcaatgaaaaattgattctgacagagaaaagcaacaccgtgctggaaaacctactcattactccacctgtatcattttcaccatcagaacaggaacaaatcaaaaactacgctatagcttgccttaatgccgttggtttaaacaatgcaattgctcaccttgaatttcgtatgacttccgaaggccctgtcattattgaaataaacccacggctcggagggctgtttgtcaactcggctttccgtgatcttgcaggcctgaacccttatcagctttatctttctatcctcatacaagatcaagaagttgattttcaacttacccaagcttgcaaacaagtagaacaagccacacaacattactcaatgattgttatgtatccagatacaaacggtcattttaaaggcatcgaaaaccttcactatctcaaaaatcagccatgcatactcgaatgtgtatcttatgccaatgactgctatatcaacgcggaaattgaagaacattatctgattaagtgctgggcaaaagtcgaaggagcatcccatgcccatacgttgcacagcaatatgctagaaaacgtcaaacccatcattattccagaatctgatttgatttcatga

SEQ ID NO: 5124 - DNA, 726 bp, Xenorhabdus bovienii
  Coding sequence Name=Xb4151_4152.C444.gene299.dna; Position on contig= 338201..338926bp; Strand=+
atgaacattacgaatatctcagcaaatttaataaacgaacattattgccatattccacatttcagtaaattaatttcctgtgattcaaaagcaactaaaacgtttaaaaaccattgggataatctggttctggatcagaatttcaaagactatacccacagggagaggcgtattctgcgttaccactatcgccccggcatagaaatcccctttcagctcaatcaagatactgaatatcgatcatcagtaacctatgacattgaatacaaaaaaggtgctaatcaactcagttatgctgaagatacatttattaacgatccgatcatgcagcatattctttcaatggatattgctattttaggtgatcgattaataaaaggttgccactattcgattgatattcatcaatttcgtgttaaagcgtttgctgggaaagaaagcccaacgacttcaggtattcatcaggacggacaggattggatctttatgcattttattcaaggccataatattgcacctgttatttccgaggttcatgcaaccacagatgaaacgcctcccttgctgcataccgtgatggaacaatttctagaaacactcgcaataaatgacagacaaccttatcatcgagcaagcaatattcgacaaatatctcctacaatcacggcatttcgggatctgttgctggtgactttccggcaatgccctgaacaacaagagagctaa

SEQ ID NO: 5125 - DNA, 1227 bp, Xenorhabdus bovienii
  Coding sequence Name=Xb4151_4152.C444.gene300.dna; Position on contig= 338929..340155bp; Strand=+
atgtcaagccaggaaaatagtttgaatttgcgttggtctggcctaaatgccttgctgatcgtcagtgcacgattcgtatctgattttggcgcattcctgaatatggttgcgctatccacctatgtttacctgcttagtgatagcgtcatgcacgtcagtatttttctggcctgccgtgttgccggcgggatcattgccagcctgataggtactccattcttcaggcgatttgccggacgctggccactggtctgtttcgatttattgcgggtcattctactatccctgttattggtgataccagcttcacagcagttactgatcttaccgatgatcgctttcggcattggcttaggcaactcgacgtttgccatcggactgaacagccaactcccttactgggtacacgcttcccaacgcatatcaaccaactcctggctaacatccgtcgccgccacgggcgcagtacttggcagtttggtatccggtttgttggtcgccagcagtggttatgaaatagtctttatcgtcaatatcattacctacctgctggccgcattcttgattatgcctttgcgtttcctcacccatcctgaacagaaaacatcgcgggaacggggtaacgaatggcgtgagttaatccgcggcttacgttgtgctccgatgctggcaggaatgctgttcctcagtttggccgacaccctcggcagcgccgcccataacgtgggatttcctgtcatttctaagttacttacgccagataacgccagtaccacaatgggcttactgctggcgacatgggcggtgggaaaattcagtggagcgcgtctgaccagctacctgctacgcaaccgcaatttattgaagatggagaaactcttttttctgggcgttgcgttgatgtcgaccggatttatccttactttccaacaaaccagccagctttggctgctcgtgtttgcggtctgggcaggtatcggagacggaatagctgaagtcagcctgatttcacgggcgcaaagtgaaccggaaagtttacgcttgccgattttcagtttgctgacactattacagatgacgggctttgggataggtatgttggtggtggcaccgttttacgtctggtatcccccttccatcgtgatcctgatatttcacggtttgccgcttactgtgctagttatcatcctaatctggatccggcgttttactacaaataaagtgtaa

SEQ ID NO: 5126 - DNA, 201 bp, Xenorhabdus bovienii
  Coding sequence Name=Xb4151_4152.C444.gene301.dna; Position on contig= 340171..340371bp; Strand=-
atgatacaagtgcaacatcgttatacgaaattggagattctacacgtatttaataacctatatattaggctggggtggccagatatgctttcccccttaaatcagttggtgatggcaagctggcggggttgtctatcctcattgaggaaaaccagcagcgaaaagcaatatagaatacttcggtgctggtttttaaattga

SEQ ID NO: 5127 - DNA, 729 bp, Xenorhabdus bovienii
  Coding sequence Name=Xb4151_4152.C444.gene302.dna; Position on contig= 340838..341566bp; Strand=+
atgcagcaagccatcaatttctggccactgatcgggattgccgtcattatgatcgggtttatccttcgttttaatcctgttttggtcgtaacggttgcagggctagtcacagggttagccgcccatatgccaatcaccaaaattctggaaaaacttggctccggatttcttaataccttgaatctaccactgactattttgctccctttagtcatcattggccttctagaaaggcatggcttaaaagaacgcgcccaacgctcgattgcccatatcaaaactgccacaactggacgtttactgattgtttatctgtttatacgagaaacttctgccgcgctagggctgaccagtttaggcggccatccgcaaatggtacgtccactactggcaccaatggctgaaggggcggcagagaaccaatatggtcatttgcccgatcatattcgccaccgtattcgcgccatgtccgccgcaactgataatactgggctgttcttcggggaagatatttttgtcgccttcggtgccattatttttatgcacaatttcatgctggaatctggtggtatccagactgaacctctgcatattgccttgtggggtattcctaccgccatttgtgctttcctgatccactcggttcggttatatcgccttgattactatcttgcccgcgaaattacttccctgaatcatatggaattgactagcaaggaggcaaaataa

SEQ ID NO: 5128 - DNA, 1017 bp, Xenorhabdus bovienii
  Coding sequence Name=Xb4151_4152.C444.gene303.dna; Position on contig= 341566..342582bp; Strand=+
atgtttcagttacagtatctctactatctggcgggattcattttgctcgttgtcgccgtgatgtcgtggcgcgatcgagccaatcctcgacgtttgaccacaggcctgttctgggggctatatggcctcatcttcctgataggaaactggagttatcaattgatggctatctggataagcgacgaagatcaagcccagaaaatcgtccatatcagtgttggtacgctagtgattatcatagcgttattggcaggatttggtggagtacgtttgggaaactaccatcagcctacaacggaacaaaaacagaaaagtgcagaacgcctcggcaatcggttatttttgcctgccctgctcattcccgttgtcacgatagtgggtgtcctgctgtttaaccatattccgggactacagcaaaccgttttcggtgcagacaatcattcaacgttggtgacgttattttccattgccctcggttgtctggctgggttaatcatcgcattgcgcatgaccagagaaaacatcatgcaaccgatacaggaaacacgccgtctattggattctatcggctccgtgtttattctaccgcaaattctggcaaccctcggattactgtttacggcagcaggcgtaggcaccgttatttcttatctgactgaaaattatctggctgtcgataatcgatttatagcggtgatagcctatgttctcggcatggctgtactgactatgatcatgggaaatgctttcgctgcctttcctattgtgacagccggtattggtattcctattttgatcttgcaacatggcggtaatccagccgtaatggcagccatcggtatgttttccggttattgcggtacactgatgacacccatggcggcaaatttcaatctcgttcccgccgccctgctggaattacctgatcgcaacgccgtaatcaaggctcagatccccaccggatgcaccttagtgcttactaatgtgtttttactctactttctgatgttcttgtaa

SEQ ID NO: 5129 - DNA, 648 bp, Xenorhabdus bovienii
  Coding sequence Name=Xb4151_4152.C444.gene304.dna; Position on contig= 342603..343250bp; Strand=+
atgaaaactattttagtcactgcttttgatcctttcggtggtgaagctatcaacccatcgtgggaagcaatcaaaccattacaaggcagccaagtttttggtgcaaatattgagatttgccagattccctgcatttttgatacttctttagaacacctttatgcagccgttgataagtatcagcctgaactggtgatttctgtcggtcaagcgggcggtaggacgaatatcaccgtagagcgtgtcgctattaatatcaacgatgccagaattcctgataatgccggcaatcagccgattgatacccccgttattgttgatggccctgccgcctatttttctcgtctgcctattaagacaatggtcaatgcattaaatacagcaggtattccggcgtcagtttcccaaactgccggaacctttgtgtgtaatcatgttatgtatggcttattacattatctggctcagaatactccctctgtacgcggggggtttattcacgttccttatttgccagaacaggcggtaaaagatggtaatcaatcaagtatgacgctgatgttgatgacgttggcgttgaaaatagccattgaaacagcctggaaaaatacatcagatattgctgttacaggtggagctactcactaa

SEQ ID NO: 5130 - DNA, 492 bp, Xenorhabdus bovienii
  Coding sequence Name=Xb4151_4152.C444.gene305.dna; Position on contig= 343339..343830bp; Strand=-
atggatgatgcaaaacgccgcttaaggatgcggaatccgtggcatttgttggctacgggtttcggtagcggtttatcgccgattatgccgggtacgatgggctcactggcggcaattccgttctggttgttgttggtgcagttgcctgaatggggcatttggttggttattctgctgggaacggtgattggctgcgtgatttgtcagaaagcagccgatgctatgcaggtggaagatccgggttgtgtggtctgggatgaatttatcggcatatggatcacattgatggcgattcccgtcctcaactggcagtgggttttggtggcttttgtggtattccgtatcttcgatatgtggaaaccatggccgattcgctggttcgatcgctatgtcaaaggtggaatcggcatcatgctggatgacattattgcggcaattttcgcagttattgttatttggttgctgaatttctacccattattacctttctga

SEQ ID NO: 5131 - DNA, 1083 bp, Xenorhabdus bovienii
  Coding sequence Name=Xb4151_4152.C444.gene306.dna; Position on contig= 343823..344905bp; Strand=-
atgtgctcatcgttagtcactttttggaattctattatggcatgtggtgaatttgagctcattgcacgttatttcaatcgccatgtcatccgccgacgtgatgtgaatctaggaattggtgatgactgcgcgttgatgaccgttgcagagaaacaagaattagcggtaacaaccgatacgctggttgccggtgttcatttcctccctgacatttccccggaagatttggcttataaggcgctggctgtcaacatcagtgatctggccgcagttggggcagatccggcttgggcatcactggcgttaacgttgcctgatgtcaatgaggattggttgaagcggttcagtgatagtctgtttgaacaactgaactattatggcatgcagttgattggtggggatacgacaaaaggccccatgagcctgacgctgacggtacatggcctggtgcctgctggcagggcgttacgccgtgctggtgcgaaaaacggtgactggatttatgtgacaggaacgttgggtgacagtgctgctgggcttgcactgttgcaagatcgttttacggtggaagataccgctatccacaactggctggttaaacgtcatctccgtccacagcctcggattttacaggggcaggcactgcgtgatctggccacttccgcgattgatttgtccgatggtttgatttctgatctcaaccatattttgaccaccagccaatgtggtgcgcgtattaatctggatgcgctgccttattcggaggctgtccagaaatatgccacaccagagcaggcattaacatgggcgctgggagggggagaagattatgaattgtgcttcactgtacctgaacttaaccgtggtgcattaaatatggcattggcacataccggcgccagtttctgctgtattggacaaatcaggccagaatcagaaggcatccgcttttttaacaaaaataaagaaattgagctggatctgaaaggcttcgaccattttaagcctgaaaaaaaaccgttagcagtctgtcaggtatcacaacagacacagaatgatcagacggagggaactcatggatga

SEQ ID NO: 5132 - DNA, 417 bp, Xenorhabdus bovienii
  Coding sequence Name=Xb4151_4152.C444.gene307.dna; Position on contig= 344971..345387bp; Strand=-
gtgaaacctgctgctcgtcgtcgtgctcgtgagtgtgctgttcaggcaatttattcatggcaattatccaaaaatgacattgctgatgttgaatttcagtttttgtcagagcaggacgtaaccggtgttgatatcacctatttccgtgaattgctgactggggtagcggtcaatgctgcaaaattggatgctttgatggctccttacctttcccgtcagcttgaagagttaggtcaggtggaaaaagccatcttgcgcgttgcgatgtttgaactaagctttcgtgatgatgtcccctataaagtggctattaatgaaggtatcgagctggcaaaaacgtttggtgctgaagatagccataaattcgtgaatggggtgttggataaagctggcccggcagcacgcaagaaaaagtga

SEQ ID NO: 5133 - DNA, 471 bp, Xenorhabdus bovienii
  Coding sequence Name=Xb4151_4152.C444.gene308.dna; Position on contig= 345417..345887bp; Strand=-
atgaacgtaatcaaaggtgttgttgcagctcctaaagcccgcatcgccattgcgatcgcccgctttaacaacttcattaatgacagcctgctggaaggggccttggatgcgttggaacgcatcggtcaggtttcttcagacaatatcactgtagtctgggttccaggtgcttatgaattaccgttaacggttaaggctctgactgagactcaaaaatatgatgcggttatcgctttgggaaccgttatccgtggcggtacagcccattttgaatatgttgcgggtgaatgcagctctggactgtccagcgtagcgatgtccagtgacattcctgtggcatttggtgttttgacaaccgaaagtattgaacaagcgattgaacgcgctggcactaaagcgggcaataaaggcgcggaagctgccttgaccgcattagaaatgatcaatgtaatcaaagccattaaaggctga

SEQ ID NO: 5134 - DNA, 1191 bp, Xenorhabdus bovienii
  Coding sequence Name=Xb4151_4152.C444.gene309.dna; Position on contig= 345977..347167bp; Strand=-
atgttcgcgaatttggcgaagaaattgccagactacaagattgaatatgctggctttcaaaaaatcaggctttcaaaaactatgactctcgatgaaaaatatatgtcccgtgcgctggaactggcgaatcagggacgttttacgacatctccaaacccgaatgttggatgtgtcatcgttcagggcgatcacattgtcggtgaaggtttccatgtatgtgccggtgaacctcatgcagaggtacatgctctccgcatggccggaggcaaggcaaaaggggcaacggcttatgtcacccttgagccgtgtagtcaccacggcaagacgcctccctgtgccgatgcgttgattgcagccggtatcagtcgtgttgtggccgctatgcaagatcctaatccgcaggttgcagggcgtggtttgtataaattgcagcaggcggggattgccgttgagcatggcgtgttgatggcggaggcagaagcgctgaataagggatttctcaagcgtatgcgcacgggattcccttatttgcaactgaaaatgggcgcgtcactggacggacgtactgcgctggcatcgggtgaaagcaagtggattacgtcgccagaagcccgtcaggatgtgcagcagttccgggcgcaatgcagtgctattctcagttccagtgccacggtactggcagatgatccttcattaactgtccgctggcatgaattggatgccgaaatacaggcgatttatcctcaagagcaagtacgtcagccaatccggatcattgttgatagccagaatcgcgtaacaccacagcatcaagttgtacagcaggtggggcaatgttggttagcacgtactcacaccgatcagcagcagtggcctgacaatgtcgatcatattgtattgcctgcccacggaggaggtgttgatctggttttgctgatgatgcagcttggtaaacgtcagataaattcggtttgggctgaatgtgggcctgttttggcgggagcattgttatcactggggctagtcgatgaattaatcctttatatagcaccaaaagtgctgggaaatactgcccgtgggctgtttgctatccctgagttacaaaaattatcggatgcgcctgaattcacgctgtttgatgtccggcagattgggtctgatgtgcgtcttcgcttgcggccagcgtcttga

SEQ ID NO: 5135 - DNA, 450 bp, Xenorhabdus bovienii
  Coding sequence Name=Xb4151_4152.C444.gene310.dna; Position on contig= 347124..347573bp; Strand=-
atgcattgcccattttgcgcagccgttgatactaaagttattgattcccgtctggtaggagatggctcccaagtgcgccgtcgtcgtcagtgtctcgaatgtcatgaaagattcaccacgtttgaaatcgcagaactggtgatgccaagagtgattaaaagtgatgacattcgggagcctttcgacgaggaaaaattacgtcgcggcatgttgaaggcactggaaaaacgtcctgtcagctctgatgatgtggaaacagcgattatccatattaagtcacaagtgagggcaacgggagaacgagaaattccatccaagatgatcgggaatttcgtgatggatgcgctgaaaaagctcgataaagtagcttatattcgtttcgcatctgtttaccgcagctttgaggatgttcgcgaatttggcgaagaaattgccagactacaagattga

SEQ ID NO: 5136 - DNA, 969 bp, Xenorhabdus bovienii
  Coding sequence Name=Xb4151_4152.C444.gene311.dna; Position on contig= 347701..348669bp; Strand=-
gtggcacaggattacactgttgaacaattaaactatgggcgtaaagtcatcgactttatgcgctgggacaacgttgcctttgggatttcgttactgttgttggtcgcttccatcattacgatgggtgtccgtgggtttaactgggggctggactttaccggtggtacggtaatcgagattaacctgagtaaacccgccgatctggataagatgcgcgaaagcctcacgaaaaacggttttgccgatccgcttctgcaaaactttggcagtagccgtgatgtgatagtgcgaatgccgcctgtgacgggcaatgcagggcaggaactgggtaataaaattatctcggttatcaacgcgaatatcgacaaagatgcagtcgtcaagcgtgttgagtttgtcgggccaagtgtgggaagcgagctggcgcagacgggagcaatggctctgctggctgcgctaattagcatcctgatttatgtcggttttcgctttgaatggcgtctggcattgggagccgttatcgcactggcgcatgacgtgatcattacactgggtgtactgtcgttattccacattgaagttgacctgaccatcgtggcatcgttgatgtccgttatcggttattcattgaacgacagtattgtggtatcggatcgtatccgtgaaaacttccgtaagatacgccgtggcacaccgtatgaaatcatgaatgtttccctgactcagactttgagccgtacgatcatgacttcagcgacaacgctgctcgttgttctgatgctttacatctttggtggtgaaatgctgaaaggtttctcactggcgatgttaatcggggtttccatcggtacgatatcatctatctatgttgcttctgcactggccttgaaactgggaatgaagcgtgagcatatgattcagcagaaagttgagaaagaaggggcggatcagccttccattcttccttaa

SEQ ID NO: 5137 - DNA, 1815 bp, Xenorhabdus bovienii
  Coding sequence Name=Xb4151_4152.C444.gene312.dna; Position on contig= 348680..350494bp; Strand=-
atgctgatcgctgcgatcctcatcggtttgctttatgcacttcccaacctatatggtgaggatccggctgtacaaattactggcgcgcggggcatcgccgccagtgaaaaaacgctggaccaagtccgtaatgttttagaaaaagaacaaatcaagagcaagtccattgcactggaaaatggagcaatacttgctcgcttcaataattctgatgttcaacttcgtgcccgtgaagcattggtttccgcattaggagaacaatatgtcgtggcattgaaccttgcgcccgcgacacccctttggctaagtaaagtgggtgctgagccaatgaaactggggcttgacctgcgtggaggcgttcacttcctgatggaagtggatatggaaaccgcactgagtaagctacaagaacagaatattgatagcctgcgctctgaattgcgtgatcaaggcatcctttattcctctgttcgtaagcttgataactatggagtggaagtccgtttccgcgataatgatgcacgttccaaagcggaaagttatcttgaaccccgtcaccgtgatttagtcttctccactggcgcgaatagtacgctgaaagtcgttatgagtgacgatcgcctgcgtgaagctcgaacctatgcggtacagcaaaatatcactatcctgcgtaatcgtgttaaccagttaggtgtagcagagccgctggttcaacgtcagggcgcagaccgtattgtcgttgaactgcctggcattcaggatactgcccgtgccaaagaaatcctcggtgcaacggcaacgctggagttccgtctggtaaacagtaatgttgatcagagtgccgcagtatctggtcggattccgggtgattcagaactgaagtatacccgtgatagcaacccggttgtgttatacaagcgcgtgatcctgactggtgaccatattacggattccacttccagtactgatgaatacggtaatccgcaggtgaatatttctctggacggtgctggcggtagtgcgatgtctaacttcaccaaagacaacttgcaaaagccaatggctacgctgtttgtagaatataaggacagtggcaagaaggatgccaatggccgttcggttctggtgaagcaagaagaagttattaatatcgctaccattcagtctcgtttgggcaatagtttccgtatcaccggaattggcaacctgaatgaagcccgtcagttggcgctgttgttgcgtgcaggtgctttgatcgcacccatccagattgtcgaagaacggactattgggccaacccttggcttacagaatatcaagcaggggcttgaagcctgtctgtggggcttgatttcttctatcctgtttatggtgatctactaccgcaagttcggattgattgcgagcagtgctctgctggctaacttagtgctgatcgtcggtgtcatgtccttgttaccgggagcgacgctgacgatgccgggtattgcgggtatcgtattgactctcgccgtggcagtggatgcgaacgttttgattaacgaacgtatcaaagaagagctgcgtaacgggcgtacggtgcagcaagcgattcatgaaggctacaaaggtgcgttttccagtatcattgacgcaaacctgactacgctgattactgctgtgattctgtatgcagtgggaacgggctccatcaagggcttcgcgatcacgaccagcattggtgtggcgacgtcgatgttcactgccattgtgggaacacgcgcagtcgtgaacctgctgtacggcggtaagcgtatcaataagctgtcaatttaa

SEQ ID NO: 5138 - DNA, 339 bp, Xenorhabdus bovienii
  Coding sequence Name=Xb4151_4152.C444.gene313.dna; Position on contig= 350556..350894bp; Strand=-
atgagtttttttatttctgacgctgcggcatctgctggtgcatcagcgcaatctcagggaagcccatattctctgattatcatgctggttgttttcggtttgattttctatttcatgatcctgcgtccacaacaaaaacgcaccaaagaacataaaaaactgatggattccattgccaaaggtgatgaagtgctgacttctggtggtttagtgggtcgtgtctctaaagtgtctgaaacaggttacgttgtggttgctttgaatgacactactgaaataactgtcaaacgtgatttcgtcgctgccattttgccgaaaggtacaatgaaggctatttga

SEQ ID NO: 5139 - DNA, 1125 bp, Xenorhabdus bovienii
  Coding sequence Name=Xb4151_4152.C444.gene314.dna; Position on contig= 351004..352128bp; Strand=-
gtgaaatttgagttacaaaagacggatgggaatgctcgccgtggccgcctgatttttgaacgtggtgttgtggaaacgcctgcatttatgcctgtggggacttacggcacagtaaaaggcatgacaccggaagaagttaaagaaaccggtgctcagattctgttggggaatactttccatttatggctgcgccctgggcaggagatcatgaaactgcatggtgacttgcatgattttatgcagtggcacggtcctatcttgacggattctggcggttttcaggtcttcagccttggtgcgatgcgtaaaatcaaagaagaaggcgttcatttccgtaatcctataaatgggacgcccgttttcctcagcccggaaaaatccatggaaatccaacatgatttgggttccgatatcgtcatgatttttgatgaatgtacgccatatcctgcagattgggattatgcgaagcgttccatggaaatgtcattacgctgggcggcgcgcagtcgtcagcgttttaacgagttaggcaataaaaatgccctgtttggcattattcagggcagtgtgtacgaagatttgcgtgatgtttctgtaaagggactggtcgaaatcggttttgacggttacgcggtgggtggtctggccgtaggagaaccaaaggaagatatgcatcgtattctggagcatgtttgtccgcaaatcccacaggataagccacgttatttgatgggtgtcggtaaaccagaagatctggttgaaggtgtccgtcgtggtattgatatgtttgactgtgtcatgccgacccgtaatgctcgtaatggacatctttttgtgacagaaggtgtgatcaagatccgcaatgctaaacataaggaagatacttctacgctggatgagcattgtgattgctatacttgtcgccattatagccgtgcatatctgcatcatcttgaccgctgtaacgaaattcttggtgcaaggctgaatacaatccataatttaaggtattatcagcgtttgatggccggaattcgtaaagccattgaagagaacaaactggaacagtttgttgaagagttttatcagcggattggcaaacccgttccgtcgttaaatatataa

SEQ ID NO: 5140 - DNA, 1068 bp, Xenorhabdus bovienii
  Coding sequence Name=Xb4151_4152.C444.gene315.dna; Position on contig= 352199..353266bp; Strand=-
atgcgtgtcgctgattttacatttgaactgccggaagagctgattgctcattatccccagccgcagcggagtggttgccgtttgcttgcccttgatggcaaaaccggagggctgacgcacggtattttcactgatgtgctggataagctggaagccggtgatttgctggttttcaataatacacgagttattcctgcgcgtttgtttggtcgcaaggcgacgggtgggaaattggaagttttagtagaaaggatgctggataataagcgagtactcgctcacgttcgtgcgtccaaggcactgaaagaaggtgcagagcttctgctgggcgaagatgaaagcatcagggcaacaatgctggcacgccacgatactttatttgaaatccgttttgatgatgatcgtgatgtattgaccattttggatgaaattggtcacatgccgttgccaccgtatattgcccgtcctgatgaagagtcggatcgcgagttatatcagacggtctacagtgaacgccctggtgccgttgcggcaccaactgccgggctgcattttgatgaacccctgttggcagcactgcgtgaaaaaggcgtcgatatggcttttgttaccctgcatgtcggcgcaggaacgttccagcctgtgcgggtggagactatcgaagaccatatcatgcatgctgagtatgcagaagttccgcaaaatgtcgttgatgcggtattggcgtgtaaggcgcgtggcaataaggttgtagccgtgggtacaacgtctgtccgttcattggaaagtgcggctcgtgcctgtcagaatggtctgattgagccattctttgatgacacccaaatctttatttatccgggatttgagtatcaagtcgttgatgcgttgattaccaattttcacctgccggaatccacgcttattatgctggtttctgcatttgcgggttatcaaaataccatgaatgcctataaagaagcggtagccgaaaagtatcgtttctttagttatggtgatgcgatgtttattcatcgcaaccctatggcaacgaaagagaaagtctcgtaa

SEQ ID NO: 5141 - DNA, 624 bp, Xenorhabdus bovienii
  Coding sequence Name=Xb4151_4152.C444.gene316.dna; Position on contig= 353372..353995bp; Strand=+
atgaattttctcgcacatcttcatttggctgcattatcggaaagttccttactgggcaatttaatggcggattttgtccgtggctctccaaaaggattattcagccccgatattgtagaaggtattcgcctgcaccgtaggatagacagcctgacggacagccatccatgggtcaccgaagcatgcacactgtttcgtagcgagtatcgacgcgtagctcccattacccttgatatcatctgggatcattttctttctctgcattgggacaagcttgaaaaaaattactccctgcctgaatttgtacatcttgcccgtagtcagatagagccgcatcttagcttcacgcctgaaaaatttcaggcgttgaacaaatatctctggtcagaaaatctacttatccgctatgccgatatgtcatgcattgccaatgtactgaaaggcatggctcacagacgccctaaattatcggcactggcaggatcgtatcaagatatcgaaatgcattatcttgattttgaagcgctattttggaaattctatccacacatgatggcactggcgaccaataagcgactgcttgagcaagatatttcgccagaaccttgcactttttccaaatag

SEQ ID NO: 5142 - DNA, 603 bp, Xenorhabdus bovienii
  Coding sequence Name=Xb4151_4152.C444.gene317.dna; Position on contig= 354152..354754bp; Strand=+
atggttctagtaacccgccaagcccctgactttacagccgcagcggttctcggtaacggtgaaatcgttgataatttcaacctgaaaaaccacctgaatggtcgtccagccattatcttcttctggccaatggacttcacttttgtttgcccttctgagctgatcgcgtttgatcaccgttatgaagaattcaaaaagcgcggtgttgaagtcatcggcatttccttcgactctgaattcgttcacaacgcatggcgtaaaaccccaatcagcgaaggtggcatcggcgaagtcaaatacccaatggttgctgacatcaaacgtgacatcatgaaatcttacggcattgagcacccagaagccggtgttgccctgcgtggttctttcctgatcgacaaaaacggtgttgttcgtcatcaagtcgttaacgatctgccactgggccgtaacatcgatgaaatgctgcgtatggttgacgcactgcaattccacgaagagcacggcgaagtttgtcctgcacagtgggcaaaaggtcaggaaggtatgggtgcgtcccctgaaggcgtcgcaaaatacctgaccaaaaacgctgataaactgtaa

SEQ ID NO: 5143 - DNA, 1764 bp, Xenorhabdus bovienii
  Coding sequence Name=Xb4151_4152.C444.gene318.dna; Position on contig= 354988..356751bp; Strand=+
atgttaaaagcatggaaaatgccttttgtcgctgtatcgctcttagtttcctcctccctctatgccgcttatgaacctgccgttgaagccaaacaaggcatggtagtcagttcacaatacttagcttcacaggttggcgtcgatattctcaaaatgggcgggaacgccattgatgccgctgttgccgttggttatgcccaagcagttgtcaatccctgctgtggcaacattggtggcggtggtttcatgaccattcatctggcaaacggcaaagatactttcattaatttccgtgaaacagcacctgctgcggccagcgccaatatgtatctggacaaagacgggagtgtcatcaaaggtgccagtctgtatggctataaagctattggcgtccccggcacagtgatgggattagatgccgcactgcacaaatacggctcaatgacccgcgaacaagtcatggcaccggctatcaagctggcgcgtgaaggctacattttgactcgtggtgatactgatattctggacaccaccgtcaaacgctttacccaagatccagaggccgcccgtattttcttgcgcaaggatggtacgcctttccaacccggggataagttagtccaaaccgatttggccaatacgctggaactgattgctaagaaagggccagatatcttttatcatggcaaaatcccccaattagttgaagaatcatcgaaaaaatcagggggaattatcacagcagcagatttcgccaactataacattacagaaacaacaccagtcacttgcagctatcgcggttataaatttatctcttccccaccacctagttctggtggcgtcaccttatgcgaaatactgaacattgttgaaggctatgatctcaaatccatgggattcaactccgctgcttatatccatacattgacagaagccatgcgccacgcctacatggacagaaatacctatctgggcgatcctcaatttattaagaacccacttgatcggctgttaagcaaaagctacgcagaatctatcagaaaagagatcgaaccaaacaaagcgacatcttcaaaaaatgttcagccgggcgttggtccccatgaaaaaccagaaacgacccattactctgtcgtagataaagatggcaatgccgtatcaaccacttacacaatcaacgggcgttttggggccgtcgtgattgcaccgggaaccggctttttcctaaacgatgaaatggatgatttcacaactaaagttggggaaaaaaacctgtatgggcttgttcagggagcgaccaactccatcgcccccggtaagcgcccactatcatcgatgagcccaacactcgtgaccaaagataacaaaatctttctggtattgggttctccaggcggatcacggattatctccatcaccttacaggctgccttgaatatccttgattttggcatgccaccgcaagaagccgtcaacagcccgcgcattcaccatcaatggctgcctgatgaagtctactatgaacagcgtggactttcgaaagatactctaaatatgctggaaaaaatggattacaaaatggtagaacagacaccgtggggcgcggcggaactgatcatgattggattgccgggtgctgtcggtgtctctcccaccaactcatcaggcaatgattcagcggtatcaggcgtggttcgtgaaggttatatctatggctccaacgatgtccggcgacctgctggtgcagccattggctactaa

SEQ ID NO: 5144 - DNA, 1341 bp, Xenorhabdus bovienii
  Coding sequence Name=Xb4151_4152.C444.gene319.dna; Position on contig= 356845..358185bp; Strand=-
atggcataccgtttatcatctaaggatatttgggcattaggttttatgacttttgccttgttcgtaggcgcggggaacatcatttttccgcccatggttggcttgcaggcaggtgagaatgtttggatcgctgcgctaggttttttgcttacagcggttggtctaccggtcatcactgtgattgctttggcgaaagtcggtggcgggattgaagcgctaagttcccctatcggtaaaacagcaggtttgatactggctactgtttgctatatggctgttggccctttatttgcaatacctagaactgcaactgtttcctttgaagtcgggattgctccgctaatgggctctggcaaacttccgttgttcatctatagtatcgtttatttttcactggtgatcttggtttctctgtatccggggaaattactggacagtgttggacgcgtgctggctccgatcaaaattctggcactgggtattttaggaattgctgcggtgttgtggccagcaagtgatcccatccctgccattcaaacttataaagaaattccgttctcaaatggttttgtgaatggctatttaacgatggatacactgggtgccatggtattcggcattgttattgtcaatgctgcgcgctccagaggtattgaatcttcttcactgttgactcgctatactatgtgggcaggtctgattgcagggttgggcttggtactggtatatctatctctgttcaagttgggagaaagtagtggcacattggtgccgaaggctgaaaatggtgcagtgattctgcatgcttatgtacagaatgtctttggcggttatggcagtttcttccttgctgtattgattttcgttgcctgcatggtaactgcggttggtttgacctgtgcttgtgctgaatttttcagccgttatttgccattatcttatcgtacgttggttttcatcctcggaatcttctctatgttggtctctaatcttggattagaccacttgattaaattctctattccggtactgacagcaatttatccgccttgtattgcgctgatcctgttgagcttcacagtacgctggtggaataatgttactcgcattctggcgcctgctatggtagttagcctgctgttcggggttttggatgcggcgaaatcgtctgagtatctgtctcacttactaccagcatgggcaattcatctgccgttggcagataaagggctggcatggttattgccaacgatactagctgtagttgtgtgtgctctctatgatctcattgtgggagaaagcaaagtcccaaagcgtgaagtgcagcaggatcaaggctga

SEQ ID NO: 5145 - DNA, 213 bp, Xenorhabdus bovienii
  Coding sequence Name=Xb4151_4152.C444.gene320.dna; Position on contig= 358194..358406bp; Strand=-
atgcttgccttttggcgctataaaagttttacttgtgggcagttgttggcgattctagctgtaattaccactatcattctgtatttcccgattatcagtgaatattacgttgatcacttattgtcaaagcagaatccggtttcgccagtgaaaattcaagtatttgcaatactggctattgcacatgcaattcttttgacaacaatatattaa

SEQ ID NO: 5146 - DNA, 1314 bp, Xenorhabdus bovienii
  Coding sequence Name=Xb4151_4152.C444.gene321.dna; Position on contig= 358567..359880bp; Strand=-
gtgcttgaacgtttatcctggaagaagttggtattggggcttgttcttttttgtctgcctgcggtcattttgtctctctttatcggatatttaccgtggctgctggttattgggttatttctggcattggtatggcatggctacaatttattgaaattatctgactggttatggctggatcgcagtatgttacctccagcagggcgtggcggatgggagccaatcttttacggtatttatcagttgcagcagcgcaaccgtaagcggcgccgggaactggcattattgatcaagcgctttcgcagtggcgctgagtcattgccggatgcgattgtgatgatgacgacggaaggtaatattttctggtgtaaccgtcttgcccagcatttgttaggcttccgctggccggaggataatggtcagcatatcttcaatttgctgcgttacccagattttagtcgctatattacggccagtcatttctcccgtcctttatccattgagttgaataatggccgtatggtggaatttcgggtgatgccttatgcagaacggatgttactgatggttgcccgtgatattacgcaaaaacgattgttggaaaatgcccgccgggattttttctctaatgtcagccatgagttaagaacgccactaacggtactgcaaggttatctggagatgatgcaggagcaggaactgaacgatagggcaaatcagaaggtgctcagtacgatgcaggagcaggtacggagaatggacggtctggtgaagcaattattgcacctctccagaattgaagccgggccgcaagtggatatgaacgaggtggttgatgtgcctgacttattggtgttgttgcagcaggaagcgttggcattggcgaataaccagcaggatatcgtgtttaatattgatgaaaaattgaaagttttcggcaacgaagaacaactgcgaagcgctatgtcgaatctggtttataacgctattaatcatactccgccaggaacgcgtattgaggttagctggagtaaatcgtctcagggagcatggtttaaagtacaggataatggttcggggatcagtgcagagcatttaccgcgcctgaccgagcgtttttatcgtgttgaccgtgcccgttctcggcaaacagggggaagcgggttggggctggcgatagtgaaacatgcactgcatcactacaatacccatcttgaggtttcgagtacgatgggaaaaggttccacatttagttttttattggctcccgggcttattgtttctgccaaaccgaatttaattaaaaaacaataa

SEQ ID NO: 5147 - DNA, 690 bp, Xenorhabdus bovienii
  Coding sequence Name=Xb4151_4152.C444.gene322.dna; Position on contig= 359942..360631bp; Strand=-
atggctaaacgcattttggtagttgaagatgaagtccagattcgtgaaatggtttgtttggtgttggaacaaaatggctatcagaccgttgaagcagaagactatgatgttgctgtctggcgcttgtcggagccttatcccgatttggtgttattggattggatgcttcccggaggttcaggaatacagcttattaagcagatgaagcgtgatagcagcaccagagatattcctgtcatgatggtaacggctcgtggagaggaggaagatcgcgttcgtggtcttgatgtcggagcggatgactatatcactaagcctttctctcccaaggagttggtggctcgtatcaaagcggttcttcgtcgcgtttcccccatgtcggcggaagatattatcaatatggatgggctgatactggactcttcctcccatcgtgtttccagtcaggggcaaaatgtggaaatggggccaacggaattcaagctgctccattttttcatgacgcatccagagcgtgtttatagtcgtgaacaattgctcaattatgtgtggggcactaatgtttatgtggaagatcgcaccgttgatgtgcatatccggcgtttgcgtaaggcgttagaagtaggagggcacgatagaatggtgcagacggtccgtggtacagggtatcgcttttctactcgttattaa

SEQ ID NO: 5148 - DNA, 1215 bp, Xenorhabdus bovienii
  Coding sequence Name=Xb4151_4152.C444.gene323.dna; Position on contig= 360908..362122bp; Strand=+
atgcgaatcattcatacgtcggactggcatctcgggcaatatttctttaccaaaaatcgtgccgcagaacatcagcactttttgcagtggcttattgaacaaatcatacggcatcaggttgatgcattggtgattgccggcgatatttttgatactggctctcctcccagctatgcccgtgagctttataaccagttcgttgtggagctacggcccactggctgccagcttgtcattcttggtggaaaccatgattccgtcgccacgctcaatgaatcaaaagcgctattctcttgtctgaatacaacagtaatagccagtgcagacgccgacatccagcagcagataaaagtattgaataacaaaaatggagaagcgggagccattctctgtgccattccttacctgcgtccacgggatatcatgaccagccaggccggtcagtcagccacgcaaaaacagcaggcattgcagaatgccattactgaacactatcaccagctttatcagcaagctgatgcattacgggaaaaactcggccagccattgccgattattgcaaccggacacctgaccacggtgggtgcttccacctcagattctgttcgagatatttacattggtacgttggacgcattccccgcacaagcattcccacctgctgattatattgcattagggcatatccaccgcccacagatcatcgctaaatcagagcatatccgttacagcggctccccgatccccctgagttttgatgaagtcgggcaagaaaaaagcgtctgtctggttgattttaaagaagacaaatttgataacgtcactcttttgcccatcccaaactatcaaccgatgcagttgatccgtggaaatctgcaacagattgaggctcagttgcagacattcaaagcatatcagggagaacgtcctgtctggctggatattgaagtcgcgactcaagattacctgcctgatatccaaaaacgcatccaaactatgactacggatctacccgttgaaatcattctgttacggcgcagaaaggcggcacgccaaatttccctgtctgaaacaaataaagagacgctcaatgaactcagcgtgcatgaagtcttcgaacgacggctagcactggctgagattgaagatcagccccagaagcaacgcctgacgaccctgtttaagcaaacgctggatgatatttctcagcaataa

SEQ ID NO: 5149 - DNA, 3681 bp, Xenorhabdus bovienii
  Coding sequence Name=Xb4151_4152.C444.gene324.dna; Position on contig= 362141..365821bp; Strand=+
atgaaaattcttagcttacggctgaaaaatatcaactctctgcaaggtgaatggaaaattgattttacggcagagccttttgccagcaatggattattcgccatcacaggcccaacaggagcaggaaaaaccaccttactggatgccatctgccttgccctttaccacgaaacaccacggctcggtactatttctgctatccagaatgagttgataactcgtcatactgcggaatgcttggcagaagtggaattcgaagtcaaaggcgtagcttatcgtgcattctggagccagcgccgcgcccgtaaccaagctgatggaaaactccaacctccaaaaggcgaattggtggacaagagaacgggcaagattttagccgataagatccctgataaaaaagaaaagatcgctgaaataaccggtcttgatttcaaacgttttaccaaatccatccttctgtcacagggtgattttgccgcatttttaaatgcagatgataaagatcgggctgatttactggaagaactgacggggacagaaatttacggcattctgtctcaggaaatttatcaacgtcataaacaagcccaatctgaactgaatattcagcaggccaccgcttccagtatcgagttattaacaccggagcaaatagaaaattaccaaaacgaacagcaacaacttactgcagcagaaactcaactcagccaacagattaaggcttttcgatctgccgagcagtggcttatccggcaaaatgaattacaacaatcaatagcgggcaacacgttgcttttgcagcaggctgaacaggccatacaaaacgcgcaaccgcaattacaacagcttaccgccagcgaacccgcagaaaaaatccgttcactatgggatgcgcaaaaccgagcctttagtgaaaaacaacgaattactgaacaacgtataaaaatagaacatgatcgccagcaacaactttctttgttacagccagctcaacaacagcttaccgatttggaaaaaacacgggaagaacaccagcaacagcaaatccaacaggaaaagctcatctcagagcaggttataccactcgatcacaagattgatacgcaatcaaaagatctgcttacgttagaaaaggaaataaccaagcaagatcgtgaactgacagaaatctccgcccaataccaagtagcgcaaagtcgcaaagatacgctacataatgaacaaaaaacgctggaaacatacgacgatcagcacccttattgccgtagtttggacagcaaactccctgagtggaaacaattattttcacgtcagaaagagaagcaagtgcagatagccaaactgacacaaaaaacacagcagattggcactgaactggctcgtataaccgatcacttgaatacattgaatgcagagttggccgaacagacagagcaaaaccaaccactgcacgacaatctgatacttaccgaaaagcaactgattgatttgcagaaaattcatccactggaacaactgcaaaaacagctatcagactatcaggaacaactgaaatcacagaatcaacttgagatattattgcctcagatccagcaattacaggccacgatctcaactaatcaaactcaattatcacagtctcaggcattactggaacccttgccgactcagatcagtacgctagatcaacagctaacggaaaaacagcagcatcatgaagatcttgctgatcgaattcgtttggaacagcggatcaccagtctggaacaggagcgttcacagttaaaagaaggtgaagcctgcccactgtgtggcgccacacaacaccctttagtcaccgaataccagaacattgccctgtcacaatcagaagaacgcttaaaatctctacgccatcaaatagatcagctacaaacaaaccgttctgccctacagcagaaacagcagattcaacagaaaaataatcaacaattacagcaaaatacgactcaattaaccgagaaactgacaaaaataacacaacagtggaagcatcactgccaacagttacaatccgctgaattaccaatggaaacagaccctgtcgacaatttcattggccaacggcaaactgcctatcagcaatatcaaaggcaatacgacgcattattacacgcagagaaagtacatcaagcggcggaaaaagcgctatcggccaaccgtgaacagcacaaagcatctgaacaagctattgagctggaaaaggtcaaattagattcacaccaaaaacaactggcagaaaatacggcagaacttcaacaggcagaaactgaatacacaaccacgacagagctattagtcagcgaattacagcatacaccttttacccttccctctctgcaagaagtgacaatctggctgcaacaacgcgaaactgagttaaaaacctaccatgattcacgcgaaagatggcaacagttacagcaagaacaggctgccctgcaaagtcaatcgaatgaattagagaagcaaaaaactaagctgacgatcctccttcacgcccttaacgaaaaacagcagcagcaaaaacagttactggaacaaataactcaggaacgtcatcatttatttggggaaagatccgttagcaccgttcgtcagacattacagcaaaagactaatgagctggacatcgcgtacaaacaggctacttcacacctgcaacagcgacaaaacgtgatgaaccaactcactggtgcagttagtgaaattgaaagaaacagcaataccgccgaaacacaatgcaaacttaccgccagcgctttccaaagcggattggaacaacagggatttgccgatcaatctgcctttgaacaggccctactggaacctgaacaacgggaaaagctgcaacaattgcaagaacaacttacacagtatcatttgcaagccaaaacacggcaccatgaatcagaaaccgccttacagcgacatgctgaaacacagccccaattacttgaacaatatgaaccgacgcaagtatccgtgatattagctaacattagtgaagaattgaaacgtaacaatcaacagcaaggtgaagtcaaaaccatactgaacagtgatgctatgcgtcggcaaaaacaacaaacacttctgacacaaatttcccacttacaacaaaactatgatgattggagttacctcaataacctgattggttccgcagacggtgctaaattccgccggtttgctcaaggattaactctggatcatttagtccatctggcgaatattcgactggaaaaattacatgggcgctacgatttgcaacgcaaagatgatggagggctggaattgcaaatcgtcgatacctggcaagcagatgccgttcgggataccaaaaccctctctggtggcgaaagcttcctcgtcagcctggcactcgcactggcgctgtctgatctcgtgagtaacaaaacccagatagaatccctattccttgatgaaggctttggcacacttgatccggaaacccttgatatcgctctggatgcattggatcacttgaatgcgtcaggaaaaacaataggagtcatcagccatgttgaagcaatgaaagaacgcattcctgttcagatcaaagtggaaaaagtgaatggcttgggggtcagtagactggcatcagaatttcgggtttaa

SEQ ID NO: 5150 - DNA, 132 bp, Xenorhabdus bovienii
  Coding sequence Name=Xb4151_4152.C444.gene325.dna; Position on contig= 365936..366067bp; Strand=+
atgcctctcatcgatttaataaattggaataacaggaatgtctttaatcatcacatcaagcgattgctaataaaattgtttatcattcatttcactggcttttttaaccagatgatcaaaaactttatttga

SEQ ID NO: 5151 - DNA, 1623 bp, Xenorhabdus bovienii
  Coding sequence Name=Xb4151_4152.C444.gene326.dna; Position on contig= 366288..367910bp; Strand=-
atgaataaaatcacaataaacaaaaagataaaaatactttcttgtgctattgcgatgatgttgggaaatattgcattgtcccatgctgcggttgttcttgatggtataaaattggcctctaagcaggaggttgtgcgtaataatggggcagaacctgcttcattagatgtacacaaagtttcaagtgatgttgaattcaatatcattcatgatttttttgatgggctggtttataccgacagaaaaggtcatatagagccgagattggcagagcgttgggaaacccgtgataataaaacatgggttttccatcttaggaaagatattaaatggtcagatggcgcaccaatcactgctaatgatatcgtgtttagttggcggcgcctggttgatcccgatattgtttctccttacggtagttatcttgagaatgcggcgattgtaaatgcaaatgatgtgctcagaggcaagaagaaaggtgaggagcttggagtaaaagcattggatgatgtgaccttagaagtcagtctagataaaccgatgggggattttttacagatattgacccatcctgttatggttccgctcaatgaaaaagtgattaaaaaatatggcaataaatggacaaggccggaatcttttgtcggtagcgggccatttaaattgtcagaatgggtcgttaatgaaaaagtcatcggtgtcagaaatccccattattgggatgataaaaatacggttattaataaagtgacttatcttcctctctcttcagataaagcagatctaaaccgttatttggcaggagaaattgatattaccaacactattccattggattcttttgaatcactcaagaatacaatgaacgatcaaatctatatctctcctcaaacaggcgtttatttttacgaaattaataataaaaaaccaccgtttgataatatgaaggtgaggcaggcactgaatttagctgtagatagagaggtgattgttaagaagatattggggcaagggcagaagccggcttatacgattgttcctcccaatgttggagggtttaaatttacagaacctgattatgcttcatggactcaggctcggcgaattgaaaaagctaaaacattattgaatgaggccggatttaatcagaataatccgctcagatttaacttaatttataacacctcagaagcgcataagaaaattgccattgcggttagctcgatgtggaaaaaaaacctcggtgttgatgcggttttgcagaatcaagaatggaaagtgatgcttgataatatgcatcaaggtaaattcgatgttatcagaagagcatggattgccgattataatagccctatgacatttttaagtatgtttatgtcagggcaagttaaaaatacttcactatatgaaaataataattacgatgctttaataaaaaaagcaggagagactaatgataagttgtattatcagcaaggattagatgtcattaccacagattcaccggtcattcctatttattattatattaatgcgaaaatggtaaagccttatgttggtgggttttatgtcaacccgatggggtatatttcgacaaaaaaaatatatattatccagcattga

SEQ ID NO: 5152 - DNA, 1635 bp, Xenorhabdus bovienii
  Coding sequence Name=Xb4151_4152.C444.gene327.dna; Position on contig= 367983..369617bp; Strand=-
atgaaaaaaaataaaatagagttaataacgaaaaaaataattaaatcattatcctgttctatcgttattattatgggaaatatgactttatcccatgctgcggttgtcccaccgggtacgcaactggctgataaacaggaaattgtgcgtaataatggttcagaacccgcatctctggatgtacataaagtagaaagcgatactgaatttaatattattcatgatttttttgatggtttggtttacacggataataaaggtgacatcataccaaaactggcaacaagttgggagacgaaagataatcaaacttggatttttcatttaagaaaaggcgctaaatggtctgatggttcacccattaccgcgcatgatgtggtatttagctggcagcgcctgcttaatcctcaaatgggttctccttatggcagttatctggttaatgccactgtagttaacgcgaatgatatacttacaggtaagaagcaagcggaagatttgggtataaaagcgctggatgattttacgctggaagtgaagttagaccggccagtaggagactttttacagatgctggctcacccggttatggtgattgttagtgaaaaagcaattaaaaaatatggcgataaatggacaaaacctgagtattttgtcggtagcgggccatttaaattatcagaatgggtcgttaatgaaaaagtcatcggtgtcagaaatccccattattgggatgataaaaatacggttattaataaagtgacttatcttcctctctcttcagataaagcagatctaaaccgttatttggcaggagaaattgatatcactctgactattccattggaatccttcgcatcattaaagaaaaactcaggtgaacaaatttatatttctccaaggctgggcgtctattattatgaatttaatatacaaaagccccccttcaatgatgttagagtcaggcaggcactgagtctggctgtggatagggacattatcgccaataaagtcttgggacaaggccaaaaacctgcttatacactccttccaccgaaaaccggtggctttgatttccaacagcctgattatgcatcctggacacaaaaccagcggattgaaaaagccaaatcattgctgaatgaagccggatttaatcaaaataatcctctcagatttaacttactttataacacctcagaagcgcataagaaaattgccattgcggtcagctctatgtggaaaaagaatcttggtgtcgatgcagtgttgcagaatcaagaatggaaagttatgttggataataaatatcaagggaagtttgatgttgccagatatggatgggttggcgattacaacagcccgatgagttttttaaatattttcatgtcagatagtacgcaaaattcatcaaaatattctaataaagatttagatgaactggttataaaatcaggggagacgaataaaaaagattattatcaacaggctatggatattttcactaacgactcgccggttattactgtttattattatatcaatgcaaaaatggtaaagccttatctaggtggggtttatattgatccaagaggttatgtctcgacaaaagacctttatatcattaagcattaa

SEQ ID NO: 5153 - DNA, 1635 bp, Xenorhabdus bovienii
  Coding sequence Name=Xb4151_4152.C444.gene328.dna; Position on contig= 369654..371288bp; Strand=-
atgaaagatatcatgactaagtttataaaaaataaaacaaccaaaatactcacctgctctatagcgattatattggcaaatatcgcgcaatctcatgcagcagtagttccgcccggaacccagttagccgataaacaggaaattgtgcgtaataatggttcatttcctgcctctttggatgtgcataaagttgaaagtaatgttgagttgaatattatccatgatttttttgatggtttggtttacaccgatagcacaggcaatattgtgcccagattagcggaaagctgggaaacgaaggataaccagacttggatcttccatatcagaaaaggcagcaaatggtctgatggttcaccgattacggctcacgatgtggtttttagctggcaacgcttacttgatccagagataggatctccttatagcagttacctcggctccgcttttgtggttaatgcaaacgacatactgtcaggtaagaagaaaaaacaagagctgggtgtaaaagcgacggatgattttaccttggaagtcaaattagagaagcctgtcgcttatttattgcagatgttgactcacccgactttggtgcctatcagtgaaaaagccgttaaaaaatatggtgataaatggatgcagccagacgtttttgtttctagtggcgcttttaaactgtctgaatggaaagtgaatgaaaacgtggttggtgtcagaaaccctcagtactgggatgataagaacactgtaatcaataaagtaacttatctttctgttgtatcagaaaaagcagatttaaaccgctatctcgcaggcgaaattgatatcacccagtctattgcattggattcctttgcgtcattaaagaaaaaattgggcgatcaggttcatattgctcccatgttgagtacttactattacgtcttcaatactaaaaagccgccatttgatgatgtcagggtgaggcaggcattaagtttagccgtagatagagacgttattgctgataaagtattgggacagggtcaacgacctgcctatgatattattccgccaaatacggggggattcaatttagtaccacctgaagctgcctcttggacacaagaacaacgtattaaaaaagctagagaattattgaatgaagcgggctttaatcaagataatccactgcaatttaacctgctttataatacaagagaagcgcataagaaaattgctatagccgttacttcaatgtggaaaaaacatcttggtgttcaagccaacttgcaaaatcaagaatggaaggtgatgttagataatatgcatcaaaataagtttgatgttgtcagatacgcatggactgcggattataatagccctatgtctttcttggatacgttcatcacaggaagtagtcataacatacccttatatgaaaatagcgattttgatcagatggtgattaaagcaggtgaaaccaatgatataatctattatcaaaaagctatgaatattttcaccaatgatatgccaatcattcctatctactattacgttagtaataaattggtaaaaccgtatgtcggtgggatttacattaatccaatggattatatttccacaaaagatttgtatataattaaacattag

SEQ ID NO: 5154 - DNA, 1650 bp, Xenorhabdus bovienii
  Coding sequence Name=Xb4151_4152.C444.gene329.dna; Position on contig= 371417..373066bp; Strand=-
atggagaatatcaatatgcagaattttatggtgagcttaataaaaaataaagttgctaaagcattaacctgtattgtgagtcttatactagggagtgtaacttactcttatgcagccattattccttctggtacacaattagccgataaacaagaaatcacgcgtaataatttttcagaacccgtctctttagaccctcataaatccgacagcagcagtgaatttgatattctgcgtgatttttttgaacggatggtggctatcgataaagaagataaaattattcctgctttagctgaacgttgggaaaccaacgataataaaacgtgggttttccatttaagaaaaggtattaaatggtcagatggttcacccatcactgctcatgatgtggttttctcttggcggcgaatggttacgcctgacattatttctccttatggtagctatttggttcaggcaactgtggtgaatgcatatgatgtgttatcgggcaagaaaaaacccgaagaactcggtgtgaaagcactggatgatgcaaccatagaagtcactttgggaaggccaaaagcggatttattacaaatgatagcgcatccggtaatgtctcccattagtgaaaaggttgtcaaaaaatatgggaataaatggacacaacccgaattttttgtcagcaacgggccttttaaactctctgagtggatagtgaatgaaaaaattgtgggtgtcagaaatccttactattgggatgataagcatacggtgattaacaaagtcacctatctgccactgtcagactataaagctgacctcaatcgttatatggcaggagagcttgatatatccaacggtggcccatcggatttctttccaacactcaaaaagaagtttggcgatcaattccatatttcgcccataatgagcgtttattattatctttttaatacgcaaaaaccgccatttaatgatgttcgggtcaggcaagcactgactttagcgttggacagagctattattactgacaaggtattggggaatgggcaaaaacccgctttcgatgtagtttatcccggtagtgggggaatttttttaaaacatcctgattatgcctcatggacacaagaacagcgtgttgcaaaagccaaagcgttactgaatgaagccggttttaatgaaaataacccgctcaaatttaccttgttgtataacacgtcagatacccataaaaaaattgccattgcagccagttcgatgtggaaaaagaacctcggtgttgaagttgttttacaaaaccaagaaagcaaatcattgtacgataccatgtctcaaggaaattttgaggttgtcaaatacgcatggaatgcggattataatagcccgacatcttttttagatatttttaccacaggaaataccaataatataccgcaatatagtaataaaaaatttgatcaatgggtattaaaggcggatgaaaccaacgacaaaatatattatcagcgggcacttgatatcctcactcaagattcacctgccattcctgtttattattatgttcgcactaaattagtaaaaccttatgttggcggggttcatattagcccgttaggggatgttccaacaaaagatttgtatattattaaacactag

SEQ ID NO: 5155 - DNA, 669 bp, Xenorhabdus bovienii
  Coding sequence Name=Xb4151_4152.C444.gene330.dna; Position on contig= 373325..373993bp; Strand=-
atgacgagccgagcattgaagctctgtcccttgctgtctgcctatgaaaaaattgccactccgctggcaaacagcgtgatcggcaaactggaaagcagtctgactcaacagacaacccgtggtggcgaatcctcgttgggtaaagtcattgctgacgctcacttattcaccaccgcgccaaaaaaggcggggggagcgcaacttgcgtttgtgaatagcggtggtatccgcgccccgatggatgccggcgatgtgacgtacaacgcaatttataccgttcagccgttttcaaatatactggtgaccaagacattgactggcgagcagatcaaacgtctgctggaacagcagtgggatcgttcacggccacaggttctggcgatatctcacagtttcgaatacgcatgggatagctcaaaacccgtggggaaccgtgtcatgttcagttcgatgaaaatcaatggtaagcctgtagacttaaaagcgaaatatcgcgtggcggccaatgaatatctggcaacggggggcagtaatttctctgtatttaaagagggaacaaattctgtttacagcgtccctgatatagaagctatcgttaactacttcgctaaaaagtctccgattatttatccaaaacaggatcgtatcgttgatataaatagaaaataa

SEQ ID NO: 5156 - DNA, 321 bp, Xenorhabdus bovienii
  Coding sequence Name=Xb4151_4152.C444.gene331.dna; Position on contig= 373947..374267bp; Strand=-
atgcgtttttttaaactattgcctattgttctggcattgacggcggcgggatgtgcaactaaacctgctgatgacacagcaaatagagttgatgttcgggtactggccttgaatgactttcatggcgccctgaaagcacccggtgcaaatcagccggggggtatcgaacatatggcaacgctactgaaagaactgaagcaagagaatccgaataatatcgtggttgctgcgggtgacatgataggcgccagcccgctgctatcttctatgtttcatgacgagccgagcattgaagctctgtcccttgctgtctgcctatga

SEQ ID NO: 5157 - DNA, 1953 bp, Xenorhabdus bovienii
  Coding sequence Name=Xb4151_4152.C444.gene332.dna; Position on contig= 374337..376289bp; Strand=-
atgaagaatgtgttgaagatttcaacattggcaatgctggtggcattcaatgtgaatgctgcaacagtcgatttacgtgttatggaaacatcggatatccacagcaatctgattgatttcgattactttaaaaataaacctactgagcaatttggtctggttcgtaccgcgaacttaatcaaagcagccaaagctgaagcaaccaacgcggttctggttgataacggtgacctgattcaaggcagtccgctggcagattatatggcggcaaaaggccttaaaaaaggtgatgtccatcctgcccacaaactgatgaataccatgggctataccgtgggtaactttggtaaccacgagttcaactttggtctggattacctgaaacaggccatcgcaggtgccaaattcccttatattaatgccaatatcatggatgccaagacaggcaaaaactactttacgccttatattattgttgataccccagtcaaagatcgtgaaggcaaagaacacaccattaagatcggctatatcggctttgtgccacctcaaatcactatttgggataaagcaaatctggatggcaaagtggtggtcaacgatatcaccgagactgcgaaaaaattagtccctcaaatgaaaaaagaaggggcagacttgattgtcgccatccctcattctggcttttcccaagagccttacaaagcgatggcggaaaactccgtttactatttgagtgaagtttccggtattaacgccatcatgttcggtcattcccacggtgtcttcccgagtcaggaatatgctggcatcaagggcgtcgatgttgccaatggaacagtcaatggcattcctgccgtaatgccgggtcagtggggagatcacttgggcgttgttgatctggtgatcaataacgacagcggcgaatggaaaacggaatcagctaaggcggaagcgcgcccaatttacgacaaagcccacaaaaaagcgcgggttgagcgggataacaaactggctgccattattgagaaagaggacgaaggaacccgtaagttcgttggcaaatttatcggtaaagcctctgcggatatgtatagctatctggctctgatccagagcgatccgaccgttcagatcgtcaatgatgcccagattgattacaccaagcgttttattcagggagatcctgatctggccgatctgccggtattagctgccgcagcgccatttaaagtgggtggacgcaaaaatgcgccggctgattttgtcgaagtagaaaaaggggatcagactttccgtaacgctgccgacctgtatctctatccgaataccctggtggtagtgaaagcgagcggcgctgacgtcgttcaatggctggaatgttcagcggggatgtataaccaaattgatccgaactcggccaaaccgcaaaatttactgaactggaatggcttccgtacttataacttcgataccatcagcggcgttgattataaaatagatctgacccagcctgcgaaatatgataccgactgccagcttctcaacaaagaggcgaatcgaatcaaagatgtgacctatcagggtaaacctattgatccgaaagcgactttcttgattgcaaccaataactaccgtagttacggcggtaaatttgcgggtacgggtgataaccatatcgccttcgcttcacccgatgaaaaccgcactattctggcctcctacatttcccgaatcaccaaagagaagggcatagtatcaacgcaggctgaaaacaactggtcattcctgcctatcaagacggataaaaaactggatgtgcgctttgaaacgtctccaaccgagaaagctgcaatattcatcaaatcgcacgctcaatatcctgtgaaatacctgaaaaatgatgatgttggttttgctgtctatcaaattgatctgacagagaagaaataa

SEQ ID NO: 5158 - DNA, 393 bp, Xenorhabdus bovienii
  Coding sequence Name=Xb4151_4152.C444.gene333.dna; Position on contig= 376495..376887bp; Strand=-
atgaaaaatatgaaatcgttagcagctttaataggtttattagttatttttggcagtgttaattccgccactgtatacaatgacaagggaactcagatggaactgaatgggcagttccgtttaaaagcgcaggtaaccagccaggatcgtgatatcagaatgctcgatgatggcagccgtattggtatctcaggcagccacgagctcaccaaagctattaaagtctttggcaaaatgaaatggggttctgatacccagaaaaccaatagtgataactatgaaaccagctttgatatgtttaaccgtgtcggttatctcggtttttctcatcgggattatggtcagatccaatttggccgaacttataaaaacagacttatacggttggtgtag

SEQ ID NO: 5159 - DNA, 909 bp, Xenorhabdus bovienii
  Coding sequence Name=Xb4151_4152.C444.gene334.dna; Position on contig= 377544..378452bp; Strand=-
atgcgtataggtattgatctcggcggaaccaagattgaagtgatcgcattgggcgatcagggtgaagaattgtttcgtaaacgggtggatacgccccgcaacgattatcagcaaacactggtagcgattgccgggctgattgccgatgctgaacagaccactggccagaggggaacggtgggtattggcatccccggagccatttctccttttaccggaaaagtgaaaaatgccaactcagtctggatgaatgggcagatcctggataaggatctttctgccttgctggggcgtgaagtgcgggtcgccaacgatgcaaactgtctggcagtgtcggaagcgactgatggagccgcagcaggtaaaccaatggtgtttgccgtcattattggaacgggctgtggttcaggtattgcttttgatggcaaggtacatgcggggggaaatggtctggcaggggaatggggacataacccgttaccgtggatggacgaggaagatcgggcatatcaagaagaagtccgttgtttctgtggtaaaccgggatgtaccgaaatgtttgtgtcgggaacgggattcatgacggattacttccgcttaagcggggttcgtaagaaaggtcatgaaatcatggaagcgctggtacagggggatgagatagctgagttggctatacgccgttatgaaagacgtctggcacgggcgctggcacaagttattaatttacttgatcctgatgtcattgtgctgggaggtggcatgagtaacgtcgatcgcctttaccagaccttaccagatttagttcaagagtgggtttttggtggggagtgtgcaacgccgatcaaaaaagcactgcatggtgactccagtggggtacgaggtgcggcttggctgtggcctcataaataa

SEQ ID NO: 5160 - DNA, 912 bp, Xenorhabdus bovienii
  Coding sequence Name=Xb4151_4152.C444.gene335.dna; Position on contig= 378678..379589bp; Strand=+
atgttatggttcaaaaatttaatgatttaccgtttaaaccgagaaatatcactttctgcggatgaactggaagaacagttaagctcattggcgttcaccccatgcggtagtcaagatatgatgaagacaggctgggttcctccgatgggcgctcacggtgaaacgctcactcatgccacaggtaatcagatcctcatctgttcgcgcaaagaagaaaaaatgctgccttctccggtgataaaacaggaactacaggccaaaattgcccgtctggaaggtgagcagcaccgtaaactgaaaaaaacagagaaagactcactgaaagatgaagtgatccacactctgctgccaagggcattcagccgtttcaatcagacgtacatctggatagatacggtcaacaatctgattattgttgacgcagccagtgcaaagcgcgctgaagataatctggcattactgagaaaaacgctgggatcactgccagtcgttcccctcacattcaccgaccctattgaattgaccctaaccgagtgggttcgttcaggcgatttacccgccggttatgccttgatggatgaagctgagttaaaagccattctggaagaaggtggcgtgatccgctgtaaaaaacaggcattggtgtctgacgaaattgcgacacatattgaatctggcaaattcgtcactaaactggcattggattgggaagaacgtattcaattcatgctgtcagatgatggttctttcaaacgcatcaaattcagcgaaacactgcgtgatcaaaatgacgatatcgaccgtgaagatgttgctcaacgattcgacgcggattttatcttaatgacgggcgaattaagtgcgcttatcaaaaacactattgatgcgttgggcggtgaagcagaaaggtaa

SEQ ID NO: 5161 - DNA, 1146 bp, Xenorhabdus bovienii
  Coding sequence Name=Xb4151_4152.C444.gene336.dna; Position on contig= 379683..380828bp; Strand=-
atgataaaacacaacgcaatggtaatggcaattccggttctcctcatcgctggcacagtaaatgctgctgaaatttataataaagacggtaataaaattgatttatatggcaaggctgatgttcagcattattttgccaaatcagggaataaaaaggatggtgataattctgtcgctcgtctggggatcaaaggagaaacccagattacggatcagttgacggggttcgggcgttgggaatataacatgggtgcaagcgggtctgaaaccgaaggtgctaagaataacagaacgcgtctggctttcgccgggttgaaattcggcaagtacggctcactggattatgggcgtaactatggtgtggtatatgacaccaacgcatggacggatgaattgccattctttgggggtgattccatagctgcgaccgataatttctggatggggcgttcgacagggttattaacgtaccgtaatactgactttttcggattggtggacgggcttaagtttgccctgcaataccagactaaaaatgacagcaacaccattaatggccgtgatgatattttgagacaaaatggggatggttttggtctttccagctcctatgatttcggtaatggtatcagtgtggccgcatcatatggcaactctaaccgaacttccgcacaaaaaaatgggactgataaaacgaaggttgtcgccaaagggaataatactgaagcatggctgatgtctgtaaaatatgacaaaaacaatgtgtatctggccgctatgtatggtgaaggccgtaatttaacccgatttggtaaactcgataattatgttttgttcgcaaataaaacacaaaatatcgaactgaccgctcagtatcagtttgattttggtctgcgtccatcaataggctatgtttattcgaaaggcaaagatttgggtggagacagtgagactaacgtgctggctgctaaaagctctgaagatttagtgaattacgtctctgtcggtgcttactataattttaacaaaaatatgggcacttatgctgaatataaaatcaatttgatgaaagacaatgactttaccaaaaaagtgaacatcaatacggataatgttctgggggttggtttagtttatcgattctga

SEQ ID NO: 5162 - DNA, 639 bp, Xenorhabdus bovienii
  Coding sequence Name=Xb4151_4152.C444.gene337.dna; Position on contig= 381353..381991bp; Strand=+
atggaaaaaaaatatccacgcccacgaggtcgccctacaattcctgaacaagaaatacgccagaaaattcatgatgtcactctttctctcctttttacccaaggctatattacgaccacgatggatgtggttgcccaaaaagctggtattgcaaaaaaaacactctatcgctttgtcaaaaatcgagaagacttgcttgagcaaattgtactgcgctggacagatagctgtactcctacttttgagaaagatgccagcagttttaaacaggcaataaaattattagaaaaatatttgagagaaatagctcagaaattactgtctacagattctgtgggattattcaaattactgcaatctgatttcccttttcgggaagtgctactaaaaaaatatcaaaaaagtgtatttgaaagagacaaaataattttggccaattggctggagaaccaatatcaaaaagggttactgaggaaatttaactataatattatcagcgaattaatcctttcaatggttattgcagaaccactcagacaaatggttctgggtatcatcccacctctgccagaaacagatattacccctcaccttgcagcagcaataacgttgcttgaactgagtttggtaaagaaataa

SEQ ID NO: 5163 - DNA, 906 bp, Xenorhabdus bovienii
  Coding sequence Name=Xb4151_4152.C444.gene338.dna; Position on contig= 382103..383008bp; Strand=-
atgagcatatatggttgtggagaaaggagcgaacctgctcattcttatccggagcagggaagtgattctcagaatggggattatgccgctgtggcaggtaaaaaaaacagacaatttcatgcagacattccgcaaaacagcaatcagcctattatcatccaccactactatcaccataatggtgatgtgcatcatcattaccacggcaacgaacaaatgccagaatttgatgtgcctgtgtctgaccgttgccaaaagcagatgctgcaaattgaactggacgtattaagccagaataatcacattgcagagtgcaaccgccggtactttatcctccaccatattttggcgctgaatctgatagctagcccaggctcaggtaaaacaacactactgatggccacactgaatagattacggaataaagttacctgtgctgctattaagggggatcagcagacgagccatgatgctgaccgtattcgagctgtgggaattcaggccgtccaggtgaataaagggaaggaatgttaccttgatgccgaaatggttcgtgaagctatccggcaattgaagccggccgaacacagtttgttatttattgagaatgtcgggaatttagtttgcccagccagttttgatcttggcgagcagcataaaattgttatgttgtctgtcactgaaggagaagataagccgttaaaatatccgatgatgtttgctgaagctgaattgatgatcatcaacaaggtcgatctcctgccttatctcaatattgaattggaggcctgtattcaagccgcccgctgtattaatcccgatatcgatgtgattgcactgtctgcgtccacaggagaagggattgatcaatggttatcatggctggaagcccgcttgtctgcttga

SEQ ID NO: 5164 - DNA, 279 bp, Xenorhabdus bovienii; identical to SEQ ID NO: 890
  Coding sequence Name=Xb4151_4152.C444.gene339.dna; Position on contig= 384121..384399bp; Strand=+

SEQ ID NO: 5165 - DNA, 270 bp, Xenorhabdus bovienii
  Coding sequence Name=Xb4151_4152.C444.gene340.dna; Position on contig= 384350..384619bp; Strand=-
atgaacgtctgtattttggcggaagcctggtcatgtattaaatggttagttgctgtgatatgcttccggctttttaaggatgaagtatggccaaagttgatgtctattgccgttattgccacaaatcagaacaggtcaaaggacatgggaaaggaaatggcggacatcctcgttatcgctgttatagctgctgtaaggtctttcagttggcgtatacctatcaggcctgcaaacccggcgttaaagaacagattgtcgatatcgcgatga

SEQ ID NO: 5166 - DNA, 1053 bp, Xenorhabdus bovienii
  Coding sequence Name=Xb4151_4152.C444.gene341.dna; Position on contig= 384700..385752bp; Strand=-
atgtctgaaaatatcatctcaaaaaaagaaaccgtgtatccggaaatcaatataaaagccctgaatcaagcggtaaataatatctggcgtctggcgcaacgacaaacatcgggtattgcaattatcgaggagaaaaccaagcggataagtctttattgccgtgatttcgatgaagctgtacgcagttctctatcgcaattggaaccaactctaaaacaattggctacgcaagaatattttcaaacgattactgaaattgatgaggctttggcagcccccgatctgaatgatgacgatcgtaatgctctgctggaagaacgcgagcaattgattcagcatttggcgaaagatgtcgatcaggttatttccaatgtccgtgatgaaacgaatcaactgactggcaaaattaatgacattcgcaatatggtgatttcagagcggctgggagatcttctgacgcaagctcaatcacaaaaaacggaattgcagagcgctatcgagcagaaatccgcagaacaaaataaactggatgcggctcgggctaaaattatcgaaagtcaggatgttatccgccagaataatattgcggatatgtttaaagattttatccccagcgccagcgacatcgataaattggatttcacccagcctaaaaaagaagccatcaaacaggcgattaaacaaggtgtggagatagccagaaaaatactgggcaaagtctccgaagggctgaaatatgcggagctggctgatgccagagttaaactcagtgatcaaatagatcagttgaccaaagaatctgacacgctgaagaccacgttacgggaaacagagcaacgtcttgctggcataacagacacgatacaaatcgatgaagagcgcacaaccttcctcgctgaagcggtcaaactggaacaaacgtggaatttattcgctaatcaactacgaaatttatcgggcaaccaaatcaatcaggaggatttaaccagcctgatcaacagccaactggatttccttggtaatctggcatcgcaatacaatatgttgaaataa

SEQ ID NO: 5167 - DNA, 1215 bp, Xenorhabdus bovienii
  Coding sequence Name=Xb4151_4152.C444.gene342.dna; Position on contig= 385795..387009bp; Strand=-
atgtcattaagtcagttttcagcagaaagtacgataaatggagcagagcttcccgccatcaccttaaaattattggcgagccaaatcgacggtgcagcccgtcctggtggaatatttactaaagaagaccttattagtattaaattatatgttaaacacagtttgtcactcccttttactctggaaaccgtaaagcgttatatcggttacaatgatattgatatcgctggattgaaacccgcagatattaccgatttgtttaaagaaattcataaccatgcacttagctggagcggcgtggaagagaatgttcagcagcagagtatcaatctggaaagcgcgggaaaacaaattaccggaacgggagaagatataatcagcattattaatgagatgccgattattcaacgtgtaaaaacaaagctgggagatttaacagagaagcaattggctgaaataacttataccaatgacgataaagagatatcagtcgaattggggaatatcctcaatagcatggcgaaagatattgagagtcaacaggtaaaaactcaacaggtaaaaacagcggtatctgattttaagcgcacactgattggtggtacgttatcaaatggcaagaatgctgatgggttgcagccacaggtcaataataagaaaaaactgatggaagataataatctttctgccacgatcaaagatttgaatgagaaaattactgagaaaaacaacgaaattgagcaacttaaaaaagactacgataaattcgttggtttgtcattttctggtgcaccgggcggtattatcgggctggctattaccggcggcatttttggtgacaaagcggaaaaagcccgtaaacggaaaaatgcactgattgatgaagtcagcggtttgcaagatcaagttgaaggtaaaagcgcattacaaaagtctattcaaaaattggtcttacagtttggtgacattgatatccgtatgctggatgcggaagttgctctgaatcacttggattttatgtggagcaatatgctgactcaaattaatacgtctaaggataagtttgccgaaattaatgatgcgctgaaactcacttctttcgtgacagcatttaaacaagtgattagtccttggaaagaagttcaaggttctgctgcgcaattagttaaaactttcgatgaagccttggcagaatataaaaagctcaatagctaa

SEQ ID NO: 5168 - DNA, 426 bp, Xenorhabdus bovienii
  Coding sequence Name=Xb4151_4152.C444.gene343.dna; Position on contig= 387780..388205bp; Strand=-
atggcaatacgtcttaatgaagatttggacgatggcggtgaattgcatgagattaacgtcacgccatttattgatgtgatgttggtgctgctgattattttcatggtggcagcacccttggcaacagtagatattaaggtagatttaccggcatcgtcagctaaaccacaaccgcgaccagagaaacccgtctttctgaccgtgaaagcggatcatcagttatatgtcggtgaacaattgattgagcgtgacaatctatcttcagtattggatcagacaactcagtccaataaagaaaccacgattttcttccaggcggataagacggtggattatgaaaccttgatgagtgtgatggattccctgcgtaaagcgggctatctcaaagttggcttggtaggaatggaagccgttgccgctcaataa

SEQ ID NO: 5169 - DNA, 993 bp, Xenorhabdus bovienii
  Coding sequence Name=Xb4151_4152.C444.gene344.dna; Position on contig= 388212..389204bp; Strand=-
atgcgtaatttgacagcttctattctattggcactcggattaaccggttcagcatgggctgatacagtaccagtcacaacggctacttcgccagaaaatcaggcagccgttcaggtagccgctccggcaacaccagcaccagcatcttctggcgctctgcaggtagatgttccaaaaactgaagcacagcaagcgggtgaaccgaaggctgctgcccagaaagcggatgctcaacccgcggctgaaacgaaatctaccgaacctgtggacgaatctgaaagtctatccagtggttttgcaacggatctttccgtctggggcatgtatcaaaatgctgatgcggtagtaaaaaccgttatgttggggttggtgatcgcttctgtcattacatgggcgctctttttctccaaaggtactgaacttttaattgctcgtcgccgtttacgcaaggaacaatgggcattggcagatgcagccaatctggatgtggcagcgaaaattgcttcagatttcggtaagcaaagtatcagccgtctgttgttgagtgaagctcagtctgaacgcgctctgtctgcggcaagcactgacaaagcaggcaccaaagaacgtacttcattccgcatggagcgtgcggttgctgcaatcagccgccacatggggcgtggtaacggctatctggcgactattggtgctatttcaccgtttgtcggcctgttcggtacagtgtgggggattatgaacagcttcatcggtatcgctcactcacagaccactaacttggccgttgttgctccgggtatcgcagaagcattgctggcgaccgcactgggtctggtggcagcaatcccagcggtagttatctataacatttttgcccgtgttatttcgtcataccgtggtcaagtaggggatatggcggcacaggcaattctgttgctgggtcgtgatcttgatctggctgacagcaaagtagaaaaagcagaagcaaggtaa

SEQ ID NO: 5170 - DNA, 1194 bp, Xenorhabdus bovienii
  Coding sequence Name=Xb4151_4152.C444.gene345.dna; Position on contig= 389552..390745bp; Strand=+
atgaccgaaaagaaactggagaccttattggtcagtacaggcagaaagaaaaaatatactcagggtgctgtcaatcccctcattcaacgcacttcatccatcattttcgacaccgtcgaagacctgaaacatgcgttgaaaaaccgggctaagagtgagttattctatggacgccgtggcactctgactcatttcgcctttcaggaagcgatgacggagctagaaggcggtgcaggctgtgctctgtatccttccggcgcagcagcgatcacccattcgattctggcctttgtggcaactggcgatcatgttctgctgacagggagtgcttatgagccgacgcaagatttctgtaatcacatcctcaaaaagatgggcatttctaccgattattttgacccgatgatcggagaagggatcgcatcactgattaagccaaacacaaaagtcgtttttcttgaatcccccggctctctcaccatggaagtgcaggatattccgtccatcgtgcgtactatccgccagatcaatcctgagattgtcattatcatcgataatacatgggcggccggcattctctttaaagcgctggattttggcatcgatatttccatccaatcggccacaaaatatatcattggtcattcagacggcatgctggggacggcggtcgctaatgcacgctgctgggatcaactcagagaaagttcgtatctactgggtcaaattgccgatcccgatacagtttataccgcaacccgtggattacgtacgctggcaattcgcttaaaacatcatgaagagagcagcctgcacatcgccaaatggctcgcccagcggccagaagttgccgaagtttatcaccccgctttgccttcttgtccggggcatcattatttccagcgtgatttcaccggcgccagcgggttattttccttcctgctgaaggtcgaactgacccctcagcaattcgctgagtatctggataatttacatcatttcaaaatggcattttcatggggcggatttgaatccctgattctgggtattcagcctgacatgctcacttcgctgcgtcgatacgatcccctcaaaaagacgggaacattatttcgcgtgcatatcggattggaaaacccacaagacctgattgacgatcttgcagccggttttgcccgtattgcacccctttag

SEQ ID NO: 5171 - DNA, 669 bp, Xenorhabdus bovienii
  Coding sequence Name=Xb4151_4152.C444.gene346.dna; Position on contig= 390940..391608bp; Strand=+
atggaaatattaagcgagatcgtgcatgcgctctggcaacatgattttacccaactcgccaatcccgaggttatctggattatttatggtgtcctctttgtcactctggttctggaaaacggcttactgccagccgcttttttacccggcgataccctgctggtactttctggtgccctgattgccaaaggcgtcatgagcttcatccctacggttatattgctgaccatcgccgccagtctgggatgctggctgggttacttacaggggcgctggctcggccatactcgaattgtcaaaaactggcttgcccagcttcctgtccaatatcgcgagcgtgcccacgtgttgtttgctaaacatggtttgtccgctttacttgtcgggcgctttttggcctttgtccgcactctcctgccaacatttgccggtatttctggtctaaataataaacgttttcaattttttaattggttaagtggcttcttatgggtcatgattatcgtgagttttggctatatcttgaatcagatccccttcgtcaaagcacatcaggatctggtcatgaatattttgatgatcctgcctatcattctgttgttcagcgggcttttcgcttctctgttgatgtactggcgtcacaaaaagacatcatcaaaaaaaaagtaa

SEQ ID NO: 5172 - DNA, 840 bp, Xenorhabdus bovienii
  Coding sequence Name=Xb4151_4152.C444.gene347.dna; Position on contig= 391800..392639bp; Strand=+
atggatcagcagacaattattaagctcgttgatgggaatcttatgccacaattgggacttggcgtttggcaaacgagtaatgagcaagttgttaaagctattcacactgccctggaggttggctatcgttccattgatactgcggcgatttatcacaacgaaagcggagtcggcaaagcattaaaggaaatcgatattccgcgtgaagaaattttcgtcaccactaaactctggaatgatcgccaccaagatgccaaagcggcattagaagaaagtttggataagctgcaactggattacatcaatctctatttacttcactggcctgttccccatcaggatcaatatgttgaagcctggaaacagcttattgaactgaaagaatccggtctggctcgtagtattggtgtatgtaattttcacattgaacacttacagaacttgatgtcagaaacgagcgtcattcctgctatcaaccaaatcgaattgcaccctctgatgcagcaaagacaactgcattcgtggaatgcaactcaccatattacaactgaatcctggagcccattgtcacaaggcggaaaaggcgtctttgacaacccattggttcaacatctggccattaaatatgaaaaaactcctgcacaaatcgtgattcgctggcaccttgactgcggcatgattgtcattcctaaatctgtcacgccttctcgtattaaagagaactttgacgtatttgatttcaggttggaaaaagaagatttgacggctatggctgaattggatattggcaaacgaatagggccaaaccccgatatttatactggcgatcacgtcaaataa

SEQ ID NO: 5173 - DNA, 300 bp, Xenorhabdus bovienii
  Coding sequence Name=Xb4151_4152.C444.gene348.dna; Position on contig= 392969..393268bp; Strand=+
atgacttacatcatgatttctttattaatgctgatcccttttttctttttggtgaaacggttcctattatcaaatcatgttcatcagaatgtctctggcattatgttgacggtagttgcgatagctgttcatatgtatatatttcgctttgatagagttccgattgtcagcgtttccattcccaatattgtcgcttacggttctatcgtaattgcactgttacatggcatgatctattccatctgcttcagattgtattttggcagggaatcttatgatgaccattcaaggattgattaa

SEQ ID NO: 5174 - DNA, 3225 bp, Xenorhabdus bovienii
  Coding sequence Name=Xb4151_4152.C444.gene349.dna; Position on contig= 393352..396576bp; Strand=-
atggcaaaacgtactgatattaaaagtatcctgatcttgggtgcgggtccgattgttatcggtcaggcttgtgaatttgactattccggcgctcaggcttgtaaagcgttgcgggaagaaggctatcgcgtcattctggtgaactccaaccctgcaaccatcatgaccgatccggaaatggcggatgcgacctatatcgagccaatccattgggaagtggtacgcaaaattattgaaaaagagcgtccagacgcaattttgccaaccatgggcgggcaaactgccctgaactgtgcactggaactggaacgtcagggcgtactgacagaatttagcgtgaccatgattggtgcaaccgctgacgcgattgataaagcagaagatcgtcagcgttttgacaaagcgatgaaaaaaatcgggctggatactgcgcgttctggtatcgcccacacgatggaagaagcgctggcagtggcagaagacgttggcttcccttgtatcattcgtccttctttcactatgggcggaagcggcggcggtattgcttataaccgtgaagaatttgaagaaatctgtgagcgcggtctggatctttccccaaccaacgaattattgatcgatgaatcattgattggctggaaagagtatgaaatggaagtggtgcgggataaaaatgacaactgtatcatcatctgttcgattgaaaatttcgatccaatgggtatccatacgggtgactctatcaccgtagcgccagcacaaacactgactgacaaagaataccagatcatgcgtaacgcttcgatggcggtactgcgtgagattggtgtagaaactggcggctcgaacgttcaattttcagtgaacccgaaaaatggtcgtttgattgtgattgagatgaacccacgcgtatctcgttcatctgcgctggcttccaaggcgacgggcttcccgatcgcaaaaattgcggcaaaactggcagtgggttatacccttgatgaattaatgaatgacatcacgggtggccgtacaccggcatctttcgagccttctatcgattatgtcgttaccaagatcccgcgtttcaactttgaaaaatttgctggcagcaatgaccgcctgacaactcagatgaagtctgtcggtgaagtgatggcgattggccgtactttccaggaatccatgcagaaagcgctgcgtggtctggaggtcggcgtgaccgggttcgatcctaaagtcaatctggatgatccacagtcactgaccaagatccgcagcgaattgaaaagcgctggcgctgaacgcatctggtatgtcgccgatgctttccgcgcgggtatgtctattgatggcgttttcaacctgactaacattgatcgctggttcttggtacagattgaagaactggtgcgtttggaagagcaggtggaagaacagggcattaatggcctgacgtttgatttcctgcgtcatcttaagcgcaaaggctttgcggatgcacatttggcgaaactggtcggcgtatctggcaaagagatccgcaaattacgtcacgattacaacttgtatccggtttataaacgtgttgatacttgtgcggcagaattttcgaccgataccgcttacatgtactccacgtatgaagacgaatgtgaatccaacccgaaccatgacaagccgaagatcatggtattgggtggtggcccgaaccgtatcgggcaaggcattgaatttgattactgctgtgtacatgcgtcactggcactgcgtgaagacggttacgaaaccatcatggtgaactgtaacccagaaactgtttcaacggattacgacacttccgaccgtctctattttgaacccgtgacactggaagacgtgctggaaatcgtccgtgttgaaaagccaaccggtgtgatcgtccagtatggcggccagacgccattgaaactggcgcgtgagttggaagcggccggtgtgccgattatcggcaccagcccggatgctattgaccgtgcagaagaccgtgaacgtttccagcaggctgtcaatcgtctcggtttgaaacaacctgcgaacgctaccgtctccaccatcgaacaggcggttgagaaaggtaatgggcttggctatccgctggtggttcgtccatcttacgtgctgggtggacgtgcgatggaaattgtctatgacgaaactgacctgcgtcgttacttccagaatgcagtcagcgtatccaatgacgctcccgtattgctggatcgcttccttgatgatgcggttgaagtcgatgttgatgctatctgtgatggtgagcgtgtcttgattggcggtatcatggagcatatcgaacaggcaggggttcactccggcgactcagcgtgttcactaccagcttacacgttgagtcaggaaattcaggacgtgatgcgccagcaagttgaaaaactggcttttgaattgcgtgtccgtggtctgatgaacgtgcagtttgcagtgaaaaataacgaagtgtacctgattgaagtgaacccgcgtgcggcacgtaccgttccttttgtttccaaagcgaccggtctgccgttggcaaaagtagctgcacgggtgatggcgggtcaatctctgctgaaacagggcgtcactaaggaaattattcctccgtactactctgtaaaagaagtggttctgccgttcaataaatttctgggtgttgaccccattttgggaccggaaatgcgttctacaggtgaagttatgggtgttggccgcactttcgctgaagccttctccaaagcgatgctgggcagtagctccacgatgggcaagcacggccgtgccctgttgtctgtacgtgaagaagataaagagcgcgttgttgatttggccgctaaactgctcaaacagggctttgaactggatgcgacccacggtacagcgattgtgttgggtgaggcggggatcaacccacgtctggtgaacaaagttcatgaagggcgtccgcatattcaggatagaatcaaaaacggtgaatataactatatcgttaataccaccgcaggccgtcaggccattgaagattcaaaactgctgcgtcgtagcgcactgcaatataaagtgcattatgacaccaccctgaatggtggttttgcgactaccatggcactcagtgcagatcccactgagcaggtgatttctgtacaggaaatgcacgcaaaaatcacaggataa

SEQ ID NO: 5175 - DNA, 1275 bp, Xenorhabdus bovienii
  Coding sequence Name=Xb4151_4152.C444.gene350.dna; Position on contig= 396594..397868bp; Strand=-
atgcgcgcaatttgccaaaattttgacaaaaatcatcaattggcattgattcaaaggattatttctgaattaatatgcatcggatgcgacttgttattcattctggagggcgttttgattaagtcagctatattggttctcgaagatggaacccaatttcatggtcgcgccataggtgtagagggtgtggctgttggagaagtggtcttcaatacctcaataaccggatatcaagaaatacttaccgacccttcctattcccgccaaattgttactcttacttatccccatattggtaataccggcatcaatgccgctgatgaagaatcccccgccatccaagcccaaggtctggtcattcgcgatttgcctttagtgaccagcaatttccgcagtgaagaaaatctgtctgattacctgaaacgccacaacattgttgccattgctgatattgatacacgcaagctgacccgcctgttacgggaaaaaggtgctcagaacggctgtatcattgcgggtaatgaggcagatgctcaagttgctctggaaaaagcgaaagctttccctggtttgaaaggcatggatctggcgaaagaagtcaccaccgaacaatcttacccgtggttacagggaagctggacattggcagatgggctaccggaagtttgcaaagagcaagaattaccgtatcacattgtggcttatgattttggtgtcaaacgtaacatcctacgcatgttggtggatcgtggctgtcgcgtaacggttgttcctgcccaaacccccgcggatgaagtgctgaaaatggcaccggatggcattttcctgtctaatggccccggcgatccagagccttgtgactatgctattgaagcaattcaggctttcttgaataccgagatcccagtatttggtatctgtttggggcatcagttactggcgctcgccagtggcgcaaaaacggtgaaaatgaaatttggtcatcacggcggcaaccatcctgttaaggacttggagaacaatgtcgtcatgatcacagcacaaaatcacggtttcgctgttgatgaaagcaccttaccaacgaatctgcgtgtgactcataagtcactatttgacggcacactgcaaggtatccatcgcactgacaaacctgcattcagttttcaggggcatcctgaagcaagtcctggcccacatgaagccgcttcactgttcgaccatttcattgaattgattgaacagcatcgtcagaaccacgttcagaacaccaagtaa

SEQ ID NO: 5176 - DNA, 822 bp, Xenorhabdus bovienii
  Coding sequence Name=Xb4151_4152.C444.gene351.dna; Position on contig= 398191..399012bp; Strand=-
atggctgatacagatattcgcgttgctgttgtaggtgcaggtggccgtatggggcgtcatctcattcaggcagcccagcagttggatggcgctacgctcggtgcggcgctggagcgttcaggttcttcattagtgggaacagatgcgggagaattggcaggtatcggcaagaatggtattaccgtcagtgatgatttgcatgatgttattgagcattttgatgtcctgatcgattttacccgaccagaaggtacactcgcttacctcgcaatctgccgccagtatcgcaaggcaatagtcatcggcacgacagggtttgatgacgcaggtaaacaggcgattgaagacgcttctcgtgatattcctatcgtttttgccgctaatttcagtgtcggtgttaatctggtgctgaaactactggaaaaagcagccacagtgatgggggagtatacagatatcgaaatcattgaagctcatcatcgtcacaaagtggatgctccgtcaggaacagcgctggcaatgggggaatctatcgcccatgctttagggcgtgatcttaaaacctgtggggtctatgcccgtgaaggccatactggtgagcgtgacccgaaaagcatcggatttgcgacggtgagggcgggcgatatcgttggagagcataccgcaatttttgcggacattggtgagcgtgtagaaataagtcacaaagcttcaagccgtatgacctttgctaatggagctattaaagctgcaatatggttgaatgcgaaaaacaatgacctttatgatatgaaagatgtccttaaccttaaaaatttataa

SEQ ID NO: 5177 - DNA, 954 bp, Xenorhabdus bovienii
  Coding sequence Name=Xb4151_4152.C444.gene352.dna; Position on contig= 399283..400236bp; Strand=-
atgcaaatattgctggctaatccccgtggtttctgtgctggtgttgatcgtgccatcagcatcgttgaacgtgcgttggaactgtatggcgcaccgatttatgttcgtcatgaagtggttcacaatcgttatgtggttgacaatctcagggaacgtggcgctattttcattgaaaacattgcagaagtccctgatggtgcgatcctgatcttctcagcacatggtgtttctcaggctattcgtgcggaagcccgctcccgtaatttaaccatgctgtttgatgctacttgcccactggtgacaaaagtgcatatggaagtggcacgggcgagtcgtaaaggcaaagaagcgattctgatcggtcatgcaggccatcctgaagtggaaggcacgatgggacaatacaataaccctgaaggcggcatgtatctggtggaatcaccggcagatgtgtggaaactgcaagttaaggatgaaaataacctctgctttatgacccagacgacgctttctgtggacgacacatcagaagtgatcgatgcgctgaatgcacgttttccgaacattgttggcccacgcaaagatgatatctgttatgccacgactaaccgtcaggaagcggttcgtgacttggcatcaggcgccgatgtggtcttggtggtcggctcgaaaaattcatcaaattcaaaccgtctggctgaactggcacagcgggtaggtaaacctgcttatttgattgattcggcggatgatatcaaatcagagtggatcaaaggtgtggacgccattggcgtaactgcgggagcatcggctccggatatcttagttcagcaggttattgaacgtttaagagcctttggtgcggatatcgtcaccgaactgcatggacgtgaagagaatattgtctttgaagtgccaaaagaattgagagttgaggtaaaagaagttaattaa

SEQ ID NO: 5178 - DNA, 471 bp, Xenorhabdus bovienii
  Coding sequence Name=Xb4151_4152.C444.gene353.dna; Position on contig= 400217..400687bp; Strand=-
atgtcaacgcaggtgcaagtgcacagtgcagttttattacacttcacattaaagctggatgatggctcaacggcagactcgacttacagtcaaggtaagcctgcattattccgcttgggtgatggcagcctctccgcgccattggaacagcagcttcttggcttgaacgtgggtgataaacatcaattcacgctggcgggtgaagccattttcggcaaacccaaccctgatttggtgcaatactttacaccccgtgattttgccgacgccggtattcctgaagtaggaaccatcatgctatttactgctatgaatggcagtgaaatgccgggtttagtcaaagaagtggctgaaggttccatcatcgttgattttaaccatccgctggctgaccaaaacatcacttttgacattgaagtgttggagattgaccctcagttggaggaaaatcatgcaaatattgctggctaa

SEQ ID NO: 5179 - DNA, 510 bp, Xenorhabdus bovienii
  Coding sequence Name=Xb4151_4152.C444.gene354.dna; Position on contig= 400793..401302bp; Strand=-
atgaataaacccatttgttccactggtcttcgctggctttggctggttgtagtggtattgatactggatttaggaagcaaacagttagtgttgcagaatttcacactatatgaatccacgccattgataccttatttcaatctgacttatgctcagaatccgggggctgcgttcagttttctcgctgataagggcggctggcagcgctggttctttgcattggtggctatcatcatttctgctgtactgctggtgatgatgtaccgctctagtgccaagcagaaactgagtaatgctgcttacgccttagtgattggtggggcattggggaatttgttcgatcggctggtacatggttttgttgtcgatttcatcgacttttacgtcggggaatggcactggcccacttttaatattgcagattctgcgatctgtatcggggcggctttcatcatcatagagagctttatcagcccggatgacaagaaaacagcatcgaaatcacaataa

SEQ ID NO: 5180 - DNA, 2814 bp, Xenorhabdus bovienii
  Coding sequence Name=Xb4151_4152.C444.gene355.dna; Position on contig= 401302..404115bp; Strand=-
atgagtgactataaagacaccctgaacctaccggaaacagggttcccgatgcgcggggatttagccaagcgcgaaccagatatgttaaaacgttggtacaaagaaggtttgtatcaggcgattagaaaagcgaaatctggtaaaaaaacatttattttgcatgatggccctccatatgcaaacggcgatattcatattggtcactcagtcaataaaattctcaaagatattgttattaagtccaaagggctgtcaggctacgattcgccttatattcctggttgggactgccacggtttgccgattgagctcaaggttgagcaaattattggcaagccgggggaaaaattttccgccgctgaattccgtgctgagtgccgcaaatatgcaatgagtcaggtcgaagtacaaagagccggtttcatgcgtctgggggttctgggcgactgggataaaccttatctgacgatggatttcaaaaccgaagccgatattattcgtgctctgggacgtatcatcggcaatggtcatttgctgaaaggtgttaaacctgttcattggtgtactgactgtggctcctcccttgcagaagccgaagttgaatattacgacagaacttcgccttccattgacgttcgcttcaaggccgttgatgcggacgcggtgtatgccaaatttgatatacagtctcctggcctgccggtttctctggttatctggacaaccacaccgtggacattaccagctaaccgcgctatttctctgaatgccgaaatcacctatcagttggtcaaaatagaagacgagtgcctgattctggcggcagaactggttgaatccgtcatgcagcgcgcgggcatgacttcatggcaagtgctgagtgactgtactggtgcggatctggaactgctgcgcttcaaccacccattcatgggcttcgacgttcctgcaattctgggtgatcacgttacgcttgaagccggtacaggtgcggtacatactgcgggtggtcacggcccggacgactactccatcagcctgaaatatggccttgaaattgcgaacccagtcgggccgaatggctgctatatctctggtacttatccttcactggatggcgtatttgtcttcaaggcgaacgatattatcgttgaactgctgcaagaaaaaggcgctctgctgaatgtggcaaaattacagcacagctatccttgctgctggcgtcacaaaaaaccgatcatcttccgtgctactccacagtggttcatcagcatggatcagaacggtctgcgtgaacaatccctgaaagagatcaaaggcgttgagtggataccgggctgggggcaggcacgtattgagtcaatggtagaaaaccgtccggattggtgtatctcccgtcagcgtacatggggcgtaccaatgtccttgttcctgcacaaagaaacgcaggaactgcatccacgtacacaagagttgatcgaagaagttgccaagcgtgttgaagttggtggtattcaagcatggtgggatctggataccgcagaattactgggcgctgacgccgctgattacgtcaaggcaccggatacgctggatgtttggtttgattcaggaagcactcactcctctgttgtcgacgctcgtccagagttccacggcaactcagccgatatttatctggaaggctccgatcagcaccgcggctggttcatgtcctcattaatgctgtctacagcgattaagggcaaagcaccttaccgccaagttctgactcatggattcacggtggatgaacagggacgcaaaatgtccaaatccatcggtaataccgtcagcccgcaagatgtgatgaacaaactgggtgcagatattctgcgcctgtgggtggcatccactgactattctggtgaaattgcggtttctgacgaaatcctgaaacgctctgctgatgcgtatcgccgtattcgtaacaccgctcgtttcctgctggcaaacctgaatggttttgacccggaacaacatatggtgaaagcggaagatatggtcgcgctggatcgttgggcggtaggccgtgctcaggcagcacaggctgacatcctcaaatgctatgacgaatatgatttccattccgtcgttcaacgtttgatgcagttctgctccgtagaaatgggttcattctatctggatatcattaaagaccgtcagtataccgcgaagagcgacggtctggcgcgtcgtagctgccagagcgccttgttccatatcgcagaagcactggttcgctggatagcgccgatcctttccttcaccgctgatgaagtctggaatgaactgccgggcaaccgcgcccagtatgtctttactgaagagtggtatgacgggctgtttggtctggcagatggcgaagatatgaacgatactttctgggctgaattgctggaagtacgtggtgaagtgaacaaagttctggaacaggctcgtgctgataaacatatccgcagttcactggaagccgcagttaccctctatgctgacgaatcgctggtagaaaaactcaacaaactttctgacgaattgcgttttgtcctgctgacttctcaggtagaagttgccacttatactacagcgggtgacgatgcacagcagagtgaacttaaaggcttgaaaattgctttccgcaaagcggatggagaaaaatgcccacgttgctggcactatgctaaaaatgtggggctggtggcggaacatgcagaactttgcggccgctgtgtgactaacgttgccggtaacggtgaagagcgtaaatttgcctga

SEQ ID NO: 5181 - DNA, 945 bp, Xenorhabdus bovienii
  Coding sequence Name=Xb4151_4152.C444.gene356.dna; Position on contig= 404142..405086bp; Strand=-
atggagctaattcgcggtgtacacaatatccgggcgcgccaccatggttgcgtgctgacgattggtaattttgatggtgtccatcgcgggcatcaggctttattgaaacatctgaaacaagaagggctgcgttccgggttaccgacgatggtcatgattttcgaaccgcagccattggaagtttttgctgtcgataaagcgccagcccgcctgacacggctgagagataaaataagatatctatcccagtatggcgttgattatctgttatgtgtgaaatttgaccgaaatttcgcagctaattcacctgaagcctttgtttcacggttgctcgtggaaaaactgggtgttaagtttctggcaataggggatgatttccgttttggcaaaaatcgtctcggagattttcactatttacaacaagcgggtaaacaatactgttttgatgtcgccagtacagacagcttctgtgacagcggcctgcggatcagcagtactgctattcgtcaggcgctgcaagatgatgatctggcattggcagaaacattattggggcatccttacagcataagtggcagagtcgttcacggtaagcgcttgggacgtaccattgggtttcctacggcaaacttaccgttgaaacgtctggttgcccctgtaaagggcgtttatgctgtggaagtttatggattgggcgataaacccttaccgggtgtcgctaatattggtaatcgacccacagttgcgggtctgggccagcaacttgaagtgcatttgattgatacccagatggatctgtatgggcgtcatattgatgtggtattacgcaaaaaattgcgtgatgagcagcgatttgcttcgcttgatgcgcttaaacagcaaatcgcaaatgatgtggttgctgcaagggattgtcttttgcagcgatccgagtcatgtatctag

SEQ ID NO: 5182 - DNA, 183 bp, Xenorhabdus bovienii
  Coding sequence Name=Xb4151_4152.C444.gene357.dna; Position on contig= 405515..405697bp; Strand=+
atggtgcgtacttttatcaagaaagtatacgtggctatcgcttctggcgataaagaagctgcacagaaagcattcaatgacatgcaaccaattgttgatcgtcactcctgcaaaggtctgatccacaaaaataaagcagcacgtcataaatctgctctggcagcgcaaatcaaagcaatgtaa

SEQ ID NO: 5183 - DNA, 909 bp, Xenorhabdus bovienii
  Coding sequence Name=Xb4151_4152.C444.gene358.dna; Position on contig= 405798..406706bp; Strand=-
atgcgggtttcacatttaaactttaaccacctttattacttttggcatgtctgcaaggaaggctccgttgttggagcagcagaggcgttatacctgacaccacagaccattactggtcagattaaggctctggaagaacgtttggctggaaagttgttcaagcgtcaggggagagggttggttccgtctgagttggggcaattggtttttcgttatgcagataaaatgtttatgctcagtcacgaaatgctggatatcgtcacttacagccgagaatcaaacctgttgtttgatgtgggtgtagcagatgcgttatccaagcgcttagtcagcaaagtgctggaaaccacagttgtagagcatgagaaaatccatctgcgctgttttgaatcaacccatgaaatgctacttgagcaactgagccagcataagctcgatatgatcctgtcagattgcccggttgactcttctcagcaagaagggctgttctcagtgaaactgggcgaatgcaatgtcagcttttactgtcgtcagccgatcccagaaaaaccgtttccagaatgtctggaagagcgccgtttactgatccccggtcgccgttcgatgctgggcagaaaacttctgacatggatacgtaataaaaatctgcaagttgaagtgctgggtgaatttgatgatgctgcgctgatgaaagcatttggcatgtatcataacgctatttttattgcgccttctttctatgccagtgatatcttcgttgatagcgatattgttgagattggtcaattggatgctgtacaagaagaatattatgtcatttttgcggagcgtatgatccaacatccggctgttcaacgggtgtgtaacaaggatttttctgctttattcagtacaccactaaaaaaataa

SEQ ID NO: 5184 - DNA, 1197 bp, Xenorhabdus bovienii
  Coding sequence Name=Xb4151_4152.C444.gene359.dna; Position on contig= 406718..407914bp; Strand=-
atgactgcaatcattcgccagtttttaaagttagaagcagcgggaggaattatcctcattatcgctgcgattgttgcgctggttttggcgaatacaccattgcagggtatctaccaccaatttctcaaccttccggttgcggtgcaatttgccgccttggaaattaagaaaccgctgttgctctggatcaatgatggcttaatggccgtatttttcctgattgtcggcttggaagttaagcgagaattaatggaaggttcgctggctggccgtgacaaagccgttttccctgcgattgccgcagttggaggaatgatcgcaccggcgctggtctacctgttgtttaacggtggtgatgaaatcgctcggcagggttgggctatccccgccgctacagatattgcatttgcgcttggtgtcatggcactgctgggaaaacgtgtgccaacagcattaaaagtctttttgcttgctctggcgattattgatgacttgggcgtcatcattattatcgctctgttttacaccaaaaccgtttcgttaactgctctcggcctggcaggggctatgatagcgcttctgatttggatgaactggcgcggaatagctaaaacatctgtttatctgatggtcggtgctgttctgtggatttgtattctgaaatcaggtgttcacgcaacattagctggcgtcatcgttgggttcatgatccctttgcgctgtaaaaaaggtcattcaccttctgaagcacttgagcatggtttgcatccatgggtggcttatttaatcctgccattatttgcttttgccaatgcgggggtttcgttgcagggggtaacattgaacggcttaacgggaatgttgccagtgggaattgcccttggcctgtttattggcaagcctctgggtatttttctgtttagctggatctcagtaaaactgggcatagccaaattaccggaagaaattggtctgaggcagatttttgccgtctcggtactgtgtgggatcggttttactatgtctatttttatttctggtctggcatttgaaggtttaaatgaggctttcagtacttactcccgcttgggtatattgattggctcaacagccgcagctgttattggttatggattattgaatatacttttgccgaagagaaaacatcgccaaacgcagatgaatagattaatttag

SEQ ID NO: 5185 - DNA, 846 bp, Xenorhabdus bovienii
  Coding sequence Name=Xb4151_4152.C444.gene360.dna; Position on contig= 408123..408968bp; Strand=+
atgtcaaccttactattattatctgtactcgctgccgccttgttacatgctagttggaatgccttagtcaaaatcaatgcagatcgctttttgagtatttcaatactcgtattttttgccggtctgatttcgacatccggattgttctgggttggattacccacacccgcctctctatcgtggttaatactctcttccatcttgcatatcggttattgcctgtttctgagccgttcttatgccacaggagatttaagtcaggtatatcccatcgccagagggtgtgcaccgctaattaccgtcttattgagttggataatattgcaggaagtattaccgccctttgccatgctaggcgtcggtttaattatcgcaggggttattttgatcgcatttcctcacggtaagaaatccatccggatagatcgcaggacattaatcgcagcgctcacaacctcaatatttactgcctgctataccttatctgatggaattggctcccgtgccagtgatagcgccttaacctatatcttgtggttattcgctattcatggctggtcaatgggtgtgattatttatttcaaataccggaaaacggctggacaaaacgtccgtcaatactggaagcaagggttaataggtgggctaatgcagttgttgagctatggtattgtcatttgggtaatgagtcacgcctcaattgtactggtagccgcactgcgtgaaactagcgtgctgtttgcggtgctattatctgtctttatcctgagagaaccattcagcaaaatgcggttattagcctgtgtcgtgattgtggcaggaattttttgtactaagttagagtga

SEQ ID NO: 5186 - DNA, 216 bp, Xenorhabdus bovienii; identical to SEQ ID NO: 1249
  Coding sequence Name=Xb4151_4152.C444.gene361.dna; Position on contig= 409063..409278bp; Strand=+

SEQ ID NO: 5187 - DNA, 279 bp, Xenorhabdus bovienii
  Coding sequence Name=Xb4151_4152.C444.gene362.dna; Position on contig= 409229..409507bp; Strand=-
atgagccactattcgcttcaggcggggttcccaagcataccaaagccagcgttggtttttcttattgccgacaaacgaccattgctcgtcgatttcacagacaatctggatgtcacattccgcaaggggaagtgtcgttacgtttcggggtctgaggtttttaatgttttcatgacggtggcggtggcgactttcaggatccgagcggtgtcacgaattcccccgttattcatcgcgatatcgacaatctgttctttaacgccgggtttgcaggcctga

SEQ ID NO: 5188 - DNA, 1188 bp, Xenorhabdus bovienii
  Coding sequence Name=Xb4151_4152.C444.gene363.dna; Position on contig= 409864..411051bp; Strand=-
atgcactcaaacagtagtttttccgtatatcttattgccattggtgcatttgcccttggtatggcttcatacgtaacggctggcttgatccctttgattgaaacatctttttccgtatctgttgctatggctgcacagttagtgactgcttttacactggcgtatgggctgggttctccattaattgttgcagtgctacccatgaataagcagaggcaagggcttttgttagcacttgtcattttctttgtggccaatgttgccagtgcattaagcagtaattttcaaatgttattaatattcagagctattgcaggcattggtgctggagtttatctggctatgggaattgcagcttcggcagccctttcagaacgcaataatcagggtaaatctatcgccattatcatgggtggcatggcaagtggagtggtattaggtgtgccccttagccttattttagctaattatgcaggctggcaggcagcactatggctgataagtttattgggattggcatcatttattggattggctttaaagcttcctgccttgcccgatacttcacacattcctctgaaaagaaaaatagctattttagctgatggtaatgtcttaatgattttgtcagtttcccttttggctgcaatatccagcttgggaatgtatacattcattgcgccattaatttcagagccaagttataacgtgaatgtttctgtaaccacttatttatgggtatggggaattggcggggttattggtagcttcctgattgggccaattatagatcggattaaaggcccattactgacattgattatcatggtattactcgctatttcattattattactcccattgttcgctgaaataaatcagtggttggttatgttgccaattgcattatggggagctgtaggatgggcattacaagttccacaaaataatgagttgattagtacccgtgagaagcagggagatggaaatttagcggtagcattgaatgagtctgcactttatcttggtagtgctattggtgccgctatcggaggattgttactttcattgagtattccaatatggatcctagctgttgccgcaggtggaattgccgttatcggggggatcatacaaatattttatcttttacgagcaagtcaaaggacaacgaatagttctcaatag

SEQ ID NO: 5189 - DNA, 408 bp, Xenorhabdus bovienii
  Coding sequence Name=Xb4151_4152.C444.gene364.dna; Position on contig= 411131..411538bp; Strand=-
atgagtatggctgttggtttagaagtaagagtaccattttgtgaccatcgtttagttgaatatgcatttaacattccttggaacatgaaatcgtttgatgggcgggagaaaagtatattgcgggcagctacccgtgacattttaccagcatcaatttctgaacgtgtcaaaagtccttatccatcgactcaagatcctgcctatgaaaatgctttgcgtaacaccatgtctgagatcatgttggataatcaagcacctgttcgcccactttttgatcaaaaacttgttaatgagaaactcagtttttctgttggttcaaattcacctatgtattcccgtatgggaatggaacttgcggttgggcttaatagttggttaaatgaatacaaagttgagttaaatttttag

SEQ ID NO: 5190 - DNA, 147 bp, Xenorhabdus bovienii
  Coding sequence Name=Xb4151_4152.C444.gene365.dna; Position on contig= 411472..411618bp; Strand=+
atgcatattcaactaaacgatggtcacaaaatggtactcttacttctaaaccaacagccatactcattcgatcttttcgatccagcaatgtctgcacaaaacgagagttatttttataatgatattttcattgactctattagctag

SEQ ID NO: 5191 - DNA, 369 bp, Xenorhabdus bovienii
  Coding sequence Name=Xb4151_4152.C444.gene366.dna; Position on contig= 411718..412086bp; Strand=+
atgttttcagaagataattctcttttattttttacatcacggttgattctccgtcaatttgaaataaaagatttctccaagtatcaaagttatcattcattgccagaagtttacacgtttctatatagttatcctccagcagatgagaatatgcatgcccaattcaatagagttatgtcccctgcatttaataataatggagatgaggtaaggcttgccgtaattctaagggaaaataatgatttggctggagaaataatgttaagactaacgaataaagagtcacaacaaggagaaatatacccgtcgtcattgaagatgcttgatttttcatttgtatcagatcatgattgcgcccatgaaaattaa

SEQ ID NO: 5192 - DNA, 1050 bp, Xenorhabdus bovienii; identical to SEQ ID NO: 483
  Coding sequence Name=Xb4151_4152.C444.gene367.dna; Position on contig= 412064..413113bp; Strand=+

SEQ ID NO: 5193 - DNA, 357 bp, Xenorhabdus bovienii
  Coding sequence Name=Xb4151_4152.C444.gene368.dna; Position on contig= 413468..413824bp; Strand=+
atggaaacgatgaagaaccataaaatgcttctattgttgtgtaccacactgggatggtcacttatcactggctgctccagcataatgacccacagcgggccttatcaaggttattactctggagcaaaagccagcattggcatgctgaaagatgacagtactgggtgggtcatgaaaccgttacttgccgtagatctcccgttctctgcctttctggatacgctcctgttcccctatgattatacccgttccagcaaagaccaagctgaacactcacctaagcatcgccttgaaaaactggaacaacgctcaactgccacagcaacagctccagaaaatacgaacagtgaaacatag

SEQ ID NO: 5194 - DNA, 1302 bp, Xenorhabdus bovienii
  Coding sequence Name=Xb4151_4152.C444.gene369.dna; Position on contig= 413825..415126bp; Strand=-
atggtctttaaggaacgccagattacattcgacaaccgtagccatcagataactaatataaatatctggactcctgatagtcaatggctggtatacgacgttcgccccagtggtgcgtcttttacgggtctcacgatagaaaaaattcatgtcggcagtaggcaggtaaaagtgatttatcaggcgcaggatgacgcgcatgttggcgttgtgacggtaaatccacaggagcctgttcgctatgcgttcatccacggcccagaaaagccagatacgcagtggcagtatgattttcatcatcgccgaggcgtgattgtctctgatgcccagccaaatgtagccgtcaacattgaggcgctggatattactccaccttatacatccggcgctctgcgcggtggtacgcatgttcacgttttcagccctgatggtaaccgtttgagttttacttataacgaccatgtgatgcatgaacgagatcccgcgcttgatttacgcaatgttgccgtggctattcctctgagagcagtcattccaccgaaaaaacatcccagagaatatgatggtagttatttttcagttattgtcagccgtacaacaccgcagccacgttctggcagtgatgagatcaatcgggcttatgaagaaggctggattgggcagcggggatatcccaaagaaaatggtcagtggcagcgttgggcgctggcttttattggtgatacctgtgctgagaacggtgaaaagatacccgaaatttatctcgttgatttaccggataataatgaggattatgccattgagggcaaacagcctttggcaggaacagaaaccacactgccagcaccaccagcaggtgtgaaacagcgccgtttaacttttacccatcaaaatcgctggccgggagtggtaaatgttccccgacactggctgagaacatcaccggatggcagcaaaatcggctttctgatgaaagacgaagcgggtatcgttcagttatggtacatctcgccaaatggtggcgtgccagtgcagatcactcacagtacacatcacatacagtcggcatttaactgggacagacgtggccgattcatcgcctttgtttgtgacaacagtatcatgctctgtgatagccaaaatggcgaaatgcatcggctgacagcacgtactgatgatgcaccttctgcggatgcgattgtgatatcaccggatgaccgatatgtggctttcatgcgtgatattgatggttatcggcaaattttggttgtcgaaactggcatcactgatgtgggggaatag

SEQ ID NO: 5195 - DNA, 618 bp, Xenorhabdus bovienii
  Coding sequence Name=Xb4151_4152.C444.gene370.dna; Position on contig= 415266..415883bp; Strand=+
atgctacttagtgttctttatatcattggtatcacggctgaagccatgacaggcgccttagccgcaggtcgccggaaaatggatgtgttcggcgttatcattattgcttccgtgacggccattggtggtggctccgtccgtgacattattctgggtcattacccacttggctgggtagaaaatccagcctacatcgtgactgttgcctgcgctgcggtgatcactatctgggttgcccccatgatgaaacatctgcgccgtttatttctcattctcgatgccattggtctgattgtcttttccattattggtgcacaaattgctctggatatgaaccacagcccgatcatcgccgccattgctgccgtgattacgggggtttttggcggggtactgcgcgatatgttttgtaatactatcccgctggtattccagaaagagatctatgcgggtgtttctttcgctgccgcttggctatatatcgggttattacacacgccattgcacccgaacagcgtggttctgattacgcttaccgcagggctggcggctcgattgattgctatccgttatcgtcttggtttacccatcttcaattatgagggttctgagcactga

SEQ ID NO: 5196 - DNA, 1860 bp, Xenorhabdus bovienii
  Coding sequence Name=Xb4151_4152.C444.gene371.dna; Position on contig= 415858..417717bp; Strand=-
atgcttaattttctcatcatgatattggcgctgttgtttggaatacctgtggcattagcgggaatggcagagcaggtgccagcagaatttactgaaagcgtagaaaccggtagtacaggaaacatggcggattgtcctgtttggccacaggagaaaatccaacgtgaaatgcagcacctgacacggcagatggcggagtgggatcagctttatcgtcaacagggtatcagtgaaatcgatgacgaattctatgatcaactattggaaatcctgacactttggcgaacttgtttgcatcagacgtcagacagcacgttttctgttgctgtgccacgggaaggaaaacaacctcatcctgtgcagcataccggattaaacaagctgaaaggggtaaaagaaattcaccagtggctacagggacggtcggttgtttggctgcaacccaaagtggatggtgttgcggtcacgttggtttatgaaaaaggccgactggtggggttaatcagtcgtggcaatggttcggaaggaacgaactggatggataaaagttcatttattaccgacattcccaaacagataaaaaatgcaccagagcgcttggtgttacaaggtgagttgttctggcagcaagataaccaccgccaatctgttgcaggtggtcagggggcgcgcagcaaggtcgcagggctgatgatgcgcaagtcatctgcgccagaacttggtcagataggaatatttatctggggctggccagatgggccaaatgagatggcggtaaagctggagcgattggcatcaatggggtttcccactgcacagcaatatagccaccgaattttcagtgcggaagatgctgaaaaaaggtggagctcctattttatccagccacttccttttgccacagatggcgttgtcttaagacaggaaactgagcctactggccggcagtggcgtgcaggctcaaacagttgggcgattgcctggaagtacccattacagcagcaattgacaactgtgagagatgtcaatttcaagataggccggacaggaaggatttccgttttgctggagctggaaaaagtgaagctggatgacaggcaggtcaggcgggtcaatcttggttcagtcagtcgctggagacagtggaacgtttatccgggagataaagttacggtagcgctggcggggcatggcgttccgaaactcgataaagtggtatggcgtattgctgaacggcctgatattcagccaccgaatgcgcaggactttcattcgctgagttgccttgtatcccatgatagttgccagcaacaatttattgcccgtctgacatggcttggggaaaatctgaacatgcaaggcattgggcaaggaacatgggccgctttggtgaaacatgggctggtgacacatttaacggattggctggcgctggatattgcacaacttactgaagtgccaaacatagggatcaaacgtgccgagttgatttttgctcagttccagcaggcaagattacagccgctttcgtcatggcgtgaagcgatagggttgccttatgccaatcgatttacggatgaaatgggctggcaacaggatttactgttatccaaaacaggcgcgaagaattcattaacgacaaaacagaccgcaaaaattgcagcttttttgcagcatccggagattaaaacgttagtccatgcattaactgtacatggaattggagaaaaacaggaaagtgaggaaaatacggttggggagaagaaagaagtggagtcggtaagttattcagaagcaagggagcaagaacatgcctccgatgctcttaataatgtcagtgctcagaaccctcataattga

SEQ ID NO: 5197 - DNA, 624 bp, Xenorhabdus bovienii
  Coding sequence Name=Xb4151_4152.C444.gene372.dna; Position on contig= 418024..418647bp; Strand=+
atgaaccaaggaacgttatatattgtttctgcgccgagtggagcaggcaaatcaagccttattcaggctttattaaaaactcagcctttgtatgacactcaggtttctgtttcacatacaacgcgcccaacgcgtcctggcgaaaatcatggtgagcattattttttcgtcactgttgatgaattccagaatatgatcagccatgatgaatttttggaatatgctggtgtttttggtaactattacggcacatcccgcaaaattatcgaagatacgctagccagtggcgttgacgtttttcttgatattgactggcagggtgcgcagcaagttcggcagaaaatgccggcagcccgtagcatttttattcttccgccatcgaaggaagaattactccgtcgcctgcggggtcgcggtcaagacagcgatgaagtcattgacaaacgaatgtctcaggcggtcgcggagatggaacattacggcgaatatgattacgtcattatcaatgatgatttcaatacggcactggccgatttacaatccattattcgttcagagcgtatacgattagatcgtcaggctcaacggcatgatgccttaatcagcaaattattggcaggctga

SEQ ID NO: 5198 - DNA, 276 bp, Xenorhabdus bovienii
  Coding sequence Name=Xb4151_4152.C444.gene373.dna; Position on contig= 418702..418977bp; Strand=+
atggcacgcgtaactgttcaagacgcagtagaaaaaattggtaaccgttttgacctggtgttggtcgctgctcgccgagcacgccaattgcaatcaggcggtaaagatcctctcgtagcagaagaaaacgataagatgactgttatcgctctgcgtgaaatcgaacaaggcctcatcaacaataaaattcttgatgttcgtgatcgtcaggagcaacaagagcaagatgccgcagaaattaaagcggtttctgtcatcgctgaaggtcgtcgctaa

SEQ ID NO: 5199 - DNA, 2109 bp, Xenorhabdus bovienii
  Coding sequence Name=Xb4151_4152.C444.gene374.dna; Position on contig= 418996..421104bp; Strand=+
ttgtacctgtttgaaagcctgaatcagcttgttctcaaatatttgcctgaagatcagatagttctactgaaacaggcctatgttgttgcgcgggatgcccacgaagggcaaacccgctccagtggtgagccgtatattactcaccctgtcgctgtttcctgtattctggccgaaatgcgtcttgaccatgagacactcatggcggcacttctgcatgatgtgattgaagatacgccagcgacatttcaggatatcgaacagctattcggcacggctgtcgccgggttggtggaaggtgtctccaaactggataagctgaacttccgcaacaagaaggaagcacaagctgaaaacttccgcaaaatgatcatggcaatggtgcaggacatccgcgtcattctgatcaaactggcagaccgtacacacaatatgcgaacccttggctccctgcgccctgacaaacggcggcgcatcgccagggaaacgctggaaatctacagcccactagctcaccgtctgggtattcatcacctgaaaacggagctggaggagctgggatttgaagcactgcaccctaaccgttatcgtgtgattaaagaggttgttaaagctgctcgcggcaatcgcaaggagatgatccagaaaattctgtcggaaattgaaggcagattaacggacgctggcatccaatgcaccgttagtggacgggaaaaacacctctactctatttatcgcaagatgcacctgaaagaacagcgttttcactccatcatggatatttacgcctttcgcgtcatcgtcaacaatcttgatacctgctatcgcgtactggggcaaatgcacagcctgtataagcctcgtcctggcagagtgaaagattatattgccattcccaaagccaacggctatcaatccctgcatacctctcttatcggcccacacggcgtccctgtcgaagtccagatccgtaccgaagatatggatcagatggcagaaatgggggtggcggcacactgggcatataaagagcagggcgaatcaggcactacagctcaaatccgcgctcaacgctggatgcagagcctgttggaacttcagcaaagtgcaggaagctcttttgaatttattgaaagcgttaaatctgatttatttcccgatgagatttacgtttttacgccagaagggcggattgttgaattaccggcgggggcaagcccggttgacttcgcctatgccgttcataccgatatcggtcatgcctgcgttggagcacgtgttgatcgccagccttatccactgtcgcaaacacttagtagtgggcagaccgtcgaaattattacggcgccaggtgcgcgcccgaatgcagcatggctgaactttgtcgtcagttccaaagctcgcgccaaaattcgccagttattgaaaaatcttaaacgggatgattcggttggtctggggcgtcgtctgctcaaccatgcgcttggcaacggaaagaaaattaccgatattccgcaggaaagtatcaccaaagagctggtaagaatgaaacttgccacattggatgatttgctggctgaaattgggctgggtaatgctatgagtgtggttgttgcacggaatttactgggtgcaacggaaaagattccaaacaacaacaatagcacccgtaaactgcccatcaaaggggctgacggcattctgattacctttgcaaagtgctgtcgtccaattcctggcgacccgatcatttctcatatcagtccgggaaaaggtctggttattcaccacgaatcctgccgtaatatccgtggataccagaaagagccggaaaaattcatgcctgtcgaatgggataaagatgtcaacagcgattttatcgccgaaattaaagttgatatgtttaaccatcaaggcgcactggcgaatctgacggcggccatcaacgatgctaactccagcattcagagcatgaatacggaggaaaaagatggtcgcgtttattgtgctttcatcaggctgacgacccaagaccgcattcagttggcgaatattatgcgtaagatacgcgttatgccagatgtgatgcgagtcagccgtaaccgaaactaa

SEQ ID NO: 5200 - DNA, 2082 bp, Xenorhabdus bovienii
  Coding sequence Name=Xb4151_4152.C444.gene375.dna; Position on contig= 421283..423364bp; Strand=+
atgaaaggccgactacttgatgctatccccttaaccaccttgcgtggagttggagccagccaggtcactaagctcgccaaattagggctggtcaatctacaggacttgctgctacatctgcctctccgttatgaggatcaaacccgtctatattccatcaatgacttactgcccggtgtttatgccaccgtgacgggtgaggtcttgcgtacccatgtcacttttgggcgtcgtcgcatcatgacctgccaaatcagtgatggaaccggcgtattgaccctgcgctttttcaatttcaccgccgccatgaagaataatttagcagaagggaagcacgtcattgcctatggcgaaatccggcgcgggaatcagggacctgagattattcatcccgaatataaaacccagcaacacgctgaacgcattcagttgcaggacacattgactcccatctatcccacgacagagggagtgcgtcagacaacactgcgtaagttaatcgagcaagcgctggaacttcttgatacctgtgtcattaacgagttattgccggaagagtttagccgcaagcttatcagccttcctaacgcactgcatactttgcatcgtcccccgccggatgtttcgctgactgatttggataatagacgacaccctgctcaacgccggctgattctggaagagttgctggcgcaccatttaagtatgctggcagtcagggccggtgctcaacgctttcatgcccagcagctcaccgcagataattctttaaaacagcaacttattagccaattgccctttgttccgacaggtgcacaggtacgagtagtcgcagagatagagcaagatttggaaaaaaatgttccgatgatgcgcttgatacaaggggatgtcggttctggcaaaacactggtagccgcactggccgctttacgggcgctcgttcacggtaagcaggttgcattaatggcacccactgaactgcttgctgaacagcatgccaataccttccgtcaatggtttgaaccacttggcattcaagtgggttggctggcaggcaaacaaaagggcaaagcgcgtcaggcacagcaggaagctatcgcaaacggtcaagtaagtatggtggtcgggacacatgcgatgtttcaggagcaggtcagattctcaggtctggcactggttatcatcgatgaacaacaccggtttggtgttcaccagcgccttgcattatgggagaagggatgtgagcaaggctttcaccctcatcagttaatcatgaccgccacaccgattccacgtaccttggcaatgacggcttatgccgatctggatacttcgatcattgatgaactgccgccggggcgaacaccagtaacaactgttgccattccagatacccgcagaaatgaaattatccagcgcatcaaaagtgcctgtttggatgaaggacgtcaggcttattgggtatgtactctcatcgaggattctgaagttctggaagcgcaggccgctcaagccaccagcgaagaactggctctgatattgccagatctgaaaatcggtctggtgcacggaagaatgaaacccgcagaaaaacagaccattatggatgccttcaaacggggagagttacagttattggttgctaccacggtcattgaagtcggtgttgatgtacccaatgccagcctgatgatcatcgataaccctgaacggctggggctggctcaattgcaccagcttcgtggacgagtgggtcgaggagcagtggcttcacattgtgttctgctgtataaaaccccgctgaccaacaccgcgaaaatacgcctgcaagttctgcgcgacagtaacgatggttttgtgattgcccagaaagatttagaaatccgggggccgggtgaattgctcggcactcgtcagacaggcaatgctgaattcaggatcgccgatttactgcgggatcagggaatgctgtctgaagttcagcgcatctccagctatatccatcagcattatcctgaacatgccaaggcactgattgagcgctggctgcctgatcgctcacaatacagtcatgcctga

SEQ ID NO: 5201 - DNA, 1215 bp, Xenorhabdus bovienii
  Coding sequence Name=Xb4151_4152.C444.gene376.dna; Position on contig= 423487..424701bp; Strand=-
atgtatcagatggatatttatggcacgctcgttgcggctacgctggttttgctactgggaagaaaactcgtacaatcaattccattccttgagaaatataccatccctgaaccggttgcaggcgggctattggtcgctatcgttttactggccgttaagcagtccacagattgggaaatcagtttcgatttatctctcaaagatcccctcatgttgatgttctttgccaccataggcttgaatgcgaaccttgccagcctgaaagcaggtggaaaatttctggtactttttgtctttgtcgtgattgggttgctgttggtgcagaacaccgtgggtattgcactggcgaaaatgcttggacttgacccattaatgggattattggctggttccatcacactttcaggcggacacggcaccggcgccgcttggggtaaagtattctccgaacgctatggttttgataatgcgaccgaagtagcaatggcctgtgcgacattcggtttgatattgggtggtttgattggtggccctgtggctcgttttctggtgaaaaataccaaagcgccgggcttgggggtagatgatgccgaaattcctactgcgtttgagaaaccttataccggccgcatgattacaccattggttatgctggaaaccatcgccttaatctctatctgtttgttggcaggtagttatattgagaaacagctagagcatacgatgtttgaattaccaacatttgtatgcgtattgtttgtcggggtaatcctgagtaatggcctatcgctgcttggcttttatcgcgtatttgaccgagcggtatcggtactgggcaacgtcagcctgtcattgttcctggctatggcgttgatgagtctgaaactgtggcagttggcttcacttgcattgccaatgttggtgatcctcgtggtgcaatcgatagtgatggcattgtatgcgattttcgtgacttatcgcgtgatgggcaaaaattacgatgcttctattttgtcggctggtcactgtggtttcggtttgggagcgacaccgacggctatcgcaaacatgcaggcaattacggatcgatgtgggccatcacatatggcattccttcttgtgccaatggtaggtgcgttctttattgatattgttaacgctgccgttatcaaaatttatctattgttaccgatattcccgtctatagcaggttaa

SEQ ID NO: 5202 - DNA, 1386 bp, Xenorhabdus bovienii
  Coding sequence Name=Xb4151_4152.C444.gene377.dna; Position on contig= 424944..426329bp; Strand=+
atggttacctcatcccgtgagcactctacatcagaagcacctgaggcatcaggcagcgaattgatttaccgtctagaagataaaccgccacttctacacgcactgtttgcagccagccaacatctgctggcgatgtttgttgccgttatcacacccgccatgttgatttgtcaggctctggggcttcctgaactggatacacaacgcattatcagcatgtctctgttcgcatcaggggtagcatcgcttatccagatccgctcctgggggcctgtcggctctggcttgctttccattcagggaaccagttttaattttgttgcgccactaatcatgggaggactggctcttaaaaatggaggagcagatatcccaaccatgatggccgctctgtttggtacgctgatgatggcggcaatcaccgaagtgctgctgtcccgcgtgttgcatctggccagaaaaatcattacgccgctggtttccggtattgtcgtgatgattatcggtctgtcgctaatccaagtcgggttgacttccatcggcggcggttactctgccattcaaaatggtacgtttggtgtgcctgaaaatctgctgctggcaggagccgttcttgccgttatcgtgctactgaatcgccagcgtaatccctacctgcgagtggcttctctggtcattgctatggcggtaggctatctgttggcttggtacatgggtatgctacctcatgcgacacccagaacagacacacccgttatcaccgttccctctccgttctattacggactgtcttttgactggaatctactgatcccccttatcctgatttttatggtgacgtcgttagaaaccatcggcgatattacagcgacatccgatgtttcagagcagccaatcagtggcccgttatatatgaaacgcattaagggaggtgtactggcaaatggtcttaattcgatagtttccgcagtattcaatacatttccgaattcctgttttggccagaacaatggtgtgatacaactgaccggcgttgccagccgccatgttggttacattatcgcgtctatgctgatcctgttggggctgttccccgccgtggccggatttgtacaacatattcctgaacccgtgttagggggcgccactattgtcatgttcgggactatcgccgcatccggtgtcagaattgtttcccgcgagccactgaaccgtcgcgccattatgatcatcgcgttgtcgctggccgttggtttaggcgtatcccaacaacccttgattttacagtttgcacctgagtggatgaaaaatctgctatcttccggcattgccgctggtgggctgactgcaattcttctgaacctgatttttccgcaggaaaaatag

SEQ ID NO: 5203 - DNA, 1812 bp, Xenorhabdus bovienii
  Coding sequence Name=Xb4151_4152.C444.gene378.dna; Position on contig= 426533..428344bp; Strand=+
atgaagtggttagggaaattttttgttactcttttgctgttgctgattctggcaattatcgtcatttatattgttgtccagacgcactggggaaccaaacaattaaaccaatggctcaacagacaaggccactatgagatcagcattgatagcatcagtcataactggctgcaacctgcgacactgacgctcaacaatgtgaatatccatgataagcaaagcgctttctcactcaatgtcagtaccgttaatctggatctcaaatggcaacacttgctgacaccgcgtaacctccaccgtctgacattgcaacaagggaaactgatactggcaggcgatcaattgccccccctcttgcaagcagacattctgcaactaaaccagatgaatattcagttagagaacccccacacacaaattaaaggggaaaatatcacgggtggcatcaccccttggatgcctgccgcaggaaacccgtttggcaatgggcagtatcaatttagtgccagtactatgagtttcaatggtattccctttgaaaaggttatcatgcagggcagctatcagaataagactctgactatcgacacttttggtgcagcatttctgcaaggggctatctctggggatggccggcaattatctgacggcagctggcgctggaataatctcctgatcagcaatatacgctggcaatcaccgatgacattgagcacgttgcaagaaaaaacccgtcatcttccggccattcatgttaaagacctcaatatcactaatgccaagctgcaagggaaaaattggtctgtcgattatctggataccaccatcaaaaacctgggactggtgaatggaagctgggaagctaaagatgggctgattgatttcaatgtcatgaatatggcattcaataacgctcagttcagcaacacgctggggcaactccatttttctggtgatacttttactgtcgctcatctgacgacccactaccaaaaaggattattcaatatccaatccgagtgggatcgcaaaaaccgtcaactgacgttcaataacagctcagtaaccgggctagtttatgacctgccacccacatggcggaacgatatcaaaaacgccgcaccgggatggatttcaggactgacattaaatgatatcagcgtcaataatactctgctgattgatgttaatccggatttcccatttcagctcaccactctctcaggccatgtggataccatgaatattctgaaaaatggcaggtggggattatgggagggtcaggcatctttgcaggcagccagcggaacatttaataaaattgaaataactcgtccctatctgcaattacacgcgacagatgacaggctaacgattgataaactgaacgctttcaacggtcatggattactacaagctagcggttcagctgaacagcaaactgcccaaaaaccttttgagcttaatttcaagggcatgaatgcggatttaggcatcctgccacgatggggttggataccacttactatgcagggagagggaaatttttccctcgccctgacaggtaatctctctgctgatgatattaaaggcaccatcaatggcacactgactgctgaagataaatcatcaaacaaagattcacaatccattgttcaggggctaattttaagcagtaactgctctccagctggaaccgtagatggcgctgcaatagcaccttcaacggaagctcataccgcagaggcaggtaatacccgcgcagaaagtgaaactgccgagagtaaaacctgcctcaaaattaaactgtaa

SEQ ID NO: 5204 - DNA, 918 bp, Xenorhabdus bovienii
  Coding sequence Name=Xb4151_4152.C444.gene379.dna; Position on contig= 428334..429251bp; Strand=-
atgtaccatctgagagtacctcaaacagaacaagagctggaaacctattatcaatttcgttgggagatgctgcgcaagccgcttcatcagcctatcggttcagaaaaagatggttacgattcgatggctcatcatcaaatggtggtggatgaacacggtaatccggttgctgttgggcgtttatatatcaatgcagacagtgaaggcgctattcgttttctggctgttcatcccaatgtgcagcagaaagggttgggtacattgatcgcgatggcattggaatcagttgccaggcaagaaggtgtgaaacggattgtttgcagtgcacgggaagatgccgttgatttttttaataaactgggatttaaaaaccggggtttgatcaatggtgccagaacgtctcccattaaccatttcctgatgatcaagcctatcatgagtcttgatgatattctgcatcgtccggactggtgtgcggagttgcagcaggcatggtatcaacagatccctctgagcgaaaagatgggcttacgcattacccagtatacagggcaacgctttattacaacgatgccagaagcagggaatcagaatccgcatcataccatttttgcgggtagcctgttttcacaggccacactgacagcatgggggctgatctggctgttgttacaggaacgccagctgggggggaacatcattctggtcgatgccaatatccgctaccgacagtctattacggggcgtcccagtgcaatcgctgattttaataacatgagcggcgatttggctcgtcttgcccgtggcaacaaggcacgggttaaactggaagtacaggtcagcggtgaacagggcgttggtagcgtgttcaccggcacttatcttgtgctgcctgtcgaacgctctgttacagtttaa

SEQ ID NO: 5205 - DNA, 456 bp, Xenorhabdus bovienii
  Coding sequence Name=Xb4151_4152.C444.gene380.dna; Position on contig= 429365..429820bp; Strand=-
atggataacagacaaaaaatgattgcattaattcagcgcgtaacacaggcgaaggttgttgttgaagatgaaactattggggaaattgagcagggactgctggttttactcggcgttgagaaagaagataaccagcaaaaagcgcagcgtttatgtgaaaaagtaatggggtatcgggtattcagtgatgagcagggaaaaatgaatctgaatgtgcagcaggctaatggtagtttgctggtcgtttcccaatttaccttggctgcagatacccaaaaaggtttaaggccgagtttttctggcggtgctgaaccgcaaaaagcagatgaattttatcgctattttgttgaacagtgccgtgtaactggtgtaaaaacagaaacggggcaatttgccgcagacatgaaagtgagtctgataaatgatgggccggtgactttttggttgcaggtatga

SEQ ID NO: 5206 - DNA, 660 bp, Xenorhabdus bovienii
  Coding sequence Name=Xb4151_4152.C444.gene381.dna; Position on contig= 429884..430543bp; Strand=-
atgataaaagtacaaaacgacaatcgtcagtcaggagggattatgctgtatattttcgatatgggtaatgtgattattgatattgattttaaaagagtactggctgtctggagtaacctgagtggaacaccactggcaacattgaccacacgattttcaatgggagaggcttttgagcaacatgaatgtgggcaaataacggatactgcgtttgcagaagcgttgtgcgatgaaatggaggtctcgctcagttttgaacagttcacagaaggctggcatgcgctctttattgatgtcagacaggatgttattgaactgatgaataaattgcgtgaacagggacatcgagttgttgtactgtcaaatacaaaccgcctgcattttgattattggccacatcattaccctgagattgcagcatctacagatttcctttatttatcccaagatctgggcatgcgcaaaccgaattctgacatttttaaatacgtgcttggagcagaaggtgtgaccgctgtacaggctgtattttttgatgatgttttggtaaatgttgaagctgcaagaaaaataggcatcaatgctattcatgtgactgacaggagcgtgattcctgattactttaaggcacatgatttctcccttccctcagaaacgtaa

SEQ ID NO: 5207 - DNA, 1824 bp, Xenorhabdus bovienii
  Coding sequence Name=Xb4151_4152.C444.gene382.dna; Position on contig= 430759..432582bp; Strand=-
ttgtcaattaataacttaagaaacatcgccatcatcgctcacgtcgaccatggcaaaaccacgctggttgataaactcttgcagcagtcgggtacatttggcgaacgcgcagcaacgactgagcgtgtaatggattccaatgatctggaaaaagagcgtggcatcaccattcttgcaaaaaacaccgccattaaatggaatgattaccgtatcaacatcgtagacaccccaggccacgccgactttggtggtgaagtagagcgtgtgatgtcaatggttgacagtgtgctgttgctggttgatgcgatggatggcccgatgccacaaactcgcttcgtaacccagaaagcctttgcccacggcctgaaacctatcgttgttatcaacaaagttgaccgtcctggcgcacgtcctgactgggtcgtcgatcaggtatttgacctgttcgtcaacttgggtgcaactgatgagcaactggacttcccgatcgtctatgcttctgcactaatgggtattgctggtaatgaacacacagacatggcggaagacatgaccccgctgtatcaggcgattgttgatcacgttgaaccgcctaaagttgatctggatggcccattccagatgcaaatctcgcagttggactacaacaactatgttggggttatcggcattggcagtattaagcgtggtactgtaaaaccaaaccagaccatcaccatcattgacagtgaaggcaaaacccgtaacggtaaagtcggtaaagtcttcagtcatctgggtttggatcgcattgaatcagctcaggcggaagcaggcgacattattgcgattaccggtctgggcgagttgagtatctctgatacgctgtgtgataccagtgccgttgaagctttgccagcactggcggttgatgaacctactgtcagcatgtacttctgcgtaaacacctcacctttctgtggtcgtgaaggtaaatacgtgacttcccgccagatccttgatcgtctgagaaaagaactggtacacaacgtggcactgcgtgttgaagaaaccgaagatccagatgcattccgcgttgcaggtcgtggtgaactgcacctgtccgtcctgattgaaaacatgcgtcgtgaaggcttcgagatgggcgtttcccgtccaaaagttatttaccgtgaaatcgatggccgtaagcaggaaccattcgagcaggtaacactggatatcgaagagcaacatcagggtgatgtgatgcaggctctgggtgagcgtaagggcgaaatgcgtgacatgctgccagatggcaaggggcgtgtacgtctggattactctattccaagccgtggtttgatcggcttccgtacagagttcatgaccatgacttccggtacgggtctgctctatgcgacattcagtcattatgatgatattcgtccgggtgaaatcggtcgccgtcaaaacggtgtgatgatttctaacggtcagggtaaagcggttgcttacgcactgtatagtttgcaggatcgcggcaagctgttcctcggtcacggtacggaagtttatgaaggccagattatcggtattcactctcgttccaatgacctgactgtgaactgcctgacaggtaagaaactgaccaacgttcgtgcatcaggaacagatgaagcaacgacactgtctccatatctcaagaaaacactggagcaggcgctggaatttatcgatgatgacgagctggttgaagtgactccacagtcgattcgcctgcgtaaacgccatttgactgaaaatgatcgccgtcgcgcaaatcgcggcaaagaaatgtaa

SEQ ID NO: 5208 - DNA, 1110 bp, Xenorhabdus bovienii
  Coding sequence Name=Xb4151_4152.C444.gene383.dna; Position on contig= 433743..434852bp; Strand=-
ttgcgtatagattcaattaattttaaacccctaccaatagattttgaaattgaaagcattgaagtcactaattttactagtcagcactcattacccggtgatggaaacagtgcatatgaataccgagctaaaattattaataaaacaaatggtaaaaagatatctaattattcatttgatcctaagcaagtgaattggagtcgagaacccaaaagaagtcctaaattagtagatgaaaaagatctcgttttatttgacccagaatttacaactaatagcgaaggttacttaacaataaagctaaagagtttagttggtattaaaaatattgaggttaatttaaatataacttcaccacacggtgacgtatcaaagaatgcaaaattggtggactttgaggtttcaccacaaccggcggggcttttcatgtatagagagggtaaaaaagacacaattaatctcttcactaaggagcaagaaaggccatataacgcagttggtactttacataatggagaattaagaacaaaagataataaacttcttagtaatagcgaaaatggtaaattagtaaaagtgcatgattatgagtatgatgatccagatggtatactttcgtataataataaacacgatcccaattttgcatttgaaaacgtgggaaaagcaacagtcaaagctctagtacaaacattaaaccgagataatgaagtagtttatgaaagattatatgcatataacttcaatatacttagactttttaccgcaatagatcaaatgaatgacccttatgttcctgggataagtaatataagctgtgagagtgataataagatggggggtaaaacaccaaaattaagcgatgttatagggccaaaaactctttctgacgaatttagaaatgctttttcatgggggttatttcacagagtacaattacctcatgatatagataaaaaggattttgctaagtttgcaataatagatgaaaacgctcctccgaataatccctatgctccatattctatttatgatgcagtacatggtaacataattgatcctacaaattcgaatgtattattaatttgcctatggaaacaaggggggtaa

SEQ ID NO: 5209 - DNA, 1050 bp, Xenorhabdus bovienii; identical to SEQ ID NO: 483
  Coding sequence Name=Xb4151_4152.C444.gene384.dna; Position on contig= 434853..435902bp; Strand=-

SEQ ID NO: 5210 - DNA, 1665 bp, Xenorhabdus bovienii
  Coding sequence Name=Xb4151_4152.C444.gene385.dna; Position on contig= 436165..437829bp; Strand=-
atgactgaacagcaaccttggtggttagatagcgttatctaccagatttatccaaaaagttttcaggacagcaccggaagcggtacaggtgatatcaatgggatcacccaacggctggattatctacagcacctcggtgttgaggctatctggatcacgccgttttatccgtctccgcaagttgataatggctatgatgttgccgattactgtgccattaatcccgattatggctcaatggaagactttgacaatttagtggaaaatgcccatcgccgtggtatccgcatcattttggatatggtctttaaccacacttcaaccgaacatccgtggtttcaggctgcacaggatatcaatagcccttcgcgccagttttatatctggcgcgaaggctccagcgattccctgcccaataactggaaatccaagtttggcgggaatgcgtggcaatggcatgctgaaagccagcaatattacctccatctgtttgcgataaaacaggctgatttgaactgggaacatgaacccgtccgcgccgagctgaaaaaaatctgtgagttctgggcagatcgtggtgttgatggcttgcggctggatgtggttaatctcgtctcaaaacagcaggattatccgagtgacgatcacggagatggccgccgtttctataccgatggcccgcgtattcatgaatttctgcaagaaatgagccgtgatgtgttccagcccaagggcttgatgaccgtaggtgagatgtcttccacaggtcttgagcactgcctccgttacagcgctttggatagcagtgcgctgtccatgacgtttaattttcatcatttgaaagtcgattatcctaacggtgaaaaatggactctcgccaaacctgactatattgccttgaaaaagattttctcaacctggcagcaaggtatgcatcaaaaagcatggaacgcgcttttctggtgcaatcatgatcagccccgcattgtttcccgatttggggatgaacaccagcatcacaggacgtcagccaaaatgctggcaatggtgctgcacggtatgcaaggtacgccgtatatctatcaaggtgaagagctgggcatgacgaaccctcactttgagcgtattgaagagtatcgggatattgaaagcctgaatatgtatcaggagcgcattgagcaaggcatggcaccagaggaaatactggcaattctggcgcagaaatcccgtgataacagccggacgccgatgcagtgggatggttcagccaacgccggctttacctctggcacaccgtggatagcctcttgcgataattatccagagctcaatgccgaagctgcattgcaggataaagattctgtcttctattgctaccacgaattaattaaattgcggaaacaacaacccatactgacctacggtgattatctggatctgttacccgaccatccttcgctttggtgttatctgcgtcgctggcagaatcaggtcatgttagttatcgcgaatttaagtgatgaaaaccagctatggtctccagaaccttctctcacagataaagaatggcaggtattaataagtaattatccatcgccttcttcaatagaaaaagagatgtcaattaaaccttatgaatcaatatacttgatagctgaaaaataa

SEQ ID NO: 5211 - DNA, 1434 bp, Xenorhabdus bovienii
  Coding sequence Name=Xb4151_4152.C444.gene386.dna; Position on contig= 437848..439281bp; Strand=-
atgaagaaaaatcaagtaaatcagaaggatcttgaaaaacttattactttgattggtggaaaagagaatattgcttctgtcagccattgtattacccgtctcagattcgttctctattcaccagaaaatgccaatgccaaggccatcgaagagctatccatggtaaaagggtgttttaccaatgccgggcaatttcaggtggttattggaaccaatgtagacatttattataaagccctgcttgaaaatacggggaaacaatccgttaataaagaagaggttaaacaagcagcccgacaaaatatgaaatggcatgaaaatgcaatttcacattttgctgagatttttttccctctgctgccagccttaatcagcggcgggttaatattaggcttccgtaacatcattggggatatccctttcagtgaaggcaaaacactcgcccagctatatcctatctggcaaaccatctatagttttctctggttaatcggtgaagccatatttctctacctccctgtaggtatctgctggtctgccgttaaaaaaatgggcggaaccccaatattaggcattgttttgggtatcacgctggtttcaccacagttgatgaatgcttacctgcttgggcagcaagcaccggaagtctgggatttcggctggtttaccatttccaaagtcggctatcaggcacaagttattccttcactattggcgggtttaacgttgggatggattgaaactcggctgaaaaaatgggtgccggattatctctatctggtgattgtccccgttgtttctctgctgctggcggtcttccttgcccatacgctgatcggcccgatggggcgcgcaatcggtgatggggtcgcttgggtcgtcaagagcctgatgaccggaagtttcgcgcctatcggtgctgccctgttcggctttttctacgcaccactggttattacgggcgtacaccaaaccacgttggcaatcgatctgcaaatgatccagagcacgggcggaacccctatctggcctatcattgcgttatccaatatcgcccaaggctctgccgttgccggcattatctgggcaagcaagaagcagaaagagcgggaggtttcgattccggcagccatttcagcctatctcggcgttactgaacccgcaatgtatggtatcaacctgaaataccgttatccgatgttctgcgcgatgattggagcaggtctggccggactggtatgtggccttaatcatgtgattgccaatggcatcggtgttggtgggctccctggtattctctctatcaagccgcagttctggatggtctaccttattgccatgatcatcgccattgtcgtgcctatgctacttactgtgctggcctatcgcagaaacgagcgcaaaacgacattaattaatgagctaacgaattaa

SEQ ID NO: 5212 - DNA, 141 bp, Xenorhabdus bovienii
  Coding sequence Name=Xb4151_4152.C444.gene387.dna; Position on contig= 439915..440055bp; Strand=+
atgacggaaggattggaggataatatcaatctttttcatattaatatttgccaaataggaatgaattatattaataagttaatttatattagaattataataataaaacataacattttaattacaactaaaactccttga

SEQ ID NO: 5213 - DNA, 456 bp, Xenorhabdus bovienii
  Coding sequence Name=Xb4151_4152.C444.gene388.dna; Position on contig= 440350..440805bp; Strand=-
atgtctatatgggtagatgctgatgcatgtcctaaggttataaaagaagtattatatcgtgcagcagaacgtgaaaaaatacaggttacattcgtggcaaatcaacgattaagtgtacctgcatccgcttttttacgtacattacaagtccctgctgggtttgatgtcgctgacaatgaaattgttcgtcgctcagaaatcggtgatttagtgattacagcagatattcctcttgctgctgaagtgatcgaaaaaggtgcaatagcactcaatccgcgcggtgaacgttatagtgaagcgacaatacgtgaacgcctgactatgcgtgattttatggatacgatgcgggcgagtgggatccacacgggagggcctgctacgttaaaccaacgtgatcgccaacagttcgcaaatgaactagataaatggttattgcaacaaaaaaaagtatcttga

SEQ ID NO: 5214 - DNA, 537 bp, Xenorhabdus bovienii
  Coding sequence Name=Xb4151_4152.C444.gene389.dna; Position on contig= 441367..441903bp; Strand=-
atgtcaaagctcatttattatgtcgccgcaacaatggatggttatatcgctaccgaagatcacggactgggttggttagaggcatttaccctcggcgatgacgccacgccttatgatgaattttaccaaggcattggggcagccattatgggggctggtacttatgagtggatcatgaaaaatacctccggtgactggccgtatcaggatattccctcgtttatcctctcctcacgaaatatatccattccgccaggcatcagtgccgttgtcactcatacctcgaccaacgatattgctgctgaagcaagagccgctgccaaaggtaaaaacgtgtggatgattggaggaggcaaaaccgcagccagttttgccgatgctggggagttacaacaactgtttattacgaccattcccatatttctgggttcaggcatccgtgtcctgccagtcaataaaccgattcacgttacgtcggataagcggcgctttttacgcagtggcgcaattgaaaccattatggatatcaaatggtaa

SEQ ID NO: 5215 - DNA, 843 bp, Xenorhabdus bovienii
  Coding sequence Name=Xb4151_4152.C444.gene390.dna; Position on contig= 442335..443177bp; Strand=+
atgtctagatttattatcagtcggaacaacaagtctttacttaatgaaaccgtattctatcttacgaaagggaatatgcttacattaaagatagatggtttgaatagtaatacaaaaagacatcttaaatttcagtcgaataatacgcttgtgtccatttttcaacgtgataattatctgtttagagagcaaagcttgcaaataacagctcttaatatgggagtaagcgtggttagagcggtggatactgatatagattactgtccctattttgcagcaggtgtcgctgaggattgttttccaccattaacaattcatgtcttatccaaaatatcgattccaacggacttaactgccgagcagaaagcgattttaatggtgttgttagcggaaacgacaacgcctgagacaccgggaataaagtatgatgaaaaaaaagctaaagatgttatgcaatatatgcatgatgttctattgaacagagtccggtctcctaaagcacatgagcttgatgtgcccagtcaggggaataaattaatcggattaatttcaggagcacggacaatagaaggttttagtcaatatcccaatattaaatctgatataaaagatagaattaacggtatgataatagctgcgaacgaaggtagtaattcaaattttttagcttatcgacggttaattaaaaatgctattgatatagccaaaagtaataaaatctctaatacagagattattgcatggagaacgaaaagtactgattctcctggctcaaattttatcaagctattttcattacaaggacaagatttttataagctatctgatagttatcttaaataa

SEQ ID NO: 5216 - DNA, 531 bp, Xenorhabdus bovienii
  Coding sequence Name=Xb4151_4152.C444.gene391.dna; Position on contig= 443188..443718bp; Strand=+
atgaaatatttaattggtctatgtgttatttttttctctttaactgttttttctaagcaagatgaattggacttcaaggcttgggaaaagaagggcagttgggggatatatagtgaaaaaccaaatagtcattttaagccgctaaaaatcaagagctataaagagggttatttgcctgcattcagttatcttattaagcggtttaatttacaaaatgtgaataatcaatactgtctgattggttataagtggaataaaacaaaaaatagtgatgagcgtgaaaatattattgttttttggaaaacggctaattatctgattaattggaatttgccggatagtgaggacgatgatagttataaagccattatattcagcaaaccctttattgatatgagtgaatccgttgttccttataaggaatcagaaggtgcgcaggctttatgggctaaagaaggcgttattcaaatgatgaatgattgtgaattgaatgggcagaaaatcacgataacaccttctggggtcaggtaa

SEQ ID NO: 5217 - DNA, 594 bp, Xenorhabdus bovienii
  Coding sequence Name=Xb4151_4152.C444.gene392.dna; Position on contig= 443901..444494bp; Strand=-
atgaaagtcccctatttttctcagtgggaatcattccatttagccaatgacattattcaccatcaacttccacttagtcatgatccgctatgggaacaatccggtgcagattccccagaggaatatgcaaaatgggcaaatcatatttgtggtatggcttgtcttaaaatgttgcttgcagctcgctcagggaaaatttacccattgctgaaattaactaaaatggcaaccgagtacggagcataccagatagaagatgagcatataaaaggaatgatttatgctcctgtagtttcaatgttatcggaacaatttgggattatctctcaaatagtgaccggtatgacggccgaaaagatacatgaagtttttacccaagatagtttatatatagcttccgttcatcctagtatcagatggccaacacgattacctgaaaaaaagggcggacatcttgtactggtgactaacgctacacccgaagaaataacttttcataatccttctggtgctaacactcaaagtcaaattgatgtaaaaatgtcagtagatatttttggccgattttatgccgagcgtggcatactcatttag

SEQ ID NO: 5218 - DNA, 825 bp, Xenorhabdus bovienii
  Coding sequence Name=Xb4151_4152.C444.gene393.dna; Position on contig= 444491..445315bp; Strand=-
ttgatcaccgtactaacgactttgcgaacccttgcccttaaaaaagttgcagaacgtgtatctccggagaatactgcttttattattggcgctggcacgtttttaacgtgcctttctctacttcctgtcgccataaccacgggcatctcaactccatctgatttctttaacctagcagggatatctgctggattgatgaaaggggtgcttctaggcataatgctgatagcacaacaaaatcttatcaacaaaagcctttcatctgccacttatgtattccctatatctcttgggtttattgcactcattgatatactgatatttggttctaatcttaccttttcctcaatcctcagtattaacattctttttgtcgccggaattcttttcactatgattggtcatattaaaagcatgcacaaacgaagtaagcttatgtttttcattatgatattctgtgtaatcgggtttgcaattatggaccgaacagggattcccatgagtggttggtttacctatttattatttactggcgtagggaatatatctgttatttttttctatcagaaaaataaattttcttttgttccactgaaattttggctttccatatcaatcatctggtttttaccagaattattttttaactatgctattgccacttatttacctgtcagctacggatatctagcaataactctcagaattcctttacttatgctaatttcagtgcttgtctatcgtgaaggaaaactctctgaacaaatgttattttcctttgttgctgttatcgcaattttacttatgttcatggagagactatga

SEQ ID NO: 5219 - DNA, 732 bp, Xenorhabdus bovienii
  Coding sequence Name=Xb4151_4152.C444.gene394.dna; Position on contig= 445342..446073bp; Strand=-
atggaaagaataggattaattggcggtgtcagttgggcatcaactatggaatattataaacgtttgaatatggctgtgcagaatactggcaaagattttgaatctgccgatctagctattatcagccttaatttttcaaaaatacttgccgcccagaagcgagatgataatgagactgaatttaacattctcagcaaagcagttcatcaacttgcgcaagccgaagtaaaaaaaatccttatttgttctaatacaaccagtaatacttgcgatcggctttcaaaactggttaatattccaattatcaatattattgatgccaccgcaaataaattactcagcatgaaggtttccaatgttgggttaattggtactcaatatgttatggaacgtgatttttataagaaacgacttgaagctaaaggaataaacgtattaatacctagatccaggactcggcaaatcatacatgattctatttatcaggatctatgtcgctatgcactcactgacacatcccgtggaataatgtatcgtgctattgatgaattagctgaattaggcgcagaagccgtcatactcggctgtacagaaattcctttagttgtcagtgatagggtgtatcaaaattcaataaaaataattgattctatcgatgctcacattgaagccgcattgtctctaacaccggaaaataataatacttcgtctatgttaaggtatctcaattga

SEQ ID NO: 5220 - DNA, 1098 bp, Xenorhabdus bovienii
  Coding sequence Name=Xb4151_4152.C444.gene395.dna; Position on contig= 446084..447181bp; Strand=-
atggtttattttcctagcgatacaaaaacaactataccattatcgatcatttttggtggaatttccccagaacatccagcatcagttagttcttttgataatcttataaaaagtttcagagagcttaattttgatagaaatcttaattcaatatacttcttcgataaagatggttctgtcttatacaacgcctatacaccttatatttctccctatgattttactcattctggagataaaatagatttatatacagcaatcaaaaggatgtctaaacaaagcgaatttcacatcaatcttcttcatggtaatttaggtgaggatgggcatatccaaggagttgctaagtattttaaaattaaaggaacatttggtagtgtacttccttcctcgctatctatgagtaaataccatatgtcacactatattaatagtttattaccctctttaagatcaccgaaaacattactcttaactgaaggtaatctagaaaaagcattttcattgattagcgataacttccctgaagaaaaaatagttataaaacctaattcattaggcgcttctttatttacaaataaatatgttaatctggaaaatgaaaaaaaatcaatattggataatttaaaaaatatttttgaatacgatagatttgccttggtacaagctttcatcaaaggaaaagagtattctgttggttgcattcgaatagaagggaaagcaatagcactcaatgttgtcgaaataatcacaaagaatggttttttcggtcatgatgaaaagcatcgaattaataaagcagaagaaattcttttaatacaagattcagagataacgagaacactaaaagatttatctattaaaatttttgaatctactggatatgaatttatgtgtcgatttgactttattgttaccgagtctgaagaaatatactttcttgaatcaaatccaattccgggcatgatgaaaaatagcatattccctaagatgttaaaaggacacaaattatcaatacctggcttgtttattcacctatcatgttcatcacaaaacatttctgaaaaaaaatctatttttaactacattatcgagtaa

SEQ ID NO: 5221 - DNA, 153 bp, Xenorhabdus bovienii
  Coding sequence Name=Xb4151_4152.C444.gene396.dna; Position on contig= 447432..447584bp; Strand=-
atgaataacagatttactcatatcaataaagggattactgaatattatagctttataacgatgatcgtcctcaccatccggcagataccaatcaatcagataattagccgttttaataagtttaccaaaacacgatcatctgtgtttatttag

SEQ ID NO: 5222 - DNA, 150 bp, Xenorhabdus bovienii
  Coding sequence Name=Xb4151_4152.C444.gene397.dna; Position on contig= 447564..447713bp; Strand=+
atgagtaaatctgttattcatgataaagagactgaagatgctcaggctttatggactaaagaagtcgttattcaaatgataaatgattgtgaacttaatgggaaaaaaattacgataaccccctattttaagggggtcgtggctttataa

SEQ ID NO: 5223 - DNA, 627 bp, Xenorhabdus bovienii
  Coding sequence Name=Xb4151_4152.C444.gene398.dna; Position on contig= 447734..448360bp; Strand=-
atggaaaactactttgacagcccatttaagggcaaaaccttagcggaacaagtcactaatccgaatattcagatcggccgtttcagttactattccggttattatcatggtcactcttttgatgactgcgcccgttacctgcatcccgatctggttgatgttgataagttgatcatcggcagcttctgctccatcggcactggagtcgcctttatgatggcaggtaatcaaggacatcgtttggattgggtttcatcctttccgtttttctatatgtcggaagaaccggcctttgctgatgctcaaaatggctaccaaccgatgggagatactgttatcggcaatgacgtctggatgggtgccgaagcgattattatgcccggcgtaaacattggcgatggggcagttatcggcacccgcgctcttgtcaccaaggatgtggaaccttacaccattattggtggcaatccggcgaaggtgatcagaaaacgcttttcagatgaacagattgctatgttactggaaatgcagtggtggaactggccgctggaacaattaaaagcggcgatgaagatgctcacttcagcagatattgaagggttatatcggtggtggcagaatcagtag

SEQ ID NO: 5224 - DNA, 156 bp, Xenorhabdus bovienii
  Coding sequence Name=Xb4151_4152.C444.gene399.dna; Position on contig= 448402..448557bp; Strand=-
atgatatggctatattggagctacaatgaattgttaccatctcaggatctcgtcacacgttgcaaaaagaccttacgggaagtggagccgctggcagaaatggaacagggacgaaaacggctgacattcagtcaggactttataccgaaaaactaa

SEQ ID NO: 5225 - DNA, 309 bp, Xenorhabdus bovienii
  Coding sequence Name=Xb4151_4152.C444.gene400.dna; Position on contig= 448529..448837bp; Strand=-
atgcgcatgttttgttcaatcagtcgtttcgcctctgctacagcagcatttgcaataaaactattcaaactcgcatacccagataatgatagtgccatttcaagcaactctttagtttctgaattcaccctagtggtgattctttcatttgataatgtggccatagtcaaaactccaccgtattgcggttattggtttaatatacggtctaatttaacattttctttaacaaaaatcaatatacgtgccaaaatgacgccaaaaaccaaatgggagaaaaatgatatggctatattggagctacaatga

SEQ ID NO: 5226 - DNA, 198 bp, Xenorhabdus bovienii
  Coding sequence Name=Xb4151_4152.C444.gene401.dna; Position on contig= 448770..448967bp; Strand=+
ttgaatagttttattgcaaatgctgctgtagcagaggcgaaacgactgattgaacaaaacatgcgcatcaaattgtgtcaggaggatgcagtggcatttgtgcatgcattagaagaacctacccagataaatgagcgtttccttcgtgcagctcgtagacataaggatttgttagatgaagatcgagtgtctaaataa

SEQ ID NO: 5227 - DNA, 513 bp, Xenorhabdus bovienii
  Coding sequence Name=Xb4151_4152.C444.gene402.dna; Position on contig= 448945..449457bp; Strand=+
atgaagatcgagtgtctaaataaaaataaacacgatagaaataattttgactgtggtgaacctgcgttaaacaactatttgaaagcagtatcagggcagcatgataaaaaggacctatcaaggacatttgtcctgacaagtagtcagaatgaatctcaaataaaggggtattattcactagcgctgtgcacggtagaactagacgaaataccagaaaaaatatcgaaaaaatacccttccagtttgtattgcgcacttattggccgattagctataaataaattatttcaacgccaaggacttggcgaaattttgttgatagatgcaattcgaaaatcaatagaatcgtcagaatccattcctactccaatgattatcgttgacgctaagcacgatattgctaaaaaattctatataaacatggggtttcaggaatttccaaaaatgaaattcaggctctttatgcctatgaatgcagctgtgaacattatagagcaaatcgacgcgatataa

SEQ ID NO: 5228 - DNA, 252 bp, Xenorhabdus bovienii
  Coding sequence Name=Xb4151_4152.C444.gene403.dna; Position on contig= 449563..449814bp; Strand=-
atgaaacgaaaatcaccccaaaaatttaccgataactttaaaagagaagcggtcaatctggttgttgaacagagctatacagtcccacaggcagctgaaaccaaaacccatcatgaaaaccaggcagagatgaaaaaagatgtcttgggttatctgcattattacaatttaacacgattgcacacggccaataatgatttaacacccgtggaatatgaaatggccttcgtaaaagtgtccgatttttcttga

SEQ ID NO: 5229 - DNA, 927 bp, Xenorhabdus bovienii
  Coding sequence Name=Xb4151_4152.C444.gene404.dna; Position on contig= 449914..450840bp; Strand=-
atggaaaaaatggcacacaaactcgacgactttatccgacacgcccttgatgcccagcccatcagcggaacgtcgctgattatctctctgtttggggatgccctcagtcaccgtggtggtgaagtatggttgggcagtctgagcctcctgctggaaccgatggggttcagtgaccgttttgtgcggacatccgtctttcgcctgcaaaaagagggctggctggcggtggagaaaatcggccgtcgcagctattaccgcatcaccgagcgtggcatgaatcaattccgccatgccgagagcaaaatctacctgagcgaacagcctgagtgggatggcaagtgggatctactgctgctggaaggcacgaccaaagaagaacgcaaccgcctgaaaaaagaactgagctggcttggcttcggccaactcaacagcactctgatggcggcgccaagcagcgcgcaaagtgatattcccgccctgcttggcgaactcaacgccagtgattctgtgatctactttcgggcagactatccctatccccgttcagaacaaagcctgaaagaacgggtatcggccagttggtcactggatcaggtggtaaaacactatcacgagtttatcgtctcattccgtcccttaatgaagctgctgcaagattgcagtgaagccgacctgacaccagaacgcagcttccagttgcgcctgctgcttattcacttttaccgccgtgtggtactgcgcgatccgctgctgccggatgctttgctgccagcacaatgggaagggcaggttgcccgtaacttgtgcaccaatatctatcaccgaatagaccttactgcgacacattacgtcagcgaacgctgtgaaaccaccattggcacacttccgccacctgcggccgcgtattaccgccgttttggtggttag

SEQ ID NO: 5230 - DNA, 1308 bp, Xenorhabdus bovienii
  Coding sequence Name=Xb4151_4152.C444.gene405.dna; Position on contig= 450926..452233bp; Strand=-
atgagcaacaacgtacaacacctcgattccattgaatttgcttcacgtgacgaaattcaggcgcaccagtttgaacagataaaatggacgctccatcacgcttacaacaacgtgcccatgtaccgccgcaaatttgacaccgccggcatccatcccagtgatttcaggcaacttgcggacatcaccaaatttccctacaccaccaaacaggatctacgggatcactacccgttcgatactttcgccgttccgatggaacaaatcgtgcgcatccatgcctcatcgggcaccacagggcatcctaccgtggtgggttatacccagcgggatatcgaccattgggcgaatctggtcgcccgttgcctacgctttgccggagcgagcgccaaagacaaagttcacgtcgcctatggctacggcctgtttaccggagggttgggagcacactacggggctgaacgtctgggcgccaccgtgatccctatgtccggcggtcagaccgaaaaacaggcgcaactgattctggacttcaaacccgacgtcatcatgatgaccccttcctactgcctgactttactggacgcgctggaacagcggatgggcggagatgccagtaaatgctccctgcgtgttggcattttcggcgcggagccttggacagaagcgctgcgcagcgaaattgaaacgcgcatgggcatcaaagctttggatatttacggcctgtccgaagtcatggggccggggatcgcgatggaatcggtggaacacgctaacggttccaccatttgggaagatcatttctatccggaagtgattgagcctgacaacctgaacgtgttgccggatggcgaatccggcgaattggttttcacgactctgaccaaagaggccatgcccgtgatccgttaccgcacccgcgatctgacccgtttattgccgggtactgcccgtcatatgcgtcgtatggacaggatcgccggacgctctgacgacatgctgattatccgtggcatcaatgtcttcccatcacaggtagaagaacagatcatccgcttcaaagagctgtcgcctcattatcagttagaagtgaaccgcacaggcaattatgactgcctgtcagtcaaggtcgagctaaaagaaccggagcggcttgatgctcaacaacgctgcgacatctgccaccagttgcgccatcacattaaatccatgatagggctgagtacagaagtcagtatcgtcaactgcggagacatcccccgctcagaaggcaaggcggtcagagtgatcgaccaccgccagcatgagtaa

SEQ ID NO: 5231 - DNA, 1215 bp, Xenorhabdus bovienii
  Coding sequence Name=Xb4151_4152.C444.gene406.dna; Position on contig= 452329..453543bp; Strand=-
atgacccatgcgtttatctgtgacggcatccgtactcctatcgggcgttatggtggtgcgctttccggcctgcgggctgacgatctggccgctctgccgctacaggcactactggcacgttatccctcgctggattggcaacagattgatgacgtcattctgggctgcgcaaatcaggcgggagaagataaccgcaacgtggcacgcatggcggttttactggcagggttaccctattcggtatcggcgaccaccctcaatcggctgtgcggctccggtctggatgccttggcctttgccgcccgtggtattaaagccggcgaagcgcaactgatgctggcgggcggggtcgaatccatgacccgtgcccctttcgtcatgggtaaaaccgacagcccattcagccgccaagcccaaatctttgataccacccttggctggcgctttatcaatcccctgatgcagcagcagtttgggacagactccatgccagaaactgcggaaaatgttgccgcccagtttcaaatcagccgtgacgatcaagatgccttcgccctgcgcagccagcaacgtaccgccaacgccgaacaacggggaattttcgcggaagaaatcacccccattaccctgccctctacagacaaaaaaggcacaccaaccatcgtctcacgggatgaacacccacggccggagacgacattcgaacaactgcaacggctgaaaacccccttccgggttgatggaacaatcaccgccggcaacgcctctggcgtcaatgatggcgcggcggcactcatcatcgcctcagagacggccgccttgcagcaggggctgacaccccgggcgcgcattatcgcaaccgccacctgcggcgttgaaccccgcatgatggggatcgggccattgccagccacccgcaaggtactggagctcactggcctgagcctgaaccagatggacgtcattgaactcaatgaagcttttgccgcacagtcactggccgtcatgcgtcagttggggctaccggatgatgcagaacaggtcaatccgaatggtggtgcgattgcattgggtcatccattgggcatgagcggggcacgtctggcgctgacggccactctggaactggaacggcgtaccggccgctatgccttgtgcacgatgtgcatcggcgtagggcaagggatcgccatgattattgaacgcatatcgtaa

SEQ ID NO: 5232 - DNA, 552 bp, Xenorhabdus bovienii
  Coding sequence Name=Xb4151_4152.C444.gene407.dna; Position on contig= 453591..454142bp; Strand=+
atggccgagacgatgggcatgaccacgaaaaaaggccacgattttgccgtcctgattgataattctgacgtcatacaagcccgtggtttttccctgatgctgcataaaagcggtggctgtcaggcggtcaccgctgaaggccgggcggataaaatcaatgctacaaccggatgccaccgccgccagcccttcgctgttgcaggcataggcgaaggcagtatcggccagactgaacaggatgccaccatgacagctttgatggccgttgagcatgtctggtttaatggtcatgcttacttgggcgacccctgtatcaacatggtcgatgtgcattcccatattctgggcgcaggcatctttggcatacatggcttctatgcagcgttgagccagttggctggaagcgttagcggacatggttgcgttccttattttgattttgatctcgctggagatgcagcgttacatagcctgccgccagttggcgcaacaaaggtgcaggtcggtaacggggttcgccataaaattgctgtaagttttccagtgtgctga

SEQ ID NO: 5233 - DNA, 1605 bp, Xenorhabdus bovienii
  Coding sequence Name=Xb4151_4152.C444.gene408.dna; Position on contig= 453997..455601bp; Strand=-
atgaacacgccagcacatcatcatccgatccttcacggcccgattgctgtcattggcgcgggaacgatggggatcggcattgcacaggtcgccgctcaggcaggatattccgtcctgctgtttgatgtgaataatgaagcggcacagcgtgcactggagacgctgcacacccgtctgcatcaacgtgtggaggcaggcaaagcagcagctggcgcaacccaagccctattacagcgcatcacacgggttgactcattgcaggcactggcaccgagcgcactggtgattgaagcgattatcgaacaactggaggtcaaacagaacctgttccgccaactggaacccctctgttcagccggaacgatctttgccagcaacacctcatcgctctcgattaccgccattgcccgtgtgctggcttcaccccaacgcatggcggggctgcattttttcaaccccgcaccactgatgaaactggtggaaatcattcagggtctggaaacgtcgtctcaaacgattaccacactcaaaagtctcgtcaccgattggcaaaaacagcctgtagtttgccgctctacgccgggttttatcgtcaaccgcatcgcccgcccgttttatgcggagactttgcgcgcactggaagaaaacgttgcttcccccgccacactggatgcagtaatgaaagaatcgggcggttttgcgatgggggcgttacagcttaccgatttgattggtcatgacgttaattatgccgtaaccgaatctctgttccacgcatttcacggtgatccgcgcttccagccttcactgcgccagaaagagctggtggaagccgatcatctgggtcgtaagcgcggtcaggggttttatgtttatgatagcaaagaaaaacatcagccattaccccggttggaaaccctccaggagcaaatacggcctgcgcggattcaggcaacgggcgattggggaactctgccacattttgccgcgctattaaaaccgttgttacaacaatatggaatcgcccccgaagaaagcaaaaataccgattcccagccgccagcattacagcttgatgacgttatattaacgctgacacaaggtaaaaccagcgcacagcttgctgatgaaatcagagcgccagtggtacagtttgatcttgccgccaatcatcagacggcttccatcatcactcttagctccgcctgccagaacacccggccgcagacggcaaaagtgatcagtttcctgcaatctctcggcaagcaggtgattctcctgccggattaccctgccttactgacgatgcgtaccgtggccatgttgtgcaacgaggcgctggatgccatcaataaaagcatcgccagcgctgcagatatcgatctggcgatgtgttacggcgtcaattatcccatcggcccattggcatggggggaacaactgggctggcggcacattctcagcacactggaaaacttacagcaattttatggcgaaccccgttaccgacctgcacctttgttgcgccaactggcggcaggctatgtaacgctgcatctccagcgagatcaaaatcaaaataaggaacgcaaccatgtccgctaa

SEQ ID NO: 5234 - DNA, 798 bp, Xenorhabdus bovienii
  Coding sequence Name=Xb4151_4152.C444.gene409.dna; Position on contig= 455604..456401bp; Strand=-
atggaaaatatgtcaatgatactcactgatattgaagcaggtgtcctcagcattacgctcaaccgtccagaacgcattaacagctttaacgaggaaatgcaccagcagttaagtgaagcgctaaagatcgctgaacaagatgaatccgtgcgctgtgtcctgctctcaggcgctggacggggcttctgtgccggacaagatttaaatgatcgcaacgccatcatctcagagggtgacgttcctgatctcggccaatccgttgaacgtttctacaacccgctgatccgtcgcctgacttccctgcccaaacccgtgatctgcgccgtcaacggagtagcagcaggcgcaggtgtctccgtcgcactggcctgtgacattgtgatcgcttcccgtaccgccagctttattcaagccttctgccgtattggtctgacaccggatgccggcggtagctggttcctgccccataaaatcggccatgcccgggcaatgggaatggcattattgggagacaaaatcagcgcggaacaagcactggaatggggcatgatctggcaggtcgtcgaacccgaagcgttagaagataaaacacgggaactcgctcaacatctggcgacccagccaacggtggcgctgagttgcatcaaaaaagccacttatgccgccgcagccaatagcttggatcaacagcttaatctcgaacgtgatttacagcgcctgtgcggacgcagtgaagacttccgtgaaggtgtcagtgcattcatagacaaacgccagccacagttcaaagggagataa

SEQ ID NO: 5235 - DNA, 774 bp, Xenorhabdus bovienii
  Coding sequence Name=Xb4151_4152.C444.gene410.dna; Position on contig= 456405..457178bp; Strand=-
atgagtcacgaatggattttatgccaccagcaacaacgggtacgcacactgaccctgaaccgcccggaagtccgtaatgccctcagcaatgattgtctggagcagctcgtccagcaattggaacaggcggatgccgataccggaaccggcgctatcgtcattacaggagcatcacgctattttgcggcgggtgccgatctcagggagctacagcagcagaccgttgccacggcaatgacagaccgccgcccacaactctggcagcgcttgcacaacatcagcaaacctcttattgcggccgtcaatggctacgcactgggtgcaggttgcgaactggtgctggcctgtgatctggtgatttgcggtgaaagtgcccgcttcggcctgccggaaattacattgggattaatgccgggcgctggcggcacacagcggttaatccgctgtgtgggcaaagcactggccaatcaaatgatcctaactggcgaagcgatcaacgcccagaaagcacagcaggcagggctggtgagcgaagtctgtatcgatgctctgacattagaacgcgcggaacagattgcccaacgcatcagtgagttttcgccgctggcgttacgggcggctaaagctgcactcaagactgcacacgaaaccagcctgtcacaagggctgctcgccgaacgccagcaatttgtcgctctggcagggacagccgatcgccaagaaggcattaccgcctttcttgaaaaacgtaaaccaacattcaaagggttctga

SEQ ID NO: 5236 - DNA, 1086 bp, Xenorhabdus bovienii
  Coding sequence Name=Xb4151_4152.C444.gene411.dna; Position on contig= 457203..458288bp; Strand=-
atggctacttttcatcgtccgacttttcaccgcttaagcattgcagcgattgagcgggaaacacctgatgccgtgaccgtcacactgcatgtccccgatgagttgaaagccctcttttgctatcaacccggccagcacctgacacttaaggcgcgggtggatggtgcagagctacgccgctgttactccatttgcagttcaccactggacgatggattacaaattggcgtcaaggccacctatcaagggcgtttttcgactttcatcaaccagcggcttaaagtcggggatgagctggatgtcatgcaaccacaaggcaatttcggccaccatcccgatgggaacaacgcgggaaactatctggcaatcgctgcgggttcgggtatcacgccaattctatcgatcatcaaaagtacactggcgctggaaccggatagcaccttcacgctgatttacggtaaccgcaccagccgttccgtgatgttcaaagaagcgctggccgatctgaaaaatcgctacctgcaccgttttcaggtgctgtacctcttcagtcaggaaatcaccgatagcccgatgttcaacggccgcattgatagcgagcaccttcaacacctcggcaaaatcctgctcaatttcagccagttcggacaggcctttctctgcgggccagcagccatgctggatgatgccaaatctgcacttgagcaggccggcatggcgtccgaacgtatccatacagaacgcttcaacaccgggcgtaatccatcaagtaccgctgcccgcccggccaatctggccgaacgcagtgaaacccgtgtggagattcatctggatggccgcaccctgaacattgccatgaacaccgaagatgacagcattcttgatgcagcactacgtcaaggtgccgatttaccctatgcctgtaaaggaggcgtgtgtgccacctgcaaatgccgtctcaaatccggtgaagtggacatgaacgtaaactacagccttgagccggatcaattggctgccggttatatcttaagctgccagtcgtggccgaaaggtgacggcgtggttgtggattttgacgtctag

SEQ ID NO: 5237 - DNA, 510 bp, Xenorhabdus bovienii
  Coding sequence Name=Xb4151_4152.C444.gene412.dna; Position on contig= 458308..458817bp; Strand=-
atggaacaacacgttaacacattacaattacagaatccggccatccatcagatctggcaatgcctacaccagattgccgatcctgagcttcccgtactctccattactgatctcggtatggttcgggcggtgaccccccagctaaccggctggcgggtgacattcaccccgacgtactccggttgtccggcaacggaatacctgatcaatgagattcagcaaacactggcacgggcgggctttacatcggtcactgtcgaaatcagcctgaggccggcatggacaactgactggatgaatgccgatgccaaacaacgcctgcgggaattcggtatcgcgcctccacaaggtctggcttgtgaaaaaccgacagaaacagaaacaatcacctgcccacgttgtggtagccatgagaccgaaaaaatcagtgaattcggttccaccgcctgcaaagcgatctatcgctgtcagcagtgtctggaacccttcgactatttcaaatgtatttga

SEQ ID NO: 5238 - DNA, 777 bp, Xenorhabdus bovienii
  Coding sequence Name=Xb4151_4152.C444.gene413.dna; Position on contig= 458847..459623bp; Strand=-
atgaatacacatagcgttgatccatccaaccatgacctgcttaattatgtgctacggcagggggataccccgttaattctggcacagcgcctgtgtgaatggtgcggccatgcgccagaactggaaattgaccttgccctgtcgaatatcggcctcgatctgctggggcaggcgcgccattttctcagctacgccgccacactctacggaatggattttgatgaagatcggctggcatttggccgcgatgaacgagaataccgcaatctgctgctggtagagcaacccaacggcggctttaacgatacgctggtacgtcagttttttatcgatgcttatcacgtcctgctccatcaggcactggggcagagccgcgatcctcaattggccgctatcagcaccaaatcgttgaaagaagtcgaatatcacctgcgtttcagccgtggctggatgatccggctgggggatggtacggaactgagccgcgaaaaaatccggcaatcggtcaatcaactgtggcgctttaccggcgaactgttctattgcgatgaagtggaacagcggctggccgaagaaggcattgcggtcgatccccgtaccttgtacgaaccctggcggcaaattatcaacgagacattcgcccaagccacattggaaattccgcaggaaacgccctaccgacagggaggcaagcagggactgcataccgaacatctgggatacatgctggcggaaatgcagtatctgcaacgcacttatcccaactgtaactggtaa

SEQ ID NO: 5239 - DNA, 288 bp, Xenorhabdus bovienii
  Coding sequence Name=Xb4151_4152.C444.gene414.dna; Position on contig= 459634..459921bp; Strand=-
atgagtgataccgattggccgctgtatgaagtctttatccgcagcaaacaggggctggctcaccgtcatgtcggcagcctccatgcagcagatgatcaaatggcgctggagaacgcgcgcgatgtctacactcgccgcaatgaaggttgctccatctgggtagtgaaatctatccatctggtggcatcacaacctgaagagcgcggggcttttttcgatccctcggaagacaaaatctaccgtcatccgactttctataccattcctgatggcatcaagaatatgtaa

SEQ ID NO: 5240 - DNA, 942 bp, Xenorhabdus bovienii
  Coding sequence Name=Xb4151_4152.C444.gene415.dna; Position on contig= 459966..460907bp; Strand=-
atgacaactaactcacttcaagcgcactttgacgccaaaatcgcggcggatctttccattgaggccaaagactggatgcctgatgcctatcgccaaaacctgatacgtcaaatcggtcagcatgcccattcagaaattgtcggtatgttaccggaggccaactggatcacccgagccccgacactacgccgcaaagcggtgctgctggcaaaagtacaggatgaagccggacacgggctttatctgtacagcgcggcagaaacactgggctgtacccgtcaggacatctaccagaagctgctgaatggcaagatgaaatattcatccatctttaactatcccaccctcaattgggcagatgtaggggtgattggctggctggtggatggggctgcgatcatcaatcaggtcgccttgtgtcgggcatcttacggcccgtatgcccgtgcgatggtgaaaatctgcaaggaagagagtttccaccagcggcagggttatgaagccgttatggtactggcggcgggcaatgacgcccaacgcaagatgctgcaagatgccatcaaccgtttctggtggccgactctgatgatgtttggccccaatgacaatgattcacccaacagcgcccaaagcatggcatggaaaatcaaacggttcagcaatgatgaactgcggcagaaatttatcgacagcaccgttccgcaattggaagcactgggcatgaccgcacccgatcccgaactggtctgggatgcaaccacggaacattaccgttttggtgaaatcgattgggacgaattctatcaagtgctcaaaggacagggcatatgtaatcacgaacggctggaagccaaacgccgggcttgggaaaccggaagctgggtacgtgaagccgcctcaatccatgccaagaaaatggccaccagaaaaaatgctgcttaa

SEQ ID NO: 5241 - DNA, 2088 bp, Xenorhabdus bovienii
  Coding sequence Name=Xb4151_4152.C444.gene416.dna; Position on contig= 461232..463319bp; Strand=+
atgcaacagttaaccagttatatttgtggtgcttgggtttatggacagggcaacgccagaacccttcatcatgcagtgagtggtgaagccttgtatcaggtgtgttcagatggcctgccactggccgatagcctaggatatgcccgtgaaaaaggcggtaagtcgttgtccgccatgacgttccagcaacgtgcgcagatgatgaaagcggtggcgaagcatctgcttgctaacaaagaaacgctgtatgccatttcggcagaaacgggagcgacccgtgcggatggttgggtggatattgaaggcggcattgcgacgctgttttcttatgcagggctggcggggcgtgagttaccggatgataccctgtggccggaagatgaaatgatcccgctttccaaacagtcgcagtttgtggctcgtcatgtgttgacttcgcgtcccggtgtcgcgctgcatatcaacgcgtttaacttcccttgctggggaatgctggaaaaactggcaccaacgtggatggccggtatgccagctatcatcaaacccgcgacggcatccgctcaattgacgcaggcgatggtaaaaatgatcatcgatagcggtctggtgccggaaggcgctctgcaattgatctgcggtggcattggcgatctgtttgatcatctcgattatcaggatgcggtgacttttaccggatcggcgcagaccgggcagaagctgcgtgttcacccacgactgatcgaaaaatccattccgtttaccatggaagccgattcccttaactgctgtatgttgggcgaggatgttacgcctgaaatgccggaatttggcgtgtttatcaaggaagttgtccgcgagatgacggctaaggcagggcaaaaatgtacggccatccggcgtattatcgtgccagtcagtcagcttgaggcggttaaacaagcattgcttaaacgcctttccggagtgactgtcggcgatcccgcactgccggaagtgcgcatgggcgcgttgattagccttgaacagcgcgatgaggttcaggccaaggttgatgaattgttgcgtcacggttgtgagcctctgtgcggtggtgctttggatcaactggtgctgacaggcaattccagcaacgagggcgcattctaccctccgactctgctctattgtgctgatccggtagcacatcaagcggtacatggaacggaagctttcgggcctgtttccaccttgatgccgtatcaggggacagaacaggcgatagcgctggtgttgatggggcagggcagtctggcgggttcgctggttacggcggatgagcagatcgcggtgcaggtgatccgggcaacagcgtgtgctcacggccgtatgctggtgctggatgaggcggcatctgcggaatctacggggcatggatctccactgcctatgctggtacatggtgggccggggcgtgccggcggtggcgaagagctaggcggtctgcgggcggtgaaacactatatgcagcgcaccgcgattcagggcagcccaaacatgctggccgccatcggccgtgaatgggtacgtggtgccaaagttaagaccgatccggttcatccattccgtaagtatttcgaacagcttgagattggtgaaagcctgctgacggctcgccgtactgtcaccgaagccgatatcgtcaattttgcctgtctgagcggagatcatttttatgcgcacatggataaactgggggcggcggaatctctgtttggtgagcgtgtggcgcatggttattttgtcgtatcagcagcagcaggcttatttgtggatgcagcggttgggccagtgcttgccaactatggcatggaaaacctgcgttttattgagccggtgaaaattggcgataccattcaggtgcggctgacctgtaagaagaagatcaagaaagtccagaaaactcctgatgacaaaccgcaaggtgttgtggtgtgggatgtgcaggttttgaatcaggagcaacaaccagtggcgctttacagtattctcacgctggtggaacggcagcaaggggattttaccgcgtctgagtcggtgcggttgagataa

SEQ ID NO: 5242 - DNA, 1095 bp, Xenorhabdus bovienii
  Coding sequence Name=Xb4151_4152.C444.gene417.dna; Position on contig= 464166..465260bp; Strand=-
atgaaaacctatccattgcaaagtatgacgatggcgcaagcccagcagcagcagttcaaactggtggatattatctgtcgtcactttcccggcgctgattttctctcgcaaggtgatctgggcttagtcccggatctgcaccaaccccggatgacccatcgcattgaagcggtcatcgcggagcattttggtgctgaagcggcagcctttgtcaatggagccggaacaggggcgctacgcgcggggctggcggcattagtcagtcccaacgctacattgctcgtccacgatgcaccgatttatcccacgaccaagatatcgattgaacaaatggggcttcacgtggtgtatgcagatttcaatcatacagaacaaattgcagcggccatccggcaatatcaacctgctgccagcctgatccagcatacacggcaaaagatagatgacagctacgccctgcaagatgtgctcgccatactccatcagtatcaaattccctcattggtcgatgataactatgcagccatgaaagtggcgcatattggctgcgaatatggcgcgacactctccagtttttcctgttttaagttactggggccacagggagttggcttagttatcggcaaacaaacaatgattgagaccctacgccgcagcatgtactccggtggctgtcagatacaaggctatcaggcaatggaagcattgcgtgggctggtgtccgcgccagtgatacatgcagtacaggcggaagttaatgaaacgttggtgacacgattgaatcagggggaattgccacaggtgaaacaggcatttctggccaatgctcaatccaaagtgttattggtggaatttcacgaccctatcgccgaagcagtactgacggccgcacatgggttgggagcattaccttatccagtgggtgcagaatccaagtttgaaatcccgccgctgttttaccgcatttccggtacatttcgtcaggcagatcctacactggaaaaacgcatgatccgcattaatcccaatcgcagcggggcagaaacagtgatgcgtattttgcgggaaagtatttttcagaaaagcggtcaataa

SEQ ID NO: 5243 - DNA, 1368 bp, Xenorhabdus bovienii
  Coding sequence Name=Xb4151_4152.C444.gene418.dna; Position on contig= 465265..466632bp; Strand=-
atgagtgatatcaatgccatacaacatcttcacagttttctgatgagcttgatggaagttgaccctttcaaggccggattactcgctgctattggcgcgattgccgccatgatggcaaaccgtggtatcgctgttttccatgatggtctgcgcccgctgctgccggaataccttgaaggccggatgagccgcaaagcgctcgctgcgaccagctttgccctgagcatcggtctggttgtcggttttggcattcccttttcactggcagcgccgattgtgctggttcacagcctgctgctcggcactgatatgatcggcatctggtgtgccaacagccgaagagggtttatcgcctcgggtatcatcggcgccctgtatgctattgccttgctcgccggcctgcgctcagtcgtcgaactgtttgccatgctgccggtgaatttcaccgatgacctcaagaaagttggcgatcccattgtcgcctgcttcgcgctgttccctgcaatagttgtgggttatcaatatggctaccgcaaagggctatgggtcatgctcaccgcgttgataggctatctggccaccaaggcggttggcccactcagctttggtggcatgatcgaaaagccggtcagtttcgatcccaacggcgcagcattactgttgtcgatgattgccatgttctactttgcgatgcgggagcgtccagcccagtcagcggagcagaaaggagccaatgaagtcttagtcgggctgttctctacccgtattgaacgcatccagaaaaacaaatggctgctgatcctctgcggcggcctgaccgcaagtgccgcgaccatgtctttcagcctgctggccgaaggcccggtttccctgcaattaatggcgcagggcgaacagaccaacgccctgttggtcgcactggcacgcgccatcagctttatcccgctggtcggcaccacggcgatagccacgggagtttacagcccgaatggcatgaaattcgtgtttgtggcgggtctggcgaccaacaacccgtggatcgcctttattgcgggcggcatcaccatgttcattgaaatccagctgctggcgaaaatcgccatttggctggataaataccccggcgtaaaagcctgtagtggccatattcgtaccgcgatcaccaaaatgctcgaagtcgccctgctggttggtggtatgattgcctccaacgctattttgccgggtataggctttatgatcgtggcgggaatctacctgctcaaccgtacttccagacgtcctttggtagagatggctatcggcccaatcgcaactattgcggtgggtatccttgccaacgtgctctatctgctgggaataaaataa

SEQ ID NO: 5244 - DNA, 363 bp, Xenorhabdus bovienii
  Coding sequence Name=Xb4151_4152.C444.gene419.dna; Position on contig= 466643..467005bp; Strand=-
atgaaatttgtcattggcgggcaaatagaaaaagaaagaatagccgaaagcattcggcaattggcgggagacaaagccactgcaattaccatcatgaatgacattgaagccgctatggcgattaaaaatggtgatgcagattactatctcggtgcatgcaataccggcggtggtggtgcactggcaatcgccatcgcacttatcggcctgaatcaatgtgccaccatcagtatgccgggtaaaatcctgtctgacgacgagattattgcccatgtgaaagcaggtaaaaaagcattcggttttacaggtcaggatattgatgttgtcctgccggtgatcatcaacaccatcgtttctcagtga

SEQ ID NO: 5245 - DNA, 1089 bp, Xenorhabdus bovienii
  Coding sequence Name=Xb4151_4152.C444.gene420.dna; Position on contig= 467091..468179bp; Strand=-
atgggataccagaaacaaactgggaatacgcccacacattccgctacgtattcctcatccagaattgatgaagctgaagacgcactcaaacaggcggactaccaagaatatcaggttaaacgtcggggtgagacgctgctatattcatcaaacaaacaattaaataacccacatctgggtacacagcaaaatacctgtattgatacatcgggctatacctatgtgcatgaacacctgcatatcgatctctctggtgcgaaaggcagtctcgactgtcgattagaccaatatgatctgatcgtcgatgaacttcgtcacctttatacccttggcctacggaacatcgcggagatgaccaaccgctacatggggcgcaatgctaacttcctactggatttgatgcgtgatagccacatcaacatcattgcttcgacgggttactataaagaaccatttttccccgctcatttcagcgaattgagtgtacaggcgattgccgacgatatgattgctgaaattgaaacgggcattgacggtactgggctaaaagccggcgtgatagcagaaattggttccagccttgatcaaatcacagcggatgagaagaaagtatttgccgccgccgctctggcacatcatgccactggctgccctatctccacccataccaccttaagcacaatgggacgtgagcaactggctctgctcaaagaatttggcgtttccgctgaacatgtggctatcggtcattgtgatctgaaagataatctcgacacaattattcccctgcttgaagaaggggcgtggatacaattcgatacgattggcaaaaacaactactatccagacagtgggcgcattgccatgttgcgggaagtcgccaaacgtggtctgctgggccaagtgatgctatcccaggatatcactcgccgttctcatttaaaaagtaacgggggaattggattcgattacctgttgaccgtattcgtgccgatgttactggcagctggtttctcccaaacgcagatagatctcatgttacgcgataatcctgcacaatttttccgacacggcttttctaagacttaa

SEQ ID NO: 5246 - DNA, 1176 bp, Xenorhabdus bovienii
  Coding sequence Name=Xb4151_4152.C444.gene421.dna; Position on contig= 468276..469451bp; Strand=-
atgtttatcaatgccctgaaaaaacagaaccccaaattgattgaaatagcaaaagacctttggcagcaaggcgcgatattaccagacacttacatcattgatgtcgatcaggtcttggacaatggtcggcatttactgcaagcagcagagcaatatggcattgaactctatttgatgaccaaacagattggccgtaatccctggctggctcaaaagctcattgaactcggttaccctggtgtcgtggccgtggatttcagggaggcatatgccctgagtcagcatggcataccgctatgccacatcggtcatttggtacaaacccctgcacacctgatagaaaccatgcttaaacagcatccgggtatcattacggtgttttccattgaaaaagcacaggcgatctcagatgccgcagagaaattgggacggattcagcccatcatgctgaaagtgtttgataagcgtgatatcactttaccctctcaggaagcaggtatcttcttcgatgaactggatacaaccgttgacgtattaaaaaccatgccgggcattaagttgagcggtttaacccatttcccctgcctggagtggaacgcccgatatcagacaaccctgcccaccatcaacttgcagaccctcctcagggcgcgcaacagacttgaacagcttggcattgaactctcacaaatcaatgcgccttcagcatcaagctgcaacaccatccccctgctggcaaaatacggtgctacccaccttgagccgggacatgccctgaccggcacgatacccgccaatatcagtggccaagaacctgaaaagatctcaatggtttatatcaccgaggtttcccatcactacgacggcaacagttactgctatggcggcggctactataaacgtggacatatgaaatacgcgctggttttccctgaacatgcgcgctcccccaaaaccgtgcgggtactgagtctgggagatccctgcattgattaccatatcccgatatccggtatccatcctatcggcagcccagtgatcatgtgcttccgtacccagatttttgtcacccgcagcgacgtagctctcgtttccggcattcaatccggttcaccaaagcttcaaggcatttatgacagtcaaggaaattggaaaaacaggggttattttcaataa

SEQ ID NO: 5247 - DNA, 363 bp, Xenorhabdus bovienii
  Coding sequence Name=Xb4151_4152.C444.gene422.dna; Position on contig= 469556..469918bp; Strand=-
atggtagaacaacgactaactatcctgttgcaaggtggcgtcatcgaccaagatatctacgataacatgcttgatattgtgcatgatctagaagatatctggttaatccctgtccatcatccacaaggtgaaatggcgcttacccacatggcgagtgctttcatgcgctcacgtcgcggcgaaattgttttgccacttgaaaagaatatcttgaccaaaatcgagcagtcagaacactgcgcacaattattcaaaatccatcgcgcattgttagaaaaattcacaatcacactgcaccccaacgaagaaggctatctgttggtaaatttatatggtttaatactggcaaccaaaattccctga

SEQ ID NO: 5248 - DNA, 909 bp, Xenorhabdus bovienii
  Coding sequence Name=Xb4151_4152.C444.gene423.dna; Position on contig= 469968..470876bp; Strand=-
atgatgagtcaaacattcattaaaaaagaggggattgcacaatcgtttctagctcgttatctcctctctgagcaatgtggcaaccgcctgaaaactatcgagttactggctaaagaatgtggattgtccgtaggtttaatgcaagcagcattgaaatctcttgaacaggcacaagcggttggaattaagcgtcgtggtcgtaatggcagctttctttcgcagattaaccataaattactcttggagtatgccgatatcggcaatgtggtctgcgcaatgccgcttccttatacccgcgcctatgaaggtctggccagtggtttaaaagcattgtgtgcagagattcctttttattttgcacatatgcgtggttcagacatccgcattgaatgcttactgaatggcgtctatgacttagcagtaacgtcaagacttgccgcagagcagcacccagaaaataaagatttatatattgcgctttcactagggacacaaagttatacagacaggcatagattaatctttcgtcatggcgaaatggattccattcgccgggttgggttggacagtacttcagcagaccaaaaaataatgacgaatcagtattttgaaggaaaagagattgaagtggtcgaggtctcctatcacgaatgtctgaatcaaatcatgaaaggccacattgatgcggccatttggaacgtcgggcagggtcacgaactggtagcacaaggtttgatgactcagcttccagatgatagtgagtgctttatcaaagcctccgaagccgttattttggctcgtaaggacaacatccccatccagcaactcctgtacaccatggttgatcgggaagcactgctgactcatcaacaaaacgtggtcgcaggcacaatcgagccagtttattga

SEQ ID NO: 5249 - DNA, 510 bp, Xenorhabdus bovienii
  Coding sequence Name=Xb4151_4152.C444.gene424.dna; Position on contig= 471306..471815bp; Strand=-
atgttaaccattcgggaagcgacaatcaaagacgcggtgctgttatcccagctcattgaggaaagctatcgttttcacttttcctatttgtggcataacaaaaccgaattggaagaatatgtcgccgaagagggttcaccagaaaaaatatcgaactcactcaacaccaccaatcacaagtggtttattgctgaaactcatcactcagtcggttttgccaaaatcgtcttctatgaaccgctccctgatagcgatttaactggcgtctatttgcataagctccatctgatgccacatcagaccggacaaaaatacggtgagcaattatttgaccatatagtcaaactcggtcaggagcaggggttgcaatggctttggctggaagtattagaacagaacacattagccatcaaattctatgaaagaaaagggatgaaatggtacaaaaatattatcttttcccgttccaagcagaaaagtaccctgcatattatgactaaaccaatatga

SEQ ID NO: 5250 - DNA, 1506 bp, Xenorhabdus bovienii
  Coding sequence Name=Xb4151_4152.C444.gene425.dna; Position on contig= 472083..473588bp; Strand=-
atggaaaccaaagacttgattgtgattggcggcggaattaacggcgcgggtattgcggcagatgccgctggccggggactttccgtcctgctattggaaggtcaagacttggccagtgcgacttcgtctgccagttccaagctgatccacggtggcctgcgctatctggaacattatgaattccggctggtcagtgaagcactggcagagcgtgaagtattactgaaattagcaccccatattgcattcccaatgcgttttcgcctgccccatcagccgcatctgcgcccagcctggatgatccgcattggcctgttcctgtatgataacttgggtaaacgcgttagtctgccaagcagcaaggggctgaaatttggtgcgaattccgtgctgaaaccttccatccgccgtggctttgaatattccgactgctgggtcgatgatgcccgtctggttgtcctgaacgctcaggaagtccagaagcatggcggtgaagtccgtacccgtactcaagtgacccgcgcatggcgtgaaaagggttactggatggttgaagcgaaagatctcaccacgggcaaaaccgatacatggcgcgccaaaggcttagtcaacgcgactggcccgtgggtcaaaaacttctttgatgatgggctgaaactgaaatcaccttacggtatccgtctgatcaagggcagccatatcgttgtacctcgtgcgcatgatgaacctcaagcctatattctgcaaaacgaagataaccgtatcgtgtttgttattccgtggaatgatgagttttccatcatcggcaccaccgatgttgaatacaaaggcgatccaaaagaagttaaaattgacgatcaagagatcggctatttgctgaaagtttataacaaccacttcaagaaacagcttaaccgtagtgatgttgtctggacttactccggcgttcgcccactgtgcgatgatgaatcagattcaccacaggcgatcacccgtgattacacgctggatgtacaggatgaacaggggcagatgccattgttgtccgtctttggcggtaagctgacaacctaccggaaactggctgaacacgcgctggagaaactggtacagtactatccaaacgcaggtaaggcgtggactaaaaacggtaaattaccgggtggtgaactggaaggccatgatcgcgatggttatgcacgcctgctacgccagcgtcataactggctgccagaaggtgtggcacaacgctatgcccgtacttacggcagcaactgccagataatcctgaaaggcgcagaagccctgacagatttaggcgagttcttcggccacggcctgtatgaagccgagttgcgttatctggtcgaacatgagtgggtgactcagttagacgatgctatctggcgccggactaaattgggtatgtggctgaccgatgaacagaaacagcgggttgctgactggctggcacagaacgttcaatcaagtcaggcacaaagctaa

SEQ ID NO: 5251 - DNA, 759 bp, Xenorhabdus bovienii
  Coding sequence Name=Xb4151_4152.C444.gene426.dna; Position on contig= 473851..474609bp; Strand=-
gtgaagcaaactcagcgacatgatgcaataatcgagctggtgcgccttcaaggttatgtcagcactgaagagctggttgaacactttgatgtcagcccgcaaaccatccggcgtgacttaaatgatctggcagacaaaaataagatccagcgtcatcacggcggagctgcactaccctccagctccgtcaataccgcctatcatgaccgtaaaatcatgtggtcagatgaaaaagcccgtattgcccggcaggttgccacccagatcccaaatggtgcaaccctgttcattgatattggcaccactcccgaagccgtcgcgcatgcactacttaatcaccgggatttacggattgtcaccaacaacctcaatgttgccagcctgttcatggggaaagaagatttccggttaattatggcgggtggtgaagtccgttcccgtgatggcggcattattggtgaagcaactctggatttcatctcccagttccgccttgattttggcattcttgggatcagcggcatcgatagcgatggctctctgctggaattcgattaccatgaagtccgagccaaacgcgccattattgagaactcccgctgcgtgatgctggttgccgaccattcaaaatttggccgtagtgcgatggtcaacctcggcaacatgaatcttattgatttcctgtttacggataaagtgcctcctgccagcatccagaaaatcattgagcagcatagtgtcaaactggaactgtgctaa

SEQ ID NO: 5252 - DNA, 834 bp, Xenorhabdus bovienii
  Coding sequence Name=Xb4151_4152.C444.gene427.dna; Position on contig= 474671..475504bp; Strand=-
atgatccacgtaacctcaatatccaatccacgactggctcaagcctttattgattatatggtgacacagggcattcacttgaccatgcgtcctacccatgagccagcactggttgaattgtggctggaagatgaaaaccagttaagttttgttgagcaggaacttaaccaattttcccgcgatccattcaatgagcgctatcaaaccgccagttggcaagctggcaaatcgggttattcatttaaatatcacaacagcctgaatttgagcaccttgaaaagtcagtccggcccgctgactatctccgtgaccgctctctgtatcttagtttatctatggatgcaggtggcaggagattccgatgtcatgcgctggctagcgtggcctaatggtgaacaatatctggaattatggcgctgggtcagccctgccctgctgcatttctccctgacacatcttctgttcaatctcgcgttatggtggtatctcggcagtcaggtggaaaggcatatgggtgccggaaaactctttgaaattacgatagtctctgcggttttcactgactgggcacaatccttgttcagtggatcgcattttggtgggctttctggtgtggtctacgcactgatcagctacgtttggctgacgggtgaaatgtcccccaaaagagggatcagtgtccccagagggttaatcgctatctcggtcatctggttattggttggctatttcgatatgttttcactgaatatcgccaatgctgctcatttttcggggttaatcatcggcttactcatggggctatgggataatttacgtaaacaaaaaaattaa

SEQ ID NO: 5253 - DNA, 324 bp, Xenorhabdus bovienii
  Coding sequence Name=Xb4151_4152.C444.gene428.dna; Position on contig= 475578..475901bp; Strand=-
atggaccgttttcaaacaataaaccctgaacaagcctaccagcattggctgaataaaactgctgttatggtggatatccgtgatccacagagtttccgtgccggacatacaacaggcgcatttcatctgaccaatgaaaccctcaataacctcctgcaagaaactgattttgaccagcctgtcatggtgatgtgctatcacggccacagtagtcaaggcgccgcacaataccttgtgaatatgggttttgaaaccgtttacagtgttaatggtggctttgacgtatggcagagaagctatcctgaggctgttaacacgctatag

SEQ ID NO: 5254 - DNA, 576 bp, Xenorhabdus bovienii
  Coding sequence Name=Xb4151_4152.C444.gene429.dna; Position on contig= 476065..476640bp; Strand=-
atgattaatattactgaagcagcgcaagcgcactttgccaagctactggcaagtcaagaaccgggtacacagatccgcgtttttgtcattaatccgggaaccccgacggctgaatgcggtgtttcctactgcccaccggatgctgttgaagccactgataccgaactaaaatttgaccagatttctgcctatgttgatgaaatcagtgctccttttctggcagaagccgtcattgattttgtaactgatcaacttggctcccagctgaccctgaaagccccgaacgccaaaatgcgcaaagtgacggatgacgctccactgattgagcgtgttgaatatgtcctgcaatcgcagatcaaccctcagcttgcaggtcatggcggccgtgtcagcctgatggaaatcaccgatgcaggttatgccatcctgcaattcggcggtggttgtaatgggtgttctatggtcgatgtcactttgaaagaagggatagaaaaagagttgttgaatatgttccctgagttgaaaggggtcagagacctgactgaacaccagcgtggcgaacactcttattactga

SEQ ID NO: 5255 - DNA, 999 bp, Xenorhabdus bovienii
  Coding sequence Name=Xb4151_4152.C444.gene430.dna; Position on contig= 476713..477711bp; Strand=-
atgcaatacggctggcaaccaatcctcccagcgaccagcccagccacaacgcattctccggtgcctgctgccatacagtatccgccatttctgccagagtcattgccggatacggctggctgcgaccatgccccggcaaatccaccagatgtaagcggaaatgcgaagacagtcgcgtttccacggaacgccagacctcagaattcaatccccatccgtgcagcatcacaagatcgcgtggagcctcacccattatctgccaaaacaacttattcattgttattctcatcttatttgtcatcaaggaaggaacctatgctaacaatggttggatactgttggctatgccatcaaagtttgtattttgctcatcatgggatctgccatatctgccaccagcaattaaaacggctgaaacatgtctgtccgcgctgtgctctgcctgccgaatcaagagattttccctgtggccgctgcctgaaaaatccgcccccgtggcaacacctcatcgccattacagactatgccccgccattaagccggcttatccgacgctacaaatatcacggcaccccacaactcgcgacagtattagcccgtctgtttctcctgcattggttacagggttatcgtgatggccgctggaataagccggattgtatactcggcattcctctgcacagcaaaaaacgctggcgacgtggattcgatcaaattgaactgatcgccaagccgttatcacgctggttacaatgccactatcagcccgatcttttgtggcgctcgcgtgctacactcacacaacggggcttatctgccactcaacggaaaaccaatcttaagcatgcctttcaattgcgtggcgattttaccgatcaaaatgtcgcgattttcgatgatgtgatcaccacggggacaacgttgcatgaagcctcacagttgttgattcgtgcgggtgctcactccgtgcaagcttgggcaatatgccgaaccttgtag

SEQ ID NO: 5256 - DNA, 777 bp, Xenorhabdus bovienii
  Coding sequence Name=Xb4151_4152.C444.gene431.dna; Position on contig= 477435..478211bp; Strand=+
atgaataagttgttttggcagataatgggtgaggctccacgcgatcttgtgatgctgcacggatggggattgaattctgaggtctggcgttccgtggaaacgcgactgtcttcgcatttccgcttacatctggtggatttgccggggcatggtcgcagccagccgtatccggcaatgactctggcagaaatggcggatactgtatggcagcaggcaccggagaatgcgttgtggctgggctggtcgctgggaggattggttgccagccgtattgcattggatcatccggcggaggtcgcgggtctcattaccgtggcatcttcgccgaagttcagtgcggaaggtgactggccggggattaaaccgaccgtattgagggcttttgagcatcaactgagtgaggatttccagaagaccgttgaacgttttctgtcattgcagaccttgggtactgacagcgcacgtcaagatgcacgtttactgaaatctgtgatattgaatcagccgatgccgacagtggaagtactcaatgcagggctggaaactctgcgtaccgatgatctgagggcggaactggctcaacttcagctaccttttttgcgtctgtatggttatctggatggccttgtgccgcgtaaaattgctgcacaactcgacaatgagtggccacatacccattcggtcattatgcgtaacgcggctcacgcgccttttgtttcccatcctgatgaatttgtggatgccgtaatggagtttgtggctaacgcaggattgtga

SEQ ID NO: 5257 - DNA, 444 bp, Xenorhabdus bovienii
  Coding sequence Name=Xb4151_4152.C444.gene432.dna; Position on contig= 478258..478701bp; Strand=-
atgcctaaagagttatttactgctgaaatagaatcatccggtcacctcaaaatgcaatgttcaacacgtggcttttccttccatgtggatgaacccaaaaatctgggaggaactgatgaagccatgaatcctgtggaagcattactttcagctttcggtgcctgccaatgtattgtggcgaaaagttttgcccgcaaacataaaatcaacttgattgatattcaggtaaaaatggaaggggaattggataccgacggcttcacaggaagaaataaaaacaccaaaatggggttttccaaaatcacctccaaattctatatcaaagccgataataccgaacaagagatccgcgattttattgattttgtcgaaagcaactgccctgttcttgataccatcctcaatgcacctgaaattgtcactgaagtttatccttccagataa

SEQ ID NO: 5258 - DNA, 282 bp, Xenorhabdus bovienii
  Coding sequence Name=Xb4151_4152.C444.gene433.dna; Position on contig= 479093..479374bp; Strand=-
atgggcgatgacttgtttccttttcgtatcaaaagcataccaaagccaatgacgttgttttttattgcctataaaaaaccactgctcatccaattcacagataagtgtgacatcgtcataagcgatctgtcgcgatgttactttttttggcgagagttttttaatgtccgcatcaccgtattgataccgagacctaatacacggcctgtgtctctcacgccagagccattcattgccatatccacaattttttctttcatacccggtttatggccgttgtaa

SEQ ID NO: 5259 - DNA, 390 bp, Xenorhabdus bovienii
  Coding sequence Name=Xb4151_4152.C444.gene434.dna; Position on contig= 479282..479671bp; Strand=+
ttggatgagcagtggttttttataggcaataaaaaacaacgtcattggctttggtatgcttttgatacgaaaaggaaacaagtcatcgcccatgtctttgacccccgaacggatgcaacctgccgaaaattgctcaacttattggtgccttttaatattcgtttcatcacgaccgataacgggggaagttatgccagagaagtggtgccggaaaaacatagggtaggcaaaatttttacccaacgtatagagcggcataatctcaatctgcgaattcatatcaaaaggttggcaagaagaaccatttgttactcacgttcaatggaaatccacgaaaaactcattggcgcatatattgaaaaacatcattacaaccctttggagtcatga

SEQ ID NO: 5260 - DNA, 141 bp, Xenorhabdus bovienii
  Coding sequence Name=Xb4151_4152.C444.gene435.dna; Position on contig= 479693..479833bp; Strand=+
atgtcaagtcaggccaacagctcaggtattacggtgatttcgttcgatttttctgctgttttctgttgcctcagtaccttcttgttttctgtggcaaacgcactcaccatatggatggttgaacgccgatcttcacggtga

SEQ ID NO: 5261 - DNA, 168 bp, Xenorhabdus bovienii
  Coding sequence Name=Xb4151_4152.C444.gene436.dna; Position on contig= 479845..480012bp; Strand=-
atgatttcaaaagaaagggctgctcaaagtcggtatccctgtgcatggcactatttgcccgggtcattgcttgtattgaacctcgtcaattccagcaatgccagctggatgcagactgtgaatcaactcactgaaagcagtttaatcgcaattgatggtaaaacatga

SEQ ID NO: 5262 - DNA, 159 bp, Xenorhabdus bovienii
  Coding sequence Name=Xb4151_4152.C444.gene437.dna; Position on contig= 480048..480206bp; Strand=-
atgatctcatacgctccttttcgggataatccctatgaatatcgacgcattttcactgcatttcggtcaaatagtagacaatcatttaaaatccaataccccctttttgatattctttttttaaccgtttgcgccgtcatcgccggagctgaaggctga

SEQ ID NO: 5263 - DNA, 108 bp, Xenorhabdus bovienii
  Coding sequence Name=Xb4151_4152.C444.gene438.dna; Position on contig= 481002..481109bp; Strand=-
atggtgcccccacccagaacaccccattcatcacacggcgatattcaacatgtagacgtcctgctagctctgaatggacaaggggcaaacaaggctgctgacgtttaa

SEQ ID NO: 5264 - DNA, 336 bp, Xenorhabdus bovienii
  Coding sequence Name=Xb4151_4152.C444.gene439.dna; Position on contig= 481079..481414bp; Strand=+
atgaatggggtgttctgggtgggggcaccatggcacgatttacctgagcgctatgggccttggaaaacggtctataaccgatttaatcgcggatcaaaatcgggcattatcgacaaaatatttaaccgattactgtctgttcttgatgaaaaaggcttaattgactggtctgaaatttgcctagatggcagcaatattcgcatcagtaaagatgctgcaggcgcgaaaaaaaacatctcgatattgctggcgattatgtgctgggtcgctcacgtggtggttatgatacaaaaatctatttggcaactgacggaaagggctttccatttaacctga

SEQ ID NO: 5265 - DNA, 390 bp, Xenorhabdus bovienii
  Coding sequence Name=Xb4151_4152.C444.gene440.dna; Position on contig= 481414..481803bp; Strand=+
atgttgaccgtagggcaagcccatgaaagtcaatccgctatccctttgctcgacggagttggcgtacaacgtaaaaatggcttcatgaaatggcgtggcaaagccgtgttggccgataaaggctattcgggcggaaaaccccgcagttacctgcgaaaattgagactaaaaagcattattctttataaagtcaatgaaaaaggtagtagtgatgggtgtacacaatttgatgaaccgatttgtcgtaaccgcaatgttgtcgaacgctgtttcggttttcttgaaggaaatcggcgtatcacaacccgttatgaaaaaacagcacgaaactatctgtccatggtgaaattgggcagtattcgactcttttgcagaaggttatataattga

SEQ ID NO: 5266 - DNA, 729 bp, Xenorhabdus bovienii
  Coding sequence Name=Xb4151_4152.C444.gene441.dna; Position on contig= 482012..482740bp; Strand=+
atgaatattcgtaatagaacaccgaattttgatgacgtagctaacattgtgaaaattctagggataacatctaataatggtgaatcttttgatagagatttgcatctttattcactaatagaaaaaccatgggggtttgaatatcgggtttattgtgattcaatttttgatgtatggaaattacatatatctccacaggaaaaaacctctatgcattgccatattcaaaaagatactgttctcatctgcttaaatggtagtggtgtgacaaaattccttgatggtgatgagtttaatatatctgttggccaagtggtttatatagagcgaggagttttccaccaaactatttcgactggaaatgattaccttgaacttattgaggtagaaaatccaagaaataaattcgacctattacgtttgtcagatgattatggtcgagcggctcaatcatatgaaaatgttagtcttaatcatgacctgctttctccactaaaattaatctcaccaggagcatatattcgaaatgttgacataaactctaaattttcttttttccttgaaaaattaaatattgatatattagatgatgaaaatattttatttattgtcagtcttagtattgatagtcatctttcaggaaaaataaatatctttttaaaagaagatgttaaatgtcgtagctatattggccaacaagtcttactaatatcacgaaaaaataaataa

SEQ ID NO: 5267 - DNA, 576 bp, Xenorhabdus bovienii
  Coding sequence Name=Xb4151_4152.C444.gene442.dna; Position on contig= 482752..483327bp; Strand=+
atgttagataaatttaaattggttattattaccggaccaggattccaagatcatgatctcgtttacacttattaccgctcaatagaagagggttatgatgtttccatcgctactaaagatggagaatctgtaattggaaagtatggcatctcagtacctatggataaacgggcaaaacaaaatattacatttgacgatttgaatgaagaaaaatttgatcttgtcattcttactggtggtcatgaagcacctgaccgggttcgtcaggatcaacgggtaaaagattttgtgtctaatatgtctaaacaagaaaaagtagtagcaggcttgtgccatggtccttggatcatgatttctgctggtgtgatgaaaggcaagttagcttgtgcttatgtgggtttgaaagatgacatggagaattctggggctaatgttattgaagctgatgttgttgtagataaaaatattatcacatgctcttactattctgaatgtgggaaatttatgaaagaaacttttgcggcagttaaaagatggaacaaaggtgaaaagctaacagaaccattagtggtgtaa

SEQ ID NO: 5268 - DNA, 738 bp, Xenorhabdus bovienii
  Coding sequence Name=Xb4151_4152.C444.gene443.dna; Position on contig= 483331..484068bp; Strand=+
atgattattgcacttgattttgatggtgtggttgttgatgctatcgatgaatgccttctggtttcttggaatacatttaacggaaaaggatatcagcaatttaataaaaatactttggaatccattcctagatctttcagagaaaaatttctcaattatagaagttacgtgagacatgatgggcattttattgttccctattatttaaatgatgaggtttttgtaaataaggatagtttcgaaaatgtttattctagaatatccacgtctgataaagatagatttagaaattcatttatagaatatagaattaaggtgcgtaatacataccccaaagtatggacgtcactgcataaatttcttatggatattgagacattattaaattcaggaaatgagttcatcatagtttcaggaaaggattctagttctatacattttttattgtgtatgataggggttgaatttcccatttcaaaaatatatggaaggatgaccaataaatctgaaacattaaaatccataaataataaagcgtacatgaaaggagagaaatttatttttatagatgataatttagataatgttaaagaagctattaataatgatatcccttctgtttgggcagagtggggatacaacacaaaagaacaattttgtgaagcaaaacagcttaaaatcccttcgctgaagcagaaagacttaagcgatcttatcaaatcacttcatcaatattaa

SEQ ID NO: 5269 - DNA, 714 bp, Xenorhabdus bovienii
  Coding sequence Name=Xb4151_4152.C444.gene444.dna; Position on contig= 484079..484792bp; Strand=+
atgatcaataatgttaaaagagctttaattatcgtaacatcacatgcaattttagggaaaacgggaaggcaaactggattttattacgaagaacttgctacaccttattgggaatttgttgatgcgggatacaccgttgacatagcctctattaatggagggacagctcccgctgatccaagtagtgttaaaagttccgaccaacaaccaaagtctgtgcgtcgtttcctcaacgataaaagctgtatgaataaggttaatactacaaaatcaattttgaatattgatccgaatagctatcagattgtctttcttcccggtgggcacggtacgatgtgggattttgctcaatctatgtctctggcaacgctacttagcaagctctatcaaaacggtgctgttcttggttctgtatgtcatggtgcagccggattgttgaatgtaaaaactgctgatggtattccacttgtggaaaaccgaaaaattaattctttcactgaagctgaagaacaagcctctggtttagataacgtagttcctttcatcctcgaaactgagctcaaaaaactcggtgcacattttgaatgtgcggctaattttgaaccctatgtagtatctgatggtcgtttgataactggtcaaaatccagcatcttctggtttggtagccgctgctattctcaaggctgctaatcatctttacaataaggagtaa

SEQ ID NO: 5270 - DNA, 876 bp, Xenorhabdus bovienii
  Coding sequence Name=Xb4151_4152.C444.gene445.dna; Position on contig= 484800..485675bp; Strand=+
atgaccaaagaaattctttgtggattcggtgtgggtgtagacgcggttgccggttggttatcttcgtatggtggtgaagattcaccaagtgacatttcacgtggaatgtttgctggtgaaatcggtgttccacggcttcttaatttgttcaaaaaatttgatatcccaacaacttggtttatacctggtcattcgatcgagacatttcctgaacaaatgaaaatggttgtagatgcaggtcatgaaattggtgtacataattacagtcatgaaaatcctattgatatgacgccggaacaggagaggatagtcttacaaaaaagtattgatatggtcaccaaattatctgggaaaaagccaacaggatatgtggctccttggtgggagttttctccatcaactacagatttgctcttagagcatggcatcaaatatgatcattctcttatgcataacgatcatcttccatattatgtacgtaaaggtgattattggacgaaaattgattacacaaaacatcctgacgaatggatgaagccgttgatcagggggaaagaaactgatcttgtcgaacttcctgctagttggaccgtagatgacatacctccttttatgtttatgaaaaataaagccaatagtcaaggttttatgaatccgcgtgatattgaacaactatggcgcgatcaatttgattgggtgtatcgggaaatggaatatggtattttcacttttactattcatcctgatgtttcaggcagacctcatgtattaatgatgcttgaaagacttttggtacatatgttgggtcatcctggcgtaaaatttatgacactcaatgatattgcggatgatttcaaaaaaagaaatccacgataa

SEQ ID NO: 5271 - DNA, 900 bp, Xenorhabdus bovienii
  Coding sequence Name=Xb4151_4152.C444.gene446.dna; Position on contig= 485720..486619bp; Strand=-
gtgagctatcttattcaattacgtagttttcttgatgtttatagatctggttcgatttcaaaagctgcaacgaggctgggagtgagtcagcctgctgtatctgcacatgtacactctctagagtcatttatgggtagtgtattatttactcgtcgctcccatggcgttatacctacggctgaagccgatgatcttgtccttcaaatagggactcatttagatgcgattgaaaccaaactctcattaattcgtggaaaatcgaagaaaattgaaggtgtcgtgaagatcattgctccagctgattttctatgggcaaaatcagcaaatattttatcctcaatcattaataaacagctcagatttaagctgttgattggtgaccgaaaaaaaatttattctagtttgaatgatggagatagtgatttggcttttacaacatcttgcccagatgaaaataaattcggctttgaaatcataggaaaagaaaaactcattatagtaacatcagcatctatagcagctgaattaaagaacaaatcaatcagccctgaaatattagaaaaatacccattaatttcctacgataatcaattacctctaattagagattattataaattagtttttggtgttgaggcagatattttaccatcaattaccatctctgatctcagagtaattgggagaattataagtgataataatggatggaccgttatgcctgaatatttatgcgaagatggatttaaaagcaggaaagttttcaaaataaaccataatactaatattccagagaataatttttatcttgtgtggaataaaagcgcactgcggcacccaagagttttatatgttaaaaatcatataatcaacttagctcaacagggttactttggatga

SEQ ID NO: 5272 - DNA, 1182 bp, Xenorhabdus bovienii
  Coding sequence Name=Xb4151_4152.C444.gene447.dna; Position on contig= 486802..487983bp; Strand=+
atgccgtttgttatttatattttttctttgtgtgcgtttgctctcggactgacagaatttctggtgattggacttgtatcagccatatctactgacttccatacatcagtagagtctgttggtttaacagtcacggcttacgcagtaggagcgaccattggagccccattccttacagcagtaaccacgagatggtcacgaaaaggtgtaatgctcactacaatgatgattttttctatcgggagcctggcggcaacattttccagtagtgttgaaatgatgattgtttcgagatttgtcgctggtcttgctcacggactgttcttagctgtttcagctagtgtcgcgactgatcttgttcctccagaaaaaagtggggcagcagttgcatgtgtttttactgggctaacactggcgcttgccttaggtgttccaataggaacatatttaggaagtgttgtatcttggaaatttagtttttctttggttacgatatttggattaatcggccttatcggattgatttttttgatgccagccaatacaggaaataaaaatgatgtgattgcacacccggtaaaatcattatcttatatatttagtcctactcttcttttaggtgcacttgttactgtattaggttatacaggtgcatttactttgtatacatatatctcccctttcctttatcaggtaaccaaagtttctattcagacagcaagttatatgatgttgatttacggaggatttgctgctgctggaaatattataggtggaaaaatgacagatgctatcggagcggatcgctctgtcatgatcatattattgtcactgagcgctgatttactacttatgtactttttcgggcaatcattgataataatgggtattctaattgcaattattggtgcaatttcttatgcggcagttcctgccatgcaagctagagtaataagcattgctaagtataatgttcctgaagcaattccggtggcttcggggcttaacattgcaggttttaacgcaggaatagctttaggctccgttgtggggggaataattatttcttatttatccattgcttaccttgcattaggcggtgttgtaatatcattagctgggatatgtgtcatgatatttctccctagaccaaccaagattttgatcagtcaggatgagtaa

SEQ ID NO: 5273 - DNA, 144 bp, Xenorhabdus bovienii
  Coding sequence Name=Xb4151_4152.C444.gene448.dna; Position on contig= 488077..488220bp; Strand=-
atgacaggaaaagcaacgataacgctggtgacccctttccctttaccatactttttcaccgcttttgtttggttacaaaagcggcattttacttccactgttgccactcaagttctccccataaaaatggtgattataacttaa

SEQ ID NO: 5274 - DNA, 504 bp, Xenorhabdus bovienii
  Coding sequence Name=Xb4151_4152.C444.gene449.dna; Position on contig= 488293..488796bp; Strand=+
atgaataattcaggtattcgtgataccgcacgggcattacatatcagtattaatgctgttgttcgcaccctaaaaaactccgccaagatgggtaacctggataatttggaaattcagttaatctgtgaagttgacgagatgtggtcttttgtcggcaataaaaaacaacaacgttggttatattatgcttgggaaccccgtctgaaacgtatcattgctcataccttcggaaggcggaataagaaaacgctgaagaagctattgaaaaaactcgctcgattcaacgtagctttctggtgtacagataatttaaatgcttacaatatgttacaaacgaataaacacctcatcgggaaaagtttcacgcagcggatcgagcgtgaaaatctcaccattcgtaatcgaattaagcgattaaaccgcaaaacattgggttattcaaagtcgccggaaatgcatgataaagtcatagggacttttatcgaaagagaatattatatttag

SEQ ID NO: 5275 - DNA, 519 bp, Xenorhabdus bovienii
  Coding sequence Name=Xb4151_4152.C444.gene450.dna; Position on contig= 488815..489333bp; Strand=+
atgcataacccgagcatccagtggtccggtgatattacgtccatccgcataaaagagggctggcgctatcttgccgtggtgattgatttattttcccgtcgcgtggtaggaatggcaatatcttcctccccgaatgctgagttggtatgtcgggcactgaacaatgcgttagaaacgcgttatattgaaggccgactgatttttcactcagatcaaggaagtcaatacagcagcaaaaagtttcgccggttactctggcgaaatcaggttatccaaagcatgagtcgaagaggcaactgcgatgataatttcccaatggaacgggtattccggagcttgaaaagtgaatggatcccaccagaaggttatctggatattcatgatgcgatacgggatattacccaatatctgggtggctattacaatcaccaacgtccccatcgctttaatggcgggatgtcatcggttgaatacgaaagaggttgggaagaggctaaaaatatgtccgatatcttttga

SEQ ID NO: 5276 - DNA, 240 bp, Xenorhabdus bovienii
  Coding sequence Name=Xb4151_4152.C444.gene451.dna; Position on contig= 489344..489583bp; Strand=-
atgattagcctgttgaaaatccgggatgctgtcgccctcaacgggcgcaccgatgcaaggtcactgagccatcagttttcaacaccgctaccgatggtagaagccatgctcaaacagctcgtcacaatgggtaaactggaggaagtcgatacttcctcctgcctgagcggtggctgcaagcaatgtccagaaacgcagaaatgcactattaaggtgtatcaactgatggtaaaaaactga

SEQ ID NO: 5277 - DNA, 2313 bp, Xenorhabdus bovienii
  Coding sequence Name=Xb4151_4152.C444.gene452.dna; Position on contig= 489593..491905bp; Strand=-
atgaaacaattaacaataggtctgatcggtaatccgaatgccggcaaaaccacgctgttcaaccaactcaccggctcccggcaacgggtaggtaactgggcaggtgttacggtagaacgcaagaccggccgttttaccaccgatgagcagcaaatcgagcttgtcgaccttcccggaacgtattccctcacgaccatttcggagcagacctccattgatgaacagattgcctgccactacattctcagtggtgaagccgatatgttgatcaatgtcgttgatgcttccaatctggaacgcaatctctatctctcgctgcaactaattgaactgggcatcccctgtattgtcgctctgaatatgctggatatcgccaaaaaccaacatatcaacattgatattgcggcgctggagcaacgcctcggctgcccggttattccgctggtttctacccgtgccacggggatcgatacactgaagaaagccatcgaccattatcaaccgtcttcccaacctgtacggattgaatatcccgattccctgttgcaggaagtcaatcatcttgccagccagataactcagaatttcaacccgcaacagcgccgctggctgactttgcaggtgctggaaggggacatttacagccgtgagcgagcaggactaacgcagtcgcagctcgctgagagcaaaatgcgcctgcaacagcagcagcttgacgagccggaactggttatcgccgattcacgctatcaagcgattaatgcgctgtgcctggctgtcattgatacccatgccgcgacaccgcacaagctgactcaagtgatggataaagtgatcttgaaccgctggctgggtgtgccgattttcctgttcgtcatgtatctgatgtttgtgctggccatcaatcttggtggcgcgctgcaaccgatattcgatggtgcttccaccgccattttcattgatggtatgcgctggctcggccacacacttcacttcccggattggttgacggttttccttgcccaaggcgttggtggggggatcaacacggtgctgccactggttcctcaaatcggcctgatgtacctgttcctttcctttcttgaagactcaggctatatggctcgtgccgcatttgtgatggataggttaatgcaatcactgggtttaccgggtaaatctttcgtacccttgattgtcggctttggctgtaacgttccttccgtgatgggctccagaacattagacgcaccgcgtgaacggctgatcaccatcatgatggcgccttttatgtcctgcggagcacgactggccatctttgccgtctttgctgccgccttctttggtaaaagcggtgccagcatcgtcttctcgctgtatatactcggtatcacagtcgctgtcctgaccggcctgctcctcaaacacaccctgatgcgcggtgaagcatcgccattcgtcatggaactgccggtctatcacgtcccccatgccaaaaccctgctgctccagtcatggcagcgtctgaaaggttttgtgatccgtgcaggtaaagtgatcgttgcagccagcatactcattggtgccctgaatagtttctccttctccggcaaagcggtggataacatcaacgaatctgcgctggcttctgtcagtaaggtgatcacaccactcctgtatcctatcggcgtacattccgataactggcaggcgacggttggcctgatcaccggtgcgatggcaaaagaggttgtcgtcggtacgctgaataccctgtataccgctgagaacctcaaccaagcgccattcaatccggatgaattccatctgctgaatgaactgaaaggtgccgttgcggagacatgggacagcctgaaagagacatttaccctgagtgccctttccaacccgattgaggccagtaaaggcgatggcaatatggatagcggcgcgatgggaacgatgagtgccaaatttggttccgccatttccgcttacagttatctgattttcgtactgctgtacgtaccctgtgtttcggtaatgggggcgattgcccgtgaaaccagccgtggctggatgctcttctccatcctgtggggattagatgtcgcttattcgctggcggcagtgttctatcaagtcacgacattttcggcgcatccacaaagcagcctgattaccattctggccgtgattgtatttaacgtactggtctttatcggcttacgccgtgctcgcagcagagtcaccatgacgttcaataacaccgcaggccggagctgcgaatgctctaacggtagctgtcactag

SEQ ID NO: 5278 - DNA, 231 bp, Xenorhabdus bovienii
  Coding sequence Name=Xb4151_4152.C444.gene453.dna; Position on contig= 491970..492200bp; Strand=-
atgtcacttcttccaaatcgaagttataaaattctggggttttctgcacagattagccccgcctatcggcagaaattattgtcactcgggatgttgcctggttccacatttcaggtcattcgcgtggctcctttaggcgatcctgtacaaatcgaaacacgcagagtcaatctgatcctgcgtaaaaaagacttagcgtttatcacactagataacaccccacttgaatga

SEQ ID NO: 5279 - DNA, 528 bp, Xenorhabdus bovienii
  Coding sequence Name=Xb4151_4152.C444.gene454.dna; Position on contig= 492570..493097bp; Strand=-
atgaataaatatgctaaaagcagttttgatctactcagcaatatacgatttttcagccttgccactcaccatcctgattcaggctcaccttggtcagcgtcactgctgtatgttccaagatacgatccattacgcctgatctggtattcaaaattgattacccgtcattcgcacgaaatttctatcaacccattagtcagtggctcgctttaccacaaccgggtcaatcctgacacatcactggatcttgcaggggcacagtttatcggccaggctcacgaaatcccggacaatgagttgcaggaaacttacgattactactttaacttcctttttcctgatgaaaatatcagaaagaaaaaagcccggcctctcagtgaatttcacggccatggccgccggcggttttatgaattagacgttcaagagtggtgggtatacgattccgaactttggcacaatcaacaagatgatggccgcgtttttgttccactgagtgaattgactcatccgcctgaaaatcaataa

SEQ ID NO: 5280 - DNA, 111 bp, Xenorhabdus bovienii
  Coding sequence Name=Xb4151_4152.C444.gene455.dna; Position on contig= 493295..493405bp; Strand=+
atgaagattatgacatttttactgatggggtgtgtgggaaggccgtttattttcctcttgccgatactggcctttttaaatcagattgttagcgatgacatcggcgtttag

SEQ ID NO: 5281 - DNA, 204 bp, Xenorhabdus bovienii
  Coding sequence Name=Xb4151_4152.C444.gene456.dna; Position on contig= 493698..493901bp; Strand=+
atggggttgggacaatacttcctggatcatcagtgtgttgatatcaatcatgcagttttgaatcaggtgcagcgccagcatgctgacttaatgagcttcgcgaggattactcgtcatctcaccacggcgtgcaaagaatacaaaattagttacaccattccattgtttggctacattcagttcttcgttaactttcctacgtaa

SEQ ID NO: 5282 - DNA, 159 bp, Xenorhabdus bovienii
  Coding sequence Name=Xb4151_4152.C444.gene457.dna; Position on contig= 494082..494240bp; Strand=+
atggttaatagttcagtgaaatctgagggaaaactagctgtaatgatgatattctgttttcaattattgtcagtaactcaaactgatatgattaaaatgcgtgtttcggatggtagagagttggtattaaaatttgaagaaaacaaagttaatcattga

SEQ ID NO: 5283 - DNA, 771 bp, Xenorhabdus bovienii
  Coding sequence Name=Xb4151_4152.C444.gene458.dna; Position on contig= 494253..495023bp; Strand=+
atggaattcgatagtaacagccatgaaaatgccatacaggaagcgcaaaggattttaaaagaagctcaaactgatcttgctttaagattggaaaaggcggttgaaggtgtaagggaagttgcacaggaaacaatgcataccataggacaaggagggcagagagctttatggagaacttcatatttttttgacagttatgaagatgtatatcaaagaataaatagagaagatgcaagggtatttctcgcggcttggtcggtagctagaggaggtttatttgaaaataatgttataaaaaaaattgttgatatttacatagataaattattagagcctcatgagcgtgatcaggcttttttaaatgaactttatgaaaaattagttcgttcgtctacaatcatgatgcatttagtcgctaaatttaagacatcaggtttggcaaagaatgctgttgtttctgccataacagaagctatctatgtagcagtaattaaaaaagcatttattagggaaggctttaagaagtttggaatgtctatcactttagcatttcaattttatggttattttgataaggctgctgtatctgcgagtaagttaaaaagagaatgtcctgttttatactggtctttttatgctaatgagatagagatgttgtattttatttttgaacctttatttaaacatggcatttctacaataaaaaaaggaaaagggagtaatgtagatgatgtttatttagctataatggaaatcgttggttataactga

SEQ ID NO: 5284 - DNA, 213 bp, Xenorhabdus bovienii
  Coding sequence Name=Xb4151_4152.C444.gene459.dna; Position on contig= 495055..495267bp; Strand=+
atgtttagtaaaggatggttaagaagagaaataatgtcatggcttaagggaatttattcttatataatatggtcttttattccaactctatgtgtttttagttggtctctttttgcgtttgttattttcccaaatcattgggggttgttaactgtggtaggtattattattgttttattatttactgcttattttgcatttaaatctaactaa

SEQ ID NO: 5285 - DNA, 480 bp, Xenorhabdus bovienii
  Coding sequence Name=Xb4151_4152.C444.gene460.dna; Position on contig= 495296..495775bp; Strand=-
atgtcatacatgatctatttaactttaaacggcaagaagcaaggtttaatctccgcagggtgttcaacgcttgattctataggaaatcggtatcaaaaagggcacgaagaccaaatacaagtattaagcttagatcattcgatgactagagatcaaaacgtaagtcatcacccaatacaattcataaaaccaatagataaatcttcaccattattatccatagctatagattctaatgaatcactgaatggtggatttattttttatagaacaagctcatcagggcaattggaacttttctatgaattaaaaataacagaagcgacaattgttgatatatcctgtgtttatccaaattcaattaacagtaatgataaaatgccatatgaaaaagtacagctaaaatataaatctatcgcatggagtcatataacagctggaacatcagcttatagcatatgggatgaacgaatttattaa

SEQ ID NO: 5286 - DNA, 321 bp, Xenorhabdus bovienii
  Coding sequence Name=Xb4151_4152.C444.gene461.dna; Position on contig= 495888..496208bp; Strand=-
atgcaacagcagccctgcgttttttccgtaaagcgataccttctcaatgcagaagaatcgcctcagcaggtgattgaaatccggcaaaataaatacctgaataacctcgttgagcaagaccatcgccatgtcaaacgtcgggtccattcgatgctaggatttaaatcgttccgccgggcacaaacgttgctgataggaatagagttagtcatcatgccgcgtaaaggacaatgtcttcaaaatgaaggcgagaatttatcgccagcagagctgttttatcgactgaactgtgtgaaaaataatcacaccggatgcgactga

SEQ ID NO: 5287 - DNA, 342 bp, Xenorhabdus bovienii
  Coding sequence Name=Xb4151_4152.C444.gene462.dna; Position on contig= 496178..496519bp; Strand=-
atgtcccttatccgaaaagcgttcaaacgtctgcattatcctgtcgatatcattgcccaatgtgttcgttggtacctcgcttatgccttgagtctgcgcaatctcgaagaaatgatggcagagcgcggcattgaggtcgaccatgccacgatacatcgctgggtgttacgtctggtgcccctgctcggcaaggctttccgaccacgcaaaaaacccattggttcccggtggcggatggatgaaacctatatcaaagtgaaaggtcagtggaaatacctttatcgggcggttgatactgacagcccgccgcgatgcaacagcagccctgcgttttttccgtaa

SEQ ID NO: 5288 - DNA, 180 bp, Xenorhabdus bovienii
  Coding sequence Name=Xb4151_4152.C444.gene463.dna; Position on contig= 496484..496663bp; Strand=+
atgcagacgtttgaacgcttttcggataagggacatcgttctggactcgctcaaaaacaggggtgcttacctgatgaccgcttaatgcgacagaaccaaatatattgtggtcgcacaccaatagagacattattggaaggaaaatcaatttgggctgaaaagaatctaacccgaatttaa

SEQ ID NO: 5289 - DNA, 783 bp, Xenorhabdus bovienii
  Coding sequence Name=Xb4151_4152.C444.gene464.dna; Position on contig= 496715..497497bp; Strand=-
atgaaatttctctgtaataaacgcgtattatcccccctgcttgctgtgtttttcatacaaggatgtgcgcaaagcggatcattctctccaccgattaatggagagaatgttcattttatggccactattccggatgagttggatgccttacccatttcagccatgtatcgttctaaaatttgccgcaaagaacgccgaactgcgaatatgaaatcgtattctgttccgggttttcatcatgctacctacccgctatcaatcggtcagtcaaatcaagttgaggtcagtgtccctaaggagggaggggggaagtgtgattggaaactgagtaatcttactttcgaagtgaaactgaaagatacgtcaacaattgcgcctcttattgacgataattttggatttaaaacgacatttgttattgatggtaatgcaccacaagaatttgatgggggatatataaaaaaaacaggtaatttaaatgaagaaattactctatttcctttactaagagagaggttcttaggggggcatagtcaatcattttatttggtaggagagcatgatgttatgacatataaaatggataatggcagaaaaattcatcttaatgtcttatatgaaaaaaaatttttaactcattggaatggaggaaaaaataaggatgcagatacatcaatgacttatcctgacggcacaataatatacaatggtgatgtaataccagactttgataaattaatgcgtattcttgaatcaagaaacagcaaacaaactaagatgtag

SEQ ID NO: 5290 - DNA, 765 bp, Xenorhabdus bovienii
  Coding sequence Name=Xb4151_4152.C444.gene465.dna; Position on contig= 497594..498358bp; Strand=-
atgaaatttctatgcaataaaagcgcattctcctccttgcttgctgtgtttttcatacaaggatgcgcgcaaagcgactcattctctccaccgatgaatggagagaatattcattttacggccactatgcctgatgagttggatgccttacccatttcagccatgtatcgttctgaaatttgccgcaaagaacgccgaactgcgaatatgaaatcgtattctgttccgggttttcatcgtgcgacctacccgctatcaatcggtcagccaaatcaagttgaggtcagtgtccctaaggagggcggggggaagtgtgattggaaactgagtaatcttactttcgaagtgaaactgaaagatacgtcaacaattgcgcctcttattaaaaataattttggatttaaaacgacatttgttattgatggtaatgcaccacaagaatttgatggcggttatttaaaaataaatggaaatttgcatgaaaaaataattttatttccccttctaacaaaattatttttaagtgtaaatgagacttcattttatcttatagggaaaggagatccgttaacgtataaagtaggagcgactaaaaacattaacctaagttacatatatataaaaaaaatgctttcagtttggactgatagaaagaacaatgacaggccatttatgacatatcctaatggcgatattgtttatggcgaggttagacctgaatatgaaatattgatgcgtattcttgaatcaagaaacagcaaataa

SEQ ID NO: 5291 - DNA, 765 bp, Xenorhabdus bovienii
  Coding sequence Name=Xb4151_4152.C444.gene466.dna; Position on contig= 498456..499220bp; Strand=-
atgaaatttctatgtaataaaaacgtattatcctccctacttgctgtgcttttcatacaaggatgcgcgcaaagcgactcattctctccacccattaatggagagcatgttcattttatcgcaacgattcctgatgagttggatgccttacccatttcagccatgtatcgttctgaaatttgccgcaaagaacgccgaactgcgaatatgaagtcgtattctgttccgggttttcatcatgctacctaccctctatcaatcggtcagtcaaatcaagttgaggtcagtgtccctaaggaggggggagggaagtgtgattggaaactgagtaatattacttttgaagtcaagctgaaagatacgtcaacaattgcacctcttattgacgataatattggatttaaaacaacatttgttactgatggtaatgcaccagcagtatttgatggcggttatttaaaaataaatggggatttacatgaaaaaataattttatttccccttctaacaaaaagctttttaaatggcaatgagaatacattttatcttatagggaaaggaagtccgttaacgtataaaataggaacggctaaaaaaattaatataaattacatatatataaaacaaatgctttcagtttggacgggtagaaagaacaatgacatgccatttatgacctatcctaatggtgatattgtttctggcgaggttagacctgaatataaaaagttaatgggcattcttgaatcaagaaacagcaaatag

SEQ ID NO: 5292 - DNA, 1947 bp, Xenorhabdus bovienii
  Coding sequence Name=Xb4151_4152.C444.gene467.dna; Position on contig= 499204..501150bp; Strand=-
atgagtaatgctaattcggtttattgtcataattgcccgggaatgttaaagaacaaaatagaaattcagcttgttgatgaacacaataaacccatttctaagatggactatattttaaaaaatagtaaagttgagcgtccgggaaagacggatgaaaacggcatgatccgagcagataaattgcctgcttctcctatacgtttatttctccgtgggcaaaaacttgccgatgagatggaaacacgaccattacgaacattgcgtggtgagtctcattcaacagtcaagccagatgccgaatccaaaggttatttttatcgttatgctgtcattggtgagttgtgtgacaaagcccctaatattgcaaagtgggaacaagctaagtttgggctaccttactaccattttccgaaagaaaatgaatttaaaggattagagttttacggtgaggattttaatcaacgtcatgtgattgaggtatgtccgtttagagcatggtctttaatcctaaaacatacaccaaactacgatatagtgaatgcgtataacctaggactcatgtcactattggtgtataagaatgaagtgatggttaacccagattctcctgatattaatatgaggaaatttattaatactcccgatacgaccacttcttttttctaccagcaatgctttgacttatcaaaaacccctgttatcaatgatcattccgtttatcccgcgattgtaaacgatgtaccatttaaagaacgttatcgaccggcaatattcctggatgttgaacaagtggaaacgcctgaaacgtttgagcatgatactcaaatgttttttgttgaaaatgaaacgcaaattattgcggcatggcgagggacggcaagctcgagagatgcgctgacggatgggacttaccgccctattccatgcccagagaatattcttcccggtggaaaagccaaggttcataagggctttttagaagcttatcagtgcatggaaaaatattttataaatgaaattaaacaaatcaaagaatcatcacaacatattaatcttaaaaagttatttatctgcggtcatagtttggggggggcacttgctttattgcacgccacagagctaagaaataataacccgctcctttatacgtatggaatgccgagagtcctcactggaagtggcgttaaagccttaacgtcactgaatcacttccgacatgtcaatgatgccgatagcgtaacgagcgtgccatttgataccaatatggataactggttatttgaagtttatgggccactaggaaccatttttggctttagctggactttggcaacattgccgaccattccaatacaaaaatctctccccgagatgggtgaagtctattatcaccaagggaataccgtgagcttctttcaggcgagacaaatgggtgaagaaagaattccaagtaagaatggtgtcggttttacgggtaaaaaaagatggcgcatgaatggcatctataagttttatttagttccgagcatagctaattcattagataaaggactagagaatgaacaacaggaatatgtggactcattaaagggagataagtctgttctcgatgaaatattcccacaatggaataatcctgatttagatacgattataacgacggcaacagaccactttatgggcagtaaatatcaagccattataaataatcaattgctcagtttcttagagccaacgaaaacgcctaagctaatagcttcaaaagagaaatttgatgaattaatacatcatcaagatgcctctccactgaatgcaaaacgtaacaccacttttatggcactcgaaaataacctgcacgatatttttaaacaagatgttaaccaggatgaattattgaaacacgctcttgagcgatataaggaaggcgccaatgaaatttctatgtaa

SEQ ID NO: 5293 - DNA, 795 bp, Xenorhabdus bovienii
  Coding sequence Name=Xb4151_4152.C444.gene468.dna; Position on contig= 501166..501960bp; Strand=-
atggaaaatgcaattcccgcagaggacacagaatccccggtaagctggcaagaatggctgaataaatctaatgatgcgcccgtattttttatcctcaattcactggcgaaacctgatccggtggcacacttttatctcaatgactgggtagaagaagcttttccgttatatagcggtacgccgatgcgcaaaatgctgaaacaaagcccgtggctggtgcaggcgaaagtaaatcatttatttcagattggtgcagtgctagataaacatgaactcagtgacaacagctggggttgggcttatcgaagccataagtcgtggcaggaacagcttacccactggcaacgacgacaattggtgacgttgaatggcgaacaagtgatatttcgcatgatggatacacgggtatttggcgcgatggtatcggccttcacgcccagtgactggtcactgatgctgactcctgtcacggaactgatgattgacctgtcccagaccacacatttccaccgtccgaaggaatgtggacaaggcaatgacgatattccttttacattgggcgaacacctacaactggtttggctgcattcgccttatggcctgaaagtcttaagcagctctctctataacgatctatgggaaaaccacggtgtaatggcgaagaaattggatcagccagaaggcagtttagaaccacggattgagcagtggttgagacaaaagctggaagccggacaacgtattgaaaatatgtccggtcagaattatctattggctatggaacaagaaaaataa

SEQ ID NO: 5294 - DNA, 1923 bp, Xenorhabdus bovienii
  Coding sequence Name=Xb4151_4152.C444.gene469.dna; Position on contig= 501969..503891bp; Strand=-
atgatgaatatgctgtcttctgccaaaagtggattacgatttacttttcaggtcgcggggcttcctgaagatacgttcagcgtgggggaattttccctgcaggaagggttatctgagctgtttaccctgaacctgacgctggtcaaaacgcacacactgaacccgtttaaaccccagacggaagtggatttgaccgccttgctgatgcaggaagcggtgttacaaatctttaatggggaactcgcacagcgcaaaatcaccggtatcatctcccacgccgactgggcaggcaccgacggcaataaaaccctctataccctgacggtgcgccctgccctctggcgtctgacgctcaatcaggacagggaatacgtgacccagaaacgggaatctgactatgcatttttcaatcgtctggccgcggaagaaggcatcagtttctggtttgaggatgaaacggcatttttcagcgacagtcatctggggatgacggccgggctgccgctgacttacagcccgcaaccggaaactgcccatgggatagatacgatttatcaggtacggctgggcgtcggaatgagtccgcaacgcagcctccacaaagactttaactacgacaatccgcgttatcacctttcccatatggaaagcagtgaaggttttcgcgattttggtacacaaaccccttataccgtctttgagagctacgggcgtttccagaaagatgcggcggccaaaccgttcttaaaataccgtcatgaagcgctggataaccagaaaaagaccggcagcggaaacagtaactgcatcaaactgatgccgggtaaaatcttcgagatcaaaaatcacccgcacgccccattgaatgcccgctggcagattgtcggtatcagccatcatgggcgctgcccacaggcactgggtcatgatggcggtgatggcacgacactctccaatcagttcagctttatcgacggcctcgccgactggcgtccgccgttctattacaagcccttagcagatggcgatgaaaccgccatcgtcgtgggtcccgaaggagaagaaatcttcgtcaataaagacggtgccattaaaatccattttcactggaaccgctatgacaacgcggatgatggcgcatcctgctgggtacgggtggcacaaggctggaacggtcatggctttggctttatggcgataccgcgcatcgggcaggaggtgattatctcctacctcaacggcgatattgatcgaccgatcgtcacggggtctgtctataacggcctgaaccgcccgccactggatttaccggcacaaaaaacccgtacgaccttcaagaccaaaacccataaaggcaaaggttttaacgaactgcggtttgaggatgcgaaaggcagcgaggaagtctatatccacggccagaaagactttaccgcccatatcgaaaacgatgcctactggcatatcaaacatgaccagaaacagcgcatcgataacaaccgctaccacgatatccgcgccgatgaccatcatcaggtcgccggttccagaaaaatcaccaccgaaggggatgtgtcacaccggattgccggcagccagcatatccagacgggagatgccacagtgattgatagcgggcaggaaattcacctgaaaagcggcggcaaaatggtattggaagcggcatcggaaattaccctgaaagtgggcggcagttttctcaaagtgaccccgggcgggattttgtcttcaccgattaatgttggccaaggctcaggcggcagcggacgcggggtaaacctgcaactgccggagggcgtggagccgttgccggaggtggaaatggtatttccggcacatccttattgcccggaactggcacaacaagacgtcagtcccgttattaaaccagccaaggagtaa

SEQ ID NO: 5295 - DNA, 1758 bp, Xenorhabdus bovienii
  Coding sequence Name=Xb4151_4152.C444.gene470.dna; Position on contig= 503928..505685bp; Strand=-
atgaaaaacaacaaggagtctatgtacctgcgggaaagagcctatatgagggaactggctcaacgcgtggcgaaagaatcgcctcacctggccgactttctgcttgcctctcatgatccggatattgaacgtgtcttcgaagcgtttgccctgctgatcgcccacttacgggataaacttgaggatgatttccccgaaattacccacggcattctttcccgtatctggccgctggccctgagtcccattccgcctacgacggtcatgcaatttcatcccaccgacggagaacatcagggcgccgttgatatcccggcaggcacgccggtttctgcccatgtcaacgggcagttactcacgtttaaaacctgccgttccctgcatatcgaaccccttatcgtgctggacagggcggtgaagaaaaccggcacacacagtgagatagtgctgacgctttgccagacaggcattccctcccccgtctggcaaagcgggtcactgtcttttttcctcggtacggacagtgaacaggcggcgctattaagcctgtggctggatcaacatatcagtgacgtcagcctgagagtccggggtgaacagcgagaactgagctgttttccttatggctggcacaatctgttcgatacccccatcctgccgatggaaaaacacacttatgccgggcttcagtctctcattgaatattatgcgctgccccagctttataactttatgacggtggatatcagtgactactgccgtgaggtgccgttgaatgccgacggcacctttgaactcatttttcgttttgaaggcgaattgccactggaagacgttgatgatgcctttatgctgggctgcgtcccggccattcatctggaaaatctgaccagcctccccattccgctgacgccagaaaatcatcgctatcccctgccgctcggggagtccgtgcgattgttccggctgcgcgatattcaggttattcagcagcctgatgagaaacagcaacgcggcacgccataccgctacctgcccattgaccagtttaccccggcaatgggctggctggcagaagacggggaagctgacactttttactacctgctccagacagcgcgtgatttgccgggaaggctgacgcaccagctccatttttttgacctgaccggccgacccgccgtgaacttaccggagatcgccgtcgcctgtcattcctggggttaccatgaacaggccattgcgctggaaaaaggcaccctcaccgtgatgcaggaaggttccccgtcccatctcaatgtgcacaatattacgccggtcgccaccgattacccgtcgatgttacaggataattccggctggccgctgctttcctgcctctccagcccgccgatgttgttatttactaccgaaagcctgaaacatttcctccgcctgtttgacccttacgccgaactcaatcgtccgctgagccgccatatccgccggcatattgacggcatcgtccgggtggaggaacgcctgaccgacaggatgtataagggcagacccgtccggggtcacctgttgtcactcacactgaaccctgacggctacgccaatccgggggagatgtaccgtttctgccggttgattaatcaggctatggcctgttttgtcggccagtccaccttcgtcaagctgaatgtgtataccccgaactgtcacaaagccctgtgggaattctgggaagtctatggattacgcagggatatgtaa

SEQ ID NO: 5296 - DNA, 147 bp, Xenorhabdus bovienii
  Coding sequence Name=Xb4151_4152.C444.gene471.dna; Position on contig= 505869..506015bp; Strand=+
atggttgaaagggtactgaggccggatagcagagttgtctggctggatgcgcctgaacggttctatcgcattaacagagaaagtttgtacggaggtggggatgatgactatttatggagtcaatcgataaaacatctctgccggtga

SEQ ID NO: 5297 - DNA, 273 bp, Xenorhabdus bovienii
  Coding sequence Name=Xb4151_4152.C444.gene472.dna; Position on contig= 505982..506254bp; Strand=+
atggagtcaatcgataaaacatctctgccggtgacaatgtcttatcttcgggttgtgagtattgccctttacgcagcatcgaaacgagttctatccccgctaaaatcgtttgtgcgcggcggtattggccccacttttatcgatagtcacgacggcgggtctgccgtgctggcgtattgctttacggaaaaaacgcagggctgccgttgcatcgcagcgggctgtcagtatcaaccgccccgtaaaggtctttcgtctaactggctcaggtga

SEQ ID NO: 5298 - DNA, 2343 bp, Xenorhabdus bovienii
  Coding sequence Name=Xb4151_4152.C444.gene473.dna; Position on contig= 506281..508623bp; Strand=-
atgaatgaatctttaagtcgaatcattgccggtgagttacaggctcaaccacagcaagtcctcgccgccattactctgttcgatgagggaaataccgttccctttgtcgcccgttaccgtaaagaagccaccggaggtttggatgacactcagcttcgccaactcgaaagccgcctgggttatctgcgcgaactatcagatcgccgtcagactattctgaaatctattgaggaacagggaaagttaaccgttgagctcgcagaggcgattaataccacgcagagtaaaaccgaactggaagatctgtacttaccgtataaacccaagcgccgcacccgtgggcaaattgccattgaagccgggctggagccactggccgacctgctgtggcaagatccgcaacaaacgccagaactggcggcagccgcctatgttgatgccgacaaaggcgttaccgataccaaggctgcactggatggcgcacgttatatcctgatggaacgctttgccgaagatgcggctctgttggtgaaagtgcgcgaatatctgtggaagaatgcgcatctggccgccaaagttgtcgaaggtaaggaagaggaaggcgccaagttcagtgattattttgatcaccatgaaccgattgccaccgttccatcccatcgcgctctggccatgttccgtgggcgcaatgaaggcatcctgcaactggctctgaatgccgatcctcaatttgaggaagctcctaaagagagctattgcgaacagattatcaccgatcacctgaacctgcggctgaataacgcgccggctgacagttggcgtaaagccgtggtgagctggacatggcgcatcaaggtgctgctgcatctggaaactgagctgatggggacgctgcgcgagaaagccgaagatgaagcgatcaacgttttcgcccgtaacctgaacgctctgatgatggccgcccctgcgggtatgcgcgccacgatgggattagatccggggttacggactggggtgaaagttgccgtcgtagactctacaggcaagctgattgccacagataccgtttacccgcataccgggcaagaagtcaaagctgctgctgccgttgccgctctgtgcaccaaatatcaagtcgagttagtcgccattggtaatggtacggcatcccgtgaaacggaacgcttctttgctaacatccagaaacaataccctgacgtcaaggctcaggcagtgatagtcagtgaagcaggtgcatccgtctattccgcctctgaactggcagcattggaattccctgatttggatgtttcactgcgtggtgccgtttccattgcccgtcgcctgcaagatccgctggcagaactggtgaaaatcgatccaaaatctattggtgttggtcagtatcaacacgatgtcagccagactcagcttgccaaaaagctggataccgtggttgaggactgtgtaaatggcgtcggtgttgacctgaataccgcatcagtcgctctgctgacccgcgtcgcagggctatccaagtcggttgcccagaatatcgtgaactggcgtgatgaaaacggccgcttcgacaaccgtaatcaactgttgaaagtgaatcgtctggggccaaaagcgttcctgcaatgtgccggcttcctacgcatcaatcagggtgataacccgctggatgcctcaaccgttcaccctgaaacctatcaggttgtcgagaagatcctggccactaccgaacagtccctgtctgaactgatgggcaatcctggcgccctgcgtggtttgcaggcacaggactttaccacggataaattcggtatcccgaccgttacggatatcctgaaagagctggaaaaacccggccgtgacccgcgtcctgaattcaagacagcgactttcactgatggcgtcgaaaccatgaaggacctgcgcgccggcatgattctggagggaacggtcactaacgttaccaatttcggtgctttcgtggatatcggtgtacatcaggatggcttagtccatatctcctcactgtctgatcgttttgtggaaaatccacataccgtggtcaagactggcgatatcgtgaaagtgaaggtgatggacattgacctgaaccgcaagcgtatcggattgactatgcgtcttgatgagcaacccggcgaagctccggcacgtcgtagcggttctcagagcagtaacccgcgtaatagcaacgagcgcaatggtaatggcagaaaccgccagacttcccgctctccgggatcaacggcattgtccaacagcgccatgagtgatgctctggctgctgcattcggcaaaaagcgttaa

SEQ ID NO: 5299 - DNA, 483 bp, Xenorhabdus bovienii
  Coding sequence Name=Xb4151_4152.C444.gene474.dna; Position on contig= 508864..509346bp; Strand=+
atggcgaagagtaactacattacccgagaaggctggcatgcgcttgatcaggagctgaaatatctctggaaagtcgaacgccccaacgtaactcaggctgtttccgatgctgcggcactgggagaccgttcggaaaatgccgagtacatttatggcaaaaaaagattaagagaaattgaccgtcgtgtgcgatttttatccaagcgacttgatgcactgcaaattgttgatcctgatccgagacaggaaggcaaagtcttttttggtgcatgggtgaaagtcgaaaacgaaaaagccgaagaacatatttttcgtctggtggggccggatgaatttgaacctgccaaaaagtggatttctattgattcacctgtggccagggcgctgcttggcaagcaggtggatgatgaaatcaccgtcatgactcccaatggtatggcgatttactggattctggagattggctaccagccgttggggtaa

SEQ ID NO: 5300 - DNA, 99 bp, Xenorhabdus bovienii
  Coding sequence Name=Xb4151_4152.C444.gene475.dna; Position on contig= 509425..509523bp; Strand=+
atgaagttagtctctactgaagtttggggtttctgtgagagtaatggatatggcgggcatggagcatcttgggagctgaaacatgcaagagagttataa

SEQ ID NO: 5301 - DNA, 720 bp, Xenorhabdus bovienii
  Coding sequence Name=Xb4151_4152.C444.gene476.dna; Position on contig= 509507..510226bp; Strand=+
atgcaagagagttataaaatccttgttgttgatgatgatatgcgcttgcgggcgttgttggagcgttatttatcagagcagggttttcaagttcgtagtgtagcaaatgcagaacagatggatcgcttattaaccagagaatccattcaattgattatactggatttaatgttgccaggcgaagatggcctatctatctgtcgaagattgagaagccagcataacccgatccccattatcatggtgtcagcgaagggggaggaggttgaccggattgttggccttgaaatcggcgctgatgattatctcgtcaagccttttaacccgcgtgaactgctggctcgtatgcgagcggtgatgcgccgtcagagccatgagttaccgggggcaccaacgccggataatgcggtagtgaagtttggcaaattcaaactcgatcttggaacgcgtgaaatgttccatgaagatgagcaattgtccctgaccagcggcgaattttctgtattgaaagttttagtttcccaccctcgcgagccactgtcgcgggataaattgatgagtctggcacggggaagggaatatggtgcaatggaacgctccattgatgtacaggtttcccgtctgcgccgcttgattgaagaagatcctgcccatccccgctatattcagacggtctgggggctgggatacgtttttgtgcctgatggaagcaaggtatga

SEQ ID NO: 5302 - DNA, 1002 bp, Xenorhabdus bovienii
  Coding sequence Name=Xb4151_4152.C444.gene477.dna; Position on contig= 510223..511224bp; Strand=+
atgaaaaggctctggctctctctgcgcgctttgttctcccatgttatttatttaactttggtaattgtgctgggcagcctgatgatcagttatctggctgcccagagactggtcgagatggaaaaactctcattcgccatcgtgttcttttatgtctttgccagtgttttcacggcggcttcggctgtttctatcaccttctggttttacctacgcgcccagagacagccattgagaacgatgcagaaagcagtgagagagatggaaaaagggaaaatagcagcaccactccccgaagcgggagctcctgccatacgttcgctgatcagggcgtttaatcaaatgtcgacagcgcataaagcgctggagacggatcgcgctagcttgatagcgggtgtgagtcatgacttgcgcacaccattgactcgcatacggctggcgctggaactgatagaagggaaagacaattttcttcgggaatctatcaatcgtgatattgaggagtgtaatgcgatgatcgatcaatttatcgattatcagcggtctgggcaaaatatgccaatgttgtgctgcgagttgaatgggttgcttgatgaagcgataactgtagaaaatgacggcgtcgggaatattgaaaatcatctgtcagccaacccggttgtcattatggctaatcccctgtcaatcaaacgcgtcttgagcaatatgttcactaacgcccatcgctatggacagggatggattcgggtcagtagtggcgttacggaaaagtttggctggtttcaggtggaagataatggcacagggatgacagaagaagaaagcgctaccctgttccagcccttcacacaggggcaacgcgttcacaataatgggggggcaggtctggggcttgccatcatccgacgcatcgttgatatccatgatggttacatcgaagtcggaagaagcgaaaaaggcgggttgtccatgcgcgtttatatcccacgggtgacgaaataa

SEQ ID NO: 5303 - DNA, 1032 bp, Xenorhabdus bovienii
  Coding sequence Name=Xb4151_4152.C444.gene478.dna; Position on contig= 511418..512449bp; Strand=+
atgcgtaccaccgtggcaagcatcatggcagcagcacttgccatgacatctctgtcttcgtttgctgcttccagtctgacgggagcgggggcgacattcccggcaccggtatataccaagtgggcagattcctatcaaaaagaaacgggcaataaaatcaattatcagggtattggctcttcgggtggtgtgaaacagattattgcccataccgttgattttggtgcatctgatgccccgctttctcatgaaaaactcgaagctgatggcctgttccagtttccaacggtgatcggtggcattgtgctggccgtgaatatttctggtattaaatccggccagttggtcttggatggcaaaaccctcggtgacatttatctgggcaatatcaagaaatggaatgatccggcgattacaaaactgaatcccggcctcagactccccgatcagaatatcgccgtcattcgtcgtgcggatggctctggtacttccttcgtcttcaccagctacctgtccaaagtgaatagtctctggaaggaaaaagtcggggtgggttcgacggttaaatggccggccggcttggggggcaagggtaacgatggcattgccgcgttcgtccagcgtttgcccggttccatcggttatgtcgaatacgcctatgcgaaacaaaataacctcgcttataccaaattgatttcggcagacggcaaagtcgttgcgcctactgaagcgaatttcagtgctgcggcgaaaggggcggattggagcaaaagtttcgctcaggatctgacagcccagaaaggtgacaatgtgtggccgatcacttcaacgacttttattctgatccacaaacagcagaaaaatgcggcgaatgggattgaagtgctgaaatttttcgattgggcttatgagcagggcggaaaacaggcgaaagatctggattattctgtcctgccgcaagacgtcattggacagatacgtgcagcatggaagcgcgacataaaagacagcagtggtaatccgctgtactaa

SEQ ID NO: 5304 - DNA, 957 bp, Xenorhabdus bovienii
  Coding sequence Name=Xb4151_4152.C444.gene479.dna; Position on contig= 512552..513508bp; Strand=+
atggccgaacgtaaaacggcactgaaagcaccaagcaaaaatggcgatattattttcagcgcactggttagactagctgcgctgatgacgttatttctgctggggggcattatcatttcgctgattattgctgcctggccgagtatcaaaacttttggttttggttttctatggaacaaggattgggatgcgccggcagagcaatttggcgcactggtgccgatttatggcacattggtgacctcactgattgccctgattattgccgttcctgtgagttttggtattgccctgtttttgacggaactggcacctaactggttgaaacgtccgctgggcgtggcggttgaactactggccgcgatccccagtattgtttatggcatgtgggggctgtttgtctttgctcctctgttcgccacttatttccagcaacctgtcggtgatgtgctgtcgagtattcccatcgtgggagaactgttctccggcccggcttttggtatcggcattctgacggcaggcatcattctcgccatcatgattattccttatatcgcttccgttatgcgtgatgtgtttgagcaaacgccggtcatgatgaaggaatccgcctatgggatcggctgtacaacctgggaagtgatttggcgtatcgtcctgccttacaccaagaatggcgtgattggcggcgtcatgttggggcttggccgggcgttgggggaaacgatggcggtgacctttattatcggtaatacctaccaacttgacagtctctctctctacatgccggggaatagcattacgtccgccctggccaacgaattcgccgaagcggaatccggcttgcataccgcagcattgatggaactgggactgatcctgtttgtgatcacctttattgtgctggcgttgtcgaaattgatgatcctgcgtctggcaaagaatgaggggcgctga

SEQ ID NO: 5305 - DNA, 909 bp, Xenorhabdus bovienii
  Coding sequence Name=Xb4151_4152.C444.gene480.dna; Position on contig= 513510..514418bp; Strand=+
atgaccacgggtaataatcctcagccacgtgcggttggcgcgataaatacggcggagatgaacaaccgccgccggatgcaggcatggcgccgacagaaaaaccgtattgccctgttgttgtctatggcaacgatggtatttggcctgttttggttgatctggattttattctccaccgtcaccaaaggcattgatggcatgtcgctggcgctgtttactgaaatgacacccccgcctaataccgaaggtggcgggctggcaaacgccatcgtcggcagtgggctgctgattttctgggcaaccgtgtttggcacgccattgggtatcatggccggcatctatctggaggagtatggccgccgctcatggctggctgaagtgacccgctttatcaacgatattctgttgtcagcaccttcgattgtcgtcggattgtttgtttactcggtgattgtgacaaaaatgcagcatttttccggttgggcaggggttatcgcattggcgttgctccaaattcccatcgtgatccgcacgaccgaaaacatgttgaaacttgtcccggataatctgcgcgaagccgcttatgcgctgggtacaccgaaatggaaaatgatctctgccattacgttaaaggcttcgatatccggcatcatgaccggtgtcttgctggcgatagcccgtattgcaggggaaaccgcgcctttgctgtttacctcgctttccaatcagttttggagcaccgatctcagtcagccgattgcgaacctgcccgttaccatcttcaagtttgccatgagtcctttctctgactggcagcaactggcgtgggcaggagtcttgctgattaccttgtgtgtactgctgatcaacattgtggcgcgtgtgctgtttaagaataaaaagcactga

SEQ ID NO: 5306 - DNA, 777 bp, Xenorhabdus bovienii
  Coding sequence Name=Xb4151_4152.C444.gene481.dna; Position on contig= 514464..515240bp; Strand=+
atgaataaggctaacgacattgcaggaagcaaaattcaggtacgtgatctgaacttctattacggcaaatttcacgcgctgaaaaacatcacactggatatcgagcagaataaggtgacagcctttatcggcccgtcggggtgcggcaagtccacgttactgcgcactttcaacaaaatgtatgaactgtatggcgaacagcgggcagaaggcgaaattatcctggatgacaccaatattctgaccgataaacaggatatcgccctactgcgtgccaaagtcggcatggtgttccaaaaaccaacgccattcccgatgtccatttatgacaatattgctttcggtgtgcgtttgtttgagaaactgccaagggctgaaatggatgaacgcgtccaatgggcgctgacaaaagccgcattgtggaatgagaccaaagacaaactgcaccagagtggttatagcctttccggtggtcagcagcagcgtttatgcattgcccgtggtatcgcgatccgcccggaagttttgttattggatgaaccgtgctcggcacttgacccgatctccaccggacgcattgaagagttaatcagtgaattgaaatcggaatataccgtggtgatcgtcacccataacatgcagcaggccgcgcgctgttctgaccacactgcatttatgtacctcggagagttgatcgagttcagtgacacagacacgctgtttaccacacccagaaagaaacagactgaagattatattacaggccgttacggttga

SEQ ID NO: 5307 - DNA, 717 bp, Xenorhabdus bovienii
  Coding sequence Name=Xb4151_4152.C444.gene482.dna; Position on contig= 515258..515974bp; Strand=+
atggacaatctgaatcatagcaaacacatttccggccagttcaatgcagagctggaacatattcgcacggaattaatgacaatgggtgggctggtggaagaacagctcagtaaggcgattctggcgatgcacaatcaggacggagagctggctcggcaagtcatcgaagatgaccagaaagtgaatatgatggaggtgacgatcgatgaagcctgcgtccgtatcatcgccaagcgccagccgaccgcgagtgacttgcgcctgattatggtgatctctaagaccattgcagagctggaacgcattggtgacgttgcgaataaaatctgtcagacggcgctggaaaaattctcgcatcagcagcagcccttgctggtcagcctggaatcgttgggacgccatgctatccagatgctgcacgatgtactggatgcttttgcccgtatggatctggaagaagccatccgcatctaccatgaagataaaaaagtcgatcaggaatacgaagggatcgtccgccagttgatgacttacatgatggaagatccccgcactattccaagcgtcatgaccgcgcttttttgtgcccgctccattgaacgtatcggggatcgttgtcagaacatttgtgaatttattttctattacgtcaaagggcaggatttccgtcacgttggcggcgatcaactagaaaaactgctcactaaagaccaatga

SEQ ID NO: 5308 - DNA, 849 bp, Xenorhabdus bovienii
  Coding sequence Name=Xb4151_4152.C444.gene483.dna; Position on contig= 516132..516980bp; Strand=+
atgaaatttcgcaatcaatcccgcgtagcgactgttgcgctgctgaccagtctggcattggtttctggtgtggcgaaggcagataaacttgatgatattaaaaaaaccggtacggtacggattgcggtattcgacagtaacccaccgtttggttttattgatccgcaaacgaaaaaactggcgggctatgatgtggacatcgccaacgcggttgccagtgatctcggtgtaaaactggaattacgtccgactaacccagccaaccgtattcctctgctatcttccaagaaaattgacttaattgccgctaatttcacgatcaccgatgaacgtgccaaacaggtcaatttttccatcccttattttgccaccggacagaagttcattgcccgcaaaggtgttctgaaaaccccggatgatatcgctaagctgcgtattggggcagataaaggcactgtacaggagatcacgctgcgtgagcgttatccgacagcaaaagtcatctcttatgacgatactccactggcatttgcggccttaaggaatggtaacgttcaggcgatcacgcaggatgatgcgaaattggttggtttgctggcaaacgtaccggaagcgcaaaaagcagattttgaaatttcacccttcagcattacccgtgaatatcaggcggtagccgctaccaaaggagaagatcggttgattaatgcggttaaccagacgctgctgaaactggaaaaagacggtgatgcagagaagatctacaaccgttggtttggtgctgagacgaaatcggctcagccgcgtggtgattttaaattcgccccattagacagtcaggcaaaaccttaa

SEQ ID NO: 5309 - DNA, 738 bp, Xenorhabdus bovienii
  Coding sequence Name=Xb4151_4152.C444.gene484.dna; Position on contig= 517057..517794bp; Strand=+
atgtttgagcaatttattaccgaacacttactggctcctgaatatctgcgatggctctggcaggggttccttatcaccttatggctttctgtctgcaccatcatttcttctaccttgctgggttttatgattactgcagcgcgggacagccagatcaaaccgttgcgttggctggttacggcttacaccaccgtattccgcaatacgccactgttggtacaactgtttttctggtatttcgcttccggtcaaattttacctcaggccgccatgatttggctgaatacctcccatgaaatccccattgcgggtctgacactggcatggccatcctttgaatttttggcggggtttattggcttgacgctctattccgcgccttttgtggctgaggaactgcgggcaggcattcagggcatcggccgtgggcaaaaatacgccgcgcatgcattggggctgacggactggcaggccatgcgctatgtcgtattgccgcaggcattgaaaatcgccatgccacccctgttggggcaatatatgaatatcgtcaaaaattcctcattgacgatggcgattggtgtggcagagctttcctacgcttcccgtcaggtggagacgcaatcactgcaaacctttgaggcgtttggtgtcgcgacggtactttatatcgccgtcattgccatcatggaaggttggggacagtggcgtcaacagagaatactggtgaggggatactga

SEQ ID NO: 5310 - DNA, 750 bp, Xenorhabdus bovienii
  Coding sequence Name=Xb4151_4152.C444.gene485.dna; Position on contig= 517796..518545bp; Strand=+
atggactttaccgttattacggaaaattggcgctacttgttgctcggcacctttcctgatgggccgttggaaggcgcggcgctaaccttggtgatcagtatcatggcaggggtgatttccattgtcttgggtacggtggcgggggttgcgctggcgatgctgcgtggcttctgggttaacctgctcgcggcaatattgggcttcttccgtgccattcccgtgattatgctgattttctggacttactttctgctgccggtggtactgggaatggaaattcccgaaatcaccactgtggtctgtgcactggcgttgatcacctccgcttatttggcgcatggcgtcaaagcgggcattctggcgattggtgaaggtcaatggcgtgcagggttatcgctgggcttcaaccgttgggaagtgttgtggtatatcgtcttgccgcaggcattgagaatgatggtgccgtcatttattaaccaatggattgccttaattaaggatacttcattggcctatattgtgggtgtggcagaattatcatttttagcaacacaggtaaataaccgtagcatggtatatccgatggaagtctttttatttgttgcgctggtttattttgtcatgtgtttatcactggagctcattgccaactctgtcgcccgccgtttttcgatgcaacggcaaagaacaacactgttcggtttctggcgtaaaaaaacattgataatgattccgaaaattaatatctga

SEQ ID NO: 5311 - DNA, 3786 bp, Xenorhabdus bovienii
  Coding sequence Name=Xb4151_4152.C444.gene486.dna; Position on contig= 518856..522641bp; Strand=+
atgttttcatattttagtaaaatcattcgttttgttattgtgttatatgtattaattctaccgtctacaatgatgaatgcctttgcggatggcaatgttctgattgaaaaaacagataatcatcacgtaagtaacaaaacgtctgatatagacttttcggttaatgattcaagtaaaaaattcttgaattcgacgaccaataaaaaggataccatacaaaaaaacgaggatatctcagaacccgatacacctaatagcattgcaagacatcttcagaccgcaggcaacatgctgtcctcttctccttcgcaattggccgaacaagctaaatcttatgccttgggaaaattaaatagtaccgtcaataatgaggcacaaaaatggttatctcagttcggtacggccagaattaattttgcgctggataaaaagggaaagctagagaacagtgcgtttgatatattattccccctttatgacaataaagcggactggttgttattttctcaagtcggttatcggaataaagacagccggaatacactgaacttcggtttgggaggccgttattttcagaataactggatgtatggcctgaataccttttttgaccatgatttcaccggcaaaaacagacgattgggattgggcggggaaatctggggggattacctgaaactctcggccaacgcgtattatcgcttaagtgactggcagcattcacgggatcacaaagactattacgaacgtcccgccaatggttatgacattaacggggaattcttcctgccggcttatcccaatctgggcgccaagctgacctatgaacaatatttcggtgataacgtgaccctgttcaaccgggatactaaacagaaaaaccctagtctggcaaagttagggctgacgtatacccccattccgctggtgacgataggagtggattataaacaggggggaagcgggcataccgaaacccagtttttagcgaattttaattacagactaggcgtcccgctcagtgtgcagttatcctcggataatgtcgcatctatgcgtacgttggcaggcagccgttatgatttggttgagagaaattacaatattgttctggatcatcagaaaaaacaaaacctgcaattgtccctgccgggagagattgtgggttatagccatgaacagaagacagtcacagctaaattccacgattcatctattaagaaggttgagtggatatctaatggcacgtttaccgacaataaaggccaactgtctgacaacaaagatcatactgcgaccattacttttcccaaatattcacctgatggtaataacaattacccaatccttgcgattggaatgctggagaacaaccagaaattaccccccgttcagatgcatgtgattgtcaggccgtttgtggtgaaaaaagcggaagaaggcacatcatacatcacccccgcagggccattacccgccagtggtaaagataaagatgcctataccattacgccggtgattacttttgataccccggtaggcgccccggtaaaaaatgccacgattgatgatgtcaaatggataactgagccgcctgctgatggtaaatctgggctgaagttgagttgggaaaaacaagagacaactaagacggatgagaatggaaagttacaggccgtgactttaaccagtactaaaccccagcagaatgtaaaagtttatttgcagatgggcgatgctgataaagagaagcaattagtgggaacggtgagttttggggaagataccgcgcgttttcatgtaaacagtattcaggttgaacccaaagaaacgctgactgctgacggaattcaagcctatacatatacggcgctggtattggatggcaacaatcagccagtgaaaaggcagaaaattgataaggttcactgggatcatgataaggaagataaaacgggattgaaatggaagagcaggggagatactaccgacgaagaggggaaattaaccgcggaattaatcagctctgatccggtaaaagatgtcatggtcacgttatccatagaagggaatacggataaatctgcaaaagcggataaatcggtttcttttgacgcagcaaacgtcaatttgggactttcaaaagtcagcccgatattggtgcgtgatacttatactttgaaggtaacggctaaggatgccagtgataatcctgagacaaataaaaaggtgacatggccgcaaagtcaaagtctgccgcaaggggtaatactgactccagcgagtagtattactgatggtaatggggaggcgactgcgacattaaccagtactgaggaacagactgtggatgtcacggtttctgtagagggtgtcggagagaagaaaacgagcgtggagtttaaatggccaacgattacgttccagcctgcttcgccaaaaaatggtgttgttgctgatgggaagaaaggctatcaatttatcgcaaaggtcgtgggcgctgatggacaaacaccttatacggataaggtgtttcaatttaagtggcatcttcagctttcacaggatgctgttcagggaaagacctatttattgcatgaagtcacagataatcagaataaaacatggacagctcaactagccagtacccagactcagccaaaacccgttgaaggtgcaaaagtttgtttggcgattgagggagggccatcgacatcaatggcttgttcagagccagtgagttttgttccacttcccgcgaatgttgaaatcaaatctattgaagttaattttgaccctcaaaaaccattaaaaggtaattggagtgattcatatctctataaggcgttggtttttgataagaatacaaaggaaaaactggctaactataaatttaaacccagtgaaatacattggagccgtgatccagactccggcaaggttgatgatcaatctcttgctttatttgaccaagatcttgaaacagatcccgatggttatttaacggtgaaactgaaaagctatgtggggattaaaggcgttaaggtgaaattgatgatatctactctgtatggtaatgagcctggggcagctgaaacagcagtcgattttgaagttgcaccacagttagctgggctttatctctttaagaaaagtgatccaacaaatgttaataagttctttcctgaacaggaaagaccttacaatgccattggtggtgatatgagaggggagctaagaacgctggataataagcctcttgataacccggaatatacatgggagcccaaaagcacagatacaattctacccggtgaaaataaaggtacatttatgatcaacaattttggaaaagtgacaatcaatgctcaagttaaaacatcctatggaaataatttattttatgaacgatggtatgtatataaaattaatatgcttagactttttaatagggcaggtcagagagattcactttatgatctttttgacgagaaaataaggtgtgaaaatattgcttcctcaaaagcatatacacccaatctaaaaaatatcaaagggtcaggaaagggtgaagcgctttctgaggagtttcctaatgcttattcttggggattatttgatggtttagactttcctaatacgagggaaaaagaatattttgctagattcagagttgataaaggtgaatcaccaagtaatgggtatgagctctataatgctgcctatgataaaatgatggacagtagcattactagtgcctttttaatttgtgtgactggtcattaa

SEQ ID NO: 5312 - DNA, 153 bp, Xenorhabdus bovienii
  Coding sequence Name=Xb4151_4152.C444.gene487.dna; Position on contig= 522744..522896bp; Strand=-
atgaaaaatagttatcacatgataactattttttatcacatatttatagaacaatattacaaaaaacaacaccataaacaatttacattgttaatatttacattcatcaacataataaataaatattatttttctagcaacatatgtgaatga

SEQ ID NO: 5313 - DNA, 1464 bp, Xenorhabdus bovienii
  Coding sequence Name=Xb4151_4152.C444.gene488.dna; Position on contig= 523124..524587bp; Strand=+
atggctagtaatataacaacatctcctgctagtaaatcaaaaataattgtaggtcaattactaacggctaatattacttttgaatctgatatagcaatgtcaactaatatttcttttgaattaactaatccagtcaatcttacaatatctaatactgatttttcagtgttagataactctaagagttttactgttaccactaaatttcatattagcgaaaatataaatgaaggtgatacagttagttttttgattaaacctaatgatcatgcaattgcacttggttttaaaaaacaaacaattagttattttcctcatgatgtagacagacattcattaaatatccattttgatcaaaccgtcgtggatgcattaactacagataagccgaatataccaccgaatggtcaatcatatagtttagctactgcattagtcacagatagaaaaggtaagcctcttgctggagagactattacgatcataggagggtttgcggctaatttagataaggtaagaatatttagttccaataagaatgtgcaatcagaaataaaaaagaattcactttatggtcagtcgtctattgatataaatactgacaaatacggaaaacttgaattttatgtttatccaagtgataaatcacaatttgtatttgacttacaagctagaataacagatgcaacacagtttgtgtattcagaagataggttatatattttgaatgacgatcagggtgacccatttaatgctgatcaacagacattagctcctcctgatattttagaacgtcaaggagataagctaactgaaagtgatggctcatctacatttaccgctttaattgacaattatgaaggtgaaagcgagaatgatagtatactattttttgttgatggaaaatatgctcatcaacaatttttaactagcaagaaaaaatataatcatggttatactttccaattgccttatagcattttaccattaaataagtatgctggtttttcttatattatagttactgtcgatggaaaccttaaattttcggctggaatggacataatgtataatggtggttcaaaaaatcagccattggataatgtaccaagagtttatgacatgtgtactgtatattctagttttgggtattccaatgcatctgatttagtactatataatgatatggttaattgttttacaatatcccgccatttgaagactaagcttaaagcggggttatatgttgcaattactggcaccaatgatcctacagataaaactaaagtaccgtttggaactgaggtgacattgactttatacatcgattcttataagaaaaaaacaaatcagatatttaaaataaaaatgccaactcagcctgatgaaggtagcaaaaacatagcaacatatataatcccaattccttataaatatgtgaatgaagttggtgacattttctaa

SEQ ID NO: 5314 - protein, 174 aa, Xenorhabdus bovienii
  Peptide sequence Name=Xb4151_4152.C1.gene1.pep
  Gene classification: Gene name=HemE; Function=Uroporphyrinogen-III decarboxylase; Function class=H Coenzyme metabolism
  Homolog annotation: Query=1..172bp; Hit=26..197bp; Blast score=295; Percent Identity=82.0; E value=2e-80; Homolog= hemE COG0407
MRQAGRYLPEYKATRQEAGDFISLCKNTELACEVTLQPLRRFPLDAAILFSDILTIPDAMGLGLYFETGEGPRFHSPILNHTDVEKLPVPDPEMELGYVMDAVRAIRKALAGQVPLIGFSGSPWTLATYMVEGGSSKAFTKIKSMMYAQPATLHLLLDKLANSVILYLNAQITS

SEQ ID NO: 5315 - protein, 168 aa, Xenorhabdus bovienii
  Peptide sequence Name=Xb4151_4152.C2.gene1.pep
MKLMIKKQYYDYLVQKSTKSAVNLKIYATTGIAQFIGFETIFSRRVYNQKQVMFITSSPIAVSDDFDPPIIEETYQSSTLTRPDQPDYFHFMIPQNNHLHPGDFIIGFVTDDDKHIYKKNLIFGEVAVAEDGYFRFKVYMTSSAYLLVYISQSISTVSVTKELRSGCQ

SEQ ID NO: 5316 - protein, 48 aa, Xenorhabdus bovienii
  Peptide sequence Name=Xb4151_4152.C3.gene1.pep
MKQRLKSALALLDDDTIEQLVGHFLLVNQSSRFDALLVFLLNAKKRVI

SEQ ID NO: 5317 - protein, 48 aa, Xenorhabdus bovienii
  Peptide sequence Name=Xb4151_4152.C3.gene2.pep
MMECIIDGALLPPVSLLLLQKMAAGAAISDIRLTVAEHEFHAEVEEAE

SEQ ID NO: 5318 - protein, 70 aa, Xenorhabdus bovienii
  Peptide sequence Name=Xb4151_4152.C3.gene3.pep
GYNSSSELGGQILGDSIESVAAVTLAKTIENTVEEGSQGETEHGSYCSSGLRSHSKEQSLMEKLALSALD

SEQ ID NO: 5319 - protein, 47 aa, Xenorhabdus bovienii
  Peptide sequence Name=Xb4151_4152.C6.gene1.pep
LGGSGAPHPPGEMGVMGAPQKFYGGKGGRLKKKPLEEKGGVFSRVGE

SEQ ID NO: 5320 - protein, 60 aa, Xenorhabdus bovienii
  Peptide sequence Name=Xb4151_4152.C11.gene1.pep
LGGKKLGPWEKKKKKAAQKKNKSLEIRPPGPWGPKGPKKKEAHIVKGRSAAAKKKKREKI

SEQ ID NO: 5321 - protein, 93 aa, Xenorhabdus bovienii
  Peptide sequence Name=Xb4151_4152.C20.gene1.pep
LGGVFKKNFLWGARGGGAPKKKARGGGGGGGGKILGEKKIFFFPFLGGEKNLGKKNFGGGGGGDKFKKRGGKKGGKKKAPQNFGFSKGKEGEF

SEQ ID NO: 5322 - protein, 60 aa, Xenorhabdus bovienii
  Peptide sequence Name=Xb4151_4152.C25.gene1.pep
MVGLPGPAQNPGFLVGPWFWEWGALPVLGFFGGGMWGAWVGPLIVGKGLGRPMWASVLGK

SEQ ID NO: 5323 - protein, 173 aa, Xenorhabdus bovienii
  Peptide sequence Name=Xb4151_4152.C26.gene1.pep
LGGGGGGGPPGGGGGGGGFFPRAHFYGGGFFLKKNPGGGGGGGGGVLGGGFFFGKWGGGEILGGGGFLGGGGFLGGGGGIPGGARGGGGWFWGGGGVLKGGGAGAGGGVGPGGVGWVRGGVPFDRGGFSSGVAGTGGVGSGFRAWGVFGGGGGGSRPPPAGGAPPGGFFFFFS

SEQ ID NO: 5324 - protein, 70 aa, Xenorhabdus bovienii
  Peptide sequence Name=Xb4151_4152.C26.gene2.pep
LGGGGGGGAVLIGKLKGGGGGGGGPPFFFFPSGPGGFFFWGGGGGAGPPGGGGGGGVFSPAPIFMGGGFF

SEQ ID NO: 5325 - protein, 63 aa, Xenorhabdus bovienii
  Peptide sequence Name=Xb4151_4152.C38.gene1.pep
VGGGKRGGGQILKFLGGQKILGKRGGGEMGKNFPKTPPQKFPPLKKPGPPWGKKNFPPPRGGF

SEQ ID NO: 5326 - protein, 45 aa, Xenorhabdus bovienii
  Peptide sequence Name=Xb4151_4152.C40.gene1.pep
MGETWGETPRPQGGWGPSGKKGEKKIFFWGGGGKKKKKKIFGGQN

SEQ ID NO: 5327 - protein, 84 aa, Xenorhabdus bovienii
  Peptide sequence Name=Xb4151_4152.C40.gene2.pep
LGDKIKEGGGGGCSQNKKGEKGGAKTLFLEGGVKKERKNPGGNNAGWEEGGGFFWGGAPPTKKGPRPGGIKKNGGRGGGGPKTF

SEQ ID NO: 5328 - protein, 193 aa, Xenorhabdus bovienii
  Peptide sequence Name=Xb4151_4152.C43.gene1.pep
LGGPLGGGEIKKKFFLKKGGGGLGGGVGGGKGGEEGGGGAPNLGGGGERGGIWGGGGGEKPLGGKGAGGGKIGGGGGLKTPRGVSCLGGPPPIFVFWGGGGLGGEIIFKRGGKYKARRGKRGGSRGAGAGVGGGLGTGGGFCWGSGGWGGAVRGGARGGGKPGRGGFFPARGGGGGLKIIEMGGGGGGGAPPL

SEQ ID NO: 5329 - protein, 157 aa, Xenorhabdus bovienii
  Peptide sequence Name=Xb4151_4152.C44.gene1.pep
LGGGTFLGVFFGPGGGFFKKGEGGEKNTEIFGVFGGGKKGGFFGVFWGGGFGIFFFWGGGFFGFWFWPPKGGVPQGAGLGVGGGRGREKILSRGGEGDRWQRVFGLGGGGEKKNGGRGGVFFPGGRFFFFGGGGWGRFYPREKNKGGKFFFFRFLAS

SEQ ID NO: 5330 - protein, 137 aa, Xenorhabdus bovienii
  Peptide sequence Name=Xb4151_4152.C50.gene1.pep
  Gene classification: Gene name=CheA; Function=Chemotaxis protein histidine kinase and related kinases; Function class=N Cell motility and secretion
  Homolog annotation: Query=8..128bp; Hit=527..647bp; Blast score=174; Percent Identity=67.0; E value=2e-44; Homolog= cheA COG0643
YEFELGPPLSVVVSSLQPQEEDIYPLAGDEKLLQVRGEYLPLLELYRIFDISSGETSPTKGIAVIVQSAGRRYALLVDKLVGQHQVVVKNIESNYRKVPGISAATIMGDGSVALIIDIPALQKLNHEQLATRKAELV

SEQ ID NO: 5331 - protein, 60 aa, Xenorhabdus bovienii
  Peptide sequence Name=Xb4151_4152.C50.gene2.pep
  Gene classification: Gene name=CheW; Function=Chemotaxis signal transduction protein; Function class=N Cell motility and secretion
  Homolog annotation: Query=1..57bp; Hit=71..127bp; Blast score=74; Percent Identity=75.0; E value=2e-14; Homolog= cheW COG0835
LRIKFSQENVTYNDNTVVIVLNLLNRVVAIVLDGVSDVLSLKGRSICPAPQFAATLSLNI

SEQ ID NO: 5332 - protein, 94 aa, Xenorhabdus bovienii
  Peptide sequence Name=Xb4151_4152.C52.gene1.pep
VFFLFGEGGVGGGGGGGGAFFFSFPPPPPKRKKGGGGGGGGGGGGKKNPPAGRAPGAAGGPALGRGAGRAGWGLWGGWGGPGGKKKKGEPGEKS

SEQ ID NO: 5333 - protein, 98 aa, Xenorhabdus bovienii
  Peptide sequence Name=Xb4151_4152.C65.gene1.pep
LGLWGWEKKKILGKYLKFKGGKGGGAPKKGGGGGPWGVSLKNPGFSPFPNFLIGEYIKKGGAPKRPKGAGKGKKRKLALGGPGVFGMPVIGFFGKRLA

SEQ ID NO: 5334 - protein, 68 aa, Xenorhabdus bovienii
  Peptide sequence Name=Xb4151_4152.C67.gene1.pep
MSGRNVDGLRGVWAGACLARGLGATAKGEPSGREGGEGGGGRGGVGVRGVGGEWRRERLWGVGRGGES

SEQ ID NO: 5335 - protein, 39 aa, Xenorhabdus bovienii
  Peptide sequence Name=Xb4151_4152.C69.gene1.pep
VGRGDRTGLYGRGRDGEQGGGRGWGGVAWVVEWWVGKAS

SEQ ID NO: 5336 - protein, 157 aa, Xenorhabdus bovienii
  Peptide sequence Name=Xb4151_4152.C69.gene2.pep
LFFFEKKKKKTPRFFFFFFPRAGEEKNPPPPRVGRGGVFFFPPPHQQKKKENGGGGFFFFFSPGGGAPLFFFFSPPPPQLFLLEKKKKILGGPQTLCFFFPPKKPRVPFGERKFWEKLYWVFKRGFSPLFFSPNFGHKKSLQTFIFLGLGALYRLLG

SEQ ID NO: 5337 - protein, 63 aa, Xenorhabdus bovienii
  Peptide sequence Name=Xb4151_4152.C73.gene1.pep
VTGRNSRRGIPSLGGTGKKQRKPVCKTNFKQIKTWGKVITPLGGETLNGLKNKGQTILKAKKK

SEQ ID NO: 5338 - protein, 60 aa, Xenorhabdus bovienii
  Peptide sequence Name=Xb4151_4152.C89.gene1.pep
LKVAEIASLAWNASGAILLLNMPGENQRTGKTAPLRVGEAGFRTGANLRPHSALSGSATI

SEQ ID NO: 5339 - protein, 62 aa, Xenorhabdus bovienii
  Peptide sequence Name=Xb4151_4152.C89.gene2.pep
MAPLAFQANEAISATFNQNTGPGGFGPIRFGGPKPRKKKPGLEGPPWKGGPWGKSWALGLGG

SEQ ID NO: 5340 - protein, 67 aa, Xenorhabdus bovienii
  Peptide sequence Name=Xb4151_4152.C89.gene3.pep
LGFGFGGVKKPGAKKTKPRGGFKNPRGVFFLKPNFWKKGVVKKPQGGVGGVFKNPREKKKKGGGKKV

SEQ ID NO: 5341 - protein, 61 aa, Xenorhabdus bovienii
  Peptide sequence Name=Xb4151_4152.C98.gene1.pep
MFFSSGGGVKYIFPPPQKTGGGPPQKKKKGKKNPLLVWKRGFSPWGGKNKKTPPPLRDPFF

SEQ ID NO: 5342 - protein, 66 aa, Xenorhabdus bovienii
  Peptide sequence Name=Xb4151_4152.C104.gene1.pep
MADQATCLAEPIHMQEKYYVGRPTLTGGEATLGKSFLGKNPGGEKFGTRGLNFAWVTNGPSPLKRV

SEQ ID NO: 5343 - protein, 43 aa, Xenorhabdus bovienii
  Peptide sequence Name=Xb4151_4152.C108.gene1.pep
MGLGGEVGGALGGGAPQNTGGGGRGWENAPGGLEKMLPLGGEK

SEQ ID NO: 5344 - protein, 54 aa, Xenorhabdus bovienii
  Peptide sequence Name=Xb4151_4152.C117.gene1.pep
LGGGAQNWGKKYGGGKKYWVIYPPGGPPPQLWGVWENNKPRGGVGGFKKKKIFF

SEQ ID NO: 5345 - protein, 191 aa, Xenorhabdus bovienii
  Peptide sequence Name=Xb4151_4152.C123.gene1.pep
VSPFSQPTTPPPTQKKKGGGGAPPPAGGGGGTPTTPLPKKNPQKNRPPPPHGGGGKNTGGFFSPKKTPAGGGPPPPPTPLGFKRGLKTKKKKHPPPFFGGGGVHKKKPPGAPPPPKGEKKFFFLPGVFFGVGAPFPPKATKKKGFFPLPGPPPPPPPPKNLPKPQQKNGQKKKTKNGLFPGTPTSAEVYSR

SEQ ID NO: 5346 - protein, 131 aa, Xenorhabdus bovienii
  Peptide sequence Name=Xb4151_4152.C123.gene2.pep
VLVGGIETTGNQPHQQKEKHNTTGAQHKPPPPQHKNRDQTTTTTNHPGNNQTPGKKERKEHHTTRHPVATNTKEKKNNKKTKKKNLLSLSLKTIVGEGRGHPEDPTPKQTNNNNPTPHHPTQQKQRRAPDK

SEQ ID NO: 5347 - protein, 57 aa, Xenorhabdus bovienii
  Peptide sequence Name=Xb4151_4152.C130.gene1.pep
LGPPPSKKIPQGGVGSFIFPPNPFLKQGAFPTGKARVRGLKNEMIDTCPEINSTSLM

SEQ ID NO: 5348 - protein, 47 aa, Xenorhabdus bovienii
  Peptide sequence Name=Xb4151_4152.C142.gene1.pep
VVPGLGGQAELIRRGAPETHTGKAGGRQTPPQRGGGEQAAPLGGKES

SEQ ID NO: 5349 - protein, 151 aa, Xenorhabdus bovienii
  Peptide sequence Name=Xb4151_4152.C142.gene2.pep
LLQRGGGENTKGGKVVRGSAPNPGGEGWGRGAEREQSGGGGRYSPPPQKCVVCGPPQKNLFSKPKIFIGYKRPPAGPPQQPSLQKKNIGGGGGGSGGKKKTPPRGGGGRGGKGGPPPRPPPPGGGGGAGGPFFPFSHNPPLFFRGGGGGRK

SEQ ID NO: 5350 - protein, 181 aa, Xenorhabdus bovienii
  Peptide sequence Name=Xb4151_4152.C158.gene1.pep
GKAPSGRGSGGPPALSGGGLNKFRGRRAPASFFFLLGRPSPPSSSPPRRVSLAAWGVLRLLLFSAPASPAPPALLCALSGGGGLASRPALFPSCPVALGVSFWAGGGGPPLGPGGPLAPLLLSLWLPPSPLSPFPFLPWGGAGGGGPPPPPGEKTRGEKKKKSFFFFWGAPQKKQALFLFA

SEQ ID NO: 5351 - protein, 92 aa, Xenorhabdus bovienii
  Peptide sequence Name=Xb4151_4152.C158.gene2.pep
VKGFGRGDGVQERGLVGRVAGGARGGLGGGGEGGVLGVVGGSRGGGGWGVGVGQFRPVWVWGWAFGFGGVAWVGWALWGGLMLGCLNCGCCG

SEQ ID NO: 5352 - protein, 110 aa, Xenorhabdus bovienii
  Peptide sequence Name=Xb4151_4152.C162.gene1.pep
LVCGGVGGVLWVLVCWGGWFGWGGVGVWLVGGCGGGWGVLGGWLGFWLGCGWGGGGGGGGGGGGGGWVWWWWGGGGGGGGGGGGGGGGVGGGGGGGGGGGGLGGGWGGGG

SEQ ID NO: 5353 - protein, 91 aa, Xenorhabdus bovienii
  Peptide sequence Name=Xb4151_4152.C165.gene1.pep
VVSFPLSFVFFVWGEGAKAGGGGVFKGFSGLRGGAGWGEKGKKTSRGVWLVLVGLCGGGAGAGVVLPPKGVPVLAGGGGGPPPPGFKTVGA

SEQ ID NO: 5354 - protein, 82 aa, Xenorhabdus bovienii
  Peptide sequence Name=Xb4151_4152.C170.gene1.pep
MSYRFATVIYTSFPLWLGSPVVPNVQGFPDAGFSVRMFGKKIGAKTRGEGVKFLGLKGGKKGGFPRFFGGGGKNLAKNPKNF

SEQ ID NO: 5355 - protein, 48 aa, Xenorhabdus bovienii
  Peptide sequence Name=Xb4151_4152.C173.gene1.pep
VVLGGGGGVFFFFGGGGGREHGGGGGEMGGGVSPLFFLGGGTPPGTPV

SEQ ID NO: 5356 - protein, 70 aa, Xenorhabdus bovienii
  Peptide sequence Name=Xb4151_4152.C174.gene1.pep
LGAVGWGAKLVGLCLVSLRGGGFASGKVGLLRFLLVGKAGLGLFLKIRGFYKGGGGGGGKKTGKRFAGLY

SEQ ID NO: 5357 - protein, 52 aa, Xenorhabdus bovienii
  Peptide sequence Name=Xb4151_4152.C174.gene2.pep
LVLDSFWRGGRGPWGAVYLERGLKREEGGFGVVLPGGGVLGGGINVGGGLFG

SEQ ID NO: 5358 - protein, 124 aa, Xenorhabdus bovienii
  Peptide sequence Name=Xb4151_4152.C175.gene1.pep
  Gene classification: Gene name=CorA; Function=Mg2+ and Co2+ transporters; Function class=P Inorganic ion transport and metabolism
  Homolog annotation: Query=1..124bp; Hit=134..257bp; Blast score=204; Percent Identity=89.0; E value=8e-54; Homolog= corA COG0598
LDLFETKIEQLADVIENIYSVLESLSRVIMEGKQGDEFDSALSNLAEQEDIGWKVRLCLMDSQRALNFLVRRARLPANQLEQAREILRDIESLLPHNESLFQKVNFLMQAAMGFINIEQSRIIK

SEQ ID NO: 5359 - protein, 127 aa, Xenorhabdus bovienii
  Peptide sequence Name=Xb4151_4152.C176.gene1.pep
LPPGYVRVSWGGGPRRSGDTWIKQVGRTGGSKRDWQVAGGGFRPGGGPGKGGNGGGWDLRGETGEGRQGKKRGAQKGPGGGNNTERPKERGGGAKQRGGGGGESSGGKWGVSPKGGAKRGKKGGPFK

SEQ ID NO: 5360 - protein, 62 aa, Xenorhabdus bovienii
  Peptide sequence Name=Xb4151_4152.C183.gene1.pep
LGGGGVKMGGGGGQFFLGKNLGFSGVGKREKTRGKKGIFTGGKAQGAEVWGPGAKRFGLFGP

SEQ ID NO: 5361 - protein, 64 aa, Xenorhabdus bovienii
  Peptide sequence Name=Xb4151_4152.C189.gene1.pep
MWGAIWENPLRGKKGGLFGGLIGPPFFPPKKKGGGEFNFTPPPPGGGEKKKNPVVLKKTPSVGK

SEQ ID NO: 5362 - protein, 61 aa, Xenorhabdus bovienii
  Peptide sequence Name=Xb4151_4152.C196.gene1.pep
MPICDVSINRLSTLEGKVRTRAKISPLWAWKLKGAPQMALIAAKKIPKGGEIGPQKPGPLF

SEQ ID NO: 5363 - protein, 48 aa, Xenorhabdus bovienii
  Peptide sequence Name=Xb4151_4152.C200.gene1.pep
MVLEFQGETPLENGLGALPPSWGGGIRGGETLGQSLVSRGGGGGLFGG

SEQ ID NO: 5364 - protein, 55 aa, Xenorhabdus bovienii
  Peptide sequence Name=Xb4151_4152.C207.gene1.pep
LGGGGGGGGGGGGGGGGGGGGGGGGGGGGGGGGGGGRKKKKFFFFFVPPPPFFVL

SEQ ID NO: 5365 - protein, 55 aa, Xenorhabdus bovienii
  Peptide sequence Name=Xb4151_4152.C220.gene1.pep
MGGAGKKGFFLGGGPWGGGGFFPGGGRPRPGFSKGGGGGEPSSLWGGAPPREEEF

SEQ ID NO: 5366 - protein, 158 aa, Xenorhabdus bovienii
  Peptide sequence Name=Xb4151_4152.C220.gene2.pep
VWGGGTTAGCFFFFPPFGGGIFLGGVFLINSPGVVFFFLKKEPAGGAGGGEKNFFFFFFLGARGGGGVFFGGGGGFFCGKPPRAWVFFFLRGGRGGGPLSFFPRGGAPKIFLGGFYRCFPPPPFLKFLWGGPPTPPPHIFGGGFFGEKGGGGGGGPPG

SEQ ID NO: 5367 - protein, 72 aa, Xenorhabdus bovienii
  Peptide sequence Name=Xb4151_4152.C221.gene1.pep
VGERKEESVLLPPTQTPPRGGGGVGVFFPHTPRAPTKKKKHPSFYFWGGGAPTKRRFRGAKKKRPAHTRAGI

SEQ ID NO: 5368 - protein, 183 aa, Xenorhabdus bovienii
  Peptide sequence Name=Xb4151_4152.C226.gene1.pep
LFWFRRRKKGRNKKKKQKVVKCGAPRAGFFFFYFLSPAGGGGFFFFFEGGGGEGGLYIEGGGKKKKKQPPPPPLHKKNNYKEESPPPARGGVFIFSSPPARGAAPRKIYVGRPQKKTQRVFFRGGAAALFFFGGKSPKAPGGGGGKRGPPQKKGGGIFLGRGFFQGANLKNKIMVKEQLTPKG

SEQ ID NO: 5369 - protein, 56 aa, Xenorhabdus bovienii
  Peptide sequence Name=Xb4151_4152.C226.gene2.pep
VSAVGVWRPGLGPTKGRNFVLDINQPPTAARRGGGEEVLSLSPARWGGAGGRKRNE

SEQ ID NO: 5370 - protein, 59 aa, Xenorhabdus bovienii
  Peptide sequence Name=Xb4151_4152.C232.gene1.pep
MKWERRAVWVGWWGEEWGRGGGLEGPRWGAGGRRWMDGGNGVWASWGVREGWERRSGAR

SEQ ID NO: 5371 - protein, 167 aa, Xenorhabdus bovienii
  Peptide sequence Name=Xb4151_4152.C232.gene2.pep
VGFLGKKHPGRGGGKRFFWGGTTNFPFLLPKFLPLFKKTPFFLKKNFVFFLLGGGGGGGKFFFFTKPPPRVFLGVFFFSLPPPRVKKKRGAPPLFFFFFFFGGGGAPPPSNYYIRVMGGGGGGRNKNFIFSWGGVFFFSPPFCGGGGGSPPPPKKKFIFFFFFLGGE

SEQ ID NO: 5372 - protein, 193 aa, Xenorhabdus bovienii
  Peptide sequence Name=Xb4151_4152.C236.gene1.pep
  Gene classification: Gene name=XerC; Function=Integrase; Function class=L DNA replication, recombination and repair
  Homolog annotation: Query=3..157bp; Hit=42..196bp; Blast score=182; Percent Identity=58.0; E value=3e-46; Homolog= fimB COG0582
MGYIHGFRVSELRGLKLSDADLEGKKLRVQRLKNGFSTIHPMVMREVQLIRQWLAQRQKYKNSEQNDWLFLSRTGVPMSRQQFYKIIRQTSLQANLAVCANPHMLRHSCGYALADNGVDTRLIQDYLGHRNIRHTVRYTASNAGRFGAIWQERGKRKLSTISTKLLTRQLSYFLQSVYSHFIRKNQCNRLITM

SEQ ID NO: 5373 - protein, 58 aa, Xenorhabdus bovienii
  Peptide sequence Name=Xb4151_4152.C246.gene1.pep
MEKKKKGREESGGDFLFLWFGGGGERKKKKKKERGDRGEGGGGGGGGGGGGGVGDKKI

SEQ ID NO: 5374 - protein, 140 aa, Xenorhabdus bovienii
  Peptide sequence Name=Xb4151_4152.C246.gene2.pep
VGVGGGGGGKKEKKKRGGGGGGYYFFGFFFGGFLGGGGGGGRRGEKKKKKKKKWGKKKKKKMIFFFFFFFWGRGGGEREGRRIKKNRKWKRKKREEKRVGGIFYFYGLGGGGKEKKKKRKKEEIGGRGGGGGAGGGGGGG

SEQ ID NO: 5375 - protein, 78 aa, Xenorhabdus bovienii
  Peptide sequence Name=Xb4151_4152.C251.gene1.pep
VWGEKKKTPPPPPTKKIGVWVLKGGEGKKKKPTPPAPLPEGGAAPSYFPPIFRGVWGQIFLGKGPDPVPGPSFAIPAS

SEQ ID NO: 5376 - protein, 58 aa, Xenorhabdus bovienii
  Peptide sequence Name=Xb4151_4152.C255.gene1.pep
LGGGGPKKKNGGGGEKFPPFGGGGGKKKFFGGGGGAPGEKKGIRGGFGGGGFLKKKFF

SEQ ID NO: 5377 - protein, 53 aa, Xenorhabdus bovienii
  Peptide sequence Name=Xb4151_4152.C256.gene1.pep
VLNGGAWGELGKGKAVGGERHVAKKLGLENGDQGPSCVTSDCKALPLGGVGAP

SEQ ID NO: 5378 - protein, 151 aa, Xenorhabdus bovienii
  Peptide sequence Name=Xb4151_4152.C256.gene2.pep
LFGGGGGGFFFGFFFFLPPAGAAGAAFFFFLKKKIGFFFFFWEKKKKKTPRGGGFFIFFLKKNPPRRGGPPKNPPRRGVFFLKKNFWGEKKKKNTPLFFPPPKKRRGGRRVFLWEKKKRGKKRGKIFGLWGGGPPGPQRGEKIYGGPGPPL

SEQ ID NO: 5379 - protein, 83 aa, Xenorhabdus bovienii
  Peptide sequence Name=Xb4151_4152.C261.gene1.pep
LGNPKKNRGPLGLTKNRVFPPPFLIRGGAGGNQIIKGGGRAGFFPQKKNITPPPPAGGGGGGGGVNPPASFWGGGGATAIFYF

SEQ ID NO: 5380 - protein, 155 aa, Xenorhabdus bovienii
  Peptide sequence Name=Xb4151_4152.C261.gene2.pep
VSRFCSRWCWRSSFRTEAPCVAGAYCGCFEGGRGHVSRAVREAVFCFLWPFATLSARWLRGAGWGVGRCRRMAMGVGSGGLVGDCRVMVGCFSRSRRWCGGVVLGRTAARGGGVGGVGGVGCVWGGVWARSWFVWGGRGYEFGSSEGVYSSRIVG

SEQ ID NO: 5381 - protein, 183 aa, Xenorhabdus bovienii
  Peptide sequence Name=Xb4151_4152.C267.gene1.pep
LWGGPRAPPPWEKIEKKKEKKGGGRAAPPLSFFFFFFFLGVLLKKQKGGEEGLLFFFFFFWGGGGGGKKRKRVLFFFFFLLFLKTRKKKKNKRQGLLGGREGLVFYKTAKKKGGQKKLFFYFKGGGFFFFKKNRGEKKGRRVLKAKIFFKREERKPPFCVFFLKKKNLKNCFFFFVWYFIPSS

SEQ ID NO: 5382 - protein, 75 aa, Xenorhabdus bovienii
  Peptide sequence Name=Xb4151_4152.C267.gene2.pep
MSVKKRNRIRKAGAEKKGRKREYCFIYFFFLGVWAGGREGRAPGGARVGWGGGGCGLFIIIKGRAKKKIRGTKKI

SEQ ID NO: 5383 - protein, 89 aa, Xenorhabdus bovienii
  Peptide sequence Name=Xb4151_4152.C270.gene1.pep
VGGEISPEEGRREGGGGENNSFFFWGAGGGGRPPKKGGGGGEKRREGVGEKKKKKKFFFGGGGGGSTKISHTKGGGLGGGGSHRINKVL

SEQ ID NO: 5384 - protein, 44 aa, Xenorhabdus bovienii
  Peptide sequence Name=Xb4151_4152.C271.gene1.pep
MGEEKEGTLLKILRGVWRYVSLRQSKEHSGIFSVILIWDEGCAS

SEQ ID NO: 5385 - protein, 80 aa, Xenorhabdus bovienii
  Peptide sequence Name=Xb4151_4152.C271.gene2.pep
LGAGGGGERGEGGGGGWIWRGLKGRERGGEFGAFGPLRGKVGPQGPFWGPRGGKIGPKRFFGAPGGGDNNIWEKKKRALS

SEQ ID NO: 5386 - protein, 59 aa, Xenorhabdus bovienii
  Peptide sequence Name=Xb4151_4152.C271.gene3.pep
VRAGGGGWGEKVEEEAERGRGRGAERVGRGGGGGKGEGWGLGGGGKEAKAGAGVGYGEG

SEQ ID NO: 5387 - protein, 73 aa, Xenorhabdus bovienii
  Peptide sequence Name=Xb4151_4152.C271.gene4.pep
MLPNTKKRVGYKIWAFWGQRKREGFARGLAKKTKRGRVFCRRKGYSLRLFLCFENMAENRKRLWAFGTVYNDL

SEQ ID NO: 5388 - protein, 220 aa, Xenorhabdus bovienii
  Peptide sequence Name=Xb4151_4152.C278.gene1.pep
  Gene classification: Function=GGDEF domain; Function class=T Signal transduction mechanisms
  Homolog annotation: Query=4..196bp; Hit=50..240bp; Blast score=103; Percent Identity=35.0; E value=2e-22; Homolog= aq_035_2 COG2199
ESLAEVYALVCVIYSGMIWNFGFIVMAMNRLHGDMARVAETDELTGLPNRRHFMKRLARAELAFSEDGVAYTVMLIDIDNFKHWNDTYGHALGDQALVHFADVGVDILNRRGVLARFGGDEFSILLPGMQEHEATEIAREIVGAVNHTPLVFNGRKLILTVSIGIASEEPGDERSDLDVFARADLALYKVKQAGRNGYATRTTTVNAPRSSFSGRSLAVG

SEQ ID NO: 5389 - protein, 112 aa, Xenorhabdus bovienii
  Peptide sequence Name=Xb4151_4152.C279.gene1.pep
  Gene classification: Gene name=KdpD; Function=Osmosensitive K+ channel histidine kinase; Function class=T Signal transduction mechanisms
  Homolog annotation: Query=6..106bp; Hit=709..809bp; Blast score=136; Percent Identity=62.0; E value=3e-33; Homolog= mll3127 COG2205
AASFGLVATVVDQSERLNRFIANLLDMTRIEAGAMKPNLSLHFVGDLIGAALNRASRILACHQVNVAVPVNLPMVHLDAVLFEQALFNLFDNAAKYAPENSPITVKDLGQAS

SEQ ID NO: 5390 - protein, 116 aa, Xenorhabdus bovienii
  Peptide sequence Name=Xb4151_4152.C281.gene1.pep
ERPQASVFHHALRNRAHDAARAAAINKAQTVFGNGPAKRNARIAIDGIQARRRAAINTDGSNLRHDFLCSFGLSASSASGFILRRRLAAGGGRGWTFVEIVISQSVCVSDREVDWI

SEQ ID NO: 5391 - protein, 165 aa, Xenorhabdus bovienii
  Peptide sequence Name=Xb4151_4152.C282.gene1.pep
  Gene classification: Gene name=Ggt; Function=Gamma -glutamyltranspeptidase; Function class=E Amino acid transport and metabolism
  Homolog annotation: Query=8..159bp; Hit=343..494bp; Blast score=241; Percent Identity=80.0; E value=3e-64; Homolog= mlr5711 COG0405
GAAASFGLTSKAYAAEIRSRIDPYRAGVSEALKPAEFKESNETTHYSIVDKDGNAVAVTYTLNGSFGTAKVAEGTGILLNNEMDDFTIKPGVANLYGLIQGEANAIEPRKSPLSSMSPTIVSKDGKPFMVIGSPGGSRIITITLEAIMSVIDHGMDIQEDLGQAS

SEQ ID NO: 5392 - protein, 116 aa, Xenorhabdus bovienii
  Peptide sequence Name=Xb4151_4152.C283.gene1.pep
MPDKAVPRRLLEDHVAPYDHPIAFTRGQTVSLTGKAEIWDGYRWLWAVGADGRAGWIPDNSITVKDDTVITLRDYSAMELTCNKGTVLHVIEETHGWAWCSAPNGFFGWVPVNKLA

SEQ ID NO: 5393 - protein, 72 aa, Xenorhabdus bovienii
  Peptide sequence Name=Xb4151_4152.C283.gene2.pep
  Homolog annotation: Query=8..70bp; Hit=58..120bp; Blast score=87; Percent Identity=66.0; E value=4e-17; Homolog= gi|13473206|ref|NP _104773.1| unknown protein [Mesorhizobium loti]gi|14023954|dbj|BAB50559.1| unknown protein [Mesorhizobium lot
ERPQASVFKRNGSLMGPPRPSAINVQGDDKAKKAFVNAAIDAVEKCTPLKFAPSLAEGIGGNVFTMQFHSAD

SEQ ID NO: 5394 - protein, 173 aa, Xenorhabdus bovienii
  Peptide sequence Name=Xb4151_4152.C284.gene1.pep
GSLAEVWLPTIKDMSLGIGDVLDTLDKRVGVIDKIEMAVKGLMSGFGYGGESGTRQLINDLGDLLFGKAFEGDGTQVDQRMIDLARLSNNFRKIGLDLKAFAKDIGSGDILGAAGNISEAISKMSGATTVISAIGIAATGAAMITLGRGIARLAFSPFGRIGLIAADRSLRPL

SEQ ID NO: 5395 - protein, 86 aa, Xenorhabdus bovienii
  Peptide sequence Name=Xb4151_4152.C285.gene1.pep
  Gene classification: Gene name=TktA; Function=Transketolase; Function class=G Carbohydrate transport and metabolism
  Homolog annotation: Query=6..70bp; Hit=604..668bp; Blast score=75; Percent Identity=55.0; E value=1e-14; Homolog= mlr3749 COG0021
GAAASFGLFEQQSDAYKTATIGDAPVKVAIEEEISPASQRFMGENGIFIGMKGFGASGEINDLYKHLGITAEHAAEAAEKKTSARA

SEQ ID NO: 5396 - protein, 220 aa, Xenorhabdus bovienii
  Peptide sequence Name=Xb4151_4152.C286.gene1.pep
  Gene classification: Gene name=CaiB; Function=Predicted acyl-CoA transferases/carnitine dehydratase; Function class=C Energy production and conversion
  Homolog annotation: Query=7..216bp; Hit=106..315bp; Blast score=266; Percent Identity=62.0; E value=1e-71; Homolog= mlr1614 COG1804
RKLGRGLGGLDKYGLDYESLKAINPRLIYCSITGFGHTGPYAERAGYDFMIQGMGGIMDLTGEPDREPQKIGVAFADIFTGLYSVIAIQSALIMRERTGTGQHIDMALFDCMSAVLANQAMNYLASGISPKRMGNAHPNIAPYQTLPVSDGYFIIACGNDGQFGKLTSLLGIGDIATDERFVSNSARVANRAALTAFLEEKTRAWKRDDLLAETEACGRS

SEQ ID NO: 5397 - protein, 136 aa, Xenorhabdus bovienii
  Peptide sequence Name=Xb4151_4152.C289.gene1.pep
  Gene classification: Gene name=BtuC; Function=ABC-type cobalamin/Fe3+- siderophores transport systems, permease components; Function class=P Inorganic ion transport and metabolism
  Homolog annotation: Query=1..132bp; Hit=179..310bp; Blast score=102; Percent Identity=48.0; E value=8e-23; Homolog= BS_yclO COG0609
MSAVIVVAVSLYGLRFIHVFDVLSLGRDPAINLGVDHQRVVRKVLFMVTVLVSVSTALVGPITFFGLLVANLAYMIAGSAKHRIILPVGALLAVFCLVGGQTILERVFSFNSALSVIIEFLGGLVFIILLVRGHAR

SEQ ID NO: 5398 - protein, 141 aa, Xenorhabdus bovienii
  Peptide sequence Name=Xb4151_4152.C289.gene2.pep
  Gene classification: Gene name=FepC; Function=ABC-type cobalamin/Fe3+- siderophores transport systems, ATPase components; Function class=P Inorganic ion transport and metabolism
  Homolog annotation: Query=1..137bp; Hit=1..137bp; Blast score=149; Percent Identity=54.0; E value=1e-36; Homolog= BH1027 COG1120
LIEISQVSKSYNGTLVVDDVTLKLPARGITSIIGPNGAGKSTLLSMVSRLLPMDKGRVTVDGLDVSTTSGDVLAKRLSILRQENAINSRLTVRDLVTFGRYPYSKGRPNNEDRKHVEQAIGYLGLDDLSGRFLDETSAKLP

SEQ ID NO: 5399 - protein, 155 aa, Xenorhabdus bovienii
  Peptide sequence Name=Xb4151_4152.C290.gene1.pep
  Homolog annotation: Query=1..155bp; Hit=186..344bp; Blast score=106; Percent Identity=35.0; E value=1e-22; Homolog= gi|16264213|ref|NP _437005.1| putative catabolite repressor protein [Sinorhizobium meliloti] gi|25501803|pir||A95900 probable
ERPQASVFYFIGGVDSDHNTRARVRGYKDELAALNFPVHSDAIITNGYGPDAAARIIRDIYKKLNGLPEALFVNSTSPFEGVVSFLKTLPVDEVRECSIGCFDWDPFIEVLHFPVVMVRQNVQAMVERAFELLDESVQTNNPPEMIPTETSAKLP

SEQ ID NO: 5400 - protein, 134 aa, Xenorhabdus bovienii
  Peptide sequence Name=Xb4151_4152.C291.gene1.pep
  Gene classification: Gene name=MhpC; Function=Predicted hydrolases or acyltransferases (alpha/beta hydrolase superfamily); Function class=R General function prediction only
  Homolog annotation: Query=2..132bp; Hit=138..268bp; Blast score=143; Percent Identity=47.0; E value=4e-35; Homolog= mlr7206 COG0596
MWDARIVAIRENGLASILDATMPRWFTPAYRRPDNPSYRAYCNMFVRQPLEGYAATCAALRDADLTQVAKKISVPTLCLVGEQDGSTPPDIVRELAHLVPQADFAEIADCGHIPCVEQPDAYVSLLRNFITNRF

SEQ ID NO: 5401 - protein, 49 aa, Xenorhabdus bovienii
  Peptide sequence Name=Xb4151_4152.C291.gene2.pep
  Homolog annotation: Query=1..42bp; Hit=1..45bp; Blast score=70; Percent Identity=80.0; E value=8e-12; Homolog= gi|17988982|ref|NP _541615.1| 4-CARBOXYMUCONOLACTONE DECARBOXYLASE [Brucella melitensis] gi|23500388|ref|NP_699828.1| 4-carboxymuc
MADNAVPSERYKIGMNVRRSVLGDTHVDRASNSATDLDAPFQETSAKLP

SEQ ID NO: 5402 - protein, 103 aa, Xenorhabdus bovienii
  Peptide sequence Name=Xb4151_4152.C293.gene1.pep
  Gene classification: Function=Ferredoxin 3; Function class=C Energy production and conversion
  Homolog annotation: Query=1..95bp; Hit=1..95bp; Blast score=152; Percent Identity=83.0; E value=5e-38; Homolog= mlr3855 COG1146
MTYVVTDNCIRCKYTDCVEVCPVDCFYEGENMLVINPDECIDCGVCEPECPAEAISPDTEPGLDKWLELNTEYAAKWPNITAKKDALPEAKEMDGVDRSLRPL

SEQ ID NO: 5403 - protein, 44 aa, Xenorhabdus bovienii
  Peptide sequence Name=Xb4151_4152.C294.gene1.pep
MLVETKPYSNRKVVIPGRLEIHAADDAARFVLRIGPAKTSAKLP

SEQ ID NO: 5404 - protein, 82 aa, Xenorhabdus bovienii
  Peptide sequence Name=Xb4151_4152.C294.gene2.pep
  Gene classification: Gene name=GcvT; Function=Glycine cleavage system T protein (aminomethyltransferase); Function class=E Amino acid transport and metabolism
  Homolog annotation: Query=1..82bp; Hit=341..421bp; Blast score=120; Percent Identity=69.0; E value=3e-28; Homolog= mll3108_2 COG0404
VLEEGAQIVADPKQPLPMTMLGHVTSSYWSETLGRSIAMALVSGGKARMGETLYMPMPDGSVHEATVSGMVFYDPEGKKLNG

SEQ ID NO: 5405 - protein, 149 aa, Xenorhabdus bovienii
  Peptide sequence Name=Xb4151_4152.C296.gene1.pep
  Gene classification: Function=Uncharacterized ACR; Function class=S Function unknown
  Homolog annotation: Query=11..144bp; Hit=39..172bp; Blast score=155; Percent Identity=56.0; E value=1e-38; Homolog= mlr3524 COG1434
MRMFRRFQPVSIVLFVILLAFLVGFVAFGEKVTSMQPPAIDEPADAIIVLTGGQSRIQAAVNLLKDKRGKRLLISGVHPSTNEKVLQRATHADQSLFDCCVDLDRSALNTIGNAAESERWIRTNNYRRVILVTNNYHIPRSTLESVLSQ

SEQ ID NO: 5406 - protein, 117 aa, Xenorhabdus bovienii
  Peptide sequence Name=Xb4151_4152.C298.gene1.pep
  Gene classification: Function=ABC-type multidrug transport system, permease component; Function class=R General function prediction only
  Homolog annotation: Query=1..113bp; Hit=127..239bp; Blast score=146; Percent Identity=61.0; E value=3e-36; Homolog= yhhJ COG0842
MSQAFTGGGYVQAIVTSEVNEFLNRYRGSAQTPVELNLRARFNQDLNKGWFGAINNVISSVTMLSIILTGAALIREREHGTIEHLLVMPVTPVEIMVSKIWSMGLVVLIASDLGQAS

SEQ ID NO: 5407 - protein, 63 aa, Xenorhabdus bovienii
  Peptide sequence Name=Xb4151_4152.C299.gene1.pep
  Gene classification: Function=Large extracellular alpha-helical protein; Function class=R General function prediction only
  Homolog annotation: Query=8..57bp; Hit=890..939bp; Blast score=82; Percent Identity=72.0; E value=1e-16; Homolog= mlr1663 COG2373
ERPQASVWNYEPVTFTKAIANGKIDLKTDSEAEISLPVDWGRYRLEVETADASGPATRPRPSF

SEQ ID NO: 5408 - protein, 209 aa, Xenorhabdus bovienii
  Peptide sequence Name=Xb4151_4152.C303.gene1.pep
  Gene classification: Function=Permease component of an uncharacterized ABC transporter; Function class=R General function prediction only
  Homolog annotation: Query=8..202bp; Hit=23..217bp; Blast score=164; Percent Identity=53.0; E value=5e-41; Homolog= PA2351 COG2011
SSGRKLRSVLSTLIGLPLGVALIVTGPGQFLERPAFNRIAGAIVNLVRSTPCIILMVAIIPLTRLIAGTTVGTYAAIVPLTVAIVPLYARLAETAMREVDQSLIEAAESMGATPIQIIFKVLLPEALPGIIAGQTVTLVSLVGYSAMAGTVGGGGLGDLGIRFGYQRFMPEVMIAVVIILVAIVQSIQITGDYAARLVNYRVARSRRSR

SEQ ID NO: 5409 - protein, 73 aa, Xenorhabdus bovienii
  Peptide sequence Name=Xb4151_4152.C304.gene1.pep
  Gene classification: Gene name=PhnA; Function=Uncharacterized Zn -ribbon-containing protein involved in phosphonate metabolism; Function class=P Inorganic ion transport and metabolism
  Homolog annotation: Query=7..73bp; Hit=6..73bp; Blast score=74; Percent Identity=70.0; E value=2e-14; Homolog= CC3005 COG2824
MTDVIVRDSNGTQLNDGDSVTLIKDLKVKGTSTTLKRGTLVKGIRLTGNPAEVDCSTKQVKGLVLRTEFLKKA

SEQ ID NO: 5410 - protein, 62 aa, Xenorhabdus bovienii
  Peptide sequence Name=Xb4151_4152.C304.gene2.pep
  Gene classification: Gene name=PncA; Function=Amidases related to nicotinamidase; Function class=Q Secondary metabolites biosynthesis, transport and catabolism
  Homolog annotation: Query=1..55bp; Hit=1..55bp; Blast score=85; Percent Identity=67.0; E value=9e-18; Homolog= mlr4882 COG1335
MIGHALVVIDVQNDFCPGGSLAVDRGDEIIPTVNRLIEESENVILTQDWHPANHSRPKLAAA

SEQ ID NO: 5411 - protein, 54 aa, Xenorhabdus bovienii
  Peptide sequence Name=Xb4151_4152.C305.gene1.pep
MAATVVYDEFLIELNWPLGAAIAIIVLVANLVIMIAYNRLLEGQAKKKTSAKLP

SEQ ID NO: 5412 - protein, 111 aa, Xenorhabdus bovienii
  Peptide sequence Name=Xb4151_4152.C307.gene1.pep
  Gene classification: Gene name=GcvT; Function=Glycine cleavage system T protein (aminomethyltransferase); Function class=E Amino acid transport and metabolism
  Homolog annotation: Query=9..111bp; Hit=264..366bp; Blast score=149; Percent Identity=73.0; E value=5e-37; Homolog= mlr0883 COG0404
SSGRKLRSAFNGAKAVLDAIAKGASAKRVGLKPEGRQPVRAGADLFDESGRQIGTVTSGGFGPSAGFPVAMGYVEASLATPGTRVFADVRGNKVPVDVSALPFTPHRYRKG

SEQ ID NO: 5413 - protein, 52 aa, Xenorhabdus bovienii
  Peptide sequence Name=Xb4151_4152.C314.gene1.pep
LGGVGVLGALVVFGGGETLGGKTPPGLGGVGGVLEKNVGFPHFGGEKGGWGV

SEQ ID NO: 5414 - protein, 57 aa, Xenorhabdus bovienii
  Peptide sequence Name=Xb4151_4152.C317.gene1.pep
MFPFSKQIIIPPPLRYLRLSSPLMVSHVSTTRVPAFYRYKRLTLVRIMGEYVSIAVN

SEQ ID NO: 5415 - protein, 113 aa, Xenorhabdus bovienii
  Peptide sequence Name=Xb4151_4152.C317.gene2.pep
MPNPRSRAQIVDPSNMAFIASCSIAHLSHSYGLSTMPLLSQSALGSIQFLVTHSRCSLSYRQVSRMGLSSDSSGSYISQIILYSINTPLAQFVGSYQTVQHKILIVGRRYPDL

SEQ ID NO: 5416 - protein, 59 aa, Xenorhabdus bovienii
  Peptide sequence Name=Xb4151_4152.C318.gene1.pep
MNMIKHPCGKSPITDCVELSLGYMNHGWTAVERGMLGAGHYNALHLGMLQDFLIISPPT

SEQ ID NO: 5417 - protein, 73 aa, Xenorhabdus bovienii
  Peptide sequence Name=Xb4151_4152.C323.gene1.pep
MAAAFAKRDYLVIYQTHNWGKDDVQGFRQVRKNVWLTNYDVAKEISGAVVSVYSTGYIGGGCEAFLWQERSRL

SEQ ID NO: 5418 - protein, 52 aa, Xenorhabdus bovienii
  Peptide sequence Name=Xb4151_4152.C323.gene2.pep
SGRKLSVFNGEVVFATSPGFKRNEAHVKLSSKSGKDPSNRWHPDKEPSPHSN

SEQ ID NO: 5419 - protein, 147 aa, Xenorhabdus bovienii
  Peptide sequence Name=Xb4151_4152.C324.gene1.pep
VDAEIVFELLASPVGQHKEDGAPTGYIDLTDQPSWNLGLRFPGKDKAWFAATRKQIKGETLLIERDNAYVLMNSIRVPELTASVDAAIALAERLFPGTEYEFTNLYNIVRVTIEMNGEYGGFHGEHVNSLPIAICIALLRAKEASKP

SEQ ID NO: 5420 - protein, 70 aa, Xenorhabdus bovienii
  Peptide sequence Name=Xb4151_4152.C324.gene2.pep
LATLNEGTEGTWENYHADAQKACSTILAALQEPTRPMSEIGQPYIRVGYDAWDVWRAMLAASALGEQSDG

SEQ ID NO: 5421 - protein, 64 aa, Xenorhabdus bovienii
  Peptide sequence Name=Xb4151_4152.C324.gene3.pep
MAKAELNEYDRKMLGILNGDLPNETWGAWWTPCLEFLSGLGLCTKGPNFQITAEGRHALGEQSE

SEQ ID NO: 5422 - protein, 74 aa, Xenorhabdus bovienii
  Peptide sequence Name=Xb4151_4152.C324.gene4.pep
MTMFIAGVLFAGLIRISFGRIVLREMGQWKFQFRRFDEEDQRVKDAWEEGFSIGRQALKGGGEGGIQKTSARLP

SEQ ID NO: 5423 - protein, 109 aa, Xenorhabdus bovienii
  Peptide sequence Name=Xb4151_4152.C325.gene1.pep
AEAWPRSLTEGHIASKATNPLHYNYRRLCEALSDAWPTVVKAAPPLPDFGDNLFHEGATVFMGGKSYVLGKYHPEIKAWDLRHGGENEITLRADILRRNITGIKFKEAS

SEQ ID NO: 5424 - protein, 71 aa, Xenorhabdus bovienii
  Peptide sequence Name=Xb4151_4152.C327.gene1.pep
MIAVNIKTEVEAGHFRQDISAEFFATCLVGIVVQFVRHPIPASDIQSNAELIASVLFQGMQNDTKSFRNGN

SEQ ID NO: 5425 - protein, 144 aa, Xenorhabdus bovienii
  Peptide sequence Name=Xb4151_4152.C332.gene1.pep
  Gene classification: Gene name=HyuB; Function=N-methylhydantoinase B; Function class=E Amino acid transport and metabolism
  Homolog annotation: Query=1..139bp; Hit=15..154bp; Blast score=231; Percent Identity=80.0; E value=3e-61; Homolog= mlr1573_2 COG0146
MSIAEQMGVTLQNTAYSVNIKERLDFSCAVFDAAGNLVANAPHMPVHLGSMDASVATAIRENSDIKPGDVFLINAPYNGGTHLPDLTVCTPVFDDNNREIRFWVASRGHHADIGGIAPGSMSPLAVNIEQEGVYIDNFKTSAKL

SEQ ID NO: 5426 - protein, 215 aa, Xenorhabdus bovienii
  Peptide sequence Name=Xb4151_4152.C333.gene1.pep
MVEIESGDVMHMRDESFENLLNEINSKVAQSRMSTTLAWILGGVGFVAGLALGGGTALLFSLLALPGWAIGKWLDSYRRTTVLYYDLEGEAERGYRRLTEGFDSLCGCAAKWHIEAGGAVQGLTAWKRNAGASHLVNRKATALLYKLPSIINSNITPPALHVGRQVMYFMPDVVLVQDRNRFGSVQYADLNLRWQPSRFIETERVPSDTTVVGHT

SEQ ID NO: 5427 - protein, 67 aa, Xenorhabdus bovienii
  Peptide sequence Name=Xb4151_4152.C334.gene1.pep
  Homolog annotation: Query=8..67bp; Hit=294..353bp; Blast score=103; Percent Identity=88.0; E value=1e-21; Homolog= gi|23501193|ref|NP _697320.1| conserved hypothetical protein [Brucella suis 1330] gi|23347072|gb|AAN29235.1|AE014341_3 conserv
GAAASFGLVTVVTKPGEPEGDITLTAPQDGRILTRRSLRYVRRGDDLLKLLGVKPSAVKKRAGALEA

SEQ ID NO: 5428 - protein, 100 aa, Xenorhabdus bovienii
  Peptide sequence Name=Xb4151_4152.C337.gene1.pep
  Gene classification: Gene name=GltA; Function=Citrate synthase; Function class=C Energy production and conversion
  Homolog annotation: Query=1..95bp; Hit=240..333bp; Blast score=122; Percent Identity=68.0; E value=7e-29; Homolog= CC3642 COG0372
MGFGHRVYRVRDPRADALKGALKRIESLGHERGKHRVELAEAVEKAAIAILRRHKPDRALETNVEFYTALLLEQLGFPREAFTCVFAMGRTMGWIDRSLR

SEQ ID NO: 5429 - protein, 78 aa, Xenorhabdus bovienii
  Peptide sequence Name=Xb4151_4152.C338.gene1.pep
  Gene classification: Gene name=OppA; Function=ABC-type dipeptide/oligopeptide/nickel transport systems, periplasmic components; Function class=E Amino acid transport and metabolism
  Homolog annotation: Query=1..76bp; Hit=326..401bp; Blast score=66; Percent Identity=48.0; E value=5e-12; Homolog= mlr7597 COG0747
MLPGYSMVPPHIANYVEDAPRLKYSDDMLEREDKAKELLKEAGVEPNTLSVELRYNTSENNKNTMAAIADQTEACGRS

SEQ ID NO: 5430 - protein, 137 aa, Xenorhabdus bovienii
  Peptide sequence Name=Xb4151_4152.C339.gene1.pep
  Gene classification: Gene name=CaiC; Function=Acyl-CoA synthetases (AMP-forming)/AMP-acid ligases II; Function class=I Lipid metabolism
  Homolog annotation: Query=5..124bp; Hit=415..534bp; Blast score=79; Percent Identity=37.0; E value=8e-16; Homolog= Rv1058 COG0318
GSLAEVFRKDENGVYFFVDRLKDIIRRRGENISSFALEAEVLFHDSVKECAAIAVPSELSEDEVLIAVTPVEGHQINAGELLEFLTGRLPRFMVPRYVRILDSLPKTSSGKIQKHILRSQGITGDTIDRDFNAKRAS

SEQ ID NO: 5431 - protein, 62 aa, Xenorhabdus bovienii
  Peptide sequence Name=Xb4151_4152.C342.gene1.pep
  Gene classification: Function=ABC-type sugar transport systems, ATPase components; Function class=N Cell motility and secretion
  Homolog annotation: Query=1..60bp; Hit=294..353bp; Blast score=78; Percent Identity=55.0; E value=1e-15; Homolog= mll0706 COG3839
MPIRVDKIEDIGRYRIVRAGFEGQKLAVVVGEDEDIPADPRVTFDPKAIGIFADSWRVGMEG

SEQ ID NO: 5432 - protein, 92 aa, Xenorhabdus bovienii
  Peptide sequence Name=Xb4151_4152.C344.gene1.pep
MNFRNANRDKQIFIQQKRLTLDQLEERIRYFVSKKGKGLAVIDHMGLIDRNKSETRLANWEFGEIVTGKLKQIARDVDIPIIGCAQTSAKLP

SEQ ID NO: 5433 - protein, 163 aa, Xenorhabdus bovienii
  Peptide sequence Name=Xb4151_4152.C345.gene1.pep
  Homolog annotation: Query=1..157bp; Hit=77..233bp; Blast score=192; Percent Identity=59.0; E value=2e-48; Homolog= gi|16262976|ref|NP _435769.1| hypothetical protein [Sinorhizobium meliloti] gi|25377473|pir||C95327 hypothetical protein SMa09
MRLRDVQTPVNFIVHSLREVNTRIKEGRYFFTDIRKEGIVLYELDPEPLAQPGILNPEDAHRIAKEYFDDRLPHASKFAKGAAFYCQEGDFKEAAFLLHQAIEQAYSTFLLVTTNYSPSSHNLKFLRRLSEGQRSELAKAWPQDQQRYKAWFNIVNEDLGQAS

SEQ ID NO: 5434 - protein, 75 aa, Xenorhabdus bovienii
  Peptide sequence Name=Xb4151_4152.C346.gene1.pep
VNLRFVSDMPIEQQSFPALHNDKTIALPNNTVNNICQAANIDLRIVTTELGHHYRQPLHLRCPSDELVPQTAPIY

SEQ ID NO: 5435 - protein, 46 aa, Xenorhabdus bovienii
  Peptide sequence Name=Xb4151_4152.C348.gene1.pep
MGGGGFKKNFKTPPEGGKFSSPFFGGLKFREKLPPQVLGKSPLKGG

SEQ ID NO: 5436 - protein, 106 aa, Xenorhabdus bovienii
  Peptide sequence Name=Xb4151_4152.C352.gene1.pep
  Homolog annotation: Query=4..103bp; Hit=301..400bp; Blast score=118; Percent Identity=54.0; E value=2e-26; Homolog= gi|33113968|gb|AAP94590.1| Cinful1 polyprotein [Zea mays]
VNDWEMPKEAAAGSSQGGLVYLKYTFRCREHFDEPNNEWLNCIEATSDELLGAYKRAEDDAMTVAFGERGRRRLNSVFDVIGSVYPDYSYPLRKQGKKRKVPTLDI

SEQ ID NO: 5437 - protein, 71 aa, Xenorhabdus bovienii
  Peptide sequence Name=Xb4151_4152.C353.gene1.pep
LLGPSVDCLALKNGDSYWDACSYTLSMLTALASPCVSLRSGKDMWLFTSALLGIGHLLGADLGPDLTELSD

SEQ ID NO: 5438 - protein, 53 aa, Xenorhabdus bovienii
  Peptide sequence Name=Xb4151_4152.C353.gene2.pep
MVIRVAAQNVQHILRVAPRKLVTDQRRVESNLVSEYYDSVYLMVVGVIRHRPS

SEQ ID NO: 5439 - protein, 220 aa, Xenorhabdus bovienii
  Peptide sequence Name=Xb4151_4152.C354.gene1.pep
MQRLYLICAPMLHSSPVHTPSPLYHPFPHSSQKSPWALWSLLPPLKKHLLSHQPAEEKKARREKNIPVSLLSPTPGAFLSITGSVFQRMYAKLFSNSDSASNGSRIISALSSVILEHVLSVPKIHYVALDQFIRMRRQGHFGTFNYIEMASQLSERCFPALTLCVKDMLFSQLRQHNHVVPCQYWQGSPDQNALLCLHCFTPRQYSAGHLLLCPTGRGTC

SEQ ID NO: 5440 - protein, 56 aa, Xenorhabdus bovienii
  Peptide sequence Name=Xb4151_4152.C354.gene2.pep
MRTRSPDINPLFTEYSPSPTSILHATFRAAGYASNTAVRSLSFVSLLHGLTPVTHV

SEQ ID NO: 5441 - protein, 69 aa, Xenorhabdus bovienii
  Peptide sequence Name=Xb4151_4152.C356.gene1.pep
  Homolog annotation: Query=1..66bp; Hit=149..214bp; Blast score=82; Percent Identity=57.0; E value=1e-15; Homolog= gi|15888385|ref|NP _354066.1| AGR_C_1925p [Agrobacterium tumefaciens] gi|17934950|ref|NP_ 531740.1| conserved hypothetical prote
MGSALYNFHDPLAKHREYNDSAYTLDHFYTKILKIESGFQTETGRQMARERTERMEHFLEAFLNEIQVT

SEQ ID NO: 5442 - protein, 57 aa, Xenorhabdus bovienii
  Peptide sequence Name=Xb4151_4152.C359.gene1.pep
MRWARGAHKYAREAQGLCPRVGPGGGIEFLIFFSCIARNASQGLCANGSGASEGASA

SEQ ID NO: 5443 - protein, 73 aa, Xenorhabdus bovienii
  Peptide sequence Name=Xb4151_4152.C361.gene1.pep
MWPNRLTTVAIVNAASTIHDFNVGCSGLAPSSRGGGRGGEVGWVVVARKGGGARARWVGVWGGEGGEQRPYTV

SEQ ID NO: 5444 - protein, 159 aa, Xenorhabdus bovienii
  Peptide sequence Name=Xb4151_4152.C363.gene1.pep
VIAVSHELGEIFSTKFGFWPDIQPNTAKRTNVSVAPKGHRMIWAGRLDADKTKGLYALLDMLDSLPNWELDIAGEGPEIPNLLKAISGQASRQGRIRLLGWIDDIQTHMPKYDIVAGMGRVIVEASSLAIPSLLVGYDEVKCFMSSSTVDDADRSLRPL

SEQ ID NO: 5445 - protein, 257 aa, Xenorhabdus bovienii
  Peptide sequence Name=Xb4151_4152.C364.gene1.pep
  Homolog annotation: Query=8..236bp; Hit=306..535bp; Blast score=139; Percent Identity=35.0; E value=5e-32; Homolog= gi|17938345|ref|NP _535134.1| conserved hypothetical protein [Agrobacterium tumefaciens str. C58 (U. Washington)] gi|25524181
RAAASFGLVHVHESVEQAIAAFPDREAIIKNLADAAKSLKTVQTSAPDGFLLLHGHRLERKRQEIDAALMEAASLFERAYLEQPVLASGDETRLVIEHGSGAAEIAIMAEPVLPETCSIACEQQTSERKVFTVSLMEDVAPSPLFEPAWRSLGGNGQAFVRLRAQFDDHLAECGFDLEEPFAIVPPASLKFDPPAVIISGGEEHLPVRLVVDGRADRIAFTPQNGWNISLNGQSAVLHGPSVPKPGLTNLQDLGQAS

SEQ ID NO: 5446 - protein, 138 aa, Xenorhabdus bovienii
  Peptide sequence Name=Xb4151_4152.C366.gene1.pep
  Gene classification: Gene name=Gst; Function=Glutathione-S -transferases; Function class=O Posttranslational modification, protein turnover, chaperones
  Homolog annotation: Query=8..131bp; Hit=52..178bp; Blast score=85; Percent Identity=42.0; E value=2e-17; Homolog= PA0467 COG0625
AAASFGLNPSGQIPMLVTDEGEALFDSPVICEYLNDFAKGKLIGRGDERWRNLRDQALGDSMCDAALQLRYEIGLRPSELQWQQWRNAWASKIIDTLTWLETRPEHLSGRHDIGAISIFVPLAFIDNRIPELRPRPSF

SEQ ID NO: 5447 - protein, 49 aa, Xenorhabdus bovienii
  Peptide sequence Name=Xb4151_4152.C371.gene1.pep
VGYVFLLAINDKDKQIETLQQIMATIQDADALDRLKAARTLEDVQTALQ

SEQ ID NO: 5448 - protein, 89 aa, Xenorhabdus bovienii
  Peptide sequence Name=Xb4151_4152.C373.gene1.pep
  Gene classification: Gene name=PhnI; Function=Uncharacterized enzyme of phosphonate metabolism; Function class=P Inorganic ion transport and metabolism
  Homolog annotation: Query=8..83bp; Hit=41..116bp; Blast score=122; Percent Identity=81.0; E value=7e-29; Homolog= mlr3344 COG3626
GAAASFGLALAVDRVMAEGSLYDRELSALAVRQSRGDLIEAIFLVRAYRTTLPRFGYSRPMETAQMLIERRISATYKDLPGGQTSAKLP

SEQ ID NO: 5449 - protein, 59 aa, Xenorhabdus bovienii
  Peptide sequence Name=Xb4151_4152.C374.gene1.pep
  Gene classification: Gene name=GuaA; Function=GMP synthase - PP -ATPase domain; Function class=F Nucleotide transport and metabolism
  Homolog annotation: Query=13..58bp; Hit=231..276bp; Blast score=93; Percent Identity=95.0; E value=3e-20; Homolog= mlr6950_2 COG0519
VKRMRSIWTKSARPGLYDAIWQAFAVLLPVQTVGVMGDGRTYEFVCALRAVTSVDGMTR

SEQ ID NO: 5450 - protein, 104 aa, Xenorhabdus bovienii
  Peptide sequence Name=Xb4151_4152.C379.gene1.pep
  Gene classification: Gene name=AcrA; Function=Membrane-fusion protein; Function class=Q Secondary metabolites biosynthesis, transport and catabolism
  Homolog annotation: Query=7..79bp; Hit=312..384bp; Blast score=87; Percent Identity=54.0; E value=2e-18; Homolog= Z0635 COG0845
GSLAEVLKGKVVSISPDTIQDEVKPEEFYYRVFIKTETDALFNKTGERFPIVPGMVATVDIHTGSKTVMDYPHQAFQQSAGSTPGKIVGLYYPRGENAISQWAR

SEQ ID NO: 5451 - protein, 74 aa, Xenorhabdus bovienii
  Peptide sequence Name=Xb4151_4152.C383.gene1.pep
MRTSDGPSDPTSTYLGDTKHASVITAGHFGLWPKCSQSPWIAQRDVAIVFVIVNISLLKSGMINSVLYEEFWVL

SEQ ID NO: 5452 - protein, 76 aa, Xenorhabdus bovienii
  Peptide sequence Name=Xb4151_4152.C387.gene1.pep
  Gene classification: Gene name=CyoA; Function=Heme/copper-type cytochrome/quinol oxidases, subunit 2; Function class=C Energy production and conversion
  Homolog annotation: Query=1..70bp; Hit=51..120bp; Blast score=105; Percent Identity=71.0; E value=1e-23; Homolog= ZcyoA COG1622
MLIVVIPAIVMAIIFALRYREANKSATYRPNWAHSNKIELVVWTVPILIIIVLATITWKTTQELDPYKPLDYKKNR

SEQ ID NO: 5453 - protein, 402 aa, Xenorhabdus bovienii
  Peptide sequence Name=Xb4151_4152.C387.gene2.pep
  Homolog annotation: Query=1..402bp; Hit=1..402bp; Blast score=792; Percent Identity=100.0; E value=0; Homolog= gi|9507603|ref|NP _052934.1| transposase of Tn10 [Plasmid R100] gi|15219691|ref|NP _174806.1| bacterial IS-element [Arabidopsis tha
MCELDILHDSLYQFCPELHLKRLNSLTLACHALLDCKTLTLTELGRNLPTKARTKHNIKRIDRLLGNRHLHKERLAVYRWHASFICSGNTMPIVLVDWSDIREQKRLMVLRASVALHGRSVTLYEKAFPLSEQCSKKAHDQFLADLASILPSNTTPLIVSDAGFKVPWYKSVEKLGWYWLSRVRGKVQYADLGAENWKPISNLHDMSSSHSKTLGYKRLTKSNPISCQILLYKSRSKGRKNQRSTRTHCHHPSPKIYSASAKEPWVLATNLPVEIRTPKQLVNIYSKRMQIEETFRDLKSPAYGLGLRHSRTSSSERFDIMLLIALMLQLTCWLAGVHAQKQGWDKHFQANTVRNRNVLSTVRLGMEVLRHSGYTITREDLLVAATLLAQNLFTHGYALGKL

SEQ ID NO: 5454 - protein, 51 aa, Xenorhabdus bovienii
  Peptide sequence Name=Xb4151_4152.C389.gene1.pep
KLEVAKVGVSSSFLKGTPLQDSNPVPYGLEGPLLYPNGAKGRIRDENPLMR

SEQ ID NO: 5455 - protein, 291 aa, Xenorhabdus bovienii
  Peptide sequence Name=Xb4151_4152.C389.gene2.pep
  Gene classification: Gene name=FolD; Function=5,10-methylene -tetrahydrofolate dehydrogenase/Methenyl tetrahydrofolate cyclohydrolase; Function class=H Coenzyme metabolism
  Homolog annotation: Query=1..284bp; Hit=1..284bp; Blast score=493; Percent Identity=85.0; E value=1e-140; Homolog= folD COG0190
MSAKIIDGKTIAQTIRSEVAEKVRQRIAAGRRAPGLAVVLVGENPASQIYVASKRRACEEVGFTSRSYDLPDITSEAELLSLIDNLNEDPEIDGILVQLPLPAGIDNVKVLERIHPDKDVDGFHPYNIGRLCQRAPKLRPCTPRGIVTLLERCNINTYGLHAVIIGASNIVGRPMSLELLLAGCTTTVTHRFTKNLRQHVEQADLLVVAVGKPNFIPGEWIKPGAIVIDVGINRLENGKVIGDVDFDSASERASWISPVPGGVGPMTVATLIQNTLQACEEYHDVEKTKGY

SEQ ID NO: 5456 - protein, 70 aa, Xenorhabdus bovienii
  Peptide sequence Name=Xb4151_4152.C389.gene3.pep
  Gene classification: Function=Uncharacterized ACR; Function class=S Function unknown
  Homolog annotation: Query=1..70bp; Hit=8..77bp; Blast score=92; Percent Identity=68.0; E value=1e-19; Homolog= ybcJ COG2501
MEIFCLDGHPYVELCDLLKLQGWCESGAAAKAMIAEGLVKVDDQVETRKRCKIIAGKAVAFNGESVRVEA

SEQ ID NO: 5457 - protein, 266 aa, Xenorhabdus bovienii
  Peptide sequence Name=Xb4151_4152.C389.gene4.pep
  Homolog annotation: Query=1..129bp; Hit=1..128bp; Blast score=68; Percent Identity=31.0; E value=9e-11; Homolog= gi|23104650|ref|ZP _00091112.1| COG0810: Periplasmic protein TonB, links inner and outer membranes [Azotobacter vinelandii]
MIRITRTVAHESAQSEYLLRHYDALHSALVQHLPINFSTLFAKPAKSSDGAIEWYSDLQGQPVPFAQLSAIERDKIQTQIARQLAVLARLREQLSEKEGVDNELLTLLGKISQFPAEEHIWSVDNQPVILWEPMNESASQNIAGNPDFVASQPEQKRKPRWLWWLLLLLFILLLLWLLRGCLPRNHTHIAIKQPNPPVAVKPPQVKPVEQPIKQPIEQPAPTVPEVKPEAVVLSPPADVRKLCPSQRKRNQAPEVVVVNEMVPTTL

SEQ ID NO: 5458 - protein, 152 aa, Xenorhabdus bovienii
  Peptide sequence Name=Xb4151_4152.C389.gene5.pep
  Gene classification: Function=Transposase; Function class=L DNA replication, recombination and repair
  Homolog annotation: Query=3..149bp; Hit=2..148bp; Blast score=136; Percent Identity=46.0; E value=7e-33; Homolog= PA2319 COG3547
MQNVTLIGIDLGKHSFHVHCQDKSGKALLRKKFTRARLMEFLAGSPSATVVMEACAGAHFMARRIAAFGHEAKLISPQFVRPFVKSNKNDFVDAEAICEAASRPSMRFVQPRTEAQQAMRALHRVRESLVRDRVKTTNQMHAFLLEFGISMP

SEQ ID NO: 5459 - protein, 260 aa, Xenorhabdus bovienii
  Peptide sequence Name=Xb4151_4152.C390.gene1.pep
  Gene classification: Gene name=ZnuC; Function=ABC-type Mn/Zn transport systems, ATPase component; Function class=P Inorganic ion transport and metabolism
  Homolog annotation: Query=9..257bp; Hit=1..249bp; Blast score=360; Percent Identity=71.0; E value=1e-99; Homolog= znuC COG1121
MILQDSFSMSIMITLKNITVEFGSRKVLNNITFSLRQGKILTLIGPNGAGKSTLVRVVLGLIQPTSGTIEHSHPLKIGYVPQKISLDPTLPLTVKRFMMLRPNVKSADIMPVLKRVNAEHLLQQPMQKLSGGETQRVLLARALLNHPQLLVLDEPTQGVDVNGQLALYDLINQIRTELNCAVFMVSHDLHLVMAKTDEVLCLNQHICCSGTPEVVSMHPEFIAMFGRHGAEQLAVYRHHHNHQHDLRGKIILKNGGEPRR

SEQ ID NO: 5460 - protein, 261 aa, Xenorhabdus bovienii
  Peptide sequence Name=Xb4151_4152.C390.gene2.pep
  Gene classification: Gene name=ZnuB; Function=ABC-type Mn2+/Zn2+ transport systems, permease components; Function class=P Inorganic ion transport and metabolism
  Homolog annotation: Query=1..258bp; Hit=1..258bp; Blast score=315; Percent Identity=81.0; E value=2e-86; Homolog= ZyebI COG1108
MIELLLPGWLAGILLTIAAGPLGSFVVWRRMSYFGDTLAHASLLGVAFGFLLDVNPFYAVIAVTLILAMILVWLEKRPQLAVDTLLGIMAHSALSLGLVVVSFMTNIRVDMMAYLFGDLLSVTYEDLWLIAAGVAIVAGLLTWQWRALLSMTVSQDLAFVDGIKIQRLRVLLMLVTALTIGLAMKFVGALIITSLLIIPAATARRFSRTPEHMAVFAIAVGMLAVTGGLTLSAFYNTPAGPSVVLCSAALFALSLTCKAKN

SEQ ID NO: 5461 - protein, 290 aa, Xenorhabdus bovienii
  Peptide sequence Name=Xb4151_4152.C390.gene3.pep
  Gene classification: Gene name=RsuA; Function=16S rRNA uridine-516 pseudouridylate synthase and related pseudouridylate synthases; Function class=J Translation, ribosomal structure and biogenesis
  Homolog annotation: Query=1..290bp; Hit=1..290bp; Blast score=417; Percent Identity=78.0; E value=1e-117; Homolog= ZyjbC COG1187
MLINPSIRLNKYISESGICSRRDADRYIEQGNVFINGKRAAVGDQVFAGDIVKVNGQLIEPRDEEDLVLIALNKPVGIITTMEDSERDNISDFVNHSKRVFPIGRLDKDSQGLIFLTNHGDLVNKILRAGNNHEKEYVVTVNKPVTDEFIQGMSAGVPMLGTVTKKCKVQKEASFVFRITLVQGLNRQIRRMCKHFGYEVTRLERTRIMNVNLKGLPQGEWRDLTDDELIELFKLIENSSSEEKSAKKAQTKHVTAKKTGFNEPKNAEKSDGNSASRKRFTQSGRKKKGR

SEQ ID NO: 5462 - protein, 197 aa, Xenorhabdus bovienii
  Peptide sequence Name=Xb4151_4152.C390.gene4.pep
  Gene classification: Function=Uncharacterized BCR; Function class=S Function unknown
  Homolog annotation: Query=14..196bp; Hit=3..187bp; Blast score=196; Percent Identity=52.0; E value=2e-50; Homolog= ZyecM COG3102
MERNFYGLFNGEEMSHFSKISELQDLVADLAGFEQKLKQFEGHLGLHFEQYSADHISLRCNESKIADRWRKGFLQCGQLISESIINGRPICLFDLNQPIVLLDWKIDCVELPYPSQKHYVHQGWEHVELVLSVPPEQLICEAKKLLPQPLPDNFRMKESHPKGKNERLPNPTLAVTDGEITIKYHPFCIREIVKSEV

SEQ ID NO: 5463 - protein, 576 aa, Xenorhabdus bovienii
  Peptide sequence Name=Xb4151_4152.C390.gene5.pep
  Gene classification: Gene name=ArgS; Function=Arginyl-tRNA synthetase; Function class=J Translation, ribosomal structure and biogenesis
  Homolog annotation: Query=1..576bp; Hit=1..577bp; Blast score=942; Percent Identity=79.0; E value=0; Homolog= argS COG0018
VNIQVILSEKISNALIEAGAPTDSEAHVRQSAKAQFGDYQANGVMAAAKKVGMPPRQLAEKVISQLDLQGIASKIEIAGPGFINIFLDKAWIAANIETALKDEKLGITPVEPQTIVIDYSAPNVAKQMHVGHLRSTIIGDAAARTLEFLGHKVIRANHVGDWGTQFGMLIAYLEKIQNEDANDMALADLEAFYREAKKHYDEDEEFAIRARNYVVKLQGGDEYCREMWRKLVDITMSQNQQTYNRLNVTLTEKDVMGESLYNDMLPGIVADLKQRGIAVKSDGATVVYLDEFKNKEGEPMGVIIQKKDGGYLYTTTDIACAKYRHETLNASRVLYYTDSRQHQHLMQAWAIIRKTGYIPASMLLEHHMFGMMLGKDGKPFKTRAGGTVRLSDLLDEAIERADTLIREKNPDMPEDELKKIVEAVGIGAVKYADLSKSRTTDYVFDWDNMLAFEGNTAPYMQYAYTRVSSIFKRADIDENNLTLPVMLNEEREQALATRLLQFEETITTVAREGTPHVMCAYLYDLAGLFSGFYEHCPILNADSEELRQSRLKLALLTAKTLKQGLDTLGIQTVERM

SEQ ID NO: 5464 - protein, 394 aa, Xenorhabdus bovienii
  Peptide sequence Name=Xb4151_4152.C391.gene1.pep
  Gene classification: Gene name=TufB; Function=GTPases - translation elongation factors; Function class=J Translation, ribosomal structure and biogenesis
  Homolog annotation: Query=1..394bp; Hit=1..394bp; Blast score=699; Percent Identity=92.0; E value=0; Homolog= tufB COG0050
MSKEKFERKKPHVNVGTIGHVDHGKTTLTAAITTVLAKTYGGSARAFDQIDNAPEEKARGITISTSHVEYDTPTRHYAHVDCPGHADYVKNMITGAAQMDGAVLVVAATDGPMPQTREHILLGRQVGVPYIIVFLNKCDMVDDEELLELVEMEVRELLSQYDFPGDDTPIIRGSALKALEGEAEWEAKIIELADALDSYIPEPERDIDKPFLLPIEDVFSISGRGTVVTGRVERGIVKVGDEVSIVGITDTVKTTCTGVEMFRKLLDEGRAGENVGVLLRGTKRDEIQRGQVLAKPGSIQPHTQFESEVYILSKDEGGRHTPFFKGYRPQFYFRTTDVTGTIELPEGVEMVMPGDNINMIVTLIAPIAMDEGLRFAIREGGRTVGAGVVAKVIA

SEQ ID NO: 5465 - protein, 334 aa, Xenorhabdus bovienii
  Peptide sequence Name=Xb4151_4152.C391.gene2.pep
  Gene classification: Function=Transposase; Function class=L DNA replication, recombination and repair
  Homolog annotation: Query=3..332bp; Hit=2..335bp; Blast score=241; Percent Identity=43.0; E value=7e-64; Homolog= PA2319 COG3547
MQNVTLIGIDLGKHSFHVHCQDKSGKALLRKKFTRARLMEFLAGSPSATVVMEACAGAHFMARRIAAFGHEAKLISPQFVRPFVKSNKNDFVDAEAICEAASRPSMRFVQPRTEAQQAMRALHRVRESLVRDRVKTTNQMHAFLLEFGISMPIGTAVIKRLSTVLAENELPPYLAQLLMRLHAHYLYLVEQLTELETALEQELRRDETGQRLQTIPGVGPITASVLSSQLGDGKQYGCSRDFAASTGLVPRQYSTGGKNTLLGISKRGDKNLRRLLVQCARVFIQRIDYQSGRLAEWVKAQLERKHSNVVACALANKLARIAWAITTRQTVFER

SEQ ID NO: 5466 - protein, 63 aa, Xenorhabdus bovienii
  Peptide sequence Name=Xb4151_4152.C391.gene3.pep
  Homolog annotation: Query=1..47bp; Hit=68..115bp; Blast score=85; Percent Identity=87.0; E value=2e-16; Homolog= gi|22124244|ref|NP _667667.1| hypothetical [Yersinia pestis KIM] gi|21957009|gb|AAM83918.1|AE013632_6 hypothetical [Yersinia pes
MSGSALLSHGETPHYHRRYGVSLLSSAWDQVGPPRYGRQTNSVFNPEQAAVFHLKLRLSLSPS

SEQ ID NO: 5467 - protein, 91 aa, Xenorhabdus bovienii
  Peptide sequence Name=Xb4151_4152.C392.gene1.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677
MAKVDVYCRYCHKSEQVKGHGKGNGGHPRYRCYSCCKVFQLAYTYQACKPGVKEQIVDIAMNNGGIRDTARILKVATATVMKTLKTSDPET

SEQ ID NO: 5468 - protein, 96 aa, Xenorhabdus bovienii
  Peptide sequence Name=Xb4151_4152.C392.gene2.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662
VAHVFGDRSRKTLDKLLTLLSSFTIRFYCTDDYVVYDPLPEEEHLTGKAFTQRIERTNLTHRTRIKRLNRKTIGYSKSEEMHDKVIGTFIEREHYF

SEQ ID NO: 5469 - protein, 177 aa, Xenorhabdus bovienii
  Peptide sequence Name=Xb4151_4152.C392.gene3.pep
  Gene classification: Function=TPR repeat proteins; Function class=R General function prediction only
  Homolog annotation: Query=1..167bp; Hit=1..170bp; Blast score=99; Percent Identity=33.0; E value=2e-21; Homolog= PM1611 COG0790
MKKKSQTLFAVFLLSITTACYSESNGSEHFNVKTTQVDEKTHIEIIHALANSGHIGAQYELGTMYSEGKGVKQDYIKAKDWYEKAALQGDMNSQVSLGVMYYYAEGIPQDYIKAKEWLEKAAAQDSAGSQAILGIMYYVGEGVQKDDGKAKEWFKKSCDNGYQVGCESFAKMNIHSK

SEQ ID NO: 5470 - protein, 327 aa, Xenorhabdus bovienii
  Peptide sequence Name=Xb4151_4152.C392.gene4.pep
  Gene classification: Gene name=Tra8; Function=Transposase, IS30 family; Function class=L DNA replication, recombination and repair
  Homolog annotation: Query=1..312bp; Hit=1..312bp; Blast score=295; Percent Identity=52.0; E value=3e-80; Homolog= NMB0443 COG2826
MAYKQLTETERYQIFSLKEAGFSQREISKSLNRNPSTISRELRRNREAKKYTPEQAQLKAVARRQCATKAVKVKPEIEMWIKQLIWQDLSPEQTVGYLKRENIISLHHETVYRLIYKDKLNDGNLWQHLRIAKKPYRKRYGSYERRGKIKNRVSIDKRPKLVDKKQRIGDWEGDTIVGKNHKSALLTLVERKSLFTIIIKLENKTAEGVAKAATRHLSLIKHKIKTMTFDNGLEFAEHELISKNLETKIYFAHPYSPWERGINENTNGLIRDYFPKGTDFNKVSEREINLVANRLNNRPRKTRDYKTPNELFKGIPSHLLRPLRCCA

SEQ ID NO: 5471 - protein, 125 aa, Xenorhabdus bovienii
  Peptide sequence Name=Xb4151_4152.C394.gene1.pep
  Homolog annotation: Query=3..122bp; Hit=5..124bp; Blast score=130; Percent Identity=54.0; E value=6e-30; Homolog= gi|9634171|ref|NP _037708.1| tail assembly chaperone [Bacteriophage HK97] gi|6901600|gb|AAF31103.1| tail assembly chaperone [Ba
MNIRQLALTPKLGFRTKTVTVTEWDNATVTLREPSAGAWIRWNEVTSPTDKEGTLSTAEKVLRNTRADVVLFIDVLCDEHGEPVFTPDDMEAVMDIYAPVHSRLLHQALSLVTTGDEAEKKSDLH

SEQ ID NO: 5472 - protein, 88 aa, Xenorhabdus bovienii
  Peptide sequence Name=Xb4151_4152.C394.gene2.pep
  Homolog annotation: Query=1..88bp; Hit=132..220bp; Blast score=96; Percent Identity=52.0; E value=8e-20; Homolog= gi|9634172|ref|NP _037707.1| Gp14 [Bacteriophage HK97] gi|6901601|gb|AAF31104.1| Gp14 [Bacteriophage HK97]
MLTLALRLGKTLSELQGGLSASELMLWLAYDRENPLSDRRGDIQAAQIASAVYQSQGVKVGLSEALLQWGNPDEESGDDFENFFANLT

SEQ ID NO: 5473 - protein, 1124 aa, Xenorhabdus bovienii
  Peptide sequence Name=Xb4151_4152.C394.gene3.pep
  Homolog annotation: Query=1..1057bp; Hit=1..1020bp; Blast score=470; Percent Identity=37.0; E value=1e-131; Homolog= gi|15801950|ref|NP _287971.1| putative tail component of cryptic prophage CP-933P [Escherichia coli O157:H7 EDL933] gi|15831
VAKLRELIIKISANSSSYQAEIARAARLGENYHRVMENGNRGAAAAARGSRAALRDLNSQLVSVKDSAVGMAGAFAGIFATSKLIETADKWTNLNSRLKLATASSIDLANSQRLLMEMSQKTGTSFEANATVFARAAAPMRALQYASQDIVNMTEALSTGLRISGANASESSSVLVQFSQAMSSGVLRGEEFNAMAENGSRIIQALADGMGVARTQLKGMANDGLLTMDKVIPALLSQLEKLKAEGLSMGATVEKSLMRVQNAFMEWIGGANEATGTTRVLAGVLDDLSKNINDVAAAGAVAVGLFGARALGNRVSAIGASTSALIQNSRAEINNADQAYRNSQVQVASARASAYQAQQNVIAARSRLLQTTNTQTFAAAEARLNRTLVAEAAAQARVTQSINARAAAQARLNAVTSLGSRMGGALLGAVGGLPGILIMAAGAAYLLYQNQKQAKEEARAHAKEATKIKEELSKMDPVQLRDTKNQLKEDLAVAKEDVEKFRKEMNKNQISLNLFMKDKSNGKNTDIKITEFSTKLSESRSAYEAALKTVGEITSALTSLGDQQTINGEKEKRFITAINEMRKTGNVTLALQNQKLELTVELLERIKNSSIDVSGIHIPVPVVKFEPNDKIKSLLKDQEREIDLSKRKGLDKVRREAYYKAVDGGLNPDDRQQKPYVNQVINNAAQVYQNAEALRKQDEAARKAQSEAESATRKAAKTAEDYTNKVAELNTQLATEAIRYKEGNAAAELFANSQNNVSKFTQEQNNHLNQLNKRLEETKQRYQDLQAAIEADPFRNVAKRTQEATEQLERQKNNGQIESPAEYTYRKGDIWKDEVRGNADARQQYAVSARDNLRGEVDPIQDLENQLERKKALYQSYADATVISEQRKNELIAAAETENNTKRIEAAKQLFAAQSTYHAIAVNLFDTVSERMGNMITGLLTGTKSLKEGISEMFASMAQSVVQSLMKIAANKAFEMLASSFGGGAGGAFNGFMSTFVKNAKGGVYNSPSLSSYSGQIVNSPTLFAFAKGAGLMGEAGPEAIMPLTRSADGSLGVRAISPKGLGDQGGTNINVYITDGKTESSSSKGDNDAFGRRFAQAVAQVYYAERDRDLRQGGAINKAIRAK

SEQ ID NO: 5474 - protein, 110 aa, Xenorhabdus bovienii
  Peptide sequence Name=Xb4151_4152.C394.gene4.pep
  Homolog annotation: Query=1..110bp; Hit=3..112bp; Blast score=132; Percent Identity=52.0; E value=1e-30; Homolog= gi|9634174|ref|NP _037711.1| Gp17 [Bacteriophage HK97] gi|6901603|gb|AAF31106.1| Gp17 [Bacteriophage HK97]
MEIFTWLPRVNASSNVEFAIRKAKFGDGYEQVSGAGINPKSMRWTLDFVGNEKHITEIIAFLDRHEGHKSFIWTPPLASKGLFRCESYKYQAIDYKTYALSTEFIEAHAP

SEQ ID NO: 5475 - protein, 249 aa, Xenorhabdus bovienii
  Peptide sequence Name=Xb4151_4152.C394.gene5.pep
  Homolog annotation: Query=5..249bp; Hit=6..250bp; Blast score=342; Percent Identity=62.0; E value=5e-93; Homolog= gi|16122357|ref|NP _405670.1| putative phage protein [Yersinia pestis] gi|22126082|ref|NP_669505.1| putative phage tail protein
MFTADVQKLDAGNTVRLYEIDGTKFGADVLRFHAYGMPVTPEEIDTAEETGSQPQPKSLWWQGQEYKPWPVQIEGLDMSTDGQAARPRLSVANIEGTVTALCLQFDDMVQAKVAIHDTFVHYLDAKNFPQGNPTADPQQERQLMFYINRKTSETDKTVVFELASPASLDGLIIPTRQIHGVCTWCARGWYRTGKGCDYAGTNYFDIDNNPTDDPSKDRCPGTVIACKLRYGEDNELSFGGFPASSLIRR

SEQ ID NO: 5476 - protein, 234 aa, Xenorhabdus bovienii
  Peptide sequence Name=Xb4151_4152.C394.gene6.pep
  Gene classification: Function=Uncharacterized ACR, PAD1/JAB1-related; Function class=S Function unknown
  Homolog annotation: Query=8..123bp; Hit=10..126bp; Blast score=108; Percent Identity=44.0; E value=6e-24; Homolog= PA0639_1 COG1310
MNDKTLTAIFEHTKQMYPNECCGVIAQKSRVEKYFPCKNLAPNPAEQFQLDPGDYLAASIWGTITGIVHSHPDATTMPSDLDEAQCDFTELPWHIVSYPEGDFRTIYPRGELPLLGRPFVLGVYDCYGLIMSYYRQQCGIELNDYRVNYHWWEQGENLYIENFENAGFVEVTGDPQTGDVIIMQVQADVPNHAGVLLEGNLLLHHLYGQLSQKVPYGGYWKDRTIKIVRYHLLL

SEQ ID NO: 5477 - protein, 212 aa, Xenorhabdus bovienii
  Peptide sequence Name=Xb4151_4152.C394.gene7.pep
  Homolog annotation: Query=11..198bp; Hit=12..205bp; Blast score=166; Percent Identity=52.0; E value=2e-40; Homolog= gi|16122364|ref|NP _405677.1| putative phage tail assembly protein [Yersinia pestis] gi|22126076|ref|NP_669499.1| putative ph
MAYICPPLRTIRLHGVLATKFGATFDYAVRDAPHAIRAMSRLVAGFEAFMIHAHQQGFTFSVIVGGRSYHKDELDMTKGNGGIHILPVITGSKRGGLFQTILGVALIAVAWWNPLGWAASTALFVGASGASMAMGGVSQMLAPQPPRLGMRESPDNKPSYAFGGAVNTIAQGNPVPLLYGSREIGGAIISAGVYTEDQYQTEQIENQRKHSR

SEQ ID NO: 5478 - protein, 309 aa, Xenorhabdus bovienii
  Peptide sequence Name=Xb4151_4152.C395.gene1.pep
  Gene classification: Gene name=CoaA; Function=Panthothenate kinase; Function class=H Coenzyme metabolism
  Homolog annotation: Query=1..309bp; Hit=8..316bp; Blast score=511; Percent Identity=79.0; E value=1e-145; Homolog= coaA COG1072
LTTPYLQFDREHWATLRDSVPLTLTAEEIAALKGINEEISIEEVVQIYLPLSRLLNFYISSNLRRQAVLEQFLGTGGQKIPYIIGIAGSVAVGKSTTARLLQALLSRWPEHRRVKLVTTDGFLHSNNVLNERGLMKKKGFPESYDMRNLVKFVADIKSGTEKVTAPVYSHLSYDIVPNEQLIIERPDILILEGLNVLQSGMDYPHEPHHVFVSDFVDFSIYVDASEELLEQWYINRFLKFRQGAFSDPDSYFHNYSKLTTEAAIKVASNIWLEINGLNLQQNILPTRERASLIMTKGANHAIESVRLRK

SEQ ID NO: 5479 - protein, 319 aa, Xenorhabdus bovienii
  Peptide sequence Name=Xb4151_4152.C395.gene2.pep
  Gene classification: Gene name=BirA; Function=Biotin-(acetyl-CoA carboxylase) ligase; Function class=H Coenzyme metabolism
  Homolog annotation: Query=84..317bp; Hit=1..234bp; Blast score=327; Percent Identity=68.0; E value=1e-89; Homolog= ZbirA_2 COG0340
MKDISIPLKLIKVLSDGEVHSGQQLGQELGMSRAGINKHIQTIREWGVEILTIPGKGYRFPASMDLLDKELIAGYLPNDRLEVIPVIDSTNQYLLEKLSELDSGDACVAEYQYAGRGRRGRQWISAFGRNLYLSMYWRLEQGPAAAIGLSLVVGIVIAEVLNRQGAERVKVKWPNDLYLDDKKLAGILVELIGKTGDAAQIVIGIGMNISMSSEQQKLINQQWTNLQQAGIVVERNKLISEIILELKKALIQFENEGLSPFLFRWSKLDNFMNRSVKLVIGNQEIYGTARGIDQQGALLLDINGVITPYIGGEISLRGC

SEQ ID NO: 5480 - protein, 346 aa, Xenorhabdus bovienii
  Peptide sequence Name=Xb4151_4152.C395.gene3.pep
  Gene classification: Gene name=MurB; Function=UDP-N-acetylmuramate dehydrogenase; Function class=M Cell envelope biogenesis, outer membrane
  Homolog annotation: Query=9..346bp; Hit=5..342bp; Blast score=425; Percent Identity=58.0; E value=1e-119; Homolog= murB COG0812
MSACQSIQLKEFNTFGISACADHISTVTSVASLLSAWQEAEEKEHPILLLGGGSNVLFTENFKGTVILNRILGVDIQESDTAWHIHVGAGENWHQLIVRLLHQQIYGLENLALIPGSVGSAPIQNIGAYGIEFKHVCEYVDLIELKTGKLIHLMANECQFAYRDSIFKHQYKDGYAITAVGLQLSKVWKPILTYGGLTQFSSESVTPERIFNAVCEMRQSKLPDPVIIGNAGSFFKNPIVLIELAQKIKFDYPECPQYHHNEHNVKIAAGWLIDQCHLKGYCIGDAAIHMKQALVLINKGNATGQDITALATYVRKKVAEKFNIFLEPEVRFIGSEGEIDAVECIS

SEQ ID NO: 5481 - protein, 61 aa, Xenorhabdus bovienii
  Peptide sequence Name=Xb4151_4152.C395.gene4.pep
  Homolog annotation: Query=1..47bp; Hit=68..115bp; Blast score=86; Percent Identity=87.0; E value=8e-17; Homolog= gi|22124244|ref|NP _667667.1| hypothetical [Yersinia pestis KIM] gi|21957009|gb|AAM83918.1|AE013632_6 hypothetical [Yersinia pes
MSGSALLSHGETPHYHRRYGVSLLSSAWDQVGPPRYGRQTNSVFNPEQAAVFHLKLRLSLT

SEQ ID NO: 5482 - protein, 67 aa, Xenorhabdus bovienii
  Peptide sequence Name=Xb4151_4152.C396.gene1.pep
  Homolog annotation: Query=1..65bp; Hit=47..111bp; Blast score=71; Percent Identity=52.0; E value=3e-12; Homolog= gi|16763103|ref|NP _458720.1| conserved hypothetical protein [Salmonella enterica subsp. enterica serovar Typhi] gi|29144585|ref
MRDKKDSYYEENKRALSAIFYLANIPRARHESELEHFTPEEKQALIKAMNHIKVVVSQFPKYLKLSK

SEQ ID NO: 5483 - protein, 663 aa, Xenorhabdus bovienii
  Peptide sequence Name=Xb4151_4152.C396.gene2.pep
  Homolog annotation: Query=76..631bp; Hit=65..623bp; Blast score=442; Percent Identity=44.0; E value=1e-123; Homolog= gi|9634096|ref|NP _052289.1| A protein [Enterobacteria phage 186] gi|1351406|sp|P41064|VPA_BP186 Replication gene A protein
MNSGFITTEHNGDYPIAKGRQSGLFQPSIPQGVSMAERLLWDVNAEDHQWRHQYIGQMPDFLAKYFSRRYVGIFNHSGRRDANAFLRRTVGQNVLPRLQLVKARYSFTHHISGLTPFPFIEQLEKVVTCDRKQLLKLAHEISVFIASNYEHYSLQSSQQYQAAPVDSESKLFPRVAKLYQLLAKLTLQCGTNPPYWQRFNHGRKVPSVDQLCAGMLRMMSARWWYFRLKRLRDIQSEHMAIAVGQVQKAASPYVSNHALREWLEQKRRNREFFKHFDLENENGERISLAETVVHSNANPAIRRCELMVRMRGFEDVADKMGCVGEFYTITAPAKYHAVQHQGGFVRQWNGATPRDTQRYLCGIWAKSRAAIARAGINLFGFRVVEPHHDGTPHWHILLFMLPEHQRRVRAILEHYACQEEKAELQSDDAKKARFDYRIIDPDKGSATGYIAKYISKNIDGYALEDEKDHQTGAPLRDMAKSVTAWASRWRIRQFQQIGGAPVSVWRELRRLGEVRLMDNKVNAVLQAADEGNWAAYIQAQGGPWVARCDLTIRLSYKHIPFGSPYGEDVYTIQGVTSPFLSCVEFICTRIHQWTLVPKSEAAPTSGQIVYKRNTEWPSWSSVNNCTDGQVDRAMKGYVNYRIDEDDKLINMANISAKTARNRY

SEQ ID NO: 5484 - protein, 80 aa, Xenorhabdus bovienii
  Peptide sequence Name=Xb4151_4152.C396.gene3.pep
  Homolog annotation: Query=5..63bp; Hit=1..59bp; Blast score=80; Percent Identity=76.0; E value=6e-15; Homolog= gi|37524059|ref|NP _927403.1| hypothetical protein [Photorhabdus luminescens subsp. laumondii TTO1] gi|36783482|emb|CAE12322.1| un
MEAGISVDSLMESLVAQRINFIARMATSCECNHAEDKELALVWIAELSAPHENRLNVHRNDLENNLLFEKALKNSGSTDE

SEQ ID NO: 5485 - protein, 78 aa, Xenorhabdus bovienii
  Peptide sequence Name=Xb4151_4152.C396.gene4.pep
  Homolog annotation: Query=1..77bp; Hit=1..77bp; Blast score=80; Percent Identity=45.0; E value=4e-15; Homolog= gi|33770564|ref|NP _892101.1| hypothetical protein PY54p55 [Bacteriophage PY54] gi|33636147|emb|CAD91816.1| hypothetical protein [
MKVEILFDKRANVSESVMSALESELKKRILPQYPDTHFRIAVSSSSSVRVTGTKDSSKHDQMMELIQNVWEDDSWLPD

SEQ ID NO: 5486 - protein, 67 aa, Xenorhabdus bovienii
  Peptide sequence Name=Xb4151_4152.C396.gene5.pep
  Homolog annotation: Query=1..67bp; Hit=1..67bp; Blast score=109; Percent Identity=76.0; E value=9e-24; Homolog= gi|37524058|ref|NP _927402.1| hypothetical protein [Photorhabdus luminescens subsp. laumondii TTO1] gi|36783481|emb|CAE12321.1| u
MQVIAQQNETVDALCWRHYGRTLGMTERVLLANPGLADFGAVLPHGTKVEMPGFMPTTTKPIIQLWD

SEQ ID NO: 5487 - protein, 91 aa, Xenorhabdus bovienii
  Peptide sequence Name=Xb4151_4152.C396.gene6.pep
MDKYSHATYACASITAIFSGLSLYEWSFLLGVFASISLGILTYQLNRREQMKRTLILKNILKNILENLDIESASKSAKIVSELIHHAPREL

SEQ ID NO: 5488 - protein, 169 aa, Xenorhabdus bovienii
  Peptide sequence Name=Xb4151_4152.C396.gene7.pep
  Gene classification: Function=Phage-related lysozyme (muraminidase); Function class=R General function prediction only
  Homolog annotation: Query=2..169bp; Hit=13..177bp; Blast score=235; Percent Identity=66.0; E value=2e-62; Homolog= Z3339 COG3772
VIIGLIIGGASSSVILSQFLDEKEGNRLSAYRDGGGIWTICRGVTRIDGKAVYKGMKLAPEQCDVLNRIEADRAIDWVKKNVRVPLTDPQIAGIASFCPYNIGPGKCFSSTFYRKLNAGDKKGACAEIKRWVYDGGRDCRKTQGQPNGCYGQVLRRDQEAELVCWGLDK

SEQ ID NO: 5489 - protein, 168 aa, Xenorhabdus bovienii
  Peptide sequence Name=Xb4151_4152.C396.gene8.pep
  Homolog annotation: Query=1..159bp; Hit=1..149bp; Blast score=77; Percent Identity=36.0; E value=8e-14; Homolog= gi|15830788|ref|NP _309561.1| putative endopeptidase [Escherichia coli O157:H7] gi|25289635|pir||F90820 probable endopeptidase [
MKKVSLLVSVSLVIGGCFGWWGHRSLFLSELTDLKQQHATQIVAINQKAHSETLATIQQMKDAQNRVAQLDEYYSGKLTHVTEENAALRADIAAGYRRVQIAAANLATCQLTQNRDTSSRSVGDETQVELTTKAGRAIYDIRAGIISDQAKLDYLQQYVLEVVRQCKP

SEQ ID NO: 5490 - protein, 211 aa, Xenorhabdus bovienii
  Peptide sequence Name=Xb4151_4152.C396.gene9.pep
  Homolog annotation: Query=1..211bp; Hit=1..211bp; Blast score=280; Percent Identity=75.0; E value=9e-75; Homolog= Pa|Phot2-60c06.p1ka _g80| 55423 - 56061 969 212 aa, chain -
MNTQLTELLRLMRNLIRTGVITQVDTTKGMCRVATGNLETNWLNWLTSRAGNSRTWWAPSVGEQVLLLSIGGELTTAFVLPAIFSDEFPAPSTSSEATHIQFPDGAVMEYEPQSGALTVIGIKTATVTASDSVHITAPEITCVASTRITLDTPEVICTQLMSTGNLIVRNGGKMTGNIEHTGGTFSSNGVVVDSHKHTGVRSGGDTSGGPV

SEQ ID NO: 5491 - protein, 115 aa, Xenorhabdus bovienii
  Peptide sequence Name=Xb4151_4152.C396.gene10.pep
  Gene classification: Function=Phage baseplate assembly protein W; Function class=R General function prediction only
  Homolog annotation: Query=3..98bp; Hit=2..97bp; Blast score=66; Percent Identity=36.0; E value=5e-12; Homolog= PA0617 COG3628
MYLGMNRQTGRELTDLAHVRQSVSDILLTSVGSRIARRTYGSLLPELIDWPQNPALRLQVMAASYTAISRWEPRVMLMSITMETRQNGEMVVDIAGTYHQSAKEFSLSIPVSHSR

SEQ ID NO: 5492 - protein, 302 aa, Xenorhabdus bovienii
  Peptide sequence Name=Xb4151_4152.C396.gene11.pep
  Homolog annotation: Query=1..302bp; Hit=1..302bp; Blast score=411; Percent Identity=70.0; E value=1e-114; Homolog= gi|30065720|ref|NP _839865.1| gpJ [Bacteriophage L-413C] gi|30025914|gb|AAP04453.1| gpJ [Bacteriophage L-413C]
MPTIDLSQLPPPDVVEPLDYEQLLEERKEGLISLYPEEQQDAIARTLQLESEPLVKLLEENVYRELLLRQRVNEAARAVMVAYSTGRDLDQLGVNNNVVRMVLSPADNSTVPPTPAVMESDNDYRVRIPQAFEGLSVAGPVGSYEFHARSADGRVADASAISPSPANVTVTIMSREDKGVASKELLDKVEKALNDENVRPVADRLKVQSASIVEYEIDAVLYIFPTPESEPIRKAAEQKLKYYVEAQHRLGRDIRLSAIYAALHVEGIQRVELKAPLKDVVLDKTQVSYCTKTTLMMGGSDE

SEQ ID NO: 5493 - protein, 202 aa, Xenorhabdus bovienii
  Peptide sequence Name=Xb4151_4152.C396.gene12.pep
  Homolog annotation: Query=1..201bp; Hit=1..201bp; Blast score=303; Percent Identity=71.0; E value=1e-81; Homolog= Pa|Phot4-254a01.q1k _g21| 21429 - 22043 318 204 aa, chain -
MNDRLLPMGSTQLELAAAKACAELQKIKVPLRELWNPDTCPATLLPYLAWAWSVDRWDEHWSESIKREVIKSSLFLHKHKGTIGAIRRVVEPLGYLIRVKEWWQTNDVPGTFRLDIGVLENGITHEMFEELEKLISDAKPVSRHLIGLDINLDTRGEYYYSAASYSGDELTVYPYFAEQVTVSGSDVVGMGIHIIDDMRIRP

SEQ ID NO: 5494 - protein, 601 aa, Xenorhabdus bovienii
  Peptide sequence Name=Xb4151_4152.C396.gene13.pep
  Homolog annotation: Query=4..212bp; Hit=2..211bp; Blast score=303; Percent Identity=79.0; E value=7e-81; Homolog= gi|37524053|ref|NP _927397.1| hypothetical protein [Photorhabdus luminescens subsp. laumondii TTO1] gi|36783476|emb|CAE12316.1|
MSTKYFALLTQLGADKLANAAALGTKIEITHMAVGDGGGSLPTPDTKQTKLINEKRRAAINTLSIDPKNTNQIISEQVIPESEGGWWIREIGLFDKDGILIAVGNCAESYKPQLQEGSGRTQTIRMILIVSSTESVTLKVDPSVVLATREYVDDSIQKHSNSRNHPDATLKEKGFVILSSAVDNNSETHAATPKAVKAAYDFANAANNNANGRVPSGRKVNGKALSEDIHLKASDVDAYNKTETDARVNDAKAQAKAANDNADGRVPAGRKVNGKALNADIALNSGDVGAYSKGETDTRVDEAKALANTANQNAANANNNANTRLEKNQNGADIPNKPKFVENLGLAETKNQAQDAVPNSRKVNGKTLTGDVTLSAEDVQGEPRFNQTIDLTGLSSDRYYPVWWKFPFNERGANSWLTIHRNYAENRENKNPFGKDVTHLAGLEVQIEGSDTLWGGDAQYLNIKRINQRYRNTVKKIQYGMMSIARSVDGKYPLYYDWKSGDITECRVYSGCYLRGGLTYHVTSNFNNLDYSRKEDEVEIWHGVSDSDKREIKWTVKSYAIDDPLLGKDYDDTVTAYGSDITDMLYSVGIVVWFAQNKIQI

SEQ ID NO: 5495 - protein, 385 aa, Xenorhabdus bovienii
  Peptide sequence Name=Xb4151_4152.C397.gene1.pep
  Gene classification: Gene name=XerC; Function=Integrase; Function class=L DNA replication, recombination and repair
  Homolog annotation: Query=1..378bp; Hit=1..378bp; Blast score=561; Percent Identity=74.0; E value=1e-160; Homolog= intD COG0582
MSIFRRGNTWYGNYTTPSGKRIKESLGTTDKKQAQELHDRRKAELWRIERLGDFPDVTFDEACLRWIEEKADKKSLDDDKGRMAFWLEYFEGVRLKDITEARIYTAISKMRNRKSKQRWESRVTAAQKKGKEVPAYTEVSVSVATKAKHLSLMKSLLRAAERDWKWLEKAPVIKVPAVRDKRVRWLEPHEAQRLIDECPEPLQSIVKFALATGLRRSNIINLEWSQIDMQRQVAWIHPDQSKSARAIGVALNETACRVLRAQIGNHNKWVFVHTKPSTNPDGIVMPNIRKMRVDDNTAWNSALKRAGIEDFRFHDLRHTWASWLVQSDVPLSILQEMGGWESIEMVRRYAHLAPNHLTEHARQIDELFGNLVPNPSQSGKIVVAK

SEQ ID NO: 5496 - protein, 133 aa, Xenorhabdus bovienii
  Peptide sequence Name=Xb4151_4152.C397.gene2.pep
  Homolog annotation: Query=8..132bp; Hit=3..125bp; Blast score=109; Percent Identity=51.0; E value=8e-24; Homolog= gi|9633587|ref|NP _051001.1| P40 [Acyrthosiphon pisum bacteriophage APSE-1] gi|9910956|sp|Q9T1Q8|VXIS_BPAPS Probable excisionas
MRLITDNNEIESITLSRKKAAALIGIDVDTLSLWCQIGKIAYTKKNPTKPNSPYLFTRAACIAAINNPIQTVIVSSVDATEKGDKQCQSSVEEIRGMGTTRRQAAKELRSLLGQRTKSKLRSCTTEERPNYGA

SEQ ID NO: 5497 - protein, 58 aa, Xenorhabdus bovienii
  Peptide sequence Name=Xb4151_4152.C397.gene3.pep
MKVTIEMNNKEVQEYIGGDYLSPEFEYQSLIQNDAKVILENSGFQGIETGDITVTIHD

SEQ ID NO: 5498 - protein, 178 aa, Xenorhabdus bovienii
  Peptide sequence Name=Xb4151_4152.C397.gene4.pep
  Homolog annotation: Query=5..177bp; Hit=4..177bp; Blast score=255; Percent Identity=70.0; E value=2e-67; Homolog= Pa|Phot5-476a02.p1k _g83| 38072 - 38614 2968 180 aa, chain +
MKTDFGGSNTPKELRDLWQTPLPLFTALNLEFKFKLDAAADAQNTLCSHYLTERDNALECDWESYGSIFCNPPYSKITPWVEKAAIECRKQCQSIVMLVPNDTSVGWFKLAMQTVDEVRLITGGRIQFVPVEQRKKNSNTKGSMLLIWRPFITPRKTITTVDKDYLFDIGNEHLRKIA

SEQ ID NO: 5499 - protein, 77 aa, Xenorhabdus bovienii
  Peptide sequence Name=Xb4151_4152.C397.gene5.pep
MTNKNDDVMTDRELVNAAIKLAGKFYNIMGYQHRDGFEYWKSPHPQEQSVFEMAIQAFEDIRGSDVWDAIESLEDEN

SEQ ID NO: 5500 - protein, 138 aa, Xenorhabdus bovienii
  Peptide sequence Name=Xb4151_4152.C397.gene6.pep
MSKDMIERLQNRIKKQLTNFENIRFTELEGKELLELLKRLADYEIIINAYHQDDADWHKLADINGSTTCALVDGIIKLQSKLSEYENMEPVAWARNTGIQRILDLTDLPERVFEWREYNESHPDIADEIFPLYRHPNK

SEQ ID NO: 5501 - protein, 62 aa, Xenorhabdus bovienii
  Peptide sequence Name=Xb4151_4152.C397.gene7.pep
MRNDKIECAKRKCKHIHYENDRIKVPDPEFPTWLISVCPKCGANDFYIIEKLEGDNNEQRYD

SEQ ID NO: 5502 - protein, 97 aa, Xenorhabdus bovienii
  Peptide sequence Name=Xb4151_4152.C397.gene8.pep
MNNDVMTNSDVYQSTTMKTTSDVYFYYATRNGNINKIKINGYHFDNEMSVEKFAPITIPEKHIRILHCRCGSNDWGEDGRYINEYCCNDCGQYITVY

SEQ ID NO: 5503 - protein, 283 aa, Xenorhabdus bovienii
  Peptide sequence Name=Xb4151_4152.C397.gene9.pep
  Homolog annotation: Query=1..281bp; Hit=1..282bp; Blast score=469; Percent Identity=78.0; E value=1e-131; Homolog= gi|9626299|ref|NP _040635.1| Nin protein [Bacteriophage lambda] gi|140020|sp|P03766|Y290_LAMBD HYPOTHETICAL NIN REGION PROTEIN
MINVVSFSGGRTSAYLVYLMEQRRKQGEDVRYVFMDTGAEHPMTYRFVREVVKFWDIPLIVLQADINPQLGVSNGYTVWEPKDIQTRMPALKPFTDMVKKYGTPYIGGAFCTDRLKLRPFRDYCNDHFGRGNYQTWIGIRADEPRRLTRKEGVSYLADISDFDKRDILDWWKDQPFDLSIPEYLGNCVFCIKKSSQKLGLACQDEPGLKLVFEHTCITPSYVRDGHRKTDREIMYRGHMSLDGIAKMYSDVDYQNIYQDMIAAQRFDTGSCSESCEIFQLDLF

SEQ ID NO: 5504 - protein, 172 aa, Xenorhabdus bovienii
  Peptide sequence Name=Xb4151_4152.C397.gene10.pep
  Gene classification: Gene name=Ssb; Function=Single-stranded DNA -binding protein; Function class=L DNA replication, recombination and repair
  Homolog annotation: Query=8..172bp; Hit=1..171bp; Blast score=210; Percent Identity=63.0; E value=7e-55; Homolog= BU545 COG0629
VINGGETMASRGVNKVILVGNLGQDPEVRYMPNGGAVANITLATSEQWRDKQSGEMREKTEWHRVVIFGKLAEVAGEYLRKGSQVYIEGSLQTRKWQDQQGQDRYTTEVTVNIGGTMQMLSNRQGSQQGQQPQQQYSGVPQQSHGWGAPQQPKGQQLQPEPPPMDFDDDIPF

SEQ ID NO: 5505 - protein, 231 aa, Xenorhabdus bovienii
  Peptide sequence Name=Xb4151_4152.C397.gene11.pep
  Homolog annotation: Query=1..227bp; Hit=1..227bp; Blast score=370; Percent Identity=74.0; E value=1e-102; Homolog= gi|37526826|ref|NP _930170.1| hypothetical protein [Photorhabdus luminescens subsp. laumondii TTO1] gi|36786258|emb|CAE15310.1
MVSYESVLTRAGIDLRNVEQGSFDWHKLRLGVITASDAGKVLSKSKDGKKWTDTKATYFYTLLGEICTGNVVEVNAKSLAWGKEYEESARATFEFVSGVDVMEAPILFKDDSLRTACSPDGLCSDGLGLELKCPFTTAVFMRFRLGGFEAIKSDYMAQIQYSMWVTGKDSWYFANYDPRMTREGIYYVTVDRDEKFMQQFDELIPEFIEKMDDALNEVGFKFGDQWRGNDG

SEQ ID NO: 5506 - protein, 258 aa, Xenorhabdus bovienii
  Peptide sequence Name=Xb4151_4152.C397.gene12.pep
  Homolog annotation: Query=1..207bp; Hit=26..230bp; Blast score=103; Percent Identity=29.0; E value=2e-21; Homolog= gi|9635643|ref|NP _061548.1| Orf52 [Pseudomonas phage D3] gi|8895153|gb|AAF80811.1| Orf52 [Pseudomonas phage D3]
MQEVVTREQDYHVAEPTGNAAAAPMRLIEMAVSSNADIDKLERLLELQTKWEAGQARKEFLDAMAAFQSALPTIKKLKQADFGAGKAKYKYASLDDISEQIKPFLQKFGLSYRFEQKMESGVITVKCIVSHKSGHYESCEMMSTPDQSGGKNSIQQSASAITYLRRYTLTGALGIATADEDIDGRISSSTPSNGVSAKTMERINAMLIGMDKTWDDDLLPLCSKIFNREINSPYDLSELEANKAEDFLSKKVKNNGQL

SEQ ID NO: 5507 - protein, 86 aa, Xenorhabdus bovienii
  Peptide sequence Name=Xb4151_4152.C397.gene13.pep
VRYERNPYGAQDEQWEQEEEAAAYKEALETDLDKLANDRLGNLPDNTLSDRVNSLLERTGDKRSELMDKYHEWLFDVCRTVEEQRI

SEQ ID NO: 5508 - protein, 40 aa, Xenorhabdus bovienii
  Peptide sequence Name=Xb4151_4152.C397.gene14.pep
MEERMNSGQWSMNELTDYLIDRDLMGSFMEELKKAQRRVA

SEQ ID NO: 5509 - protein, 142 aa, Xenorhabdus bovienii
  Peptide sequence Name=Xb4151_4152.C397.gene15.pep
MLSDKKQELVSESSGQLNALGINHTIDICGTITVQTKQGKVIYYPTKNKIQYKGTVTAGGLNNVKNLVDSLGLSGEIAPQKNKPDEITLRDYFAARAMGAGIRRYDGSKFGGGQNAPDYEYLAVESYHIADAMMKARQNDSR

SEQ ID NO: 5510 - protein, 73 aa, Xenorhabdus bovienii
  Peptide sequence Name=Xb4151_4152.C397.gene16.pep
MDWIKCSERLPEIRDDSVIVYFSNGSMDMVHIEDCFRDIGAGVDENGNQLWTKWYLSIGITHWQPLPEPPTEE

SEQ ID NO: 5511 - protein, 80 aa, Xenorhabdus bovienii
  Peptide sequence Name=Xb4151_4152.C397.gene17.pep
MSEKVEIRVEARITRQYNQCFEIPESEYAKICEIEDSDLSIYARERAIEKILFANGFEYDEFYSDEDESEDIEVTLEDNE

SEQ ID NO: 5512 - protein, 69 aa, Xenorhabdus bovienii
  Peptide sequence Name=Xb4151_4152.C397.gene18.pep
MNIEFINEIRASMKRDRQSDIRYVIECKRNYLDFRQWAMDHEPRSASRRALNRLAWQQRKFYRKWMALS

SEQ ID NO: 5513 - protein, 76 aa, Xenorhabdus bovienii
  Peptide sequence Name=Xb4151_4152.C397.gene19.pep
MYRTATQVSRVSNELAGGFMYFANAQDAMDTGLFCQKLVFDYWSGDERCDFLDKLFVIKNWDELTPDEKNIVNQQQ

SEQ ID NO: 5514 - protein, 102 aa, Xenorhabdus bovienii
  Peptide sequence Name=Xb4151_4152.C397.gene20.pep
MTTVTVIRSDYATRRYERRAAFLAKKQAAQNLQSRSVEEIIDSIIKPVDEIDVLTQLMIGLKKDIKDDNNSGSCCMSDVALYSTKQRAGNRILESGGVTARG

SEQ ID NO: 5515 - protein, 250 aa, Xenorhabdus bovienii
  Peptide sequence Name=Xb4151_4152.C397.gene21.pep
  Homolog annotation: Query=1..250bp; Hit=2..250bp; Blast score=403; Percent Identity=74.0; E value=1e-111; Homolog= gi|26247413|ref|NP _753453.1| Hypothetical protein [Escherichia coli CFT073] gi|26107814|gb|AAN80013.1|AE016759_287 Hypothetic
MCSTVISNLGFECHPIGSELLRIISPFTYCDDGEHVGAFVKEINGKYLVSDRCDTLMNMEARGISLTKKRIEEIRAFLKNQGSELNERGEIIGWATEDTVGSVTSGVIRAGIIASTLSQDWHQPVQAEKFEGQVINFLYHTELKDIISLRGSVMGMSGHQIVIPVTINTPTPKYIFTSSVKKNGSWNSAYSLLGKLIDLKNSNSDLNNRYVVVDNDSIGDQIQQLSLLFNETSHILPFTKRETWVSRLAA

SEQ ID NO: 5516 - protein, 61 aa, Xenorhabdus bovienii
  Peptide sequence Name=Xb4151_4152.C398.gene1.pep
  Gene classification: Gene name=CsrA; Function=Carbon storage regulator (could also regulate swarming and quorum sensing); Function class=T Signal transduction mechanisms
  Homolog annotation: Query=1..61bp; Hit=1..61bp; Blast score=95; Percent Identity=93.0; E value=1e-20; Homolog= csrA COG1551
MLILTRRVGETLMIGDEVTVTVLGVKGNQVRIGVNAPKEVSVHREEIYQRIQAEKSQPTTF

SEQ ID NO: 5517 - protein, 875 aa, Xenorhabdus bovienii
  Peptide sequence Name=Xb4151_4152.C398.gene2.pep
  Gene classification: Gene name=AlaS; Function=Alanyl-tRNA synthetase; Function class=J Translation, ribosomal structure and biogenesis
  Homolog annotation: Query=1..875bp; Hit=1..875bp; Blast score=1407; Percent Identity=78.0; E value=0; Homolog= alaS COG0013
MSKSTAEIRQAFLDFFHTKGHQIVPSSSLVPNNDPTLLFTNAGMNQFKDVFLGLDKRPYSRATTAQRCVRAGGKHNDLENVGYTARHHTFFEMLGNFSFGDYFKQDAIKYAWELLTGKEWFNLPKEKLWVTVYETDDEAYDIWHKEVGIPAERIIRIGDNKGAPYASDNFWQMGDTGPCGPCTEIFYDHGEHIWGGPPGSPEEDGDRYIEIWNIVFMQFNRHVDGTMEPLPKPSVDTGMGLERLTAVLQHVNSNYDIDLFCDLIASVAEVTGATDLTNKSLRVIADHIRSCAFLVCDGVVPSNENRGYVLRRIIRRAVRHGNMLGAKETFFYKLVAPLIKIMGSAGDELKRQQSLVEQVLKTEEEQFARTLERGLQLLDEELEKLSGDTLDGETAFRLYDTYGFPVDLTADVCRERNIKVDEVGFDVAMENQRRRARESSGFGTDYNEQIKVDGRSDFSGYEHNSQQATVMAIFRHGEAIDQIHAGEEAIVILDKTAFYAESGGQVGDTGNLSNGNGIFEVTDTQKYGQAIGHIGKLINGTLNVNNTINAEINRVRRDSIRLNHSATHLLHAALRQILGEHVSQKGSLVNDKYLRFDFSHFEAMKLEQIRQVENLVNEEIRKNLSIVTELMELEEAKTKGAMALFGEKYDEQVRVLSMGDFSTELCGGTHASRTGDIGLFRISSESGTAAGIRRIEAITGQTALNSVYQQTDLLQDIAHLVKSDISSLNEKVKTTLDRTKQLEKELQHLKSQQAAQESSSLANQTKEIQGVRLLVTQLGDTEPKMLRTMVDELKNQLGSAIIVLSTVTGDKVTLIVGITKDLTARIKAGDLISFVAQQVGGKGGGRPDLAQAGGTDVAALPSALASVEEWVTLRL

SEQ ID NO: 5518 - protein, 379 aa, Xenorhabdus bovienii
  Peptide sequence Name=Xb4151_4152.C398.gene3.pep
  Gene classification: Gene name=RecA; Function=RecA/RadA recombinase; Function class=L DNA replication, recombination and repair
  Homolog annotation: Query=22..379bp; Hit=1..353bp; Blast score=589; Percent Identity=85.0; E value=1e-168; Homolog= recA COG0468
LVSETVYQQWGSPFIAYEGVNMANDENKQKALAAALGQIEKQFGKGSIMRLGENRSMDVETISTGSLSLDIALGAGGLPMGRIVEIYGPESSGKTTLTLQVIASAQREGKTCAFIDAEHALDPVYAKKLGVDIDNLLCSQPDTGEQALEICDALSRSGAVDVIVVDSVAALTPKAEIEGEIGDSHMGLAARMMSQAMRKLAGNLKNSNTLLIFINQIRMKIGVMFGNPETTTGGNALKFYASVRLDIRRTGSVKNGDEVVGSETRVKVVKNKIAAPFKQAEFQILYGEGINTFGELVDLGVKHKMVEKAGAWYSYNGDKIGQGKANATIYLKEHPEISAELDKKLRELLLNNAGGFNSAVSDYEADYEDNGEEVKNEEF

SEQ ID NO: 5519 - protein, 168 aa, Xenorhabdus bovienii
  Peptide sequence Name=Xb4151_4152.C398.gene4.pep
  Gene classification: Gene name=CinA (BS); Function=Uncharacterized protein (competence- and mitomycin-induced); Function class=R General function prediction only
  Homolog annotation: Query=1..168bp; Hit=1..164bp; Blast score=173; Percent Identity=57.0; E value=9e-44; Homolog= ZygaD COG1546
MDEKILNQLSIEIGKKLQRKKLSLTCAESCTGGWIAKVITDIAGSSAYFNRGFVTYGNDSKNEMLGVSQASLMQFGAVSEQVVKEMAVGALKAARADFAVSVSGIAGPGGGSEEKTDGERVCFGFAYRNREDVHTVTYRQHFTGERNAVRLQAVIFSLKTLLEEIIKN

SEQ ID NO: 5520 - protein, 398 aa, Xenorhabdus bovienii
  Peptide sequence Name=Xb4151_4152.C398.gene5.pep
  Gene classification: Gene name=ProP; Function=77 Permeases of the major facilitator superfamily; Function class=G Carbohydrate transport and metabolism
  Homolog annotation: Query=10..392bp; Hit=11..393bp; Blast score=434; Percent Identity=68.0; E value=1e-122; Homolog= ygeD COG0477
MNGTVDTQPLLNKGMKAVLLSQFLTAFADNALFFAILAQLKAEAYPGWSLPALQIVFVLTYIVLAPFVGQIADRFSKGWVMLFANGIKLLGAISICIDMNPFLGYTLVGIGAAAYSPAKYGILGELTDGGRLVKANGVMEASTIAAILIGSVAGGFLSDISLALALGLCALMYGAAVVANFYIPRLAAARQGKGWNPKKMLVDFMVVCSALWRNQETRFSLVGTSLFWGAGVTLRFLLVAWVPVVLGIEGNTTPTLMNAMVAVGIIVGAGLAARFITLKTVRRCMPAGILIGIMVIVFAVQQSMWSSYLLLTVLGVFGGFFVVPLNALLQEHGKHEMGAGNAVAVQNFGENSAMLVMLGLYLISIMLGASVVTVGIGFGILFSLTIGGVWIWDLLRKN

SEQ ID NO: 5521 - protein, 479 aa, Xenorhabdus bovienii
  Peptide sequence Name=Xb4151_4152.C398.gene6.pep
  Gene classification: Gene name=CaiC; Function=Acyl-CoA synthetases (AMP-forming)/AMP-acid ligases II; Function class=I Lipid metabolism
  Homolog annotation: Query=1..478bp; Hit=40..516bp; Blast score=697; Percent Identity=70.0; E value=0; Homolog= Zaas_2 COG0318
LLKKILGVSRILEQFTQKNERVGLLLPNATVMAAAIYGASLKERVPALLNYTAGTSGIKNAMKAATIKTIVTSRQFLQKGQLTHLPEQVTEANWVYLEDLKDTITREDKLWILWHLIFPAKAITPSQKPDDDALILFTSGSEGAPKGVVHSHASLLANVEQIKTIADFTPQDRFMSSLPLFHAFGLTVGLFTPLMTGSRVFLYPSPLHYRVVPELVYDRNCTVLFGTSTFLGNYARFAHPYDFARLRYVVAGAEKLSENTKRVWLDKFGIRILEGYGVTECAPVVAINVPMAAKMGTVGRILPGMEARLLPVQGIEGGGRLQLRGPNVMKGYLRVEAPEHLELPTAEDAEGNTQIGWYDTGDIVSIDDRGFCTIKGRVKRFAKLAGEMVSLEAVEQIASRVSPDALHAATAKSDLSKGEALVLFTTDANLNRNAMSGVAREMGMPELAVPRDIRYVKQLPLLGSGKPDFVTLRKMAEQE

SEQ ID NO: 5522 - protein, 91 aa, Xenorhabdus bovienii; identical to SEQ ID NO: 5467
  Peptide sequence Name=Xb4151_4152.C398.gene7.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 5523 - protein, 96 aa, Xenorhabdus bovienii; identical to SEQ ID NO: 5468
  Peptide sequence Name=Xb4151_4152.C398.gene8.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 5524 - protein, 427 aa, Xenorhabdus bovienii
  Peptide sequence Name=Xb4151_4152.C398.gene9.pep
  Gene classification: Function=Hemolysins and related proteins containing CBS domains; Function class=N Cell motility and secretion
  Homolog annotation: Query=9..419bp; Hit=1..411bp; Blast score=572; Percent Identity=72.0; E value=1e-163; Homolog= yfjDm COG1253
LENVSTSTLIIILVIMVIISAYFSASETSMMTINRYRLRHLAKQGSRPARRVESLLRRPDRLISLILIGNNLINILASSLATIVGMRLYQDAGVAIATGILTFVILVFAEVMPKTIAALYPEKVAFPSSFLLRPLEKIMLPLVWAFNKISLLLMRCLGIKTFDIRSDAVSKDELRTIVNESNTNLSRRNQDMLISILDLEKVTVADIMVPRNEIVGIDINDDWKSVMRQLTHSPHGRIVLYRDSLDDAIGMLRVREAYRLMMEKKAFTKRNLIKAADKIYFIPVSIPLNTQLINFQRNKQKAGLIVDEYGDIQGLVTVEDILEEIVGDFTTSMSPTLAEEVMPQSDGTVLVDGTANIRELNKVFGWALPADGPRTMNGMILEELGEIPELNAQVQINKYNFEILSVHGNVIKQVRVTPINQAEKFSE

SEQ ID NO: 5525 - protein, 148 aa, Xenorhabdus bovienii
  Peptide sequence Name=Xb4151_4152.C398.gene10.pep
  Gene classification: Gene name=CcmC; Function=ABC-type transport system involved in cytochrome c biogenesis, permease component; Function class=O Posttranslational modification, protein turnover, chaperones
  Homolog annotation: Query=8..146bp; Hit=149..287bp; Blast score=173; Percent Identity=69.0; E value=6e-44; Homolog= ypjD COG0755
SARYPIELFIHIGLALLGYATLLIAALYALQLGWLDHLLKKKKFSFSSGMPPLMTIERKMFHITQVGVILLTLTLCTGIMYMDNIFGKENIHKSVLSIIAWFVYVILLWGHYHEGWRGKRVIWFNLIGAFILTLAFFGGRLLQEIMVY

SEQ ID NO: 5526 - protein, 1027 aa, Xenorhabdus bovienii
  Peptide sequence Name=Xb4151_4152.C399.gene1.pep
  Gene classification: Gene name=AcrB; Function=Cation/multidrug efflux pump; Function class=Q Secondary metabolites biosynthesis, transport and catabolism
  Homolog annotation: Query=4..1016bp; Hit=16..1028bp; Blast score=794; Percent Identity=42.0; E value=0; Homolog= CC3197 COG0841
MKYQLSEWAIRKPIPTIVIFLALTIAGLFSFLKLPINANPVINFPVVTVTVTQSGSSPSELENAVTQPIERAVSGLPGIRHINSTITDGVSITIIEFDIKIDPNVATNDIREQITQIRSELPQSIDEPLISRIDVEGSAILNYAVQSKDKNLTDLSWFVDDKLSKKLLMVPGVQKITRLGGTNKEILIEPDPIKMAALKISVADINQLLLQNNVNIPGGKMVVAGQDHTIRILGAKNEIDYLHQLKLPLANDNWIKLGDIATIRDSHKETITIARLNNEIVVGFAVFRAKGSSDTEVEKGVVRALQMAGEEYPDVSIKLVSSNVKYTVASYNSTMQTLIEGAILTVIVVFFFLKSWRATLIAAIALPLSILPAFFILHLFGYTLNSITLLALTLVIGILVDDAIVEIENIEKYIERGERPYIAAIKASDAIGFAIVAITITIVAVFLPVSFIGGFIGKYFVPFGITVSAAVLSSLLVARLVTPLMSAYLLQPKKHPKTDKTETPKWIKKYLTILEKTLKFRKTASLLAIVFLLGSLALVALLPSGFMPKADISITTIEVEAPPGTQAAQSDETLQKIIKKLQGRPEIIDIFSVAGVDGSSGEISQNRSNIIINLVPTGERDWSQKEFEQSLIPILNEIPDIRYNFGNSSGSRDISIVLASENPEILSQTIEQLRKEMMQLEGLKNIKLLQPLPRREIIITPNIDTAARAGVTTDAIGSVIRTATIGEINSRVAKFNLPDRQVPIRVLLSKEDRDNLTVLNDLYVNSISGVNVPVKSVANISFASGPDKIERIARQRKASIDADLNGIAVGTAYIQINELPTMKKLPPEVKRVEYGEVEYMNEMFDRFTTTITLSIMMVLAILIILFKDFLQPMTILIALPFAIGGAIIALLIYGAAIDLPVIIGILMLMGIVSKNSILLVEFILEKSRTGMPRNEAIIQAGRERVRPIIMTTIAMIAGMIPLVITSGADASFRAPMAISVIGGLLSSTLLSLLFVPVIYSYMDDFKNFITPYLKKLTSVTKDDIDYH

SEQ ID NO: 5527 - protein, 340 aa, Xenorhabdus bovienii
  Peptide sequence Name=Xb4151_4152.C399.gene2.pep
  Gene classification: Gene name=AcrA; Function=Membrane-fusion protein; Function class=Q Secondary metabolites biosynthesis, transport and catabolism
  Homolog annotation: Query=3..333bp; Hit=59..361bp; Blast score=97; Percent Identity=25.0; E value=1e-20; Homolog= CC3196 COG0845
MHVSTTTMQAVQFTPSIKILGAIVAKNEIVISPALPQHIITEVLVEEGDYVKKGEVLATLETLVQDEKVKQAKAELEKALALIKQNEAMSNQAQSELKRVKPLVNTGVISASEFDKYKMQANSSSSALNAAKAEYRQLQAQLEGEKTQRAKTTIFAPREGVISERTAMAGMITDSSQLFKLIENNQHEFSAEAYISALKQINTGIPAAISLTSGSKITGKVRYISPKINPVTQIGKIRIALENVPADVKLGDFGHALFQLKPEKVNAIPYSAVNMGNKNKPSVYVVGKNNAVEKKEINTGRIFDNWIEIKSGLSPKDKIIVSASPFLQEMDTVAIMPQGK

SEQ ID NO: 5528 - protein, 1908 aa, Xenorhabdus bovienii
  Peptide sequence Name=Xb4151_4152.C399.gene3.pep
  Homolog annotation: Query=127..1089bp; Hit=58..977bp; Blast score =449; Percent Identity=32.0; E value=1e-124; Homolog= gi|26246313|ref|NP_752352.1| Putative adhesin [Escherichia coli CFT073] gi|26106711|gb|AAN78896.1|AE016756_79 Putative ad
MLKKQRKQWTTQQRLRQVAWVNIFAQVAFPVAGVFTPAVAADKTPRHSQATRPQTLQTESYRLAAGESIKSVAKRHGLTVTELKKLNQLRTFHKPFTALGAGDEIDVPKSPSGHLLAESLTQAAAAESPVSHTENNTERWLASTASRAAGMLKGGHVLDSAKNQLRGMAMSEANQTVQNWLQHYGTVKLQANVDDRGRLDGSQFDMLLPLYDTEKQMAFTQFGLRHIDSRTTANFGLGQRHFFDTGMLGYNAFLDHDITRDHTRFGLGAEYARDFMKFGANGYFRASGWKDGKKLKDYEERPASGFDLRAEGYVPSYPQLGGKLIYEQYFGDEVGLLSEERRQKDPAAFTLGASYTPIPLVTLGLDRRQSTSGGGETLFNLGLNYEIGTPWSKQVDPDAVAFKRNLQGGRYDLVERNNQIVLEYRKKNLIRLMMENRINGRGGAVIPLNVNVSAQHGLKEIVWDTAGLVAGGGKLDSVNAPARAENLAAAPVRGGTRYLLTLPPFHDKGNNTYTLSGIAYDTQGNASERMETLIQVVSSAVNPDGSGFEPAEKSMVADGKTQTVIRLKLTDKDGKPVSGVAGNLKLTDDKTTLTGDGKDPELGTEVREVPEGSGIYEITATAGTKHGKWKITPTIDGHELTPTVIDFGSSLAEMIDTDRTEFKPENGNLNQEGDSTDLVLNLKDKDGNPITGAADKITLTDDKNELYGQNPAPSLGAVREDPPGSGIYKAKVTAGQKKGTWKITPAVEGRTLKPAIITFGQSLTDIVDTGGSTFTPATNILAANNEDSTVMTLHLKDKSGKPILNAKDSITFEDNGDKLSGDGQNKPTIDKVWEEPENSGIYKVKVKAGDKTGQWKITTRIDGKPLDTPTEITFGSSKAELIDPDKSEFIPEKGELPNEGDTTVIKLNLKDKDGNPITGAENSINLIPDNHELYGQGQMPTTGTAKEIPPGSGTYAIPVTAGAKKGQWTLTPEVFGKPLKRPATLTFGQSLADVLDTQGSTIELADGSNTLAADGVSTKTLRVVLKDKQGKPVTGAKDSIRVNAAGQLPGEGQDPQIGDVKEVSDGVYEVVVTAGQKTGHWTLTTTVDGTEMKKETVIEFNENKAPAVNNLQLNGILHINETLYARYQFEDKGGNTTDRSFYVWGDKGTTAKQVMALADAAGVKEPVLTQKNGEGRVTAGAADNEKVKYVIARSDAGKVLEVSILAANGANLRAKAPVTTDITDPAANQGLTGGNGKGGVADPDAKPGIDKIVLSGDLEINQPLTAEYTFNGNGGDATDLSQFAWHDKGTPAADYQPVPDNGKNAQDKTGKVTRTLEQADAGKTVAITVKPVNGNNEVGEAKTVDIGMTDTNINQTTPKGAKPGTILDPNAIPSIKNVVLHGYRSVNSTLKATYEFEPNNGYVEDKTTYTWRRVATIGGTPEDISKQGATGTVDGQGGQIESYKLSDDDIDKFVEIVLTPKNGRSKPGTDILKNSGQNEGNELQGGNTIGQIIDPSRGPGIADLKIHGKLAVDEELTATYKFEAKGGHDQDNSLFLWGIKYPEGDPDYNKSPEFLVEQFNSDDKDHIVPPNNTNTIPGYRLKPEDSGRVIQVAIQARSKLARGKSYNRDTRQEAAEGNNLEGNKDGTVKGVASDFTITPDKPEKDADGTMAVKVERDKTITLTVKTENGGQAVGGIPVTIKMTAINRQKKADTVTVNLEAKEGVLAGKEDTYRGHTDEKGYLVINVTDPNGIGTRTTLSVEVNGEANQTLTKTWDVIFTVLTSPDTPKANYWGHMEDYITLNGIKYSRPQLNAELNGESKLTRNREIWGMAQWIIVKDYCNKLGELPTRDQLMDIHNAYQNRTLYDTNGWPINSLNGFGLNIWSSSLWNPNIDINITVVDIISGKEGSAGNAGNHGGGDYSVICRIKN

SEQ ID NO: 5529 - protein, 222 aa, Xenorhabdus bovienii
  Peptide sequence Name=Xb4151_4152.C399.gene4.pep
  Gene classification: Gene name=XerC; Function=Integrase; Function class=L DNA replication, recombination and repair
  Homolog annotation: Query=3..197bp; Hit=9..197bp; Blast score=214; Percent Identity=54.0; E value=5e-56; Homolog= fimB COG0582
MLKRKYLTQSEIEMLLTESGKHAHAARNICMMFMGFIHGFRVSELLSLKLSDVDLDSRSLRVQRLKNGFSTIHPMVSREIQLLRQWLKGRPNYLPGTPQANSEVSDWLFLSRSGQRMSRQQVYKIIRQTSLKAKLSICANPHMLRHACGYALADNGVDTRLIQDYLGHRNIRHTVRYTASNAGRFETVWDGKGKRKQLTISTKLSTKGFLSENEEIAEKQTR

SEQ ID NO: 5530 - protein, 45 aa, Xenorhabdus bovienii
  Peptide sequence Name=Xb4151_4152.C399.gene5.pep
MKLDLRTDRFSGYGITLEQLRAFVYVTRCLVLTFDGLGFISKIAF

SEQ ID NO: 5531 - protein, 196 aa, Xenorhabdus bovienii
  Peptide sequence Name=Xb4151_4152.C399.gene6.pep
  Gene classification: Gene name=AcrR; Function=Transcriptional regulator; Function class=K Transcription
  Homolog annotation: Query=4..161bp; Hit=6..160bp; Blast score=77; Percent Identity=32.0; E value=9e-15; Homolog= uidR COG1309
LSKQTEKQRAKRKQIIDAAISCFIEKGFHATSTAEICKAAGMSPGNLFHYYPTKNAIIAAIAEEDSHDYDKILHTDDDENSVMATIEKMMISLIHLYNQPDYARLSIEIIAEASRNPTINKIFIENEKKIRERLALLIRKGIETGEIDKQINAEQTASWLMITAGGAIGRELVEPNFKWLDSMDSFTYIIRKIFAS

SEQ ID NO: 5532 - protein, 59 aa, Xenorhabdus bovienii
  Peptide sequence Name=Xb4151_4152.C399.gene7.pep
MPVSGAGLAFSVIGGLLSSPLLSLLFVPVFYSYMDDFKNFITPYLKKLTSVTKDDIDYH

SEQ ID NO: 5533 - protein, 153 aa, Xenorhabdus bovienii
  Peptide sequence Name=Xb4151_4152.C400.gene1.pep
  Gene classification: Function=Transposase; Function class=L DNA replication, recombination and repair
  Homolog annotation: Query=30..147bp; Hit=226..343bp; Blast score=123; Percent Identity=50.0; E value=7e-29; Homolog= mlr4143 COG3547
MISFIQEQLKVIESALSKHIKTYHRSKLDLLSTVKGVGPATIATLIADVPELGKLTRREISALIGVAPFNRDSGFFRGKRTIFGGRAMVRRMLYMATLTAIRFNPVLCAFYKRLTEAGKPNKVAIVACMRKLLVILNAMIKTNRPWDESFHTV

SEQ ID NO: 5534 - protein, 47 aa, Xenorhabdus bovienii
  Peptide sequence Name=Xb4151_4152.C400.gene2.pep
MKEMVREARLELAHLAAPEPKSGASTNFATPAKMVATTGIEPVTPAL

SEQ ID NO: 5535 - protein, 407 aa, Xenorhabdus bovienii
  Peptide sequence Name=Xb4151_4152.C400.gene3.pep
  Gene classification: Gene name=NagC; Function=Transcriptional regulators; Function class=K Transcription
  Homolog annotation: Query=7..405bp; Hit=6..404bp; Blast score=584; Percent Identity=73.0; E value=1e-167; Homolog= nagC COG1940
MSNHNAQKQIGNIDLVKQLNGAVVYRLIDQHGPISRIQIAEESQLAPASVTKITRQLLERGLIKEVEQQASTGGRRAISIITETHHFHTIGVRLGRHDATVALFNMSGKTLVEQHYSVPENTQQEVENRIISAIEDFIEKNQRRLRELIAISVILPGLVDPDDGVIRYMPHIKVDNWPLVKNLNNHFNISCFVGHDIRSLALAEHYFGATRNYEDSLLVRIHRGTGAGVIINKNILRNKRGNLGEIGHIQIEPLGERCHCGNFGCLETIVSNSAIETRVQHQLRQGFPSQLALNNCNIHAICLAANEGDPLAVEVIRQVGHYLGKGISIAINLFNPQKIVIAGDITEAEQVLLPAIQSCINTQVLKAFREDLPVVVSELNHCSAIGAFALTKRAMLNGVLLQHLLGG

SEQ ID NO: 5536 - protein, 387 aa, Xenorhabdus bovienii
  Peptide sequence Name=Xb4151_4152.C400.gene4.pep
  Gene classification: Gene name=NagA; Function=N-acetylglucosamine-6 -phosphate deacetylase; Function class=G Carbohydrate transport and metabolism
  Homolog annotation: Query=1..384bp; Hit=1..379bp; Blast score=540; Percent Identity=67.0; E value=1e-154; Homolog= nagA COG1820
MYALTNCVIYTGYERLDNHAVIIADDLIQHVCPVNELPEHIEKHDLQGANLSPGFIDLQVNGCGGVQFNERLEDLTEDTLNIMQKTNQRYGCTSFLPTLITSPDELMITAIEVMRSYLTKHPNQALGLHLEGPYINPIKKGTHNPAYIRKPTSEMVNYLCINADVITKITLAPEIVESKYIHQLTEAGIIVSAGHSNATYEEARHGFQHGISFSTHLYNAMPAISGRQPGLISAIYDSSEVYAGIICDGMHVSWPNIRNSKRLKTDKLILVTDAIVPAGLDPKTNTLEQFTFANKTIYYRNGLCVDENGTLSGSSITMIESVKNSVEYVGIALDETLRMVTLYPARAIGVDKRLGTIEPGKVANLTAFTHDFNICKTIVNGNEIELS

SEQ ID NO: 5537 - protein, 268 aa, Xenorhabdus bovienii
  Peptide sequence Name=Xb4151_4152.C400.gene5.pep
  Gene classification: Gene name=NagB; Function=6 -phosphogluconolactonase/Glucosamine-6-phosphateisomerase/deaminase; Function class=G Carbohydrate transport and metabolism
  Homolog annotation: Query=1..261bp; Hit=1..261bp; Blast score=435; Percent Identity=75.0; E value=1e-122; Homolog= nagB COG0363
MRLIPLTNASDVGRWSAHYIVSKINKFNPTAEHPFVLGLPTGSTPLTTYRELIALYQAGKVSFRHVVTFNMDEYVGIPEDHPQSYHTFMYQSFFSHIDIPKENINLLNGNAADIDAECLRYENKIKSYGKIHLFMGGVGNDGHIAFNEPASSLSSRTRIKTLTIETRTANSRFFNNDVEQVPKYALTVGVGTLMDAEEVMILATGMNKALALQAAIEGNINHMWTVSCLQMHPKSIIVCDEPATMELKVKTVKYFRQLEADILSEFAS

SEQ ID NO: 5538 - protein, 677 aa, Xenorhabdus bovienii
  Peptide sequence Name=Xb4151_4152.C400.gene6.pep
  Gene classification: Gene name=PtsG; Function=Phosphotransferase system IIC components, glucose/maltose/N-acetylglucosamine-specific; Function class=G Carbohydrate transport and metabolism
  Homolog annotation: Query=1..395bp; Hit=1..393bp; Blast score=537; Percent Identity=71.0; E value=1e-152; Homolog= PM0876_1 COG1263
VNILSYLQRIGRALMVPVATLPAAAILVGIGYWIDPTGWGADNALAALLITSGNAILNNMGMLFAIGLAYGMSKDKDGAAALAGLIGFIVVINLCAPASIAMIKSIPIDEVPKAFGKINNQNQFVGILVGVLSAELYNRYSSVELPQALSFFSGRRLVPILNSFLMILVSFILMFIWPVVYDWLVAFGESITNLGSTGAGIYAFFNRLLIPVGLHHALNSVFWFDVAGINDIPNFLGGQKSIEAGTAIAGITGRYQAGFFPIMMFGLPGAALAIYHCARPENKAKVAGIMIAGAIAAFFTGVTEPLEFSFMFVAPVLYVLHAILTGISVYIAATMEWIAGFGFSAGFVDMLLSSRNPLAVKWYMLIPQGLVFFCLYYVVFRFTIKKFNLMTPGRELSATDETDGYDVDTAKQGRNGVNNIQEEARQYIAAVGGSDNLTGIDSCISRLRLSVKDSGLVNNRLTRHLGASGIIRLNKQNAQIIVGTRAELIASAMKEVLAKGPVAAIIETQYSESDVQTKEDSQQTGIPILTLIAPVTGELVKLEDVPDEAFSSKLVGDGIAIKPTSDTVFSPIAGTVVKIFDTNHAVCIAADNGVEVIVHIGIDTVTLNGRGFERLIEEGVTVKAGEPLLKLDLEYLNAHAKSMISPVIISNIDDYSGVIIIAKDSVIARESNLFQVI

SEQ ID NO: 5539 - protein, 213 aa, Xenorhabdus bovienii
  Peptide sequence Name=Xb4151_4152.C400.gene7.pep
  Homolog annotation: Query=11..206bp; Hit=45..255bp; Blast score=121; Percent Identity=31.0; E value=1e-26; Homolog= gi|21224365|ref|NP _630144.1| hypothetical protein SC1C3.21 [Streptomyces coelicolor A3(2)] gi|7479383|pir||T34713 hypothetic
MSEFLSEEKMEQYLKSWDDNGYIVIESAVSREQTQKTVDAIFYFLEMDKNDPVNFYNTDIRSRSGIDEMGRIPFYHHQTLWDNRQSQIIYSVYEKIFGIKELLVSIDRVNMNPPVNDDWKYEGFIHWDIDVSKRPLESKIQGLLSLTDDDGNSGGFQCVPGFHKVIYEWLSKQPEGYNSRFPDTTGMKIVSIPLKAGDYVIFHGALPGHVLNG

SEQ ID NO: 5540 - protein, 91 aa, Xenorhabdus bovienii; identical to SEQ ID NO: 5467
  Peptide sequence Name=Xb4151_4152.C400.gene8.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 5541 - protein, 96 aa, Xenorhabdus bovienii; identical to SEQ ID NO: 5468
  Peptide sequence Name=Xb4151_4152.C400.gene9.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 5542 - protein, 329 aa, Xenorhabdus bovienii
  Peptide sequence Name=Xb4151_4152.C400.gene10.pep
  Gene classification: Gene name=XerC; Function=Integrase; Function class=L DNA replication, recombination and repair
  Homolog annotation: Query=1..317bp; Hit=8..327bp; Blast score=342; Percent Identity=49.0; E value=4e-94; Homolog= Z1835 COG0582
MTAELNKLSDKKLKILHGRKNDKIEFFADGASLSAKVSKVGGISWVFTYRLDGKKLNRLTIGRYPDMSLKQAREIRTKCRNWLVSGKDPKLQFNLTMQESLNPVTVKKAIEYWIENYGKDNRVNIDKHISQLQKHIYPYIGNMALSDCETHYWLQCFDRIKQAAPMTSGIIFQLCRQAIKFCRVRRYAISNALDDLTILDVGKKQNKGQRYLKDNELGQLWQSLNTNVNLPYYSNFLRVLIVFGCRSQEVRLSKLSEWDFDSMLWTVPKENSKSGEKIIRPIPECLKPFLEKLIYQNHKSGYLLGEIKRSGSVSQYGGNIWKKLGSCIK

SEQ ID NO: 5543 - protein, 238 aa, Xenorhabdus bovienii
  Peptide sequence Name=Xb4151_4152.C400.gene11.pep
  Gene classification: Gene name=LexA; Function=SOS-response transcriptional repressors (RecA-mediated autopeptidases); Function class=K Transcription
  Homolog annotation: Query=2..233bp; Hit=5..230bp; Blast score=156; Percent Identity=39.0; E value=1e-38; Homolog= Z0309 COG1974
MKKKLTTEQLADAKRLKRIFVLRQKQLGISSQDAFADEFGMTQSAVSHYLNGVNALNLERAADFANKLGVSIADFSPSLDQQARKLLKAVYGDDPTFATHQHPQKQYPLLNWANAGNWCEEPAPLYPENDIEQWHETSIECSPHAFWLEVKGDSMASSNELNIQQGMIILIDPDVKPMANNLVVAKLEGEKELTFKQLITEGYDAYLKPLNPQYNMIPLNEKVHIVGVVIEAKIAKLP

SEQ ID NO: 5544 - protein, 316 aa, Xenorhabdus bovienii
  Peptide sequence Name=Xb4151_4152.C401.gene1.pep
  Gene classification: Gene name=SdaC; Function=Amino acid permeases; Function class=E Amino acid transport and metabolism
  Homolog annotation: Query=1..316bp; Hit=87..403bp; Blast score=367; Percent Identity=68.0; E value=1e-101; Homolog= tyrP COG0814
MLFLMYALTSAYISGAGELLTSSINEWTGSSFSLSTGVILFTLIAGAVVCIGTSSVDFINRIFFSAKLIFLILMLGLMMPHIHHVNLLSLPVEQGLVLSAIPVIFTSFGFHGSVPSIVRYMKGDIRKLRWIFIIGSAIPLAAYIFWQLGTLGSIAPTSFMGILAEKSGLDGLLSAIRHVVASPQTELSVRMFANLALVTSFLGVALGLFDFLADLFKRQDNIAGRFQTGLLTFVPPLIFALFYPKGFIMALGYAAAALSILALLLPSILVFKVRQQHKRQYRVFGGTPALVVVFLCGIILIAIQIGIVAGILPEVG

SEQ ID NO: 5545 - protein, 180 aa, Xenorhabdus bovienii
  Peptide sequence Name=Xb4151_4152.C401.gene2.pep
  Homolog annotation: Query=1..180bp; Hit=1..180bp; Blast score=244; Percent Identity=71.0; E value=5e-64; Homolog= gi|37526955|ref|NP _930299.1| hypothetical protein [Photorhabdus luminescens subsp. laumondii TTO1] gi|36786388|emb|CAE15441.1|
MKSFIAVSMASLFFVSGVANAISMNVQAGKHYTSTSVGLGDKSAGLSLNGNWTRSDHNGQIGSLGTAFALPVGPITASVGGKVLYLSPKEGKDGVALAAGAGLSWAVLPSLSLYGEAYGAPSGLTSGVDSYTEATGGIRYTLFKPLTVDAGYRVIDLQGKNGNRNNKVSEGFYIGAGFSF

SEQ ID NO: 5546 - protein, 474 aa, Xenorhabdus bovienii
  Peptide sequence Name=Xb4151_4152.C401.gene3.pep
  Gene classification: Gene name=CaiC; Function=Acyl-CoA synthetases (AMP-forming)/AMP-acid ligases II; Function class=I Lipid metabolism
  Homolog annotation: Query=6..458bp; Hit=3..447bp; Blast score=455; Percent Identity=54.0; E value=1e-128; Homolog= menE COG0318
MSLAEWTQWPWHHWAMLYPEKQAVRLHEETLSWRQLAEKINAIAAHFHQQGLWESSSVILRGKNSADLLLCYLSALQCGARVLPLNPQLPEPLLAELLPHLNMTFVIDFTDPPSSAIQAIKLDWQPELSVIPEQWVPWDIHRPASMILTSGTSGLPKAAVHSIGAHLASAQGLLSCMDFQPNDSWLFSLPLFHVSGQGILWRWLLKGAELVLRDLNPLDRALSGCTHASLVPTQLWRLLEQSFEHALTLKAVLLGGAMIPTELTQQAEQLGIHCWCGYGLTEMASTVCAKRADSLSGVGNPLPGKDIRLVDEDIQIRADSIALGYWLDGKLNPLADTDGWFSTRDRGIFEQGELRILGRLDNQFFSGGEGIQPEDIERIINQHPQILQNFVVPIPDSEFGHRPVVVIETQHPALTETLADWLTDKLAAFQRPVVCYLLPVQLKNGGIKISRQQVKQWVLEKWVISKVIYKPDDV

SEQ ID NO: 5547 - protein, 331 aa, Xenorhabdus bovienii
  Peptide sequence Name=Xb4151_4152.C401.gene4.pep
  Gene classification: Gene name=DgoA; Function=O-succinylbenzoate synthase and related enzymes; Function class=H Coenzyme metabolism
  Homolog annotation: Query=1..323bp; Hit=1..317bp; Blast score=410; Percent Identity=63.0; E value=1e-114; Homolog= ZmenC COG1441
MRKATLYSFSLPMEAGIILRYQRLKTRDGFLVHLQENERHGWGEISPLPEFSHETLEQAKNAAVTWLQQWCQNEQGLTVEPEESEPPSVAFGISCALAELQGELPEEADYRKAPLCTGDPDDVILRLGNMTGQKIAKVKVGLYEAVRDGMVVDVLLEAVPDLQLRLDANRSWTRIKADDFAKYVNPDYRQRIAFLEEPCKTCEESLAFARDTGIAIAWDESVREAGFTVEAQEGVAAIVIKPMLVGSIVRCRQLVADAHQAGLEAVISSSIETSFGLTQLARLAHWLTPDTLPGLDTLDLIQSQLIRGWPESPIPCVVLDDLDTVWSNECH

SEQ ID NO: 5548 - protein, 285 aa, Xenorhabdus bovienii
  Peptide sequence Name=Xb4151_4152.C401.gene5.pep
  Gene classification: Gene name=MenB; Function=Dihydroxynaphthoic acid synthase; Function class=H Coenzyme metabolism
  Homolog annotation: Query=1..285bp; Hit=1..285bp; Blast score=551; Percent Identity=89.0; E value=1e-157; Homolog= ZmenB COG0447
MLYPNEEKLYAPIEWQDCSQGFNDILYHKSVDGIAKITINRPQVRNAFRPLTVKEMIQALADARYDDEVGTIILTGMGEKAFCAGGDQKIRGDYGGYQDDNGMHHLNVLDFQRQIRTCPKPVVAMVAGYSIGGGHVLHLMCDLTIAADNAIFGQTGPKVGSFDGGWGASYMARIVGQKKAREIWFLCRQYDARQALDMGLVNTVVPYADLEKEAVRWCREMLENSPMALRCLKAALNADCDGQSGLQELAGNATMLFYMTEEGQEGRNAFNEKRPPDFSRFKRNP

SEQ ID NO: 5549 - protein, 268 aa, Xenorhabdus bovienii
  Peptide sequence Name=Xb4151_4152.C401.gene6.pep
  Gene classification: Gene name=MhpC; Function=Predicted hydrolases or acyltransferases (alpha/beta hydrolase superfamily); Function class=R General function prediction only
  Homolog annotation: Query=15..264bp; Hit=3..250bp; Blast score=219; Percent Identity=48.0; E value=3e-57; Homolog= yfbB COG0596
MLARVTETGGCIVKLASQVFHSDKPGTWLVWLHGLLGCGDEWLPLVNACSQYASLVIDLPGHGHSTDITVAGGFAEMNDLLNETLFKHQIHDYWLIGYSLGGRIAMYHATYGKHEGLRGVLVEGGNPGLFSQQERDARLQHDQCWVRRFREESMETVLADWYQQPVFADLSSEQREQLIHCRSQNRGSRIADMLESTSLGHQPWLVPALQHITTHFAYLCGENDEKFQNIAKQYTLPLKTIPQVGHNAHNGNPAAFAAEVNHFLSLFG

SEQ ID NO: 5550 - protein, 562 aa, Xenorhabdus bovienii
  Peptide sequence Name=Xb4151_4152.C401.gene7.pep
  Gene classification: Gene name=MenD; Function=2-succinyl-6-hydroxy -2,4-cyclohexadiene-1-carboxy late synthase; Function class=H Coenzyme metabolism
  Homolog annotation: Query=1..562bp; Hit=1..556bp; Blast score=756; Percent Identity=66.0; E value=0; Homolog= menD COG1165
MSNSVLNRRWAELLLEALTRHGLRHVCIAPGSRSTPLTLSAAGNAKLICHTHFDERGLGYLALGLAKASKEPVAVIVTSGTAVANLYPSLIEAGLTGEQLVFLTADRPPELIDCGANQAIRQIGIFASHPTQALSLPRPTTEISASWLVSVVDNGMSNLKQGSLHINCPFAEPLYGNDVIAYQDWQQTLGEWWQGNQPWLRQSETYVTSTVRDWGLWQNKRGVVLTGRMNAEEGPLVAQWSRKMGWPLISDVLSQTGQPLPCADLWLNHPRVQEILAQAQLVIQFGSSLTGKRLLQWQAECQPEEFWIVDPIVGRLDPANHQGRKFTCYVADWLREHSADSTQESTSFGWADELTSWSEQALECVNARLDGKFGEAAVAYQLHRLLPEQGQLFVGNSLIVRLIDALGQLPAGYPVYSNRGASGIDGLIATAAGVQRATNKPTLAIIGDLSALYDLNSLTLLRDLSAPMILIVVNNNGGQIFSLLPTPEETRQRFYCMPQHVNFDHAAAMFGLNYVTPQSWSELKQRVKQAWEQKTTTLIELKVTDSEGVRCLQELRKQVAAL

SEQ ID NO: 5551 - protein, 294 aa, Xenorhabdus bovienii
  Peptide sequence Name=Xb4151_4152.C401.gene8.pep
  Homolog annotation: Query=Organism:..Xylellabp; Hit=fastidiosa..bp; Blast score=; Percent Identity=; E value=; Homolog= Pa|Phot2 -44g08.q1ka_g133| 95195 - 96187 1233 330 aa, chain +
MLIFRQNYRFLLAIFILLVSLAADVYGSEGSCRIKDERKQQDLSAVFQPKVFISRNDMPGAVIYRHPVISNPQDILGIHCDKPEKISWKFIGYTPTSSRNDDTYDSGVSGIGIRMYGSNIELIKTNPKTGTGPIKNGMIQAYVGSTIVHTYHIHDALVTTESCILAKENIIVPMGSIGMWELSGNPRTAGAQDFSIDLDCDDNIPITLKFEGNTVSNDNRILALDQRGSNSTAGGIGLQILYQDQPVMINSVLKVGTSPMGIYSVPFKAHYIQIENMITAGQANATAKVSIIYN

SEQ ID NO: 5552 - protein, 849 aa, Xenorhabdus bovienii
  Peptide sequence Name=Xb4151_4152.C401.gene9.pep
  Gene classification: Gene name=FimD; Function=PapC-like porin protein involved in fimbrial biogenesis; Function class=N Cell motility and secretion
  Homolog annotation: Query=42..827bp; Hit=24..840bp; Blast score=627; Percent Identity=42.0; E value=1e-179; Homolog= Z4968m COG3188
MSKNIKHNIAKRLCEGKYYRLWLSIFIMIGSFSYHFKSYAENNFNIHALRIGDNFPDDIDLSIFNTSTQPPGKYWVDTYLNKESIDTGNVEFILNDGELRPKLTVQKLQDLGVKINAFPVLMNLPSEEVITNISEYIPSASTKFDFNRQRLDISIPQIALNHQVRGYISPESWDQGMTALLVNYHYSGSTNWQDNRRTNQNNYLNLQTGVNWQAWRLRNYSTYTSQHKNWRSIKSYLQRDIHALKGQLIVGDSFTPSYLFDGIEFRGIQLASDENMLPDSMKGFAPVVSGIAQSHAQVTIKQNGYVIYQTYVAQGPFVLTDLYPTTTSGNLEIIIKEADGRERRFIQPFSAAPIMLRKDSLKYSLTMGHYRSPYSRSRKPYFFQGTLIYGLHNNLTAYGGVMLSRDYQSMVLGSGIDLGNVGSLSFDATHANTQLPSDKKSQGQAYRLQYLKALSLTGTNLTVAGYRYSTKGFYDFDDANHADNLNSNHRLFGRINKKSKLQVQVNQILGDFGGLYVTAFQQDYWGQSSHERGLGAGYNMSHRGINYGLNYTYSRTPDSGNHDQLFSFSVHVPLDRWLKNSWASYSLTSGKNSPASQQVSLNGTVLEDNNLHYSLQQSYTNQGDGVSGNIYAGYKGAYGRLNAGYNYQHHGRQMNYGVSGGIIAHPYGLTFSQELGETAVLVRAEGAKGVKVANNTGVTTDGNGYAVVPYASSYRKNRVALDPHSFADDVDIDINTQFVVPTKGALTLANFQTRIGSRVLMFLSYQGQSVPFGAIATLEKQHDLDKPSSTIVSSEGQAYFTGMPTRGKLQVKWGSQNTKTCLANYTLPEKQTLSGHPLSGINTMKVNCE

SEQ ID NO: 5553 - protein, 207 aa, Xenorhabdus bovienii
  Peptide sequence Name=Xb4151_4152.C401.gene10.pep
  Gene classification: Gene name=FimC; Function=PapD-like chaperone involved in fimbrial biogenesis; Function class=N Cell motility and secretion
  Homolog annotation: Query=1..203bp; Hit=22..226bp; Blast score=171; Percent Identity=40.0; E value=4e-43; Homolog= yraI COG3121
MAGGVVIGGTRVVYLSDKKEVSVSVNNLEKESVYLIQSWIQDENEKTKTPFIVTPPLFKLPANNENILRIIKVSDGLPMDRESIFWLNVTSIPETVKSNADVNQLQIVVNSRLKLFYRPTQLEENSGEAYKRIKFRKENGVLIAENSTPYFISFSHLKVDGKEVEGAGMVNPFSQANWPLPVKNAKSVSWKAINDYGGVTQEEFAGL

SEQ ID NO: 5554 - protein, 173 aa, Xenorhabdus bovienii
  Peptide sequence Name=Xb4151_4152.C401.gene11.pep
  Gene classification: Gene name=FimA; Function=Pilin; Function class=N Cell motility and secretion
  Homolog annotation: Query=1..172bp; Hit=1..198bp; Blast score=112; Percent Identity=37.0; E value=1e-25; Homolog= Z5225 COG3539
MKFKLIISSLFVSSLFATTANATIGTVNFKGEITDKTCEIDAASANQTVNMGKVSVKEFSGENKVAAATKFSIKLTECPTEIKNALVKFDGSSHESKGKLLALTTDSKNAKGVAIGIYEDNSDNLVGLYKDSKSYAIEKGAAELPFIAKYVATSDNVSAGSANAVARFTVVYN

SEQ ID NO: 5555 - protein, 92 aa, Xenorhabdus bovienii
  Peptide sequence Name=Xb4151_4152.C401.gene12.pep
  Gene classification: Function=Transposase; Function class=L DNA replication, recombination and repair
  Homolog annotation: Query=4..92bp; Hit=3..91bp; Blast score=82; Percent Identity=40.0; E value=8e-17; Homolog= insA_g5 COG3677
MTVTIEVTCRYCDQAEPVRKHGTGKAGFPRYYCKGCQRTFQLNYRYNGHKPDMKEKIVDMAMNGSGVRDTGRVLGLGINTVMRTLKNSRQNK

SEQ ID NO: 5556 - protein, 124 aa, Xenorhabdus bovienii
  Peptide sequence Name=Xb4151_4152.C401.gene13.pep
  Homolog annotation: Query=1..123bp; Hit=1..124bp; Blast score=167; Percent Identity=67.0; E value=4e-41; Homolog= Pa|Phot3-163e06.p1k _g5| 5346 - 5720 221 124 aa, chain +
MYDWSGAVPAKLEKGQPTGLILKAGDVISIVAKGWVKYGHPDNYWAAPQGTLPKKPTLHDTLIAKIGNKTYGIGNGVLHKTVPEDGELIFVFFDSPGNYGDNSREFLVNVKIESRYSPLEEIKK

SEQ ID NO: 5557 - protein, 91 aa, Xenorhabdus bovienii; identical to SEQ ID NO: 5467
  Peptide sequence Name=Xb4151_4152.C401.gene14.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 5558 - protein, 96 aa, Xenorhabdus bovienii; identical to SEQ ID NO: 5468
  Peptide sequence Name=Xb4151_4152.C401.gene15.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 5559 - protein, 157 aa, Xenorhabdus bovienii
  Peptide sequence Name=Xb4151_4152.C401.gene16.pep
  Gene classification: Function=Transposase; Function class=L DNA replication, recombination and repair
  Homolog annotation: Query=3..149bp; Hit=2..148bp; Blast score=137; Percent Identity=46.0; E value=5e-33; Homolog= PA2319 COG3547
MQNVTLIGIDLGKHSFHVHCQDKSGKALLRKKFTRARLMEFLAGSPSATVVMEACAGAHFMARRIAAFGHEAKLISPQFVRPFVKSNKNDFVDAEAICEAASRPSMRFVQPRTEAQQAMRALHRVRESLVRDRVKTTNQMHAFLLEFGISMPIGTAV

SEQ ID NO: 5560 - protein, 860 aa, Xenorhabdus bovienii
  Peptide sequence Name=Xb4151_4152.C402.gene1.pep
  Gene classification: Gene name=ClpA; Function=ATPases with chaperone activity, ATP-binding subunit; Function class=O Posttranslational modification, protein turnover, chaperones
  Homolog annotation: Query=1..860bp; Hit=5..861bp; Blast score=1371; Percent Identity=82.0; E value=0; Homolog= ZclpB COG0542
MRLDRLTNKFQLALADAQSLALGRDNQFIEPIHLMSALLHQEGGSVRPLLTLAGVDTSSINNQLNQALGRLPKVEGNGGDVQVSNELGRYLNLCDKLAQKAGDNFISSELFVLAAIEERGTLSDILKAVGTTKDKIAKAIEQMRGGEKVSDQGAEDQRQALKKYTIDLTERAEQGKLDPVIGRDEEIRRTIQVLQRRTKNNPVLIGEPGVGKTAIVEGLAQRIINAEVPEGLKNKRVLSLDMGALVAGAKYRGEFEERLKGVLNDLAKQEGSVILFIDELHTVVGAGKADGAMDAGNMLKPALARGELHCVGATTLDEYRQYIEKDAALERRFQKVYVAEPTVEDTIAILRGLKERYELHHHVQITDPAIVAAATLSHRYISDRMLPDKAIDLIDEAGASLRMQMDSKPEALDRLERRVIQLKLEQQALKKESDDGSKKRLEMLNMELVEKEREYSELEEEWKAEKAELTGTQNIKAELENTRLELEKARRSGDLAKMSEIQYGKIPELEKRLATAATAATAESHHMKLLRNKVTDAEIAEILARWTGIPVSRMLESEKDKLLSMEHELHKRVIGQNEAVEAVSNAIRRSRAGLSDPNRPIGSFMFLGPTGVGKTELCKALANFLFDSDDAMVRLDMSEFMEKHTVSRLVGAPPGYVGYEEGGYLTEAVRRRPYSVILLDEIEKAHPDVFNILLQVLDDGRLTDGQGRTVDFRNTVIIMTSNLGSDIIQERFGALDYTGMKDMVMEVVGHHFRPEFINRVDEVVVFHPLGKEHLTSIANIQLQRLYHRLEERGYQVTMTSTALEKLSDAGFDPVYGARPLKRAIQQEIENPLAQKILSGKLIPGKLVTLDLENDHIIAKQ

SEQ ID NO: 5561 - protein, 243 aa, Xenorhabdus bovienii
  Peptide sequence Name=Xb4151_4152.C402.gene2.pep
  Gene classification: Function=Uncharacterized ACR; Function class=S Function unknown
  Homolog annotation: Query=1..242bp; Hit=1..242bp; Blast score=319; Percent Identity=61.0; E value=2e-87; Homolog= ZyfiH COG1496
MTPLIFPDWPQLDNVGACSTTRLGGVSLPPYDSLNLGNHVGDDSKCVERNRKLLVEYAQLPQQPVWLEQVHGTRVINLDGQPVKDNQADAVYTNIPGQVCAVMTADCLPVLFCTIAGNEIAAAHAGWRGLCTGVLENTVTQFSAKPEMIRAWLGPAIGPEKFEVGREVMDAFVVTNPELEQAFTPYGNKFLANIYLLAKLKLQSIGINEVFGGAVCTATEERNFFSYRRDGNTGRMATLIWLR

SEQ ID NO: 5562 - protein, 325 aa, Xenorhabdus bovienii
  Peptide sequence Name=Xb4151_4152.C402.gene3.pep
  Gene classification: Gene name=RluA; Function=Pseudouridylate synthases, 23S RNA-specific; Function class=J Translation, ribosomal structure and biogenesis
  Homolog annotation: Query=1..325bp; Hit=1..325bp; Blast score=527; Percent Identity=81.0; E value=1e-150; Homolog= sfhB COG0564
MAQKIRLNATVAETQLGQRLDQALAELFSDYSRSRIKEWILDNKVQVNGKLINKPKEKVLGGEVISIDAIIEEDARWEPQDIELNIVYEDDDILVINKPRDLVVHPGAGNPDGTVLNALLYRYPAIADVPRAGIVHRLDKDTTGLMVIAKTVPAQTRLVESLQLREITREYEAIALGCMTAGGMVEEPISRHPTKRTHMAVHPMGKSAVTHYRVMEHFRAHTRLRLRLETGRTHQIRVHMAHIKHPLVGDPLYGGRPRPLKGASDEFREVMRNFDRQALHATMLRLYHPISGIEMEWHAELPDDMVKLIDVMKADAETFKDEMDW

SEQ ID NO: 5563 - protein, 244 aa, Xenorhabdus bovienii
  Peptide sequence Name=Xb4151_4152.C402.gene4.pep
  Gene classification: Gene name=NrfG; Function=TPR-repeat-containing proteins; Function class=R General function prediction only
  Homolog annotation: Query=2..242bp; Hit=1..241bp; Blast score=333; Percent Identity=69.0; E value=7e-92; Homolog= yfiO COG0457
VMIRMKYLVAAATLSMVLSGCSNNKDAVPDIPQSQIYSAGQKHLQEGNYKGAIKQLESLDNRYPFGPYSQQTQLDLIYAYYKSAEFPMALASIDRFMRLNPTHPNIDYVIYLRALISQALDDNTLQSFFGIDRSDRDPEHARASFRDFNLLVSRYPNSQYTSDAAKRLVFLKERLAKYELAVVKYYTKRSAYVAVVSRVEQMLRDYPDTQATREALPYMEASYKELGLMAEADKVAKLIAANPV

SEQ ID NO: 5564 - protein, 110 aa, Xenorhabdus bovienii
  Peptide sequence Name=Xb4151_4152.C402.gene5.pep
  Gene classification: Function=Ribosome-associated protein Y (PSrp-1); Function class=J Translation, ribosomal structure and biogenesis
  Homolog annotation: Query=1..110bp; Hit=1..110bp; Blast score=155; Percent Identity=75.0; E value=7e-39; Homolog= yfiA COG1544
MLVNITSKQMEITPAIRSHIEDRLNKLNKWQVNLISPHIVLTKEPQGFLADATIGIPNNTLVASAKHEDMYAAINELLTKLERQLNKVQHKGEARRADHSVKDSNFDIEV

SEQ ID NO: 5565 - protein, 384 aa, Xenorhabdus bovienii
  Peptide sequence Name=Xb4151_4152.C402.gene6.pep
  Gene classification: Gene name=PheA; Function=Prephenate dehydratase; Function class=E Amino acid transport and metabolism
  Homolog annotation: Query=109..383bp; Hit=1..275bp; Blast score=402; Percent Identity=68.0; E value=1e-112; Homolog= pheA_2 COG0077
MERNLVNIREEISSIDADLLDLLGKRRQLACDIAQTKLLEHRPVRDKDRERELLNVLINKGKIHGLDGFYITRLFQMIIEDSVLTQQALLQQHLNQTPYDSARITFLGPKGSYSHIAARQFSARHFNQLIECSCHKFPDIFSLVEIGQADYGILPLENTSSGAINDVYDLLQQTPLFLVGEITLPINHCLLIGTETDTSKIKTVYSHSQPFQQCNQYLNQFPHWKIVYCESTAAAMQKVAGLNSSEVAALGSEAGGALYKLRVLENNLANQQNNSTRFIVVAKKPIDVSNQVPAKTTFIMSTGQQAGALVDTLIILKKHDIIMSKLESRPINGKPWEEMFYIDVQANLRSMKMQQALKELSEITRFLKVLGCYPSENVTSIDPC

SEQ ID NO: 5566 - protein, 373 aa, Xenorhabdus bovienii
  Peptide sequence Name=Xb4151_4152.C402.gene7.pep
  Gene classification: Gene name=TyrA; Function=Prephenate dehydrogenase; Function class=E Amino acid transport and metabolism
  Homolog annotation: Query=101..372bp; Hit=1..272bp; Blast score=407; Percent Identity=71.0; E value=1e-114; Homolog= ZtyrA_2 COG0287
MVAKLSQLREQIDEADKALLALLAKRMYLVAEVGEIKSQLGLPIYVPEREASMLASRRQEAEAMGIPPDLIEDILRRIMRESYVSENDKGFKKLSTHLMPVVIIGGSGKMGRLFSRLLTLSGYEVRVLESGDWDKAEHILADAGMVIVSVPIHLTEEVIRRLPPLPEQCVLVDLASIKQRPLKAMLDVHQGPVLGLHPMFGSDVGSFAKQVVVYCDGRQPEAYQWFLEQISVWGARLHQISAEQHDKNMSFIQALRHFTTFSYGRHLAKEDIDLQQLISLSSPIYRLELAMVGRLFAQDPQLYADIIMSSPENIELIRRYHQSFGQAIEMLESQDKSAFIANFNQVNEWFGDEATRFMKESQSLLQQASDSRI

SEQ ID NO: 5567 - protein, 364 aa, Xenorhabdus bovienii
  Peptide sequence Name=Xb4151_4152.C402.gene8.pep
  Gene classification: Gene name=AroG; Function=3-Deoxy-D-arabino -heptulosonate 7-phosphate (DAHP) synthase; Function class=E Amino acid transport and metabolism
  Homolog annotation: Query=3..356bp; Hit=1..354bp; Blast score=533; Percent Identity=72.0; E value=1e-151; Homolog= aroF COG0722
MIMQKGALNNIHILGEQIFITPEELKQKYPLSRNDLHTITNARNTIADIIQHRDPRLLVVCGPCSIHDVDAALDYARRLKVLSAELSDCLYIVMRVYFEKPRTTVGWKGLISDPHMDGSFDIDAGLHIARSLLMNLVKMGLPLANEALDINNPQYLGDLFSWSAIGARTTESQTHREMASGLSVSVGFKNGTDGNLNTAINAMKAAAMPHCFMGISQSGQVCLLQTQGNPNGHVILRGGAEPNYSSEHVADCENQMIKAGLTPSLMIDCSHGNSNKDFRRQSIVVDSVAEQIMSGNRSIIGIMLESNIHEGNQPSEQLRSEMKYGVSVTDACINWQTTEQVLRKLHQQIAPRFAKRNMMMEKAG

SEQ ID NO: 5568 - protein, 117 aa, Xenorhabdus bovienii
  Peptide sequence Name=Xb4151_4152.C402.gene9.pep
  Gene classification: Gene name=RplS; Function=Ribosomal protein L19; Function class=J Translation, ribosomal structure and biogenesis
  Homolog annotation: Query=1..115bp; Hit=1..115bp; Blast score=190; Percent Identity=97.0; E value=2e-49; Homolog= rplS COG0335
MSNIIKQIEQEQMKQDVPSFRPGDTVEVKVWVVEGSKKRLQTFEGVVIAIRNRGLHSAFTVRKISNGEGVERVFQTHSPVVDSISVKRRGAVRKAKLYYLRERSGKAARIKERLNAR

SEQ ID NO: 5569 - protein, 250 aa, Xenorhabdus bovienii
  Peptide sequence Name=Xb4151_4152.C402.gene10.pep
  Gene classification: Gene name=TrmD; Function=tRNA-(guanine-N1) -methyltransferase; Function class=J Translation, ribosomal structure and biogenesis
  Homolog annotation: Query=1..247bp; Hit=1..247bp; Blast score=426; Percent Identity=87.0; E value=1e-119; Homolog= trmD COG0336
MWIGVISLFPEMFRAITDYGVTGRAVKNGLLSIECWSPRDFTYDRHRTVDNRPYGGGPGMLMMVQPLREAIHAAKAAAGVNAKVIYLSPQGRKLDQQGVCELAENEKLILVCGRYEGIDERVIQTEIDEEWSIGDYVLSGGELPAMTMIDSISRFIPGVLGHQASAEEDSFADGLLDCPHYTRPEVLDGMEVPPVLLSGNHAEINRWRMKQSLGRTWLRRPELLESLALTDEQRMLLSEFQQEYQDQATS

SEQ ID NO: 5570 - protein, 182 aa, Xenorhabdus bovienii
  Peptide sequence Name=Xb4151_4152.C402.gene11.pep
  Gene classification: Gene name=RimM; Function=RimM protein, required for 16S rRNA processing; Function class=J Translation, ribosomal structure and biogenesis
  Homolog annotation: Query=1..182bp; Hit=4..185bp; Blast score=304; Percent Identity=78.0; E value=4e-83; Homolog= rimM COG0806
MSKQTGLEPPVDPIVLGKLGSTYGIRGWLRVFSSTERTEDIFEYQPWFIQRSGQWQHVELETWKYHNQDLIIKIKDIDDRDAANLFTNCEVVVDSTKLPELETGDYYWKDLMGCQVISIAGYNLGTINDMMETGSNDVMVIKANLKDAFGIKERLVPFLDGQVIKKVDLATKTIEVDWDPSF

SEQ ID NO: 5571 - protein, 85 aa, Xenorhabdus bovienii
  Peptide sequence Name=Xb4151_4152.C402.gene12.pep
  Gene classification: Gene name=RpsP; Function=Ribosomal protein S16; Function class=J Translation, ribosomal structure and biogenesis
  Homolog annotation: Query=1..82bp; Hit=1..82bp; Blast score=120; Percent Identity=79.0; E value=3e-28; Homolog= rpsP COG0228
MVTIRLARGGAKKRPFYQVVVTDSRNARDGRFIERVGFFNPIASGQAEALRLDLDRIEHWVGLGASVSDRVSALIKDAKKSAKAA

SEQ ID NO: 5572 - protein, 453 aa, Xenorhabdus bovienii
  Peptide sequence Name=Xb4151_4152.C402.gene13.pep
  Gene classification: Gene name=Ffh; Function=Signal recognition particle GTPase; Function class=N Cell motility and secretion
  Homolog annotation: Query=1..453bp; Hit=1..453bp; Blast score=713; Percent Identity=87.0; E value=0; Homolog= ffh COG0541
MFDNLTDRLSRTLRNISGRGRLTEDNIKDTLREVRMALLEADVALPVVRDFISRIKENAVGHEVNKSLTPGQEFVKIVQNELVKAMGEVNSELNLSAQPPAVVLMAGLQGAGKTTSVAKLGKLLKEKNKKKVLVVSVDVYRPAAIKQLETLSEAVDIDFFPSDPQEKPVDIANKAIQHAKLKFYDVLLVDTAGRLHVDEAMMDEIKAVHAAINPVETLFVVDAMTGQDAANTAKAFNEALPLTGVVLTKVDGDARGGAALSIRHITGKPIKFLGVGEKTDALEPFHPDRIASRILGMGDVLSLIEEIESKVDRTQAEKLASKLKKGDGFDLNDFLDQLKQMRNMGGMTSMLSKMPGMSQIPDAVKSQMDDKVLVKMEAIINSMTRKEREKPEIIKGSRKRRIASGSGTQVQDVNRLLKQFDEMQRMMKKMKKGGLAKMMKGMKGMLPPGFMGR

SEQ ID NO: 5573 - protein, 131 aa, Xenorhabdus bovienii
  Peptide sequence Name=Xb4151_4152.C402.gene14.pep
  Gene classification: Gene name=CcmC; Function=ABC-type transport system involved in cytochrome c biogenesis, permease component; Function class=O Posttranslational modification, protein turnover, chaperones
  Homolog annotation: Query=1..116bp; Hit=26..142bp; Blast score=104; Percent Identity=52.0; E value=2e-23; Homolog= ypjD COG0755
MPVFSIIALLAYLISLMLIVPGLLRQQNSYQKLALLFSIMALINHAIALKYQIFHVSSGQNLTLLNLGSIVSLLMSTIMTVVAFRGRAWFLQPIVYSFAMTNLMLASMVPGAFITHGDLLESNLRVYATLV

SEQ ID NO: 5574 - protein, 231 aa, Xenorhabdus bovienii
  Peptide sequence Name=Xb4151_4152.C403.gene1.pep
  Gene classification: Gene name=BioD; Function=Dethiobiotin synthetase; Function class=H Coenzyme metabolism
  Homolog annotation: Query=1..225bp; Hit=1..225bp; Blast score=307; Percent Identity=67.0; E value=7e-84; Homolog= bioD COG0132
VTNKYFLTGTDTEVGKTVVSCALLQAANKQGYQTAGYKPVASGSEITSEGIRNGDALALRRNSSVSLTYQEVNPLVFVEPTSPHIVSAALNQPIEFEVISQGLERLTAKSDWILVEGAGGWYTPLSENTTFADWVIQEELPVILTVGVKLGCINHAVLTAKAIQHSGLRLAGWIANEIEPAGKRQTEYLATLERMIPAPLLGIIPHLSESSDNNNIGEYIILFLVTIVTGT

SEQ ID NO: 5575 - protein, 257 aa, Xenorhabdus bovienii
  Peptide sequence Name=Xb4151_4152.C403.gene2.pep
  Gene classification: Gene name=SmtA; Function=SAM-dependent methyltransferases; Function class=Q Secondary metabolites biosynthesis, transport and catabolism
  Homolog annotation: Query=8..253bp; Hit=4..248bp; Blast score=195; Percent Identity=47.0; E value=4e-50; Homolog= ZbioC COG0500
MDLAVKAVDKQAIAGAFGRAASRYDTAAKLQQQTGEYLMELAQAENLGIRVLDAGCGTGFFSARWKQQGKQVIALDLASGMLNHAQEQQVADHYLQGDIEHLGLADNSVDICFSNLAVQWCNELPCALQEFYRVTRPGGLILFSTLVQGSLCELEAAWGQVDTYRHINQFLPLQAITDACQAYRHKIISQQYCQYYPQLLSLLNSLKGIGATHLHHGRQHGLMTRKRLNTLAEAYPRNNEDYPLSSQIAFEVIYCDK

SEQ ID NO: 5576 - protein, 383 aa, Xenorhabdus bovienii
  Peptide sequence Name=Xb4151_4152.C403.gene3.pep
  Gene classification: Gene name=BioF; Function=7-keto-8 -aminopelargonate synthetase and related enzymes; Function class=H Coenzyme metabolism
  Homolog annotation: Query=1..382bp; Hit=1..384bp; Blast score=437; Percent Identity=63.0; E value=1e-123; Homolog= ZbioF COG0156
MNWSDTISRRLTERRGTSLWRSRQVHLGSDGRLLHTSDGQYLNFSSNDYLGLSQHPQIIAAWQQGAEQYGVGSGGSGHVTGYTAVHHTLEQQLAEWLGYSRALLFISGYAANQGVIAALMEKDDRVIADRLSHASLIEAAMHSPAQFRRFLHNDPNSLKQNLAKDCAGKTLVVTEGIFSMDGDCAPLASLAQQTKSTGSWLMVDDAHGIGIHGEQGRGSCWAQNVKPEILIVTFGKAFGLSGAAVLCDEQTAEYLIQYARHLIYSTSMPPAQAVALSEAVRQIKEGDELRQRLQNNIRYFRREAHHLPFTLMDSETAIQPLIIGDNERCIALSHTLRQQKVWVKPILPPTVPLESARLRITLTASHTQQDIEILLEALHGSGC

SEQ ID NO: 5577 - protein, 346 aa, Xenorhabdus bovienii
  Peptide sequence Name=Xb4151_4152.C403.gene4.pep
  Gene classification: Gene name=BioB; Function=Biotin synthase and related enzymes; Function class=H Coenzyme metabolism
  Homolog annotation: Query=1..345bp; Hit=1..344bp; Blast score=572; Percent Identity=79.0; E value=1e-163; Homolog= bioB COG0502
VSERQQWTVKQAQALFDQPFFELLFQAQQVHREHFDPQQVQVSTLLSIKTGACPEDCKYCPQSSRYKTGLEKERLMEVEQVIESARKAKNAGSTRFCMGAAWKNPHERDMPYLETMVKEVKELGMETCMTLGMLNQTQAQRLAEAGLDYYNHNLDTSPEFYGNVITTRSYQDRLNTLGNVRDAGIKVCSGGIVGLGEQIRDRAALLVQLANLPKPPESVPINMLVKVKGTPLENNDDVDPFDFIRTIAVARIMMPASHVRLSAGREQMNEQTQAMCFMAGANSIFYGCKLLTTPNPNEDKDLQLFRRLGINPQQTQTAFGDNQQQQNLTEAIINNVDYEQFYNAAV

SEQ ID NO: 5578 - protein, 422 aa, Xenorhabdus bovienii
  Peptide sequence Name=Xb4151_4152.C403.gene5.pep
  Gene classification: Gene name=BioA; Function=Adenosylmethionine-8 -amino-7-oxononanoateaminotransferase; Function class=H Coenzyme metabolism
  Homolog annotation: Query=1..421bp; Hit=1..421bp; Blast score=644; Percent Identity=74.0; E value=0; Homolog= bioA COG0161
MNPSDLEFDLRHIWHPYTSMTHPLPTYPVVSAAGVELELSDGRRLIDGMSSWWAAIHGYNHPVLNEAAKSQIDRMSHVMFGGIIHPPAIELCQQLVAMTPAALECVFLADSGSVAVEVALKMALQYWQAKGEKRHRFLTLRHGYHGDTFGAMSVCDPDNSMHNLYKGYLPNHLFADAPQSRFEGEWQPEDITSFRQLLLQHHNEIAAVVLEPIVQGAGGMRIYHPEYLRQVRKLCDEYQILLIADEIATGFGRTGKLFACEHAQIEPDILCLGKALTGGYMTLSATLATRHVAETISQGEAGCFMHGPTFMGNPLACAVASANLKLLSDSQWQPRIQSIEAQLKVELLPLKSHTTVKDVRVLGAIGVVEMKQPVDMASLQRRFVQHGVWIRPFGRLIYLMPPYIIRSEQLSKLTNAINDVII

SEQ ID NO: 5579 - protein, 190 aa, Xenorhabdus bovienii
  Peptide sequence Name=Xb4151_4152.C403.gene6.pep
  Homolog annotation: Query=1..190bp; Hit=1..191bp; Blast score=177; Percent Identity=50.0; E value=8e-44; Homolog= gi|6137238|gb|AAF04395.1|AF191556_3 unknown [Xenorhabdus nematophila]
MSDEKSIMPSNEEMQATFSLSKEMHEKEISHHSTVAREIPELAHLFVKNPNVISSTGYGAGLIEYISGSFNLNTFQQYGSYPFIQISSHSAIIGYAPNVGQRVKFNGYVNAGHIIPIINWNNFYFAGTVHNVRSIINVQLTIQLYINQQNIFIRLFDGNIYLGDLVSVYRPNAIIPVPMVISGVGSFSLI

SEQ ID NO: 5580 - protein, 328 aa, Xenorhabdus bovienii
  Peptide sequence Name=Xb4151_4152.C403.gene7.pep
  Gene classification: Function=3-carboxymuconate cyclase; Function class=G Carbohydrate transport and metabolism
  Homolog annotation: Query=1..327bp; Hit=1..330bp; Blast score=348; Percent Identity=53.0; E value=6e-96; Homolog= ybhE COG2706
MKQVVYTASPNSSQIHVWSLNIVGELSLLQTVNVPGEVQPMVVNPDGKHLYVGIRPQFSIVTYAIGFDGRLEQQAIAPLPGSPTHISTDRAGRFLYSASYGFNKLSVHPIDENGIVKAPVQIVEGLQAPHSANIDRENRQLLVPCLKEDHIRIFNLDEQGYLIENRADEISTVAGAGPRHMVFHPEKSAIYCINELDATVDVLRKWDKYRIVQSVDSLMADFSSVRWSADIHMTPDGRHLYTCERSESLISHFRVSEDGYHLTLVGNYPTESQPRGFAIDHSGSFLIASGQKSDHISVSRIDKYSGKLTQLARYPVGKGPMWVTVLAL

SEQ ID NO: 5581 - protein, 271 aa, Xenorhabdus bovienii
  Peptide sequence Name=Xb4151_4152.C403.gene8.pep
  Gene classification: Gene name=Cof; Function=Predicted hydrolases of the HAD superfamily; Function class=R General function prediction only
  Homolog annotation: Query=1..271bp; Hit=1..272bp; Blast score=321; Percent Identity=57.0; E value=5e-88; Homolog= ybhA COG0561
MSYRVIALDLDGTVLDPQKRILPESLAALNEARQAGVKVLIVTGRHHVAIHPFYQALQLDTPAICCNGTYSYDYHAKKVLDSNPLSTQEAVQVLSYLQGTEIQHLMYVDDAILYQFHDTISRTLAWSDSLPEHQRPNLQQVNSFQDAIYNVNCIWKFATSSPNVVKLREISEQIEEKVGLECEWSWVDQVDITKKGNSKGMRLKQWVESQGISMKEVIAFGDNFNDISMLETAGLGVAMENAADAVKEHADIVTRDNTQPGIAEVIRKYVL

SEQ ID NO: 5582 - protein, 383 aa, Xenorhabdus bovienii
  Peptide sequence Name=Xb4151_4152.C403.gene9.pep
  Gene classification: Gene name=CysA; Function=ABC-type sulfate/molybdate transport systems, ATPase component; Function class=P Inorganic ion transport and metabolism
  Homolog annotation: Query=30..379bp; Hit=1..350bp; Blast score=432; Percent Identity=64.0; E value=1e-121; Homolog= modC COG1118
MCDCDRAGIGFIDAFRVADPLGQKTSGGSMLELEFEQRLGNLHMQVDTTLPTESITAIFGLSGAGKTSLINVIAGLSRPQRGRIVLNGRTLVDIEQKIFLPPEKRRMGYVFQDARLFPHYCVKGNLQYGMSPDMKPQFDNIIGLLGIEHLLSRFPMTLSGGEKQRVAIGRALLTAPEILLMDEPLASLDLPRKRELLPYLEKLSADVKIPLLYVSHNLDEILRLADNVIVMDKGKVRATGTLEEVWSNSILRPWLQKESLSSILTVSVMEHHQRYHMTAVAVGDKALWLPKMDAAPGTDLRIRVDASDVSLVLEPPKVSSIRNTLQVKVIEFFEDDGQVDVKLALREYFLWARITSWAREELNLRSGQWLYAQIKSVSLNQPL

SEQ ID NO: 5583 - protein, 232 aa, Xenorhabdus bovienii
  Peptide sequence Name=Xb4151_4152.C403.gene10.pep
  Gene classification: Gene name=CysU; Function=ABC-type sulfate/molybdate transport systems, permease components; Function class=P Inorganic ion transport and metabolism
  Homolog annotation: Query=3..229bp; Hit=2..228bp; Blast score=274; Percent Identity=75.0; E value=5e-74; Homolog= modB COG0555
LEMLSEYEWQAILLSLKISGISVLFSLPLGILMAWVLARCQFFGKSLLDSIIHLPLVLPPVVVGYLLLLSMGRRGVIGEFLYDWFGISFAFSWTGAALASAVVAFPLMVRAIRLALESIDRRLEQAARTLGASSLKVFFTITLPLSLPGVIVGAVLAFARSLGEFGATITFVSNIPGETRTIPLAMYTLIETPGAETAAARLCVIAIVLALVSLMLSEWLTRWGRKRLGAAC

SEQ ID NO: 5584 - protein, 256 aa, Xenorhabdus bovienii
  Peptide sequence Name=Xb4151_4152.C403.gene11.pep
  Gene classification: Gene name=ModA; Function=ABC-type molybdate transport system, periplasmic component; Function class=P Inorganic ion transport and metabolism
  Homolog annotation: Query=1..254bp; Hit=1..255bp; Blast score=313; Percent Identity=62.0; E value=2e-85; Homolog= ZmodA COG0725
MKKSLYQLLTGAVVYFALVGNSWSAEKVTVFAAASLTNALNDIAVQYKKEQQGDIVASYASSSTLARQIEHGAPADIFVSADQQWMDYVAGKKLIADNTRHTLLGNQLVLIAPKESKLDKIDIDRETKWKSLLADGRLAVGDPDHVPVGIYAKESLQSLGAWEVVNPLMARTNNVRSGMALVERAEVPLGIVYGSDAVASKKVKVVGIFPSESHKPVEYPIAIIKGHENQAVRDFYDYLKTPEAAVIFKHYGFSPL

SEQ ID NO: 5585 - protein, 46 aa, Xenorhabdus bovienii
  Peptide sequence Name=Xb4151_4152.C403.gene12.pep
MFELIGSMAFALIMVPVVMALILGLIYGLGAVFNVISKTGNTERQP

SEQ ID NO: 5586 - protein, 62 aa, Xenorhabdus bovienii
  Peptide sequence Name=Xb4151_4152.C403.gene13.pep
MSDHNSAKKLTVQHSALFFLNGKTVLHDTGGDLTILDNKKVTVTDETCDSYGHPVRNSQIFA

SEQ ID NO: 5587 - protein, 263 aa, Xenorhabdus bovienii
  Peptide sequence Name=Xb4151_4152.C403.gene14.pep
  Gene classification: Gene name=ModE; Function=N-terminal domain of molybdenum-binding protein; Function class=R General function prediction only
  Homolog annotation: Query=1..263bp; Hit=1..262bp; Blast score=289; Percent Identity=65.0; E value=2e-78; Homolog= modE COG2005
MQAEILLILKLQQRLFADPRRIELLKQIKITGSISQGAKQAGISYKSAWDAINEMNHLADEVLVERATGGKGGGGAQLTHYGERLLQLYDLLERIQQKAFDVLKEDSLPLDSLLAAISRFSLQSSARNQFFGTIVERDHENIQQHVRILLADGKTSISAALTEQSANRLKLVKGKEVLALIKAPWITLSKEPVTATPFDNALSGQVSLIETGTEHSEVILTLDGGESLCVTLANQEMERSGLQPNDFVTALFNADKVIIATLC

SEQ ID NO: 5588 - protein, 494 aa, Xenorhabdus bovienii
  Peptide sequence Name=Xb4151_4152.C403.gene15.pep
  Gene classification: Gene name=ModF; Function=ABC-type molybdenum transport system, ATPase component/photorepair protein PhrA; Function class=P Inorganic ion transport and metabolism
  Homolog annotation: Query=1..484bp; Hit=1..484bp; Blast score=680; Percent Identity=67.0; E value=0; Homolog= modF COG1119
MSELQITQGSFRLSDTRTLRLPSLKIISGENWAFVGANGSGKSSLARALSDELIQLAGERHCSFNTPVHLSFEQLQQLIDEEWQRNNTDLLSEDEEDTGRTAAEMIQLHHKDNELCLELAAYFGIKDLLSRRFKYLSTGEVRKVLLCQTLMANPDLLILDEPFDGLDTYAQNQLSQLLRSLATKGITLVLILTRFHEIPDFIEQIGVLADCHLTRTGKKENILSESLVAQLAHSETLKDIHLPETDEYRADEQLPEDQPRVSMCNVVVQYNDKPILHGLNWQINPDEHWQIIGENGAGKSTLLSLITGDHPQGYNNKLILFGRQRGSGETIWDIKRHIGYVSNSIHLEYRVSTCVRNVILSGFFDSIGLYQAVSDQQQQLADEWLALLGFSETIANSPFHSLSWGQQRLVLIARALVKHPTLLILDEPLQGLDPLNRQLVLRFIDIMIANGDTQLLFVSHHQEDAPECITHRLKFIPDGYIYRYETEDISQQSL

SEQ ID NO: 5589 - protein, 275 aa, Xenorhabdus bovienii
  Peptide sequence Name=Xb4151_4152.C403.gene16.pep
  Gene classification: Function=Predicted metal-dependent membrane protease; Function class=R General function prediction only
  Homolog annotation: Query=1..268bp; Hit=2..269bp; Blast score=202; Percent Identity=44.0; E value=4e-52; Homolog= Z1787 COG1266
MSWALLAVSLALLDTRRIIAFSIAFLALIVGISTNVLTFPAVAALIVIAGLGTAHVYLKKHPTFRIITEVLLLISVVLLFMHYIPGFNNLKYLDKVQVGPLSAPFSMYFNFDKALIPFILLFCMPSLFTRKPVADAFPHVWAALIVAIPALLGLATELGGLAVELHLPSWFPAFVIANIFFVSLAEEALFRGYLQQKLSQWMNPYSALVITSLIFGAAHFAGGSLLMIFATLAGLIYGLAWMWSGRLWVAVAFHVSLNLGHLLFFTYPVKSLLIQ

SEQ ID NO: 5590 - protein, 250 aa, Xenorhabdus bovienii
  Peptide sequence Name=Xb4151_4152.C403.gene17.pep
  Gene classification: Gene name=GpmA; Function=Phosphoglycerate mutase 1; Function class=G Carbohydrate transport and metabolism
  Homolog annotation: Query=1..250bp; Hit=1..250bp; Blast score=404; Percent Identity=81.0; E value=1e-113; Homolog= gpmA COG0588
MAVTKLVLVRHGESEWNKENRFTGWTDVELSDKGRTEAQQAGQLLKQEGFAFDFAYTSVLKRAIHTLWNILDQVDQQWLPVEKNWKLNERHYGALQGLDKAETAAKYGDDQVKLWRRGFAITPPDLAKDDERYPGHDPRYANLKPEELPATESLAATIERVVPYWEDVIKPRVANGEKIIIAAHGNSLRALVKYLDGMSEEEILELNIPTAVPLVYEFDENMRPIKHYYLGNADEIAAKAAAVANQGKAK

SEQ ID NO: 5591 - protein, 350 aa, Xenorhabdus bovienii
  Peptide sequence Name=Xb4151_4152.C403.gene18.pep
  Gene classification: Gene name=AroG; Function=3-Deoxy-D-arabino -heptulosonate 7-phosphate (DAHP) synthase; Function class=E Amino acid transport and metabolism
  Homolog annotation: Query=1..350bp; Hit=1..350bp; Blast score=600; Percent Identity=82.0; E value=1e-172; Homolog= aroG COG0722
MNYQNDDIRIKKITELLPPVALLEKFPATRNTATTVREAREAIHNVLTGEDDRLLVVIGPCSIHDPKAALEYAERLNKLRGELKADLEIVMRVYFEKPRTTIGWKGLINDPNMDCSFDINDGLRTARKLLIDINDMGLPAAGEFLDMITPQYLADLMSWGAIGARTTESQVHRELASGLSCPVGFKNGTDGTIKVAIDAINAASSPHCFLSVTKWGHSAIVSTTGNQDCHIILRGGKEPNYSAEHVSVVKEELMKAGLAPRVMIDFSHANSSKQFKRQMDVNDDVCDQIARGERAIIGVMVESHLVEGSQNLDSDKPLVYGQSVTDACIGWDDTEMLLRQLSQSVKARRG

SEQ ID NO: 5592 - protein, 234 aa, Xenorhabdus bovienii
  Peptide sequence Name=Xb4151_4152.C403.gene19.pep
  Gene classification: Gene name=PnuC; Function=Nicotinamide mononucleotide transporter; Function class=H Coenzyme metabolism
  Homolog annotation: Query=1..234bp; Hit=1..234bp; Blast score=254; Percent Identity=67.0; E value=8e-68; Homolog= ZpnuC COG3201
MDFFSIKSILVHIPLGADGYDLSYIEAVGTIAGLLCIWLASQEKIINYLFGLINVFLFAVIFFQIQLYASLLLQIFFFAANIYGWYAWSRVNEQKQIELKIRWLNPKQTIAVAAVSIFVILVMMFNIDQIFGYMAKIVVFALQGMGFNIAMPALEPDAFPFWDSVMTVLSIVAMVLMTRKHVENWLVWVIINVISVVIYFHQGVLAMSLQYIILTGIALNGARLWITAAKPNGS

SEQ ID NO: 5593 - protein, 902 aa, Xenorhabdus bovienii
  Peptide sequence Name=Xb4151_4152.C404.gene1.pep
  Gene classification: Gene name=BaeS; Function=Signal transduction histidine kinase; Function class=T Signal transduction mechanisms
  Homolog annotation: Query=6..689bp; Hit=13..700bp; Blast score=417; Percent Identity=34.0; E value=1e-116; Homolog= ZyojN_1 COG0642
MYKQASIKPSTIPRFYALFIILLFTSLFLFGYNYFDSWLTDKKYAISSVTVKMRLQIENYRYHANHIFEQSNIPLSASSQEATSLFKLRPDVHWLESRYKTVDAIIFGQYNHSSIQLAQRLSNYLEILWGSRNEYESMYYLNGKDNNLLLVTTHPILKPEIRFKESYLTLTSEAKRTEMLAQSIALDEKESISAINVLRGENIYFYTYKAAFNLPGQLTTVIAFELPINNLLPIDMSPANFRLNLTNLHDAEGSNKVEVSLNGFWLEFSQNLNAMPYELVYQVPLKALVIDLLIRNMWLLFSILLFAMFSLSGLFYIRRRYITPNASMDHELKIKDSLGNDIISNIPIGLLIYDFSSNRLITSNKIAEQLIPYLDLNKVKAMAQQHHGVIQTSIDDANYEVKMYNSNLLPETYLFLLQDRDQEVMINRRLQLANREYDKTVQARRSMLSNINNEIKIPIQSLNEIAAQLKQISQDENMQNLLDKLLVKSEYITKWVENISLLNELESGDWQSATEIFSLSSRLEHILKASLSTLNAKGLKIYYHFNFHHESLFIGDGVAITKIVSLLFNYAITTTSYGKISLSINSSGEYDNCIQIDLIDTGSGLSEKDLISLNYPFLNKSAEDKYYTNSGLTFYLCNQLCKKMGGNFEIKSKLGLGTHYVINLPLSQHSDNNGETPQLLQGVTALIDISNPEISKIIHNYLNNYGASYFDKIKGNVTEEYDIIFTDMQCKVEKPTILLVDGLADFKQIKPNLVKCNYNFVDAVINAISLLVEENFSLDESCYALETPKSECNVVSSVDNILKGYQTQLADSDYRKLFIETVPMDITKLYTDMERHDLTLLSQTVHRLKGAFAMLDLKLLKLSCEALEQHIADNNEIEIENSISRIDSFVTKLLQQGNQEYE

SEQ ID NO: 5594 - protein, 216 aa, Xenorhabdus bovienii
  Peptide sequence Name=Xb4151_4152.C404.gene2.pep
  Gene classification: Gene name=CitB; Function=Response regulator containing a CheY-like receiver domain and an HTH DNA-binding domain; Function class=T Signal transduction mechanisms
  Homolog annotation: Query=1..210bp; Hit=1..210bp; Blast score=351; Percent Identity=87.0; E value=3e-97; Homolog= rcsB COG2197
MNNLNVIIADDHPIVLFGIRKSLEQIEWINVVAEFENSTTLINNLPHIEADVLITDLSMPGDKYGDGITLIKYIKRHYPTLAIIVLTMNNNPAILSAVLELDIEGIVLKQGAPTDLPRALSALQKGKKFTPESVSKLLEKVNANGYGDKPLSPKESEVLRLFADGLLVTDIAKKLNRSIKTISSQKKSAMLKLGVDNDIALLNYLSSVTIEKDIGR

SEQ ID NO: 5595 - protein, 921 aa, Xenorhabdus bovienii
  Peptide sequence Name=Xb4151_4152.C404.gene3.pep
  Gene classification: Gene name=BaeS; Function=Signal transduction histidine kinase; Function class=T Signal transduction mechanisms
  Homolog annotation: Query=1..692bp; Hit=8..699bp; Blast score=681; Percent Identity=49.0; E value=0; Homolog= rcsC_1 COG0642
MLWVLGALLTSFYLVNIFNEVKSDIRQEYNTNYDTMFSYIRHTTNTLRDIQYMTEKHLSQKNEKDLTITLPYNNPAFSYTPLNMNSDCDLLRKSTHSYLDSLNNLILFWKDNIAAPRGLNQIFLVGTQSMCMVSFSVRSTITEPETLKKMVYENFRKLIILKEQGKERNVFWVMPNTRADSGTFYILAPIYTNGQMTAVIGIEQAIRLDSFLPTRNRPISITMLNHYNQPELYYPVKNDNKFRYADYNIQTPYFGYDEGFSNLLLKRRLAPSSFNVVFSLPLKYIYSELKVTIINSIVLNLIFTILIIFFVWLFERKIFSPAEENAIRLEEHEQFNHKIVASAPVGISILRINDGANILSNELAHNYTRMLTYEDQKRIVDIICDKTSSYIDVVTSNNNHLQISFVHSRYRNEEVAICVLVDISTRVKMEQSLQEMASAAEQANQAKSMFLATVSHELRTPLYGIIGNLELLQSHTLPSESARLLSAMNNASSLLLKIISDILDFSKIESKQLKIDSKKFSCKEIVLHVISNYLPLIVKKELGLYCYIEPDIPDIINNDPVRLQQIISNLLNNAIKFTETGSVVITISIKHSYLYISIKDTGVGIEDKLQTQLFEPFFQINANKQTFSQGTGLGLAICEKLINLMDGDIEFISQQYIGSIFSIRLPLYGAKYHTKAYSKNRTQQKIVLAVRNDYLEKYLQNFLTKNYFQIALYDKSKIDGTELVILDQPDVLDIAVRYYIEISEKHIGPPKQIREHYWLHNTYQLIELDSVIDKLLSKNNHISPATISMSTSIRADSRLSTIKILVVDDHPLNRHLLIEQLNTIGFRTASANDGIDAIEHLKNNSTDIILTDVNMPNMDGYELTKYLRDKGYTSPIIGITANALAEEKQRCADAGMDYCLSKPVSLATLRDTLIEYSDIQS

SEQ ID NO: 5596 - protein, 880 aa, Xenorhabdus bovienii
  Peptide sequence Name=Xb4151_4152.C404.gene4.pep
  Gene classification: Gene name=GyrA; Function=DNA gyrase (topoisomerase II) A subunit; Function class=L DNA replication, recombination and repair
  Homolog annotation: Query=1..880bp; Hit=1..866bp; Blast score=1380; Percent Identity=80.0; E value=0; Homolog= gyrA COG0188
MSDIAREITPVNIEEELKSSYLDYAMSVIVGRALPDVRDGLKPVHRRVLFAMNVLGNDWNKSYKKSARVVGDVIGKYHPHGDSAVYDTIVRLAQPFSMRYMLVDGQGNFGSVDGDSAAAMRYTEVRMAKIAHELLADLEKETVNFVPNYDGTEQIPDVMPTRIPNLLVNGSSGIAVGMATNIPPHNLSEVVDGCLAYIDDENISIEGLMEYIPGPDFPTAAIINGRRGIQEAYRTGRGKIYIRARAKIETDEKNGRETIIVNEIPYQINKARLIEKIAELVKDKRIEGISALRDESDKDGMRIVIEVKRDAVAEVVLNNLYSLTQLQVSFGINMVALHQGQPKLLNLKDILSAFINHRREVVTRRTIFELRKARERAHILEALAVALVNIDSAIELIRRASTPAEAKANLIAQAWELGNVSAMLEQAGDDAARPEWLEPEYGIHDGKYYLTEQQAQAILDLRLQKLTGLEHEKLLDEYRELLKLIGELLFILENPERLREVIREELLAIKDQYNDARRTELTENSADINIEDLINQEDVVVTLSHQGYVKYQPLSDYEAQRRGGKGKSAARIKEEDFLERLLVANTHDTILCFSNKGKMYWMKVYQLPEASRGARGRPIVNLLPLEQEERITAILPVREYEDGLNIFMATASGTVKKTKLSEFSRPRSAGIIAVKLSDGDELIGVDLTDGSNEVMLFSAKGKVVRFLEEDEETLEDGTIRVKGVRAMGRTAAGVRGIKLSAGDKVVSLIIPRGEGEILTVTENGYGKRTAQSEYPTKSRATQGVISIKVSERNGDVIGAIQVETTDQIMMITDAGTLVRTRVSEVSVVGRNTQGVTLIRTTEDEKVVGLQRVAEPDDDEDEENNITSPSDEGNSESEDQV

SEQ ID NO: 5597 - protein, 64 aa, Xenorhabdus bovienii
  Peptide sequence Name=Xb4151_4152.C404.gene5.pep
MCESGVLTFISDIAPKNCFTESCSTENVTVLWGCVIRGYYTCLNLEIPASGFYKTVNLWYNLNL

SEQ ID NO: 5598 - protein, 244 aa, Xenorhabdus bovienii
  Peptide sequence Name=Xb4151_4152.C404.gene6.pep
  Gene classification: Gene name=UbiG; Function=2-polyprenyl-3-methyl-5- hydroxy-6-metoxy-1,4-benz oquinol methylase; Function class=H Coenzyme metabolism
  Homolog annotation: Query=11..243bp; Hit=7..239bp; Blast score=399; Percent Identity=79.0; E value=1e-111; Homolog= ZubiG COG2227
MNVKTPDSHIPSHPNVDQQEIEKFEAVASRWWDLEGEFKPLHRINPLRLNYILQRAGGLFGKKVLDVGCGGGILSESMAREGADVTGLDMGFEPLQVARLHALESDTPVTYVQETVESHAEQHLHSYDVVTCMEMLEHVPDPESVIRACAKLVKPGGHVFFSTINRNRKAWLMAVIGAEYILNMVPKGTHDAKKFIRPSELIGWIDKTPLKDQHIIGLHYNPLTDKFRLGHNVDVNYMLHTQSV

SEQ ID NO: 5599 - protein, 763 aa, Xenorhabdus bovienii
  Peptide sequence Name=Xb4151_4152.C404.gene7.pep
  Gene classification: Gene name=NrdA; Function=Ribonucleotide reductase alpha subunit; Function class=F Nucleotide transport and metabolism
  Homolog annotation: Query=1..763bp; Hit=1..761bp; Blast score=1399; Percent Identity=87.0; E value=0; Homolog= nrdA COG0209
MNQSLLVTKRDGHKEQIDLDKIHRVVAWAAEGLKNVSVSQVELRSQIQFYDGIKTADIHETMIKAAADLISGDAPDYQYLAARLAIFHLRKKAYGQFEPPALHDHVVRMVNLGKYDKHLLEDYSKEEFEQMDSFINHLRDMDFSYAAVKQLEGKYLVQNRVTGEIYESAQFLYILVAACLFSTYPKETRLSYIRRFYDAVSTFKISLPTPIMAGVRTPTRQFSSCVLIECGDSLDSINATSSAIVKYVSQRAGIGVNAGRIRALGSPIRDGEAFHTGCIPFYKHFQTAVKSCSQGGVRGGAATLFYPLWHLEVESLLVLKNNRGVEGNRVRHMDYGVQLNKLMYERLIKGEDITLFSPSDVPGLYDAFFADQDEFERLYTQYESDVTIRKERIKAVELFSLMMQERASTGRIYIQNVDHCNTHSPFDPAVAPVRQSNLCLEIALPTKPMNNINDENGEIALCTLSAFNLGAINNLTELEELAELAVRALDSLLDYQDYPIIAAKQGSMGRRTLGIGVINFAYYLAKNGVRYSDGSANNLTHKTFEAIQYYLLKASNGLAKEKGACPWFGETTYAQGILPIDTYKKTLDTLTREPLHMDWETLRNDIRQHGLRNSTLSALMPSETSSQISNATNGIEPPRGYISIKASKDGILRQVVPEYNRLKGAYELLWQMPGTDGYLQLVGIMQKFIDQSISANTNYDPARFPNGKVPMNQLLKDLLLAYKYGVKTLYYHNTRDGAEDVQGDLEEVVESADSDCDGGACKI

SEQ ID NO: 5600 - protein, 376 aa, Xenorhabdus bovienii
  Peptide sequence Name=Xb4151_4152.C404.gene8.pep
  Gene classification: Gene name=NrdF; Function=Ribonucleotide reductase beta subunit; Function class=F Nucleotide transport and metabolism
  Homolog annotation: Query=1..376bp; Hit=1..376bp; Blast score=679; Percent Identity=88.0; E value=0; Homolog= nrdB COG0208
MSYTTFSQVKNNQLQEPMFFGQPVNVARYDQQKYPIFEKLIEKQLSFFWRPEEVDVSRDRIDYNALPDHEKHIFISNLKYQTLLDSIQGRSPNVAFLPLISIPELETWIETWSFSETIHSRSYTHIIRNIVNDPAIVFDDIVANEQILKRAKDISGYYDVLIEMTNYYHQLGEGTYNVAGKNITVSLRALKKQLYLCLMSVNALEAIRFYVSFACSFAFAERELMEGNAKIIKLIARDEALHLTGTQHMLNLLRSGQDDPEMAEIARECEQQCYDLFVQAAEQEKEWADYLFKDGSMIGLNKDILCQYVEYITNIRMQAVGLKLPFEARSNPIPWINAWLVSDNVQVAPQEVEVSSYLVGQIDSEVNAEDLSGFEL

SEQ ID NO: 5601 - protein, 73 aa, Xenorhabdus bovienii
  Peptide sequence Name=Xb4151_4152.C404.gene9.pep
MISALLKHSLNCPIHSTIYNEINFNLLFVKKISNYYFICDFKKYLNIKKVDKGQIGKIIILSVTHYYINFLSL

SEQ ID NO: 5602 - protein, 186 aa, Xenorhabdus bovienii
  Peptide sequence Name=Xb4151_4152.C404.gene10.pep
  Homolog annotation: Query=1..186bp; Hit=1..176bp; Blast score=173; Percent Identity=54.0; E value=1e-42; Homolog= Pa|Phot3-136c07.q1k _g15| 21859 - 22389 468 176 aa, chain -
MKKTLLTAAIAAGLSIFAFGANASNSGKSTISLGYAQTQNSANGIKVFKSEGTEWNTKQHGLNLKYRYELDDHLGVVGSLTYTLNRFENDHVGNVTKFKSDSYSLLAGPSYRFNDYISAYGMIGAAHNKIKIQDDSEFDISKTSLAYGAGLQFNPIENIAVDASYQYSKFSDIKVGTWVLGIGYRF

SEQ ID NO: 5603 - protein, 131 aa, Xenorhabdus bovienii
  Peptide sequence Name=Xb4151_4152.C404.gene11.pep
  Homolog annotation: Query=1..127bp; Hit=1..127bp; Blast score=194; Percent Identity=70.0; E value=2e-49; Homolog= gi|27550080|gb|AAO18063.1| Orf38 [Photorhabdus luminescens]
MKTTPVLRIARATDNLSAIKDMYCKGLQFTLLGEFRDHDNFDGVMLGHPNHSWHLEFTHHHNTSVGKAPTQDNLLVFYIEDVSEWQKQSQLMQEAGFSLVPSYNPYWDRTGKTFEDIDGYRVVLQNTPPHI

SEQ ID NO: 5604 - protein, 197 aa, Xenorhabdus bovienii
  Peptide sequence Name=Xb4151_4152.C404.gene12.pep
  Gene classification: Function=Uncharacterized BCR; Function class=S Function unknown
  Homolog annotation: Query=28..175bp; Hit=32..178bp; Blast score=173; Percent Identity=53.0; E value=1e-43; Homolog= BH1303_1 COG3397
MNIKKSLLLVGLTTFGAIPFYSTADPVSRHGYVDSPPSRAFLCYQRTNKDCGNIMYEPQSVEGPKGFPESGPPDGQIASGGVGQFSPLNEQSAQRWHHVTVNKGQNNFKWTLTARHSTTSWQFFITKSGWDPNKPLTRAQFDLKPFCERDDHGKLPVQNVSITCEVPERSGYHVILGVWTISDTDNAFYQVIDADIK

SEQ ID NO: 5605 - protein, 71 aa, Xenorhabdus bovienii
  Peptide sequence Name=Xb4151_4152.C404.gene13.pep
  Gene classification: Gene name=CspC; Function=Cold shock proteins; Function class=K Transcription
  Homolog annotation: Query=1..70bp; Hit=1..70bp; Blast score=108; Percent Identity=75.0; E value=7e-25; Homolog= cspI COG1278
MSNTMTGTVKWFNSDKGFGFISPKDGSKDVFVHFSAIQSNDYKTLDEGQEVSFSVESGAKGPSATNVIALS

SEQ ID NO: 5606 - protein, 153 aa, Xenorhabdus bovienii; identical to SEQ ID NO: 5533
  Peptide sequence Name=Xb4151_4152.C404.gene14.pep
  Gene classification: Function=Transposase; Function class=L DNA replication, recombination and repair
  Homolog annotation: Query=30..147bp; Hit=226..343bp; Blast score=123; Percent Identity=50.0; E value=7e-29; Homolog= mlr4143 COG3547

SEQ ID NO: 5607 - protein, 511 aa, Xenorhabdus bovienii
  Peptide sequence Name=Xb4151_4152.C405.gene1.pep
  Gene classification: Function=Phage protein D; Function class=R General function prediction only
  Homolog annotation: Query=27..256bp; Hit=3..230bp; Blast score=138; Percent Identity=31.0; E value=1e-32; Homolog= PA0628 COG3500
MLDLKLRIPNTDWIPQFDLVTGKEGAPAFRLETNKKDITGNIQSRLMSLTLTDNRGLESDQLDIELDDADGQLIFPSRGDILALELGWHGDSLTPKGKFVVDEIEHTGAPDRLTIRARSADFRGNLNVKREESYHKHTLESIVSTIAARNQLTFKISEELKGISMHIDQTNESDVSFLTRMAKQEGAIASVKNGELLFVQQGQNKTSSGQDIPLVLITRESGDSHRFSLSDREAYTGVDAQWQDTRTAAKQTVKLRRVESKNGEIKIIVEYGSSEKKSSAKNIPQKDKSLSLKEKDSSKKKEFRIVKEEKEHKSESPRGMNLTKSAQSNGVSLEKKGGIDLTKKNHKKKGREKPAYIEKGQKERKRKNKDNGNIDRKKNIDTKGSPSSKEQRKSTAEHHKTTTAQQKSAKYLTGTQENVLTLSRIYSNKENAERAAKAVWDKMQRGAAQFSITLAKGRADIYPETPIQLKDFKTEIDGTHWTLVKVTHNLNGSGFTTSLDLEIKIDDVEVK

SEQ ID NO: 5608 - protein, 171 aa, Xenorhabdus bovienii
  Peptide sequence Name=Xb4151_4152.C405.gene2.pep
  Gene classification: Function=Phage protein U; Function class=R General function prediction only
  Homolog annotation: Query=1..150bp; Hit=3..154bp; Blast score=140; Percent Identity=47.0; E value=4e-34; Homolog= Z2985 COG3499
MMAALGLFVFMLKTTPYQSFQYKQSWRHAFNSRVGARPAWQFIGSDNDTVTLSGELYPELTGGSLSLTALTLMADRGKAWSFIDGSGAIYGMFVIESIDETKTEFMSGGAARKISFTLTLRRVDNNLFEMLGDLQDQLSDIKGKPPTSLDKPSGLTRKAIGEIKEHPNARS

SEQ ID NO: 5609 - protein, 1111 aa, Xenorhabdus bovienii
  Peptide sequence Name=Xb4151_4152.C405.gene3.pep
  Homolog annotation: Query=702..1108bp; Hit=480..835bp; Blast score =302; Percent Identity=43.0; E value=2e-80; Homolog= Pa|Phot4 -254a01.q1k_g13| 13368 - 15878 1336 836 aa, chain -
MSNIQSQLNKVLSAVGKLTGSFKSFQRHNKKLENSVDKIHNQFKKLNKTVESLKPIVGYAQETARIRTDLKAYNQTIKQSLSARQNSTRTLQVSAASQSANIIQTTQIIKQENSSSKKNEFNLGATGNMTNNFTLLDKLVININPKITILFSILNKINAVLNVTTGAVKVVFQTLVGYIQLFGNVGIKTFDFLRVSLNIFTQLGIQAFVSLKVSLNIFAQLGIQALVSLRVNFNFFAQLGIQALDKLKSSLDAFVQLGLNAFEELKASLNFFAQLGVQALDKLKSTLDAFVQLGVQALNKLTAPLDIFAQLGTQALDKLKSTLDAFVQLGVQALNKLTAPLDIFAQLGTQALDKLKSTLDAFVQLGVQALNKLTAPLDVFAQLGLNAFEELKASLNFFAQLGIQALDKLKSSLDAFVQLGLNAFEELKASLNFFAQLGIQALDKLKSTLDAFVQLGVQALNKLTAPLDIFAQLGTQALDKLKSTLDAFVQLGVQALNKLTAPLDIFAQLGTQALDKLKSTLDAFVQLGVQALNKLTAPLDIFAQLGTQALDKLKSTLDAFVQLGVQALNKLTSPLDVFAKLGMQALEELKASLSFFAQLGVQALDKLKSSLDIFTQVGVQALEELRANLNRFAQVGIQAMENLRDGLKVFAQLGTEALEALRAAMDFFGKTGNKVFGSLNDGADLLSNKGGKDTFGNQRKGLEILGNIGQKVFGVLGSGINILANVGVKGLSFLSSTFSVLGKSIMFIGRAMMANPILAIIGVIAMAAIYIWQNWGTLGPKFTALWEGIKNVCSNVWQGIKNIVSAAWEGIKSFFMNGGLIGIIYQNWDAIKQSASEVWEAIKALLSEKWESIKQSVLATWENIKAQISGAWESVKQNTLEIWESIKKSISDRWNEIVSDVQAIPEKLKKAGSDMIDSLLTGIQEKWEALKGKITSITDIFKSWWSGDDKKEVAVKTSQEITNSATTQQAAQITKHDTGGSISAGKFGIAGERGPEIISGPANVTSRKNTAKLAAVGLAVSSMSLPIAAQDAPLHAQSLPAHTYEAVQAKKERSLPPQLSGAPQYNIYVYGAQGQSAQDIARVVRQELEQRERIQQARMRSSLSDRGEDFS

SEQ ID NO: 5610 - protein, 105 aa, Xenorhabdus bovienii
  Peptide sequence Name=Xb4151_4152.C405.gene4.pep
  Homolog annotation: Query=1..105bp; Hit=1..105bp; Blast score=139; Percent Identity=79.0; E value=9e-33; Homolog= Pa|Phot4-254a01.q1k _g14| 16098 - 16415 225 105 aa, chain -
MTETLNTQNDDLRTIELEAPLARGNGEITEVMVRKPTSGALRGARLQALLEMDVDSMLLVLPRVTTPVLTKNDLMMMSPGDLINLSVEVVNFLLPKSVKSDSQNN

SEQ ID NO: 5611 - protein, 172 aa, Xenorhabdus bovienii
  Peptide sequence Name=Xb4151_4152.C405.gene5.pep
  Gene classification: Function=Phage tail tube protein FII; Function class=R General function prediction only
  Homolog annotation: Query=1..160bp; Hit=1..157bp; Blast score=136; Percent Identity=45.0; E value=1e-32; Homolog= Z2990 COG3498
MALPRKLKYLNLFNDGNNYQGIVEELTLPKLSRKLEAYRGAGMNGSAMVDLGLDEGALDAEFTLGGIESQLYKQWGIATADGVMLRFAGSFEREDTGDVVAVEVVMRGRFQEFDHGTYKQGDNSQTKITAKNTYFKLTWDGEELIEIDTINMVEKVGGEDRLEQHRRNIGLF

SEQ ID NO: 5612 - protein, 390 aa, Xenorhabdus bovienii
  Peptide sequence Name=Xb4151_4152.C405.gene6.pep
  Gene classification: Function=Phage tail sheath protein FI; Function class=R General function prediction only
  Homolog annotation: Query=1..380bp; Hit=1..383bp; Blast score=350; Percent Identity=47.0; E value=1e-96; Homolog= Z2991 COG3497
MAQDYHHGVRVQEINEGTRTITTVSTAIVGMVCTGPDADEKTFPLNTPVLITDVMSASGKAGKKGTLYSSLKAIADQAQPVTVVVRVAEGESEEVTVSNIIGTVTDAGKKTGMQALLAAQSQLGVKPRILGVPGLDSKAVAIELASVAQKLKAMAYVSAYGSKNISEVIKYRDNFNQRELMLIWPDFLSWDTVSNSESIAYATARALGLRAKIDEETGWHKTLSNVGVNGVTGLSADVFWDLQDTATDADLLNKSGITTLIRKNGFRFWGSRTCSDDALFQFESYTRTAQVLADTMADAHMWAIDKPLTPSLVRDIIEGINAKFRELKSGGYIIDGRCWYDEKANDKDTLKAGKLTIDYDYTPVPPLENMMLRQRITDSYLMNFAKSINK

SEQ ID NO: 5613 - protein, 393 aa, Xenorhabdus bovienii
  Peptide sequence Name=Xb4151_4152.C405.gene7.pep
  Homolog annotation: Query=8..210bp; Hit=124..324bp; Blast score=266; Percent Identity=65.0; E value=4e-70; Homolog= gi|37524063|ref|NP _927407.1| hypothetical protein [Photorhabdus luminescens subsp. laumondii TTO1] gi|36783486|emb|CAE12326.
LTGDVTLSAEDVQGEPRFNQTIDLTGLSSDRYYPVWWKFPFNERGANSWLTIHRNYAENRENKNPFGKDVTHLAGLEVQIEGSDTLWGGDAQYLNIKRINQRYRNTVKKIQYGMMSIARSVDGKYPLYYDWKSGDITECRVYSGCYLRGGLTYHVTSNFNNLDYSRKEDEVEIWHGVSDSDKREIKWTVKSYAIDDPLLGKDYDDTVTPYGSDITDMLYPVGIVVWFAQNKNPNNLFPGTSWKYIGENRTVRLAAANGSNVLSTGGNDTKWLSVNQIPKHSHSFSANTSNAGGHNHSRGDMNITGYLPSVIQHGDDVFGGAFARNGQNKPAVDYTDHWKELTTFDASRTWTGHTSWGGEHIHNVSGTTSEIGKGEGFDVTNSYVMLMGWYRIS

SEQ ID NO: 5614 - protein, 165 aa, Xenorhabdus bovienii
  Peptide sequence Name=Xb4151_4152.C405.gene8.pep
  Homolog annotation: Query=1..164bp; Hit=329..492bp; Blast score=150; Percent Identity=47.0; E value=6e-36; Homolog= gi|37525940|ref|NP _929284.1| hypothetical protein [Photorhabdus luminescens subsp. laumondii TTO1] gi|36785369|emb|CAE14316.
MERIVVGVSLSAGAYSDAPELPESVDIAVCRSTDGKSWINVPDYRGKTAYHIKTLKPMKIQSIGEIPFELTLLEPKTLFDKWDGKQWVTDLNEQKQHDLKQIENQKQSLLQEAEKRIIQLERKVRLNMASKEEISLLNEWEVYSVKLIDIDISGINKLGWPKKPN

SEQ ID NO: 5615 - protein, 124 aa, Xenorhabdus bovienii
  Peptide sequence Name=Xb4151_4152.C405.gene9.pep
VLPDSLHGSIAHSVVSTLSVLPVDSERIPLSYESPTLIRTVVLDYVGGVRAEAIGIPFDSADFTTQAQPNTAKTPNNQPIPGGNTDSGISGIVSTAALRVSDWASWWFSTRPRNIAFLYIVRAA

SEQ ID NO: 5616 - protein, 181 aa, Xenorhabdus bovienii
  Peptide sequence Name=Xb4151_4152.C405.gene10.pep
  Gene classification: Function=Transposase; Function class=L DNA replication, recombination and repair
  Homolog annotation: Query=1..164bp; Hit=1..167bp; Blast score=70; Percent Identity=33.0; E value=8e-13; Homolog= yi5A COG2963
MKKKRYSQTFKLKVVLHYLSHPDCGYSRTASLFGLHRNLVNKWIDIYRVHGEHGLKKSLNRSYSFEFKKHVVLTIQHEGLSLSEAMKRFKLKDTGMISRWLALYRKGGIELLKPRKRSRKACTRNAATQYKPESTKSAKPPPELLDELAYLRAENAYLKKLTALIGKEENTYQQKQKLSPN

SEQ ID NO: 5617 - protein, 139 aa, Xenorhabdus bovienii
  Peptide sequence Name=Xb4151_4152.C405.gene11.pep
  Gene classification: Gene name=Tra5; Function=Putative transposase; Function class=L DNA replication, recombination and repair
  Homolog annotation: Query=1..137bp; Hit=144..280bp; Blast score=167; Percent Identity=56.0; E value=3e-42; Homolog= yi5B COG2801
MMDLFNREIVAFRTSRKPVFDLVKNMLSDAMEKLKSHEKPLIHSDPGWQYQMIHYQNQITENGLIQSMSRKGNCLDNAAMESFFGILKSECYHGVEFSSIYELEKTITDYIYYYNHDRIKIKLNGLSPVEYRTQSIMGI

SEQ ID NO: 5618 - protein, 66 aa, Xenorhabdus bovienii
  Peptide sequence Name=Xb4151_4152.C405.gene12.pep
VQTATKRLYLLNEVDTQIMRLERITRREIATPDEQKWFDAWELYSIELQRLDTTAAPDIDWPKAPK

SEQ ID NO: 5619 - protein, 299 aa, Xenorhabdus bovienii
  Peptide sequence Name=Xb4151_4152.C405.gene13.pep
  Homolog annotation: Query=6..296bp; Hit=12..305bp; Blast score=143; Percent Identity=29.0; E value=3e-33; Homolog= gi|37524508|ref|NP _927852.1| hypothetical protein [Photorhabdus luminescens subsp. laumondii TTO1] gi|36783932|emb|CAE12794.1
MNIFDLKCKLFGWQETNFTEYEKSYFSFGGNLATHPLVLKFIHERYNFKEKYFINKNRNSINTSICVWDNKYLANDPACPLSNEIGIVVPNDEIVIPSSENARFLLPIKSKFISPLNSENIINLTFKHNAKRSLCLAKPLSEKSNKKYKYRLNSFMKFGGELVDVQIFSADELTDFYSQLVEERWGTCSFDKEMINELFHLIKPMIFGNVLFFKGQPCAFHFITKTQFHHHTNIEFIQAGMDRSAELAKYSIGSLLIWSNIYKAVNEFDNVRFSFGRPSRDYKLRWSNIYPIGRTITLI

SEQ ID NO: 5620 - protein, 505 aa, Xenorhabdus bovienii
  Peptide sequence Name=Xb4151_4152.C405.gene14.pep
  Homolog annotation: Query=8..214bp; Hit=124..328bp; Blast score=271; Percent Identity=64.0; E value=2e-71; Homolog= gi|37524063|ref|NP _927407.1| hypothetical protein [Photorhabdus luminescens subsp. laumondii TTO1] gi|36783486|emb|CAE12326.
LTGDVTLSAEDVQGEPRFNQTIDLTGLSSDRYYPVWWKFPFNERGANSWLTIHRNYAENRENKNPFGKDVTHLAGLEVQIEGSDTLWGGDAQYLNIKRINQRYRNTVKKIQYGMMSIARSVDGKYPLYYDWKSGDITECRVYSGCYLRGGLTYHVTSNFNNLDYSRKEDEVEIWHGVSDSDKREIKWTVKSYAIDDPLLGKDYDDTVLPYAHDYSETINLAKNAYPITGGRLNGELVASNVVISQGDGRQHFSLRDNDGQTRAWIYKDKGGDGIHINNGYDGGGEWILNKSGEMYCPGTISSYLEHTIRHAGYGRINYVHQNTGDYIFLETTEDGKGIYFVQRNKDHNNQWVLRFPQKDGVVATTDDIASTNNIPVGIPLPWPQETPPPGYLICNGESFDKAKCPQLALAYPSGVLPDLRGEFIRGLDAGRNVDSGRKALSWQADEFRSHNHEFEAIRNETGNSVWADFFGTGSDFGRKKYPVSNSGGKETRPRNVAFLYIVRAA

SEQ ID NO: 5621 - protein, 137 aa, Xenorhabdus bovienii
  Peptide sequence Name=Xb4151_4152.C406.gene1.pep
  Gene classification: Function=Conserved domain frequently associated with peptide methionine sulfoxide reductase; Function class=O Posttranslational modification, protein turnover, chaperones
  Homolog annotation: Query=1..137bp; Hit=1..137bp; Blast score=188; Percent Identity=62.0; E value=2e-48; Homolog= yeaA COG0229
MAKTKNTSLFIEQLSEIQRYVTQKAGTEPPFSGKLLHNKKSGIYHCLCCRQPLFISDTKFDSGCGWPSFYQPFNDKSINCIDDYSHNMHRIEVRCSHCQAHLGHVFPDGPKPTGERFCINSAALRFIDEETGDETEG

SEQ ID NO: 5622 - protein, 91 aa, Xenorhabdus bovienii
  Peptide sequence Name=Xb4151_4152.C406.gene2.pep
  Gene classification: Function=Uncharacterized BCR; Function class=S Function unknown
  Homolog annotation: Query=1..79bp; Hit=16..94bp; Blast score=102; Percent Identity=64.0; E value=9e-23; Homolog= Z2816 COG3139
MKLDDLLSAMTPEIYQRLVQAVELGKWQDGVPLTPEQKEHSLQMVMLWQAKHNHDPEHMTIGTDGQITIKSKQELKVMFQSEMVVKPQPEE

SEQ ID NO: 5623 - protein, 211 aa, Xenorhabdus bovienii
  Peptide sequence Name=Xb4151_4152.C406.gene3.pep
  Gene classification: Gene name=PncA; Function=Amidases related to nicotinamidase; Function class=Q Secondary metabolites biosynthesis, transport and catabolism
  Homolog annotation: Query=4..204bp; Hit=11..211bp; Blast score=241; Percent Identity=57.0; E value=4e-64; Homolog= ZydjB COG1335
MKTALLLIDLQNDFCSGGALAVKESEEVIAIANKAISLCQKNNITIIASQDWHPANHMSFAVNACQPVGESGLLNGIPQIWWPVHCVQGQSGADFHPALNQSAIQEIFRKGENPQIDSYSAFFDNDHKSATRLHGWLAEQNIQRLIMSGIATDYCVKFTVLDALEQGYETYVITDGCRGVNLQDNDSLKALKEMATKGAKLIPLHELTTLF

SEQ ID NO: 5624 - protein, 339 aa, Xenorhabdus bovienii
  Peptide sequence Name=Xb4151_4152.C406.gene4.pep
  Gene classification: Gene name=AnsB; Function=L-asparaginase/archaeal Glu-tRNAGln amidotransferase subunit D; Function class=E Amino acid transport and metabolism
  Homolog annotation: Query=1..338bp; Hit=1..338bp; Blast score=505; Percent Identity=74.0; E value=1e-143; Homolog= ansA COG0252
MQKKSIYVVYTGGTIGMQRSPNGYIPVSGHLQRQLSQMPEFHRPEMPTFTIREHQPLIDSSDMSPNDWGIIANDIYQNYHDYDGFVILHGTDTMAFTAAALSFMFENLKKPVIVTGSQIPLEALRSDGQTNLLNALYLAANYPINEVGLFFSNKLFRGNRTIKAHADGFEAFSSPNCQPLIEAGINIRTFNTSPIPASHGGFTVHQITSQPIGVVTIYPGLSSQVVENILMQPVKALILRSYGVGNAPQRADLLKILREATERGIIVVNLTQCISGRVNMKGYATGHALATSGVISGYDMTFEATLTKLHYLLSQPYESEEIRHLMQQNLRGELSYSDK

SEQ ID NO: 5625 - protein, 636 aa, Xenorhabdus bovienii
  Peptide sequence Name=Xb4151_4152.C406.gene5.pep
  Gene classification: Gene name=SppA; Function=Periplasmic serine proteases (ClpP class); Function class=N Cell motility and secretion
  Homolog annotation: Query=1..636bp; Hit=1..618bp; Blast score=688; Percent Identity=54.0; E value=0; Homolog= sppA COG0616
MRILWKFITALFKWSWKLLNFARQLISNLIFILLVIVVATGVLVYQQQSKSVDDYRGALYVDLSGIVVDQVSARSPLDQFGRDLIGVSSSSSQETSLFDIVDSIRRAKHDAKITGMVLKLDNFLGADQPSMQYIGKAINEFKAAGKTVIAISDSYSQPQYYLASYANKVYLSPHGAVSLHGFSTNHLYYKSLLDSLKVSTHIFRVGTYKSAVEPMTRDNMSEEARQADSLWLNELWNNYRNTIAVNRKIPAVRVLPEPTQFIEEFRQAGGDSALYAAKNKLVDEIKPRNVIETELSNKFGWDEKNKHFNYISLYDYIAQQPIKNSDQSNSNIAVIIAEGAIMDGRQSEGIAGGDTIAEQLREARLNPNIKAIVLRVNSPGGSISASELIRSELVAIREGTTVKNKEGHTVKENQKPIVVSMGGLAASGGYWISTPANYIIADKNTLTGSIGVFGVLNTYEKGLNYLGVNTDGISTYPLADISVTKGINPMFSDVMQLSIESGYHKFIELVAQSRQKTQNEIKEIAQGRVWSGSDAKKNGLVDQLGDFDDAVNKAAQLAGIKTVSLNWMQPELSFSEKLMLEFSSSAQALLPNTLQSMLPAPIAQIAQDMKQQAVFYNRMNDPQNIYTFCLNCADIR

SEQ ID NO: 5626 - protein, 183 aa, Xenorhabdus bovienii
  Peptide sequence Name=Xb4151_4152.C406.gene6.pep
  Gene classification: Gene name=NfnB; Function=Nitroreductase; Function class=C Energy production and conversion
  Homolog annotation: Query=1..183bp; Hit=1..183bp; Blast score=242; Percent Identity=63.0; E value=1e-64; Homolog= ydjA COG0778
MNALELLLNRRSASRLTTPAPEGNELEYILAAGMRAPDHGALRPWHFVVMQGEGIDKFSKLLEKSAIENALGQEVEEKARNAPYRAPMVITVIAKVVENTKIPAWEQVVAAGCAVHAMQMAAVAQGFGGIWRSGSWTEDPVVKAGLGCGENDKIVGFLYLGTPVLKAPEKVALPDLTNFVSYF

SEQ ID NO: 5627 - protein, 129 aa, Xenorhabdus bovienii
  Peptide sequence Name=Xb4151_4152.C406.gene7.pep
  Gene classification: Gene name=SelD; Function=Selenophosphate synthase; Function class=E Amino acid transport and metabolism
  Homolog annotation: Query=5..99bp; Hit=6..100bp; Blast score=183; Percent Identity=88.0; E value=4e-47; Homolog= selD COG0709
MPTEIRLTQYSHGAGCGCKISPKVLETILRSEWPKFFDPNLLVGNETRDDAAVYDIGNGTGIISTTDFFMPIVDDPFDFGRIAGTNAISDIYAMGGKPVRRLRFWAGQLLNYSQKSRKKLLKEIGPYVN

SEQ ID NO: 5628 - protein, 65 aa, Xenorhabdus bovienii
  Peptide sequence Name=Xb4151_4152.C406.gene8.pep
  Gene classification: Gene name=SelD; Function=Selenophosphate synthase; Function class=E Amino acid transport and metabolism
  Homolog annotation: Query=1..63bp; Hit=284..346bp; Blast score=70; Percent Identity=57.0; E value=2e-13; Homolog= ZselD COG0709
LIGEMTARQRHLLCDPQTSGGLLLAVLPDAVEEAKAIARSHNIDLIAIGELTEPHSDRALIEVIE

SEQ ID NO: 5629 - protein, 644 aa, Xenorhabdus bovienii
  Peptide sequence Name=Xb4151_4152.C406.gene9.pep
  Gene classification: Gene name=TopA; Function=Topoisomerase IA; Function class=L DNA replication, recombination and repair
  Homolog annotation: Query=1..643bp; Hit=1..641bp; Blast score=1038; Percent Identity=79.0; E value=0; Homolog= topB COG0550
MRLFIAEKPSLARAIADILPKPHRRGDGFIECGNNQFVTWCVGHLLEQAEPDTYDSRYARWVLSDLPIIPEKWRLKPRAAVAKQLNTIKSLLEKADEVIHAGDPDREGQLLVDEVLDFLNLRDDKKQNVQRCLINDLNPQAVIKAVERLRSNREFIPLCVSALARARADWLYGINMTRAYTLLGQNAGYQGVLSVGRVQTPVLGLVVRRDEEIEHFVPKDFFEVKAYIVTPNEEQFTALWQPSESCIDFQDEEGRLIHQPLAEHVVARITGQPAYVTAYQDKRESETAPLPFSLSSLQIEAAKRFGLSAQNVLDICQRLYETHKLITYPRSDCRYLPEEHFVGRHAVLNAISIHSSDLLPQDALESDKKNRCWDDKKVDAHHAIVPTARSSQVNLTENERQIYGLIARQYLMQFLPDAVFRKCTIELDIAGGKFIAKARFLAEAGWRTLLGNKERDEENEGTPLPVVAKGDELLCEKGEVVERQTQPPRPFSDATLLSAMTGIARFVQDKSLKKVLRATDGLGTEATRAGIIELLFKREFLYKKGRNIHATPAGRALIHVLPDMAVLPDMTAHWESKLTQISEKQFRYQDFMLPLQETLQQLIWQAKQYRNLKAFRDLPPVPMKGKKGKTKQVKKGKEKVNKTE

SEQ ID NO: 5630 - protein, 268 aa, Xenorhabdus bovienii
  Peptide sequence Name=Xb4151_4152.C406.gene10.pep
  Gene classification: Gene name=XthA; Function=Exonuclease III; Function class=L DNA replication, recombination and repair
  Homolog annotation: Query=1..266bp; Hit=1..266bp; Blast score=445; Percent Identity=77.0; E value=1e-125; Homolog= xthA COG0708
MKFVSFNINGLRARPHQLAAIVEQHQPDVIGLQETKVHDEMFPLEEVSKLGYHIFYHGQKSHYGVALLTRQQPVTVRKGFPTDDDDAQRRIIMADIETPQGLMTIINGYFPQGESREHPVKFPAKEKFYQDLNRYLEKNQSPDSHILIMGDMNISPTDLDIGIGENNQKRWLKTGKCSFLPEEREWMGRLKDWGLIDTFRAQHPEASDQFSWFDYRSKGFDDNRGLRIDLLLASRPLAERCLSSGIDYAIRSMEKPSDHAPVWAEFGI

SEQ ID NO: 5631 - protein, 287 aa, Xenorhabdus bovienii
  Peptide sequence Name=Xb4151_4152.C406.gene11.pep
  Homolog annotation: Query=1..286bp; Hit=1..286bp; Blast score=471; Percent Identity=81.0; E value=1e-132; Homolog= Pa|Phot5-468c10.q1k _g11| 9968 - 10831 405 287 aa, chain +
MFFSRKLEAFMAVVEMGSLSKAARVMNRTTPPVAKSIKDFEATLGKRLFKREKFGMILTKDGVELYNDLKELYLKEKEITKKHISGSICNVVNIYHDWGKKKHLISLYKAADRNNAQVNILRFSYDNIDEIVDYEGNTIILSSEKVLSDRFSLVRKIEGPNLGICCRKELLDEVHGDFTQLLKKRTWLCDPVLYKGNLIKNLEEEMIKNGEKVNIRQMDSIECCLNFIQSTDYIFITDSHSGALEEGESLGFIPISRTDAVNQCYVYKSKSHSSVLNRFIDSVSDME

SEQ ID NO: 5632 - protein, 282 aa, Xenorhabdus bovienii
  Peptide sequence Name=Xb4151_4152.C406.gene12.pep
  Gene classification: Gene name=PurU; Function=Formyltetrahydrofolate hydrolase; Function class=F Nucleotide transport and metabolism
  Homolog annotation: Query=5..282bp; Hit=3..280bp; Blast score=455; Percent Identity=80.0; E value=1e-128; Homolog= purU COG0788
MQNANIQKKILRTICPDAKGLIAKITNICYKHQLNIVQNNEFVDHRTGRFFMRTELEGIFNDETFLADLDDALPAGSNRELNTAGRRRIVIMVTKEAHCIGDILVKSAYGGLDVEIAAVIGNHTILQHLVEQFDIPFHYISHDGLTREQHDEALMVQIEQYKPDYVVLAKYMRVLTPAFVQHYPNQIINIHHSFLPAFIGARPYHQAYERGVKIIGATAHYVNDNLDEGPIITQDVINVDHTYTAEEMKRAGLDVEKNVLSQALHWVFSQRVFVYGNRTVIL

SEQ ID NO: 5633 - protein, 120 aa, Xenorhabdus bovienii
  Peptide sequence Name=Xb4151_4152.C406.gene13.pep
  Gene classification: Function=Uncharacterized BCR; Function class=S Function unknown
  Homolog annotation: Query=1..120bp; Hit=34..151bp; Blast score=134; Percent Identity=55.0; E value=1e-32; Homolog= ychJ COG3012
MRSRYSAYATKNADYLIATWHPDCQAESWRSEIEQSFASVQWLGLNVIETSEGQHNNEAYVEFSACFIEQGKQDRQLIHERSRFLRIDRHWFYLDGIRPQTGRNSPCPCGSGKKYKKCCG

SEQ ID NO: 5634 - protein, 307 aa, Xenorhabdus bovienii
  Peptide sequence Name=Xb4151_4152.C406.gene14.pep
  Gene classification: Gene name=CheY; Function=CheY-like receiver domain; Function class=T Signal transduction mechanisms
  Homolog annotation: Query=3..79bp; Hit=54..129bp; Blast score=73; Percent Identity=45.0; E value=3e-13; Homolog= VC1050_1 COG0784
MCASNGEMALQMVDREIKPELIFCDLSMPIMDGIEFMSHMAMKGLTIPIIIVSATSKMTEIDDALRLGAKDILLKPIANLNEVKEMALDYLHPKVFMSDAIEQNRLIQELSRLKQNTESVWCLLKQLQPPVSQTIANCRVNYRLLNTVGKMGLVFDITALSDNEMIFYCLDISRSKDNGAVSALLLRVVFNNLLKKRKFHKKSGLPDMQEIMNWVNRILNDTEISEPLPLLLGYYNTHNKTILMSSAGLSARIQSGNHQQQLGRGIPLGTLKIIHSHQVCEHSSLWQCRIWNNKNQIKLMFSPPFYQ

SEQ ID NO: 5635 - protein, 305 aa, Xenorhabdus bovienii
  Peptide sequence Name=Xb4151_4152.C406.gene15.pep
  Gene classification: Gene name=GalU; Function=UDP-glucose pyrophosphorylase; Function class=M Cell envelope biogenesis, outer membrane
  Homolog annotation: Query=1..296bp; Hit=1..294bp; Blast score=468; Percent Identity=78.0; E value=1e-132; Homolog= galU COG1210
MSIINKKIKKAVIPVAGLGTRMLPATKAIPKEMLPLVDKPLIQYVVNECIKAGINEIILVTHSSKNSIENHFDTSFELEAILERRVKRQLLDEVQSICPNHVTIMQTRQGIAKGLGHAVLCAKPLIGDEPFAVILPDVILDEYSTDLSKYNLSEMLSRFNSSGASQILVEPVPLESVADYGVVDCLGENLQPGDSKPIARVVEKPKPEEAPSNLSIVGRYVLSEKIWPLLAKTAPGAGDEIQLTDAIAMLMEKEPVEAYHLQGRSHDCGNKLGYMQAFVEYGMKHKDLGTAFKDWIMTLQNQIEK

SEQ ID NO: 5636 - protein, 447 aa, Xenorhabdus bovienii
  Peptide sequence Name=Xb4151_4152.C406.gene16.pep
  Gene classification: Gene name=Ugd; Function=Predicted UDP-glucose 6 -dehydrogenase; Function class=M Cell envelope biogenesis, outer membrane
  Homolog annotation: Query=1..442bp; Hit=1..443bp; Blast score=620; Percent Identity=67.0; E value=1e-177; Homolog= mlr5265 COG1004
MKVTVFGIGYVGLVQATVFAEVGHDVLCVDVDAKKVENLKNGQIPIFEPGLVPLVKKNFTEGRLNFTTDAKAGVAHGKLQFIAVGTPPDEDGSADLQYVTAVARTIAENMDGYKVVVDKSTVPVGTADKVRAVMQTALTQRSADFPFDVVSNPEFLKEGAAISDCMRPERIIIGCDNDNVIDVMRELYEPFNRNHDRMIVMDIRSAELTKYAANCMLATKISFMNEIANLAEMLGADIEHVRQGIGSDSRIGYHFIYPGCGYGGSCFPKDVQALIRTSEQIGYTPKILQAVELVNEKQKSKLPTFVKRHFGDDLSGKTFAIWGLSFKPNTDDMREASSRVLMEALWESGAKVQAYDPEAMQEAQRIYGQRDDLSLMGTKEAALKDADALIICTEWQNFRAPDFDIVKDSMKSPIIFDGRNLYDPERLQSRGFTYYGIGRGASINPVV

SEQ ID NO: 5637 - protein, 338 aa, Xenorhabdus bovienii
  Peptide sequence Name=Xb4151_4152.C406.gene17.pep
  Gene classification: Gene name=WcaG; Function=Nucleoside-diphosphate -sugar epimerases; Function class=M Cell envelope biogenesis, outer membrane
  Homolog annotation: Query=1..333bp; Hit=1..333bp; Blast score=415; Percent Identity=60.0; E value=1e-116; Homolog= BH3709 COG0451
MKFLVTGSAGFIGFHVSQRLLSMGHEVVGIDNINDYYDVNLKQSRLNLLLPHTNFQFEKLDLADRIAISELFVKHQFQRVIHLGAQPGVRYSIQNPMAYIDANIVGHINILEGCRHNRVEHLLYASSSSVYGLNKKQPFSTNDSVDHPVSLYAATKKADELMSHSYSHLYQLPTTGLRFFTVYGPWGRPDMALFKFTKAMLEGRSIDVYNHGNMVRDFTYIDDIVESIIRLQDIIPIPNKDWLVEDGEISSSSAPYRIYNIGNGQPTKLGDFIEAIEASLGINAKKNFMEIQDGDVLSTCADSNTLYDKIGFSPDTPVKEGVKRFVDWYLDFYQKSEQ

SEQ ID NO: 5638 - protein, 133 aa, Xenorhabdus bovienii
  Peptide sequence Name=Xb4151_4152.C406.gene18.pep
  Gene classification: Gene name=Hns; Function=DNA-binding protein H -NS; Function class=R General function prediction only
  Homolog annotation: Query=1..133bp; Hit=1..135bp; Blast score=137; Percent Identity=71.0; E value=3e-33; Homolog= hns COG2916
MSENLKSLNNIRTLRAQARECELTTLEEMLEKLTIVVEERRDEDSQARAQIEERSRKLQEYREMLEKDGIELSDLVDALSGKATSKSKRATRPAKYSYFDEGETKTWTGQGRTPAVIKKAIDEEGKKLEDFLI

SEQ ID NO: 5639 - protein, 199 aa, Xenorhabdus bovienii
  Peptide sequence Name=Xb4151_4152.C406.gene19.pep
  Gene classification: Gene name=Tdk; Function=Thymidine kinase; Function class=F Nucleotide transport and metabolism
  Homolog annotation: Query=1..191bp; Hit=1..191bp; Blast score=270; Percent Identity=68.0; E value=9e-73; Homolog= tdk COG1435
MAQLYFYHSAMNAGKSTSLLQSSYNYNERGMRTLIFTAEIDTRFGKGRVSSRIGLSVDALLFSPETNIAELIRCENEMKKVHCVLIDECHFLTKKHVEQLCEIVDYDDIPVLCYGLRTDFQGELFSGSQYLLAWSDKLVELKTICHCGRKASRVLRFGSDGKVVYDGAQVDIGGNEKYVSVCRRHYTDVIREAQTKKIP

SEQ ID NO: 5640 - protein, 884 aa, Xenorhabdus bovienii
  Peptide sequence Name=Xb4151_4152.C406.gene20.pep
  Gene classification: Gene name=EutG; Function=Alcohol dehydrogenase IV; Function class=C Energy production and conversion
  Homolog annotation: Query=448..869bp; Hit=1..422bp; Blast score=780; Percent Identity=87.0; E value=0; Homolog= ZadhE_2 COG1454
MAVTQIAELNELIARVKKAQREFTNFSQEQIDRIFRAAALAAADARIPLAKLAVAESGMGIVEDKVIKNHFASEYIYNAYKDDKTCGILSEDNTFGTITIAEPIGLICGIVPTTNPTSTAIFKALISLKTRNGIIFSPHPRAKKATNRAAEIVLQAAVAAGAPKDIIGWIDEPSVELSNALMHHPDINLILATGGPGMVKAAYSSGKPAIGVGAGNTPVVIDESADIKRAVASILMSKTFDNGVICASEQSVIVVDNVYDQVRERFSTHGGYLLQGEELQAVQDIILKNGSLNAAIVGQPATKIAEMAGICVPDETKILIGEVTLVDETEPFAHEKLSPLLAMYRGKNFEDAVEKAEKLVEMGGIGHTSSLYTDQDNQSERIEYFGDKMKTARILINTPASQGGIGDLYNFKLSPSLTLGCGSWGGNSISENVGPKHLINTKTVAKRAENMLWHKLPKSIYFRRGSLPVALEEVATDGAKRAFIVTDRFLFNNGYTDQVINVLKSHGIETEIFFEVEADPTLGIVRKGAEQMHLFKPDVIIALGGGSPMDAAKIMWVMYEHPETHFEELALRFMDIRKRIYKFPKMGVKAKMVAITTTSGTGSEVTPFAVVTDDITGQKYPLADYALTPDMAIVDANLVMNMPKSLCAFGGLDAVTHALEAYVSVLANEYSDGQALQALKLLKDFLPASYHEGAKNPVARERVHNAATIAGIAFANAFLGVCHSMAHKLGSEFHIPHGLANALLICNVIRYNANDNPTKQTAFSQYDRPQARRRYAEIAEHLGLTVSGDNTAAKIEKLLAWLEELKSQLGIPVSIRETGVQETDFLTKIDKLAEDAFDDQCTGANPRYPLISELKQLMLDSFYGREFTEYAISQEAEKPNRKNK

SEQ ID NO: 5641 - protein, 151 aa, Xenorhabdus bovienii
  Peptide sequence Name=Xb4151_4152.C406.gene21.pep
  Gene classification: Gene name=Tra8; Function=Transposase, IS30 family; Function class=L DNA replication, recombination and repair
  Homolog annotation: Query=1..136bp; Hit=177..312bp; Blast score=150; Percent Identity=56.0; E value=3e-37; Homolog= NMB1022 COG2826
VGKNHKSALLTLVERKSLFTIIIKLENKTAEGVAKAATRHLSLIKHKIKTMTFDNGLEFAEHELISKNLETKIYFAHPYSPWERGINENTNGLIRDYFPKGTDFNKVSEREINLVANRLNNRPRKTRDYKTPNELFKGIPSHLLRPLRCCA

SEQ ID NO: 5642 - protein, 30 aa, Xenorhabdus bovienii
  Peptide sequence Name=Xb4151_4152.C406.gene22.pep
MTGNFWQHLRLAKKPYRKRYGSYEAARGKN

SEQ ID NO: 5643 - protein, 396 aa, Xenorhabdus bovienii
  Peptide sequence Name=Xb4151_4152.C407.gene1.pep
  Gene classification: Gene name=Hmp; Function=Flavodoxin reductases (ferredoxin-NADPH reductases) family 1; Function class=C Energy production and conversion
  Homolog annotation: Query=151..396bp; Hit=2..247bp; Blast score=277; Percent Identity=51.0; E value=1e-74; Homolog= hmp_2 COG1018
MLDSQVIATVKSTIPLIVSTGPKLTAHFYERMFKHNPELKDIFNMSNQLNGAQREALFNALCAYASNIDNLQALLPAVEKIAHKHTSLNIQPEHYQIVGTHLLATLDEMFHPGDEVLNAWGKAYEVLADVFINREEDIYQRGESEEGGWRGLRQFRVNKKQPQSDVITSFEFVPADGGKVIDYKAGQYLGIYLDTPVFENREIRQYSLTTAPNNHSYQIAIKREAQGKVSNYMHDNVQEGDTILLAPPRGDFFLDVQSDTPVTLISAGVGLTPMMSMLQHLHNQHHVGTVNWFHATEHGGYHAFADKVNTITQSMTNLHTQVWYREPRNEDQQGADYQHMGLMDLSVVKDSITEEGMQFYFCGPVVFMQYIAQQLLAIGIDKQHIHYECFGPHKVL

SEQ ID NO: 5644 - protein, 112 aa, Xenorhabdus bovienii
  Peptide sequence Name=Xb4151_4152.C407.gene2.pep
  Gene classification: Gene name=GlnK; Function=Nitrogen regulatory protein PII; Function class=E Amino acid transport and metabolism
  Homolog annotation: Query=1..112bp; Hit=1..112bp; Blast score=183; Percent Identity=94.0; E value=3e-47; Homolog= glnB COG0347
MKKIDAIIKPFKLDDVREALAEVGITGMTVTEVKGFGRQKGHTELYRGAEYMVDFLPKVKIEIVVPDDIVDTCVETIIQTAQTGKIGDGKIFVFDVARVVRIRTGEQDEEAI

SEQ ID NO: 5645 - protein, 540 aa, Xenorhabdus bovienii
  Peptide sequence Name=Xb4151_4152.C407.gene3.pep
  Gene classification: Gene name=NadE; Function=NAD synthase; Function class=H Coenzyme metabolism
  Homolog annotation: Query=256..535bp; Hit=5..286bp; Blast score=308; Percent Identity=54.0; E value=7e-84; Homolog= XF1961_2 COG0171
MSRTLNIVLAQLNWLVGDIEGNSERMLQTVQEQQKKGADLVMFSELALSGYFPEDLLFRADLHQRCREQLVRLQEASSQVAILVGHPWQQDGKTYNALSLFWKGEIIARYFKQLLPNYGVFDEDRYFKAGDQSCVVPFKGYNLGLLICEDLWFDAPIDALKQAGSDIILSLNASPYNREKPNIRSTLIQSHCQRTQLPIIYLNQVGGQDQLIFDGCSKVFDANGKITHRMAAFEEQIEQCRFNEMNIEPMANLIPQLSPLAQIYKALVLSVRDYVHKNGFKGALLGLSGGIDSGLTLAIAVDALGKDHVQAVMMPFRYTSEMSIHDAREQAELLGVEFDVVSIEPMFDAFMAQLEPMFAGTEKDTTEENLQARCRAVILMAMSNKRRRLVLTTSNKSESAVGYSTLYGDMAGGFNALKDVPKTMVFALSKYRNTVSPAIPQRVIDRPPSAELAPDQLDQDSLPPYDMLDAILEGYVEKDKSVADLVAQGFDEAIVRKVIRLVDINEYKRRQAPIGPRITERDFGKDRRYPITSGFGRKNW

SEQ ID NO: 5646 - protein, 445 aa, Xenorhabdus bovienii
  Peptide sequence Name=Xb4151_4152.C407.gene4.pep
  Gene classification: Gene name=AtoC; Function=Response regulator containing CheY-like receiver, AAA-type ATPase, and DNA-binding domains; Function class=T Signal transduction mechanisms
  Homolog annotation: Query=6..445bp; Hit=5..444bp; Blast score=717; Percent Identity=86.0; E value=0; Homolog= yfhA COG2204
MTVRNPARLLLVDDDPGLLKLLGMRLTSEGFRVTTAESGHEALRLLAKEKVDLVISDLRMDEMDGMALFAEIQKQHPGMPVIILTAHGSIPDAVAATQQGVFSFLTKPVDRDALYKAIDAALELSKPAIDGQWCEQIVTRSPLMLRLLEQAKMVAQSDVSVLINGQSGTGKEVLAQAIHRVSPRVKKPFIAINCGALPEQLLESELFGHAKGAFTGAVSSREGLFLAAQGGTLFLDEIGDMPLALQVKLLRVLQERKVRPLGSNRDIDIDVRIISATHRDLPKAMQRNEFREDLYYRLNVVNMKIPALNERAEDIPLLANHLLRASAKRHKPFVRSFSTNAMKCLMAASWPGNVRQLVNVIEQCVALTTAPVISDALVMQALEGENTALPTFVEARGQFELHYLRKLLQMTKGNVTHAARMAGRNRTEFYKLLARHELDANDFKE

SEQ ID NO: 5647 - protein, 291 aa, Xenorhabdus bovienii
  Peptide sequence Name=Xb4151_4152.C407.gene5.pep
  Homolog annotation: Query=1..256bp; Hit=1..251bp; Blast score=258; Percent Identity=55.0; E value=1e-67; Homolog= Pa|Phot3-198b04.q1k _g112| 80032 - 80868 1909 278 aa, chain -
MYNRFTYRFMMKTEQQNIVIQPMKKPAVMQHFLERASALRFRVMILLFIPYLLSGCAETTGNDELLTIAQAIMPEQRVTDYRLKGCDGIWNIVKPAAMENGLYWLKVMDCTDRLSSLEARDTAKRFTPAAPTDWGHVFKQSILMNRATPTLIERRKIVENLNRYSPQFPSALRPLLQLWREQQYLKINLAEERLKFQRLQFDSDSKIDRLKEIRARLEHDLRSISRKLENLTDIERQLSSRKQDQSSVATLGETEHLSNVEASEQLKPEAKPEMHQKTESEANLPEEKGVE

SEQ ID NO: 5648 - protein, 491 aa, Xenorhabdus bovienii
  Peptide sequence Name=Xb4151_4152.C407.gene6.pep
  Gene classification: Gene name=BaeS; Function=Signal transduction histidine kinase; Function class=T Signal transduction mechanisms
  Homolog annotation: Query=2..485bp; Hit=8..490bp; Blast score=564; Percent Identity=63.0; E value=1e-161; Homolog= ZyfhK COG0642
MSVSINVITGYEMISLNKWRLFPRSLRQLVLMAFWLVLLPLLVLAYQAYQSLDQLSTQAAEINRTTLADARRSEAMIGVALEMERSYRQYCVLGDVRLEKLYQRQYRQYLNMLGNQMMMLANKEYTQRFNQLLSGLTKISCSNGMPEPVANKRLEQFSTANNLLVQETRNIIFIRGEQLQKDIADKGQLFGWQSLILFLLSAFLITLFTRMIIGPVKGIENMINRLGAGQTLDNQIESFQGPRELRSLAQRIIWLSERLSWLESQRHEFLRHISHELKTPLASMREGTELLADEIAGPLTADQKEVVSILDSSSKHLQRLIEQLLEYNRRLADSSVEHQIVSLKEIVDSVVLSHQLPARAKNINTEIQLDTFFCWAEPKLLMGVIDNLYSNAVHYGAESGNIWISSRQVGKNIQIDIANTGTPIPELEKSMIFEPFYQGKLQRKGAVKGSGLGLSIAQDCIKQMGGELHLIEPEFADVCFRIELPLTAEND

SEQ ID NO: 5649 - protein, 51 aa, Xenorhabdus bovienii
  Peptide sequence Name=Xb4151_4152.C407.gene7.pep
MLRKLSKFLLNKTKQWGDKGDYSGVFCDATYTLIVSISRQWPLNASQIRDI

SEQ ID NO: 5650 - protein, 1295 aa, Xenorhabdus bovienii
  Peptide sequence Name=Xb4151_4152.C407.gene8.pep
  Gene classification: Gene name=PurL; Function =Phosphoribosylformylglycinamidine (FGAM) synthase, synthetase domain; Function class=F Nucleotide transport and metabolism
  Homolog annotation: Query=1..973bp; Hit=2..973bp; Blast score=1588; Percent Identity=77.0; E value=0; Homolog= purL_1 COG0046
MEILRGSPALSAFRITKLLSQCQDQQLPVTEIYAEYVHFAEINSPITGDEREKLNRLLKYGPSLDEHDPKGQLLLVTPRPGTISPWSSKATEIVHNCGLKQITRLERGIAYYIQSDEMSDGQWQELSALLHDRMMESVFTQSEQAEALFSHQQPAPLKQIDILQSGRAALESANIELGLALAADEIDYLVRAFQTLGRNPTDVELYMFAQANSEHCRHKIFNADWVIDGQEQPNSLFKMIKNTFEQTPDYVFSAYKDNAAVMEGSQIGRFFPHPESGVYDYHQEPAHILMKVETHNHPTAISPWPGAATGSGGEIRDEGATGRGAKPKAGLVGFSVSNLKIPGFEQPWEEDFGKPDRIVSALDIMLEGPLGGAAFNNEFGRPALLGYFRTYEEKVNSHNGAELRGYHKPIMLAGGIGNIREEHIQKGDISIGAKLIVLGGPSMNIGLGGGAASSMTSGQSDAELDFASVQRDNAEMERRCQEVIDSCWQLGDKNPILFIHDVGAGGLSNAMPELVSDGGRGGRFELRNILNDEPGMSPLQVWCNESQERYVMAVAPEQLVQFEEICRRERAPYAVIGEATEERHLLLNDNHFDNQPINMPLDVLLGKTPKMLKNVMTLKAQGHSLERRDIDLAEAVKRVLHLPAVAEKTFLITIGDRSITGMVARDQMIGPWQIPVADCAVTTASLDSYYGEAMSIGERAPIALLNFAASARMAVGEALTNIASAYVQDLKRVKLSANWMSASGHAGEDAGLYAAVKAVGEELCPALGLTIPVGKDSMSMKTCWNQNGEEREMAAPLSLVITAFARVEDVRCTVTPELSTDDDNALLLIDLGQGQNALGGTALAQVYRQLGDKTADVRSTEQLAGFFNAIQQLISEQKLLAYHDRSDGGLLVTLAEMAFAGHCGLRADISAFDEDILAALFSEELGAVIQIRQTDREQVEKLLADYGLRECVHYLGLAQAGEDFVISSNDMDVYRQNRSTLRLWWAETTWQMQRLRDNPECADQEHQTKQNVNDPGLNVKLTFDPAEDIAACYISKQVRPRVAVLREQGVNSHVEMAAAFHRAGFDAVDVHMSDLLSGRITLDQFQTLVACGGFSYGDVLGAGEGWAKSILFNSQVRDDFANFFARPDTLALGVCNGCQMISNLHELIPGTEHWPRFVRNRSERYEARFSLVEVADSPSLFLQGMTGSRLPIAVAHGEGQVEFRNSQSLAELEKHQQVALRFVDNYGLATENYPANPNGSVNGITAVTSLDGRVTAMMPHPERVFRTVSHSWHPKEWGEDGPWMRIFRNARRQLG

SEQ ID NO: 5651 - protein, 498 aa, Xenorhabdus bovienii
  Peptide sequence Name=Xb4151_4152.C407.gene9.pep
  Gene classification: Gene name=MltE; Function=Soluble lytic murein transglycosylase and related regulatory proteins (some contain LysM/invasin domains); Function class=M Cell envelope biogenesis, outer membrane
  Homolog annotation: Query=276..471bp; Hit=1..196bp; Blast score=253; Percent Identity=60.0; E value=3e-67; Homolog= yfhD_2 COG0741
LSNIKINYFVIVIIALLSAAIIGRNISWPNKQQEQINRILARGELRISTISSPLISANSKNEATGFDYELAKRFAEYLGVKLVIHFRTNINQIFDDLNNDNADFLAAGLIYNEERLDQARIGPAYYSVSQQLIYRKDTPRPRTFGDLNGTLVVTEGSAHARELKKYKEESYPNLTWEDTSRDNTLELLEQVSEGKINYTISDSISFSLQQRIHPNLALAFEVNGERPLTWYLKRSDDYTLYSAMLDFFNQMSENDVIPQLEEKYFSHIYQFDYFDTISFIRAINSTLPIYQPIFEKYAGSLDWQLVAAIAWQESHWNPQATSPTGVRGMMMLTRPTAEWVKISDRLDPEESVKGGMVYLHYLMERLPKTIPEDERIWFALAAYNMGYGHILDVRKLTAEQKGNPDRWLDIKSRLDLLSKKKFYTNTTYGYARGHEAYRYVENIRRYYQSLEGYLRAKDKHSKKAEYETPIDKIIVPLSDREGNKAVVNEKTPEVKTPT

SEQ ID NO: 5652 - protein, 169 aa, Xenorhabdus bovienii
  Peptide sequence Name=Xb4151_4152.C407.gene10.pep
  Gene classification: Function=Cytosine/adenosine deaminases; Function class=F Nucleotide transport and metabolism
  Homolog annotation: Query=5..160bp; Hit=17..172bp; Blast score=229; Percent Identity=67.0; E value=7e-61; Homolog= ZyfhC COG0590
VTEIYSDEYWMRRAMELAMQAQSQDEIPVGAVLVANNKIIAEGYNHPITEHDPTAHAEIIALRRGGIELQNYRLLNTTLYVTLEPCVMCAGAMVHSRIQRLVYGASDMKTGAAGSLIDILRHPGMNHQIEITAGVLAQECATMLSTFFKQRREQHKALKKLKIQQQETL

SEQ ID NO: 5653 - protein, 214 aa, Xenorhabdus bovienii
  Peptide sequence Name=Xb4151_4152.C407.gene11.pep
  Gene classification: Function=Predicted HD superfamily hydrolase; Function class=R General function prediction only
  Homolog annotation: Query=25..211bp; Hit=24..208bp; Blast score=155; Percent Identity=44.0; E value=2e-38; Homolog= ZyedJ COG1418
MLFFSPFEDLAQQLLPIAVEGDYGAHDIAHLHRVWRNAKRICEVESGNLQWVLAAVLLHDCVSVEKNDPNRHLASHMAAEKAALILKNLGWGGEDIAAVCHAIEAHSFSAGLTPRTLEAKIVQDADRLDSIGMVGVARCFYIAGRMGSALYNFHDPLAKHREYNDSAYTLDHFYTKILKIESGFQTETGRQMARERTERMEHFLEAFLNEIQVT

SEQ ID NO: 5654 - protein, 298 aa, Xenorhabdus bovienii
  Peptide sequence Name=Xb4151_4152.C407.gene12.pep
  Gene classification: Gene name=AlkA; Function=3-Methyladenine DNA glycosylase; Function class=L DNA replication, recombination and repair
  Homolog annotation: Query=9..291bp; Hit=12..300bp; Blast score=97; Percent Identity=25.0; E value=2e-20; Homolog= BS_alkA COG0122
MKLSSFTEIILPSNYHVQDFLAFHHRDEKGASEIVQQSRMKKGIIWHGNPALLTVSINKHRAQIQLEVDGDDAHQSEEALSMLASHMLGLLQPVEEFESMYQADPVIGELVTRQAGLRIYQSATPFEALSWAIIGQQISLSAAISIRRRFIQAIGVKHSSGLLCHPTHEQIIQCSEHDLRQCGFSVSKANALLNVSQLIDSGELKLAIIEGGIKRLTDNLLAIKGIGMWTINYALSRGFNYLNGSLHGDVAVRRNLQYLLRQEDKVNAEQTEAWLSGFSPWKALVAAHLWRQQSSSGY

SEQ ID NO: 5655 - protein, 205 aa, Xenorhabdus bovienii
  Peptide sequence Name=Xb4151_4152.C407.gene13.pep
MNLLQRIDWRHGGLIFVLFVILGLAGIYIYQIFYSHEPEIALMIGEPYEDMRQRSSAAINPALPGKIWYNVPKMDARLRFTDPKYGFMTPAARFFVVKYNNGIIESVRISPQIEPLLFDDVIKIVLDLQNQWRKAGWIPVYDRTFPPLANTPELRTQLRSLKCSETTYWRAGDQYQIMMNLGCFNDKKHPDEERFMITMDIAKAR

SEQ ID NO: 5656 - protein, 272 aa, Xenorhabdus bovienii
  Peptide sequence Name=Xb4151_4152.C407.gene14.pep
MPTDACASELENTMDNPFYFLHPKLKAQAENKVEDFAQAVEEARQASKNNRLSISSYVPGLQGISSLSQYSFNYVYEKMALGNTTLFLDVYQLHAFCKQRGLEDLKTCLNLRQDIYGNSQFPILWPIGQNNLKFGLPYDDILLAFEAIEAGNIAQGVVHLAYHEQINILQTTMYSDEQLIVFLWGNQFSYVTGFLPDNVAQPVELTLASQCQFIDNERTIKFSDDVANLADADQRMPFVLNAAERFDELLRGRDRHLIEKSLQDIEAGRGVK

SEQ ID NO: 5657 - protein, 56 aa, Xenorhabdus bovienii
  Peptide sequence Name=Xb4151_4152.C407.gene15.pep
VVYQKEAEDTVAPGGKLIADPIERNKRINQAYARCCRHDMHEQIQANNDADRRVRK

SEQ ID NO: 5658 - protein, 205 aa, Xenorhabdus bovienii
  Peptide sequence Name=Xb4151_4152.C407.gene16.pep
MSLLQRIDWRHSGLIFVLFVILGLAGIYIYQVFYSREPEIALMIGEPYEAMRQRSSAAIDPDLPGKIWHNIPKTDARLRFIDPKYGFVTPTARFFTILYDDGIITSVRMSPQIEPLLYEDAIKIVLDLQDQWRKAGWIPTRTREYPPLVNTPELHDSLRKMKNPGTTYWQAGEQYQIMMDVGRFKDDRHPDEERYLITLVISKPW

SEQ ID NO: 5659 - protein, 173 aa, Xenorhabdus bovienii
  Peptide sequence Name=Xb4151_4152.C407.gene17.pep
MKHTTVVLGVRQKIDYSSQFPILWPIGQDKLRFGRDYPDILLAFEAIEAGNIAKGVVHLANHEQINILQPTMYSDSDLVFALNGNQFAYVTNILPSSVTQPVELTLASQCKRIDNKRTITFSDYNPIADLSDVKQRMPFVLKAADRFDELLRGSKRSLIGESLQDIASWGGVK

SEQ ID NO: 5660 - protein, 344 aa, Xenorhabdus bovienii
  Peptide sequence Name=Xb4151_4152.C407.gene18.pep
  Homolog annotation: Query=8..342bp; Hit=12..337bp; Blast score=261; Percent Identity=46.0; E value=1e-68; Homolog= gi|29827211|ref|NP _821845.1| putative transposase [Streptomyces avermitilis MA-4680] gi|29604309|dbj|BAC68380.1| putative tra
MHLPTHAWEQELLSLHTRLAPLFHHHAPQQRSLAYLRGLLSDVERKNGWQLAEWIGERTPDGVQHLLERAHWDVDIARDILRDYVTEHLGDEHGVLIVDETGFIKKGTHSAGVQRQYSGTAGRVENSQTGVFLCYAGQGGHAFIDRALYLPRQWTDDRPRCEAAGIPDAVPFATKPQLARQMLERAFEAGVLCRWVTADAIYGQDRRLRCWLESRYQPFVLAIPKNEPLWWQGPTFVRADKIVDNLTPQRWETHSAGWGAKGERQYDWIRVPLWRLQLSEKEREYGHYLLVRRSRDEKQERAYYIVYARRDQAALKPLDQVAGCRWEIECGFEETKGECGLDSV

SEQ ID NO: 5661 - protein, 165 aa, Xenorhabdus bovienii
  Peptide sequence Name=Xb4151_4152.C407.gene19.pep
  Homolog annotation: Query=3..165bp; Hit=100..256bp; Blast score=101; Percent Identity=41.0; E value=5e-21; Homolog= gi|37526431|ref|NP _929775.1| hypothetical protein [Photorhabdus luminescens subsp. laumondii TTO1] gi|36785862|emb|CAE14913.
MSDVINPEMNLEDYMLVFDLNSATGELDDGTQGWGYMSGKASDGPRGFFGTLRVIQNKIDIKNISNFYWNSPNFLSLSLSLSLSLSFRIPSDKRQGEPNSVPPLFQGNFYVTVDNVTYDLGAPYDSYEKIGKRIYNARYNSEDALKLSTILKQTGQTKRFYCNWR

SEQ ID NO: 5662 - protein, 174 aa, Xenorhabdus bovienii
  Peptide sequence Name=Xb4151_4152.C407.gene20.pep
  Homolog annotation: Query=28..174bp; Hit=230..375bp; Blast score=196; Percent Identity=59.0; E value=2e-49; Homolog= gi|37524053|ref|NP _927397.1| hypothetical protein [Photorhabdus luminescens subsp. laumondii TTO1] gi|36783476|emb|CAE12316
MQDKKPDISELKDTTLEQQSYEDLGYTVIPIGVPVPWPSEIPPDGWLKCNGEVFDTVKYPKLALAYPSGRLPDLRGEFIRGWDDERGADSNRNVLSWQEGSYLVQEVYNPPDRIVNFSLDERKDLNWDIPDTEVIKLRGKAVTADKSGTWSIDKRYLGVTRPRNIAFNYIVRAA

SEQ ID NO: 5663 - protein, 424 aa, Xenorhabdus bovienii
  Peptide sequence Name=Xb4151_4152.C407.gene21.pep
  Gene classification: Function=Predicted transposase; Function class=L DNA replication, recombination and repair
  Homolog annotation: Query=77..354bp; Hit=7..292bp; Blast score=112; Percent Identity=28.0; E value=8e-25; Homolog= VNG6148H COG3385
MKPVTIIAIKHQLMQFFSDISLQHIAFQCAFMKRIRNIEPHVLILSLIAALSTGKITSIAQLHQKFNGLCPDKKQPVSYRPFYNQLRKAAFVEFVKILVRFAMAQWVEKQVSSPQKLMKFKQVILQDGSSFKVHSALADVFPYRFRTTGAAVECHMTMSLLTQSPVKMTVTADTAPERAYLPVPAMLRDQLLLADAGYVDFAYFEQVSLSGGSFIVRGSKSLNPQIVVARNGQGKLLPKLLNKPLKSITRRTNRSEVLDLICRRNGYEFRLIRRWFAEEKRFCLWLSNLSVEEFTANDIMDIYRCRWQVELLFKELKSHTNWHRFATRKETLVTGLIWLSLLALLLRRSLASRLFPAVSLLKAAQNTEVWLWPIIENLLQRAWSETGFWLEKAQAYLCQNAFKTPQRKSCKYKTLDACFERLNS

SEQ ID NO: 5664 - protein, 63 aa, Xenorhabdus bovienii
  Peptide sequence Name=Xb4151_4152.C407.gene22.pep
  Homolog annotation: Query=1..58bp; Hit=72..129bp; Blast score=73; Percent Identity=56.0; E value=6e-13; Homolog= gi|30249527|ref|NP _841597.1| putative transposase [Nitrosomonas europaea ATCC 19718] gi|30138890|emb|CAD85469.1| putative trans
MDNAPFHKRNDTTQAIADSRCQLEWLPAYSPDLNPIEHKWGGAKAIRRQKRCSVDELFTEHIE

SEQ ID NO: 5665 - protein, 96 aa, Xenorhabdus bovienii; identical to SEQ ID NO: 5468
  Peptide sequence Name=Xb4151_4152.C407.gene23.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 5666 - protein, 91 aa, Xenorhabdus bovienii; identical to SEQ ID NO: 5467
  Peptide sequence Name=Xb4151_4152.C407.gene24.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 5667 - protein, 77 aa, Xenorhabdus bovienii
  Peptide sequence Name=Xb4151_4152.C408.gene1.pep
  Homolog annotation: Query=1..69bp; Hit=1..69bp; Blast score=109; Percent Identity=84.0; E value=9e-24; Homolog= Pa|Phot4-254a01.q1k _g10| 11531 - 11752 170 73 aa, chain -
MIKCPLCGQSAHTRSSFEHSSQTKERYNQCQNINCGATFVSHETFVRFIAKPGDVENVTPHPRVKTKRQPRQKADAQ

SEQ ID NO: 5668 - protein, 72 aa, Xenorhabdus bovienii
  Peptide sequence Name=Xb4151_4152.C408.gene2.pep
  Homolog annotation: Query=1..72bp; Hit=3..74bp; Blast score=82; Percent Identity=63.0; E value=2e-15; Homolog= gi|26247711|ref|NP _753751.1| Hypothetical protein ydcH [Escherichia coli CFT073] gi|26108113|gb|AAN80313.1|AE016760_172 Hypotheti
MFPEYRDLVSNLKESNPRFQSLFEKHNRLNHEISQLEGPNGTGYSDKVVRLKKEKLHIKDEMQRILQAKSQK

SEQ ID NO: 5669 - protein, 160 aa, Xenorhabdus bovienii
  Peptide sequence Name=Xb4151_4152.C408.gene3.pep
  Homolog annotation: Query=3..160bp; Hit=2..162bp; Blast score=182; Percent Identity=55.0; E value=2e-45; Homolog= gi|15802762|ref|NP _288789.1| ecotin, a serine protease inhibitor [Escherichia coli O157:H7 EDL933] gi|15832352|ref|NP_311125.1
MKKYLLPLAAMMVSVSTFAQADKKLEDVAPYPKASEGMVRNVIDLAPEEDEGDYMVELMIGQDIKVDCNHHWFGGQLETKTLEGWGYDYYVLNKVTGPASTKMACPGQKETVRFVQVQLGKDALIRYNSKLPIVVYTPKSMTVKYRIWQALDDIDNAVIR

SEQ ID NO: 5670 - protein, 33 aa, Xenorhabdus bovienii
  Peptide sequence Name=Xb4151_4152.C408.gene4.pep
MRKEPQAENKGLANMTGDDLRVISFETVLLSTW

SEQ ID NO: 5671 - protein, 230 aa, Xenorhabdus bovienii
  Peptide sequence Name=Xb4151_4152.C408.gene5.pep
  Gene classification: Gene name=GlpF; Function=Glycerol uptake facilitator and related permeases (Major Intrinsic Protein Family); Function class=G Carbohydrate transport and metabolism
  Homolog annotation: Query=1..229bp; Hit=1..229bp; Blast score=283; Percent Identity=78.0; E value=7e-77; Homolog= aqpZ COG0580
MFKKLSAEFLGTFWLVFGGCGSAVLAAAFPQLGIGFVGVSLAFGFTVVTMAYAVGHISGGHFNPAVTLGLFAGGRISAKDVIPYIIAQVIGGIAAAAVLYLIASGKSGFDATASGFASNGYGEHSPGGFSLQAAIIIELVLTAFFLIVILGTTDKNASVGFAPLAIGLALTLIHLISIPVTNTSVNPARSTAVAIFQGTWALNQLWLFWLIPLIGGAIGGLIYRTLLQKD

SEQ ID NO: 5672 - protein, 147 aa, Xenorhabdus bovienii
  Peptide sequence Name=Xb4151_4152.C408.gene6.pep
  Gene classification: Gene name=WecD; Function=Histone acetyltransferase HPA2 and related acetyltransferases; Function class=K Transcription
  Homolog annotation: Query=14..129bp; Hit=6..121bp; Blast score=75; Percent Identity=33.0; E value=2e-14; Homolog= mll0817 COG0454
MEQNITWEQGEYWVTTDKTKFDIHFVHNNLTQLYWARGITFEKVRTGIEHSLCFALFHCDKEIGFARLITDFSTFAYLCDVFIVPDYQKRGLGRWLMECVLQHPIISHVKRVMLVTSSAGGLYEKFGFEPVRVQDFVWTLEKTKASE

SEQ ID NO: 5673 - protein, 335 aa, Xenorhabdus bovienii
  Peptide sequence Name=Xb4151_4152.C408.gene7.pep
  Gene classification: Gene name=DIT1; Function=Pyoverdine/dityrosine biosynthesis protein; Function class=Q Secondary metabolites biosynthesis, transport and catabolism
  Homolog annotation: Query=7..315bp; Hit=7..317bp; Blast score=390; Percent Identity=60.0; E value=1e-108; Homolog= PA2254 COG3207
MEHIDIEKVSGKILHELLQYRRRFSESEHTIEYEEQKVSEVQLPRIRAFVEQGKAVECILPAFPTKSPNPRKVLGTMPDMAEKLSLIFLNSLCQRIQLYYPPGANIVICSDGHVFSDLIHVDDETITHYQLEIEKLLHELGATNLSVFNLGNVESLTQYTSNYDQLRELLVNGYASSTEEIKATLKESEEGLQLYRAITRFLYEDSLLPGYDGSKTALQKDARQRAVGVIQRSWAWGNLLAEQFPLAIRLSIHPQPVDSIKIGIHMMPTRDDWLTPWHGVAANINGQFVLMKSDEVKKMQGKLVEIRGVPSHYMIEAVSEQNQQTEPLVAALQEQ

SEQ ID NO: 5674 - protein, 299 aa, Xenorhabdus bovienii
  Peptide sequence Name=Xb4151_4152.C408.gene8.pep
  Gene classification: Gene name=TauD; Function=Probable taurine catabolism dioxygenase; Function class=Q Secondary metabolites biosynthesis, transport and catabolism
  Homolog annotation: Query=1..283bp; Hit=1..281bp; Blast score=244; Percent Identity=42.0; E value=9e-65; Homolog= VC1944 COG2175
MSIDELDCRIEPIMPFGLLITPNAPQQDITTLSIDTLRELARTHKLVVLRGFSSGFTDPEKLTEYTGRWGEIMMWPFGAILDVMERPDPSDHVLDSTHVPLHWDGMYKPTIPEFQIFHCVSAPEASQGGRTTFVDTEQLIADASDDERHEWKNTTITYRTSRVTHYGGEVVSPLICLHPDGKKWVMRYNEPMTGKDDKYADHHLLTIHGLSIEQQKEFEKNLFNRLYDSRYFYAHQWQSGDLVISDNFTLLHGREAFITHSPRHLQRVHVHGTPVCENLSFRTISNSDSGVAEVELKEV

SEQ ID NO: 5675 - protein, 426 aa, Xenorhabdus bovienii
  Peptide sequence Name=Xb4151_4152.C408.gene9.pep
  Gene classification: Function=Glycosyl transferases, related to UDP -glucuronosyltransferase; Function class=G Carbohydrate transport and metabolism
  Homolog annotation: Query=3..410bp; Hit=2..403bp; Blast score=157; Percent Identity=32.0; E value=3e-38; Homolog= DRA0329 COG1819
MARIVLAAIATPGHVFPICSIARHLIEQGHEATIFTGSIFRQQAEALGASFVAFDQQVDVDYRNLEEKFPERGQHPPGNHQMTHALKQFFAGPIPVLYRQLEQLVKGADLLIVDNTFYAVLPLLQKPAHDRIPIIAIGVTPLSWSTRDTIFWGPRIPPELLPADLMREQLVDEETAQLIGQVRDAFNTALLEVASPPLTQDHNDVVISRADRFLQLATKSFEFPRDDLPETVDFIGALGVEVQDDKTQLEWSDESLPLVLVTQGTLANVDFSQLLLPTLRALATLPVRVLAITAGRPVEMLGEEIPDNARVVEYLNFEHWLPRSAIFITNGGYGSLNAAIRHGVPLVVAGTGDGKLEAVARVIWSRCGISLNTDTPSEKQLYQAVTRILSSPEWHYQSQRIKADYDAHNALELITRHVNELIAESV

SEQ ID NO: 5676 - protein, 193 aa, Xenorhabdus bovienii
  Peptide sequence Name=Xb4151_4152.C408.gene10.pep
  Gene classification: Function=Uncharacterized BCR; Function class=S Function unknown
  Homolog annotation: Query=2..192bp; Hit=1..191bp; Blast score=271; Percent Identity=67.0; E value=3e-73; Homolog= yceI COG2353
MLKKMLIGLSAGALLMSTGSAIAANYKIDTIGQHAFIEFRIQHLGMSWLYGNFRKFDGDFAFDPQNPETNKVNVVIKTNSVDTNHAERDKHLRKPNFLNTEKYPEAKFTSTKISQEGEKYTVIGDLTLNGVTKPVTLNAKLMGEGKDPWGGYRTGFEANGKIKLKDFDIKANLGPKSQEVELVISVEGVREKA

SEQ ID NO: 5677 - protein, 184 aa, Xenorhabdus bovienii
  Peptide sequence Name=Xb4151_4152.C408.gene11.pep
  Gene classification: Gene name=CybB; Function=Cytochrome B561; Function class=C Energy production and conversion
  Homolog annotation: Query=1..180bp; Hit=1..180bp; Blast score=221; Percent Identity=65.0; E value=3e-58; Homolog= Z1693 COG3038
MLLKNTSTRFGHVSVFIHWLVALAVYGMFALGLWMVTLSYYDTWYHQAPELHKSIGSLIFFVMVIRLIWRFISPPPKPLTSYSYLTRISSKLAHFTLYLALFGILGSGYLISTADGQPISVFGWFNIPATLSEQGIQADTAGIIHLYLAWVVVVLSLLHTLAALKHHFIDRDSTLKRIFGFNPD

SEQ ID NO: 5678 - protein, 327 aa, Xenorhabdus bovienii
  Peptide sequence Name=Xb4151_4152.C408.gene12.pep
  Gene classification: Gene name=Tra8; Function=Transposase, IS30 family; Function class=L DNA replication, recombination and repair
  Homolog annotation: Query=1..312bp; Hit=1..312bp; Blast score=292; Percent Identity=52.0; E value=3e-79; Homolog= NMB0443 COG2826
MAYKQLTETERYQIFSLKEAGFSQREISKSLNRNPSTISRELRRNREAKKYTPEQAQLKAVARRQCATKAVKVKPEIEMWIKQLIWQDLSPEQTVGYLKRENIISLHHETVYRLIYKDKLNDGNLWQHLRIAKKPYRKRYGSYERRGKIKNRVSIDKRPKLVDKKQRIGDWEGDTIVGKNHKSALLTLVERKSLFTIIIKLENKTAEGVAKAATRHLSLIKHKIKTMTFDNGLEFAEHELISKNLETKIYFAHPYSPWERGINENTNGLIRDDFPKGTDFNKVSEREINLVANRLNNRPRKTRDYKTPNELFKGIPSHLLRPLRCCA

SEQ ID NO: 5679 - protein, 209 aa, Xenorhabdus bovienii
  Peptide sequence Name=Xb4151_4152.C408.gene13.pep
  Gene classification: Gene name=Gst; Function=Glutathione-S -transferases; Function class=O Posttranslational modification, protein turnover, chaperones
  Homolog annotation: Query=1..175bp; Hit=1..175bp; Blast score=159; Percent Identity=50.0; E value=1e-39; Homolog= PM1551 COG0625
MYTLWIANKNYSSWSLRPWILLKALEIPFNEQLSYFEDNKSSYEKFKAFSPTGLVPCLVEGEITVWDSLAIAEYLAEHHTQVWPQDRIARAWARSASAEMHSGFATLRQTCAMNCSKQFELEEISPELQCDIDRLDALWSDGLTKFGGEWLAGSTFTAVDAFFAPVAFRAQTYGLKFSAVSQAWVDRMLKHPAMVEWAEAAAKEPEMKH

SEQ ID NO: 5680 - protein, 644 aa, Xenorhabdus bovienii
  Peptide sequence Name=Xb4151_4152.C408.gene14.pep
  Gene classification: Gene name=Acs; Function=Acyl-coenzyme A synthetases/AMP-(fatty) acid ligases; Function class=I Lipid metabolism
  Homolog annotation: Query=1..626bp; Hit=1..626bp; Blast score=960; Percent Identity=71.0; E value=0; Homolog= ZprpE COG0365
MSFQDFYQYSIDDPNAFWAEQARRIHWQHPFAQVLDYNNPPFARWFSGGKTNLCYNALDRWLETQPDAKALIAISTETNSEEVFTYQELYQEVNRAAAMMLSLGVKKGDRVVVYMPMVAEALFVLLACARIGAIHSVVFGGFASHSLATRLDNAEPVLVVSADAGSRGGKIIPYKPLLDEAIELAQHTPRHVLMVNRGLAAINWLEGRDIDFASLRQIHLDADIPVTWMESNETSCVLYTSGTTGTPKGVQRDVGGYAVALATSMDTIFGGKPGGVFFCTSDIGWVVGHSYIVYAPLIAGMATIMYEGLPTRPDASIWWQIVEKHRVNRMFSAPTAIRVLKKYPTDCIAKYDISSLEALYLAGEPLDEHTARWVAEIINVPVIDNYWQTETGWPIMAIARGLDDRPSRFGSPGFPMYGFNVKLINELTGQECGDNEKGMLVAKGPLPPGCIQTVYGDDTRFINTYWKHFAQQIYSTFDWGIRDSDGYYFILGRSDDVINISGHRLGTREIEECITSHEDVAEVAVIGIKDEVKGQAAVAFAVLKEGRKIQSADHFAALEKALMDLVDKQLGSVGRPARVYFVTQLPKTRSGKMLRRTMQAICEGREPNDIALIENSASLEMIRDVVSHQATANKKYKVSPNDKN

SEQ ID NO: 5681 - protein, 483 aa, Xenorhabdus bovienii
  Peptide sequence Name=Xb4151_4152.C408.gene15.pep
  Gene classification: Gene name=PrpD; Function=Uncharacterized protein involved in propionate catabolism; Function class=R General function prediction only
  Homolog annotation: Query=1..483bp; Hit=1..483bp; Blast score=832; Percent Identity=81.0; E value=0; Homolog= ZprpD COG2079
MSTSVVNNRPDYDQVIVDIVDYVMDDTITSPVAYETAHYCFLDTLGCGLEALEYPACKKLLGPIVPGTVVPNGVRVPGTQFQLDPVQAAFNIGTLIRWLDFNDTWLAAEWGHPSDNLGGILAIADWLSRTAVANGKQPLTIKDVLTGMIKAHEIQGCLALENAFNKVGLDHVVLVKVASTAVVAQMLGLAREEILSAVSLAWVDGQSLRTYRHAPNTGSRKSWAAGDATSRAVRLALMAQKGEMGYPSVLTAKTWGFYDVLFNGQPFKFQRPYGTYVMENVLFKIAFPAEFHSQTAVEAAMTLHQQLKAAGKQVEDIARITIRTHEACIRIIDKQGSLNNPADRDHCIQYMVAIPLLLGRLTAADYEDNVAADPRIDVLREKMICVEDPDFTRDYHTPEKRSIANALTITFNDGSRLDEVKVEFPIGHARRRKDGIPLLLKKFSTNLARQFPDTQQRKILSVSLDRTLLENMPVNEYLDLYVI

SEQ ID NO: 5682 - protein, 391 aa, Xenorhabdus bovienii
  Peptide sequence Name=Xb4151_4152.C408.gene16.pep
  Gene classification: Gene name=GltA; Function=Citrate synthase; Function class=C Energy production and conversion
  Homolog annotation: Query=17..391bp; Hit=15..389bp; Blast score=613; Percent Identity=79.0; E value=1e-175; Homolog= prpC COG0372
MSKQNTMTGSPEAATFKPKKSVALSGVTAGNTALCTVGKNGSDLHYRGYDILDLATYCEFEEIAYLLIHERLPSRAELAAYKTKLKALRGLPSSVKAALEALPAVAHPMDVMRTGVSVFGCTLPEKEDHNLTGARDIADRLLASLGSILLYWYHYSHNGRRIDVETDDDSIGGHFLHLLHGQKPRDSWEKAMHASLVLYAEHEFNASTFTSRVIAGTGSDTYSAIIGGIGALRGSKHGGANEVSFEIQQRYDSPDKAEADILTRLERKEVIIGFGHPVYTVSDPRHKVIKEISLHLSKEAGTTQMFDIADRIESVMRDNKKMFPNLDWFSAVSYHMMGVPTAMFTPLFVIARTAGWAAHIIEQRIDNKIIRPSANYTGPENLPFTPIDQRK

SEQ ID NO: 5683 - protein, 296 aa, Xenorhabdus bovienii
  Peptide sequence Name=Xb4151_4152.C408.gene17.pep
  Gene classification: Gene name=PrpB; Function=PEP phosphonomutase and related enzymes; Function class=G Carbohydrate transport and metabolism
  Homolog annotation: Query=1..292bp; Hit=1..292bp; Blast score=455; Percent Identity=81.0; E value=1e-128; Homolog= prpB COG2513
MAFSSAGLAFRRAIEAESPLQVVGTINANHALLAKRAGYKAIYLSGGGVSAGSLGLPDLGISTLDDVLTDIRRITDVCDLPLLVDADIGFGSSAFNVARTVCSIIKAGAAGLHIEDQVGAKRCGHRPNKEIVSKEEMVDRIKAAVDARTDEHFVIMARTDALAVEGLESALDRAEAYIAAGADMLFPEAITELQMYQVFAARTQVPILANITEFGATPLFTTEELASVDVAIALYPLSAFRAMNRAAEQVYTTLRRDGTQKNVIDLMQTRNELYESINYYDFEQKLDALFSQKNQR

SEQ ID NO: 5684 - protein, 551 aa, Xenorhabdus bovienii
  Peptide sequence Name=Xb4151_4152.C408.gene18.pep
  Gene classification: Gene name=PspF; Function=Transcriptional regulators containing an AAA-type ATPase domain and a DNA-binding domain; Function class=T Signal transduction mechanisms
  Homolog annotation: Query=10..545bp; Hit=8..527bp; Blast score=631; Percent Identity=61.0; E value=0; Homolog= prpR COG1221
MASGYTGERDNNKPVIWTVSVSRLFDLFRDITPEFDHQADITPINLGFEQAVQHIRKRLETEHCDAVICAGSNGAYLKSRLSVPVIIAKSSGFDFMQALARARQISARIGVITYQNTLPALEEFQQRFNLRIEQRSYVTEEDARTQVNALKAIGIKVIVGAGLITDLAYEAELVGVFLYSADTIRQAFHDALEMARMTKLNLGGSSPYPTEDKLRIRHTLNDIIGDSAVVEHVRNTIMLYARSTATVLIQGESGTGKELVAQAIHHEYSLRYGQSVGKHPRPFVAVNCGAITESLLEAELFGYEEGAFTGSRRGGRAGLFEIAHRGTLFLDEIGEMPLPLQTRLLRVLEEKSVVRVGGYRPIAVDVRIICATHCDLDTWVREGRFRTDLFYRLSVLRINVPALRERGSDIGLLAVEYLRRAFAALNLPVSSSKIRELSACHAALQSYHWPGNVRELRNLMERIALYLSAHPEQALTPALILSLSPERQIDISSVKSNAKTFEIEPPSSMAVSSSVHDIVARFAGNRQAAAEYLGISRTTLWRRLKQEPEKD

SEQ ID NO: 5685 - protein, 171 aa, Xenorhabdus bovienii
  Peptide sequence Name=Xb4151_4152.C408.gene19.pep
  Homolog annotation: Query=18..161bp; Hit=19..157bp; Blast score=87; Percent Identity=34.0; E value=9e-17; Homolog= gi|23128995|ref|ZP _00110831.1| COG1917: Uncharacterized conserved protein, contains double-stranded beta-helix domain [Nostoc
MHSELLKFSHKNAKEGQWLLSEGNFYRVIATGVETNSRYSLVEIIVEPGKGAPFHFHKLEEEAFFILEGEMVFYTQTETMYGKQGAFLNFSVGQIRGFRNETDKNTRMLIILSPPGMEQMFFEGGKAIDAPIDLNTTFVENIGQTVTCPEIAGRYGIENIPLPLPEKKTTT

SEQ ID NO: 5686 - protein, 148 aa, Xenorhabdus bovienii
  Peptide sequence Name=Xb4151_4152.C408.gene20.pep
  Homolog annotation: Query=5..132bp; Hit=249..371bp; Blast score=90; Percent Identity=41.0; E value=3e-18; Homolog= gi|29826660|ref|NP _821294.1| putative transposase InsA homolog [Streptomyces avermitilis MA-4680] gi|29603756|dbj|BAC67829.1|
MVDNLTPQRWETHSAGWGAKGERQYDWVRVPLWRLQLSEKEREYGHYLRVRRSRDEKQARAYYIVYARRDQAALKTLAQVAGCRWEIEWGFEETKGECGLDHYEVRQWHSWYRHITLSLLAHAVLAVLRIQEKKNADGAGSPQYGGTA

SEQ ID NO: 5687 - protein, 131 aa, Xenorhabdus bovienii
  Peptide sequence Name=Xb4151_4152.C408.gene21.pep
  Homolog annotation: Query=1..88bp; Hit=44..131bp; Blast score=129; Percent Identity=73.0; E value=8e-30; Homolog= gi|33867233|ref|NP _898791.1| IS sequence [Rhodococcus erythropolis] gi|33669067|gb|AAP74061.1| IS sequence [Rhodococcus erythr
VLIVDETGFIKKGTHSAGVQRQYSGTAGRVENSQTGVFLCYAGQGGHAFIDRALYLPRQWTDDRPRCEAAGIPDAVPFATKPQLARQMPFMVRIAACAAGWNPDINRLCWRSPKMNRCGGKGQLLSERTRW

SEQ ID NO: 5688 - protein, 97 aa, Xenorhabdus bovienii
  Peptide sequence Name=Xb4151_4152.C408.gene22.pep
MTALTGITEKDACLTVFDATGGATVLTLHTGRMRAFFDKAGFIHNEHPVFIPQMLCDIVAQNIAGDINIPVGALQQMLNPVRLSIPPVASHFYAQRH

SEQ ID NO: 5689 - protein, 70 aa, Xenorhabdus bovienii
  Peptide sequence Name=Xb4151_4152.C408.gene23.pep
MHLPTHAWEQELLSLHTRLAPLFHHPGPQQRSLAYLRGLLSDVERKNGWQLAEWIGERGSASAGARPLGC

SEQ ID NO: 5690 - protein, 247 aa, Xenorhabdus bovienii
  Peptide sequence Name=Xb4151_4152.C408.gene24.pep
MPTDACASELENTMDNPFYFLHPKLKAQAENKVENFAQAVEEARQASKNNRLSISSYVPGLQGISSLSQYSFNYVYEKMALGNTTLFLDVYQLHAFYKQRGLEDLKTCLNLRQDIYGNSQFPILWPIGQNNLKFGLPYDDILLAFEAIEAGNIAQGVVHLAYHEQINILQTTMYSDEQLIVFLWGNQFSYVTGFLPDNVAQPVELTLASQCQFIDNKRTIKFSDEVANLADVDQRMPFVLKAADRFD

SEQ ID NO: 5691 - protein, 211 aa, Xenorhabdus bovienii
  Peptide sequence Name=Xb4151_4152.C408.gene25.pep
MSLLQRIDWRHGSLILVLFVILGSAGIYLYHFFYSSEPEIALVIGEPYEAMRQRSSAAIDPDLSGKIWYNIPKTDARLRFTDPQYGFVTPTARFFTVSYNKGIVESVRMSPQIEPLLYDDTIKIVLNLQNQWRKSGWVLTQARGFPALADTPEWHDTLRRRKNGAGTTYWQAGDKYQIMLNLRRFKDDRHPNEERYLITLAIAKPWVDFNP

SEQ ID NO: 5692 - protein, 110 aa, Xenorhabdus bovienii
  Peptide sequence Name=Xb4151_4152.C408.gene26.pep
MRCYMIATECRMSLLQRIGQWRSGLILAILIILGLVTIYLYQVFYSREPEIALVIGEPYEAMRQRSSAKISPPYDNSIGFRIPKTDARLRFTDPKYGFITPPARFFYCFL

SEQ ID NO: 5693 - protein, 144 aa, Xenorhabdus bovienii
  Peptide sequence Name=Xb4151_4152.C408.gene27.pep
MIIASGSESQKRMHAYALPIRNTDLLPPLHDFFTVSYNKGIIENVRMSPQIEPLLYDDAIKIVLDLQDQWRKTGWVLTREYQPLVNTPELHDSLRRMKGTGMTFWQAGDLYQAMLNMARFKDDRHPSEERYLITLQIAEPWVKP

SEQ ID NO: 5694 - protein, 63 aa, Xenorhabdus bovienii
  Peptide sequence Name=Xb4151_4152.C408.gene28.pep
MSLLQRIGQRRSGLTFALLIILSLIAAYLYHAFYSREPAEIALVIGEPYEEMRQRSRSCPLII

SEQ ID NO: 5695 - protein, 230 aa, Xenorhabdus bovienii
  Peptide sequence Name=Xb4151_4152.C408.gene29.pep
  Gene classification: Function=Transposase; Function class=L DNA replication, recombination and repair
  Homolog annotation: Query=4..218bp; Hit=88..302bp; Blast score=153; Percent Identity=39.0; E value=2e-37; Homolog= NMA1185 COG3547
MGNLAKTDKIDAQVLAQLALVLSQRTDRDKIVRILPSAQQRVLQAMIARRRQLVVLSISERQRLGNCHPDIRESITLMISFIQEQLKVIESALSKHIKTYHRSKLDLLSTVKGVGPATIATLIADVPELGKLTRREISALIGVAPFNRDSGFFRGKRTIFGGRAMVRRMLYMATLTAIRFNPVLCAFYKRLTEAGKPNKVAIVACMRKLLVILNAMIKTNRPWDESFHTV

SEQ ID NO: 5696 - protein, 112 aa, Xenorhabdus bovienii
  Peptide sequence Name=Xb4151_4152.C409.gene1.pep
  Gene classification: Gene name=InfC; Function=Translation initiation factor IF3; Function class=J Translation, ribosomal structure and biogenesis
  Homolog annotation: Query=1..112bp; Hit=68..179bp; Blast score=155; Percent Identity=90.0; E value=6e-39; Homolog= infC COG0290
MDYGKFLYEKSKSVKEQKKKQKVIQVKEIKFRPGTDEGDYQVKLRNLIRFLEDGDKAKITLRFRGREMAHQQIGIEMLNRIREDLSELAVVESFPSRIEGRQMIMVLAPKKK

SEQ ID NO: 5697 - protein, 65 aa, Xenorhabdus bovienii
  Peptide sequence Name=Xb4151_4152.C409.gene2.pep
  Gene classification: Gene name=RpmI; Function=Ribosomal protein L35; Function class=J Translation, ribosomal structure and biogenesis
  Homolog annotation: Query=1..65bp; Hit=1..65bp; Blast score=86; Percent Identity=90.0; E value=5e-18; Homolog= rpmI COG0291
MPKIKTVRGAAKRFKKTASGGFKRKHANLRHILTKKSTKRKRHLRPKGMVSKGDLGLVVACLPYA

SEQ ID NO: 5698 - protein, 118 aa, Xenorhabdus bovienii
  Peptide sequence Name=Xb4151_4152.C409.gene3.pep
  Gene classification: Gene name=RplT; Function=Ribosomal protein L20; Function class=J Translation, ribosomal structure and biogenesis
  Homolog annotation: Query=1..117bp; Hit=1..117bp; Blast score=144; Percent Identity=93.0; E value=1e-35; Homolog= VCA0290 COG0292
MARVKRGVIARARHKKILKQAKGYYGARSRVYRVAFQAVIKAGQYAYRDRRQRKRQFRQLWIARINAAARQNGMSYSRFINGLKKASIEIDRKILADIAVFDKVAFAALVEKAKGALA

SEQ ID NO: 5699 - protein, 327 aa, Xenorhabdus bovienii
  Peptide sequence Name=Xb4151_4152.C409.gene4.pep
  Gene classification: Gene name=PheS; Function=Phenylalanyl-tRNA synthetase alpha subunit; Function class=J Translation, ribosomal structure and biogenesis
  Homolog annotation: Query=1..327bp; Hit=1..327bp; Blast score=596; Percent Identity=86.0; E value=1e-171; Homolog= ZpheS COG0016
MSHLTELVAKAEAAVEEAQDVAALDLVRVEYLGKKGHLTLQMSSLRDLPADERPAAGAVINQAKQEVQEALNARKAKLEADVLNARLAAEKIDISLPGRRMENGGLHPVTRTIERIETFFGELGFSVESGPEIEDDYHNFDALNIPAHHPARADHDTFWFDATRLLRTQTSGVQIRTMKERQPPIRIIAPGRVYRNDYDQTHTPMFHQVEGLIVDKDISFTNLKGTLHDFLNNFFEEEMQVRFRPSYFPFTEPSAEVDVMGKNGKWLEILGCGMVHPNVLRSVGIDPEIYSGFAFGMGMERLTMLRYGVTDLRAFFENDLRFLKQFK

SEQ ID NO: 5700 - protein, 795 aa, Xenorhabdus bovienii
  Peptide sequence Name=Xb4151_4152.C409.gene5.pep
  Gene classification: Gene name=PheT; Function=Phenylalanyl-tRNA synthetase beta subunit; Function class=J Translation, ribosomal structure and biogenesis
  Homolog annotation: Query=146..795bp; Hit=2..651bp; Blast score=974; Percent Identity=72.0; E value=0; Homolog= pheT_2 COG0072
MKFSELWLREWTNPAISSEALSDQITMAGLEVDGVEKVAGQFHGVVVGEVVECGQHPNADKLRVTKVNVGGDRLLDIVCGAPNCRQGLRVAVATVGAVLPGDFKIKAAKLRGEPSEGMLCSFSELGIADDHDGIIELPADAPIGIDLRDYIKLNDSAIEISITPNRADCLSIMGVARDVAVINKLSMTEPQIEAVKLTTEATFPIRVDAPEACPRYLGRVIKNVNVKATTPLWMREKLRRGGIRSIDPIVDVTNYVLLELGQPLHAFDLERLSGSIIVRLAEQGEKLTLLDGNEIELSADTLVIADEKQALAMAGIFGGQYSGVNSETQHILLECAFFAPLAITGRARCYGLHTDASHRFERGVDPQLQHKAMEYATQLLIAICGGEAGEIIDVTSGSYLPKSATITLNRKKLDRLIGHHIVDDEVTDILTRLGCQVTVQSNSWQAVVPSWRFDMQIEEDLVEEIARIYGYNNIPDVPVRADLVMTAHREANLPLKRVKTMLVDKGYQEAITYSFVDPKIQQYLHPQEEALILPNPISADMSAMRLSLLTGLLTTVVYNQNRQQNRIRLFETGLRFVPDENAEHGIRQELMLGGVIAGNRFEEHWMLEKQAVDFFDLKGDLESVLELTGMLSSISFRAEEHPALHPGQSAGIYLENNYIGYIGVVHPELERKFDLNGRTVIFELLWASLVDRVIPEMKEVSRFPSNRRDIAIVVPENVAAEDVLAECKKVGVNHIVGINLFDVYCGKGVAEGHKSLAISLILQDTVRTLEEKEIAATVNKCVAALEQRFKASLRD

SEQ ID NO: 5701 - protein, 98 aa, Xenorhabdus bovienii
  Peptide sequence Name=Xb4151_4152.C409.gene6.pep
  Gene classification: Gene name=HimA; Function=Bacterial nucleoid DNA -binding protein; Function class=L DNA replication, recombination and repair
  Homolog annotation: Query=1..98bp; Hit=1..98bp; Blast score=153; Percent Identity=87.0; E value=3e-38; Homolog= himA COG0776
MALTKAEMSENLFEKLGISKRDAKDLVEIFFEEVRHSLENGEQVKLSGFGNFDLRDKNQRPGRNPKTGEDIPITARRVVTFRPGQKLKNRVEKALPKE

SEQ ID NO: 5702 - protein, 331 aa, Xenorhabdus bovienii
  Peptide sequence Name=Xb4151_4152.C409.gene7.pep
  Gene classification: Gene name=BtuC; Function=ABC-type cobalamin/Fe3+- siderophores transport systems, permease components; Function class=P Inorganic ion transport and metabolism
  Homolog annotation: Query=11..327bp; Hit=8..323bp; Blast score=291; Percent Identity=59.0; E value=5e-79; Homolog= ZbtuC COG0609
MHSVYELITLQKKRDYRVIALLSILFIMLFILSLCAGELWFWPDQWLSDSARLFIWQLRLPRAIAVIVVGASLAVSGAVMQALFENPLAEPGLLGISNGAGVVVVCLILVFHGIAPLWLLSIGAVLGAFAMTAILLGFSRKHQVTNTRLLLIGVAFGVMFGAMMTWMVYFSTSLDLRQLMYWMMGSFSGIDWRQKWLVIALVPAIFWLSQQGKVLNYLSLGELQAQQLGISHNKWRNLFISIVGLLVGLSVALAGAISFIGLVIPHILRLTGLTDHKTLLPACALAGSSGLLLADLFSRLSLSHAEVPIGVVTVTLGAPIFIWLLLKTHHR

SEQ ID NO: 5703 - protein, 255 aa, Xenorhabdus bovienii
  Peptide sequence Name=Xb4151_4152.C409.gene8.pep
  Gene classification: Gene name=FepC; Function=ABC-type cobalamin/Fe3+- siderophores transport systems, ATPase components; Function class=P Inorganic ion transport and metabolism
  Homolog annotation: Query=6..249bp; Hit=4..244bp; Blast score=192; Percent Identity=42.0; E value=2e-49; Homolog= ZbtuD COG1120
MTCQPILELNNITVDKRLTTLSESVIAKEQIHLVGLNGSGKSTLLSAIAGILPYSGKIHLNGRNLRDYRQYELAKYRAWFSQSVSVPIMPVYQYLDMYRPDSAPLDQSESVLYELCRQLKLTSLLSSSIGQLSGGEWQRVRLAGVFLQIWPELNPNGKLLLLDEPTNNLDITQQTVLDQLIKQFCSLGGSVLMSSHDLNHTYEQATSVWLLSHGKLLVSGIPQNVMTNQNLSEIFEVNIRHIQNTSYKLWRVDHL

SEQ ID NO: 5704 - protein, 341 aa, Xenorhabdus bovienii
  Peptide sequence Name=Xb4151_4152.C409.gene9.pep
  Gene classification: Gene name=WecE; Function=Predicted pyridoxal phosphate-dependent enzyme apparently involved in regulation of cell wall biogenesis; Function class=M Cell envelope biogenesis, outer membrane
  Homolog annotation: Query=3..335bp; Hit=58..390bp; Blast score=449; Percent Identity=65.0; E value=1e-126; Homolog= yfbE COG0399
MFGCRHAIALCSATAGMHLVLLALGIGPGDEVITPSQTWVSTINMICLLGAEPVMVDVDRDTLMVSAETVRKAITPNTKAIIPVHYAGAPCDLDALRIVADEANIPLIEDAAHAVGTRYKNEWVGERGTAIFSFHAIKNMTCAEGGMFVTDNDELAQRVRCLKFHGLAVDAFDRQLQGRKPQAEVIEPGFKYNLSDIHAAMAVVQLGKLESMNARRGELVARYAAALSNSPLQMLSVPEYEHGHTHHLFMVRVDQDVCGIDRDTFMARLKERNIGTGLHFRAAHTQKYYRERFPMLSLPASEWNSATLCSLPLFPDMNNDDVDRVVNSITEILSEHRNSDI

SEQ ID NO: 5705 - protein, 325 aa, Xenorhabdus bovienii
  Peptide sequence Name=Xb4151_4152.C409.gene10.pep
  Gene classification: Gene name=WcaA; Function=Glycosyltransferases involved in cell wall biogenesis; Function class=M Cell envelope biogenesis, outer membrane
  Homolog annotation: Query=6..313bp; Hit=7..314bp; Blast score=482; Percent Identity=73.0; E value=1e-136; Homolog= yfbF COG0463
VTFEKIKKVSVVIPVYNEEESLPQLLERTIAACQQLEQKYELILVDDGSRDSSADILTQAAETPENHVIAILLNRNYGQHSAIMAGFHQADGDLVITLDADLQNPPEEIPRLVKTAEEGYDVVGTRRANRQDSWFRKTASKIINVMITKATGRSMGDYGCMLRAYRRHIVHAMLQCHERSTFIPILANTFARRTTEIDVTHAEREFGDSKYSFMKLINLMYDLLTCLTTAPLRLLSVVGSIIAVTGFLLAVLLITLRLIFGSIWAAEGVFTLFAILFMFIGAQFVAMGLLGEYVGRIYNDVRARPRYFIQKVVGVRKINDNQEKS

SEQ ID NO: 5706 - protein, 661 aa, Xenorhabdus bovienii
  Peptide sequence Name=Xb4151_4152.C409.gene11.pep
  Gene classification: Gene name=WcaG; Function=Nucleoside-diphosphate -sugar epimerases; Function class=M Cell envelope biogenesis, outer membrane
  Homolog annotation: Query=306..650bp; Hit=1..345bp; Blast score=604; Percent Identity=80.0; E value=1e-172; Homolog= yfbG_2 COG0451
MKAVIFAYHDIGCVGLNALVKAGFDIQAVFTHTDDPNENHFFSSVARIGADLGLPVFAPENVNHPLWIERIREMKPDVIFSFYYRNMLSQDLLSLAEKGAFNLHGSLLPKYRGRAPVNWAVLNGETETGVTLHRMVMKPDAGDIVAQQAVLIGETDTSLDVHGKIREAAVELLDSILPQIKSSHYLSIPQDENQATYFGRRTAEDGEIDWHKSAKEINNLVRAVTEPYPGAFTFLGERKITVWRSRPLIQVHDKLPGTVLSTTPFVIACGEGALEITSGQGESGLYVQGSRLVLEMGIVTDVRVGSKATAQISRRKRVLILGVNGFIGNHLTERLLDDEKYDIYGMDIGSSAIERFIGNPRFHFIEGDVSIHTEWIEYHIKKCDVILPLVAIATPIEYTRNPLRVFELDFEENLKIVRYCVKYNKRIIFPSTSEVYGMCDDKEFDEDTSRLIVGPINKQRWIYSVSKQLLDRVIWAYGVKEGLKFTLFRPFNWMGPRLDNLNSARIGSSRAITQLILNLVEGSPIKLVDGGEQKRCFTDINDGIEALFRIIENRDGLCDGQIINIGNPTNEASIRQLAEMLLESFEKHELRGNFPPFAGFKKIESSSYYGQGYQDVEHRKPSIKNAERLLGWKPTIDMKQTIDETLDFFLCGEVEELTRED

SEQ ID NO: 5707 - protein, 297 aa, Xenorhabdus bovienii
  Peptide sequence Name=Xb4151_4152.C409.gene12.pep
  Homolog annotation: Query=1..297bp; Hit=1..297bp; Blast score=530; Percent Identity=82.0; E value=1e-149; Homolog= Pa|phot2b01.q1k_g9| 7101 - 7994 437 297 aa, chain -
MKKVGLRIDVDTYQGTKEGVPQLLEILQRHHIQASFFFSVGPDNMGRHLWRLLRPKFLWKMLRSNAVSLYGLDILLAGTAWPGKKIAKNLGYLMKQAVDAGHEIGLHAWDHQGWQAKVERWSEAELAEQVQLGIDALKKATGQAITCSAVAGWRADERVLTVKQRFGFDYNSDCRGTHPFRPLLPDGTIGTVQIPVTLPTYDEVVGTQVSDADFNRFILDAMKNDLGVSVYTIHTEVEGMSKSPQFETLLNMLHQQDIQFCKLSHLLPENRETLPIGKIVRSDFPGREGWLGCQQKV

SEQ ID NO: 5708 - protein, 540 aa, Xenorhabdus bovienii
  Peptide sequence Name=Xb4151_4152.C409.gene13.pep
  Gene classification: Function=4-amino-4-deoxy-L-arabinose transferase and related glycosyltransferases of PMT family; Function class=M Cell envelope biogenesis, outer membrane
  Homolog annotation: Query=4..537bp; Hit=13..548bp; Blast score=473; Percent Identity=46.0; E value=1e-133; Homolog= Z3515 COG1807
MALFFILTYLLPLNGRLLWQPDETRYAEISREMLQRGDWIVPYFFDIRYFEKPVAGYWFNNISQWIFGDNNFAVRFGSVFSTLLSAFLLYLLAMMMWKNRQIAFVSSLIYISMFIVFSIGSYSVLDPMFSLWVTAGIVSCYWALKAGSTRERMLAWSALGLACGMAFMTKGFLALALPVISMIPITIYQKRFWEMVRFGPLAVIFAILISLPWVIAIALREPDYWHYFFWVEHIQRFASDKAQHIAPMWYYLPILVLGVLPWLGLLPGSLMKSWKEKKSHPEMFFLLCWFIIPFVFFSIAKGKLPTYVLPFIGPLALMMAKYSIDCVSNGKMKALKINGLVNVLFGIIAILVLLVMQTLLNRPFYQPSEWSKWLLGTVAFGAWGIIGYLCFIHNGKRWLWAAACSLVLSLSFSSTLPNRTIDSKLPQNFIRQNVQELTDSKYILSEAVGLGAAVAWELKRSDIYMFDRTGELEYGLAYPDSQYRYVAQEKFPAWLEKARKEGQVAIVFLLSSKGGLPELPKPDLVRRSDRFVLVIYKKQS

SEQ ID NO: 5709 - protein, 93 aa, Xenorhabdus bovienii
  Peptide sequence Name=Xb4151_4152.C409.gene14.pep
MGYAILSGKYCSSRSQNIIPIPNKRIAPVSQIATDTPLWWVSVFCQQVTACFWHSCPAQVSRLTNINNAKLLVMIVFYKSQEQNGHYGAQDQV

SEQ ID NO: 5710 - protein, 76 aa, Xenorhabdus bovienii
  Peptide sequence Name=Xb4151_4152.C409.gene15.pep
  Homolog annotation: Query=4..76bp; Hit=41..113bp; Blast score=86; Percent Identity=72.0; E value=1e-16; Homolog= gi|37526546|ref|NP _929890.1| PbgE2 protein [Photorhabdus luminescens subsp. laumondii TTO1] gi|36785977|emb|CAE15029.1| PbgE2 p
VAIWLTGAILLLGIGMIFWLRLLQYLPLSIAYPMLSINFVVVTLVGQFLYQEKVGLKHWIGVFAIMFGILLMSLNQ

SEQ ID NO: 5711 - protein, 128 aa, Xenorhabdus bovienii
  Peptide sequence Name=Xb4151_4152.C409.gene16.pep
  Gene classification: Gene name=RhaT; Function=7 Permeases of the drug/metabolite transporter (DMT) superfamily; Function class=G Carbohydrate transport and metabolism
  Homolog annotation: Query=1..105bp; Hit=4..102bp; Blast score=58; Percent Identity=45.0; E value=2e-09; Homolog= PA3558 COG0697
MRGYLWGLTSVLLITVAQLLLKWGAARLPELSLSTYWLDIDWIWAHHNPLLMVMAGLAGYALSMLCWLFVLQYLPLNKAYPMISLSYVFVYLMAALLPWFNETLSWLKTAGVLFILLGVWLISRPDAK

SEQ ID NO: 5712 - protein, 92 aa, Xenorhabdus bovienii
  Peptide sequence Name=Xb4151_4152.C409.gene17.pep
  Homolog annotation: Query=27..92bp; Hit=41..106bp; Blast score=73; Percent Identity=53.0; E value=7e-13; Homolog= gi|16329754|ref|NP _440482.1| unknown protein [Synechocystis sp. PCC 6803] gi|14195505|sp|P73136|YA25_SYNY3 Hypothetical protei
MKKLAILLAALLSFGACAKTKVDVSKIYGNIKVVSSGADYKVKVVSSSPDLKVKIVTSSANSPGKWKMVNSSPDYKIQFVNSFPDFTIKYVN

SEQ ID NO: 5713 - protein, 90 aa, Xenorhabdus bovienii
  Peptide sequence Name=Xb4151_4152.C409.gene18.pep
MPNLKDLSNQLALIRKQIPFAMAQVLTSVAHDDVWQRKKSKSKKSKRRRFGDALPVEPILSYQERAQQMAQSLMPAAISQALSEAIQTAK

SEQ ID NO: 5714 - protein, 131 aa, Xenorhabdus bovienii
  Peptide sequence Name=Xb4151_4152.C409.gene19.pep
  Gene classification: Gene name=Spr; Function=Cell wall-associated hydrolases (invasion-associated proteins); Function class=M Cell envelope biogenesis, outer membrane
  Homolog annotation: Query=5..131bp; Hit=28..154bp; Blast score=197; Percent Identity=71.0; E value=2e-51; Homolog= ZnlpC COG0791
LRTALSDPIMVIAQLKEQLNQWHGTPYRYGGIDQRGVDCSGFVYRTFHDRFNIHLPRTTNEQTKLGTQISKDDLMPGDLVFFKTGSGESGLHVGIYDINDEFIHASTSKGVIRSSLGNVYWRRVFWQARRM

SEQ ID NO: 5715 - protein, 338 aa, Xenorhabdus bovienii
  Peptide sequence Name=Xb4151_4152.C409.gene20.pep
  Gene classification: Gene name=LplA; Function=Lipoate-protein ligase A; Function class=H Coenzyme metabolism
  Homolog annotation: Query=1..338bp; Hit=1..338bp; Blast score=508; Percent Identity=68.0; E value=1e-144; Homolog= lplA COG0095
MSTLRLLLSDSHDPWFNLAVEECIFRQMSPDQRVLFLWRNANTVVVGRAQNPWKECNTRRMEQDGIKLARRSSGGGAVFHDLGNTCFTFMAGKPEYNKTVSTQIILEGLKKAGIHAMVSGRNDLILSSPEGERKISGSAYRETKDRGFHHGTLLINADLNRLADYLNPDPKKLQAKGITSVRSRVTNLSELLPDITHEKVCGGITEAFFEYFGEVAKSELISPQAVPDLPGFTDVFAKQGSWEWNFGQAPEFSHTLDNRFCWGGIELHVDIEHGTIGRCQIFTDSLEPAPFELLAEKLVGVLYQPQAVGQVIQQIREQYSLLDKELQQLYHWLVDELK

SEQ ID NO: 5716 - protein, 120 aa, Xenorhabdus bovienii
  Peptide sequence Name=Xb4151_4152.C409.gene21.pep
  Gene classification: Gene name=AraC; Function=AraC-type DNA-binding domain-containing proteins; Function class=K Transcription
  Homolog annotation: Query=5..116bp; Hit=6..112bp; Blast score=112; Percent Identity=50.0; E value=7e-26; Homolog= rob COG2207
MLESVINDIVRWLESQLQRTEGIKIDAIAHKSGYSKWHLQRIFKELKGCTLGQYVRRRRLHEAAKSLHEDSLPILDIALQYGFSSQATFTRIFKKHFNTTPAKFRASGQLPEFKTFLHCE

SEQ ID NO: 5717 - protein, 66 aa, Xenorhabdus bovienii
  Peptide sequence Name=Xb4151_4152.C409.gene22.pep
MIRNLHVMLGIPADVLIKPTKNSPVMGNTTRLSKFDCITASFIINNVAIISLYLKTNKHLMRTINS

SEQ ID NO: 5718 - protein, 165 aa, Xenorhabdus bovienii
  Peptide sequence Name=Xb4151_4152.C409.gene23.pep
  Homolog annotation: Query=27..150bp; Hit=53..189bp; Blast score=91; Percent Identity=39.0; E value=6e-18; Homolog= Pa|Phot5-515h10.p1k _g164| 100451 - 101062 1361 203 aa, chain +
MKIINILFCAALYCLLISPVRADEKMVNAEKQQILSADYNMEFKNSSSSVNDFMIAKRSTDCMYDSGADQIRVEPGNQQSTHLQDNDNLFSACTLRPKWVEWAVSSGSTSCALRFERGFDGGWYTVIKGCPNIVKSATCGDADCNQNNVYGSSSYMDISVELLIR

SEQ ID NO: 5719 - protein, 264 aa, Xenorhabdus bovienii
  Peptide sequence Name=Xb4151_4152.C409.gene24.pep
  Gene classification: Gene name=FepC; Function=ABC-type cobalamin/Fe3+- siderophores transport systems, ATPase components; Function class=P Inorganic ion transport and metabolism
  Homolog annotation: Query=9..262bp; Hit=1..254bp; Blast score=270; Percent Identity=51.0; E value=1e-72; Homolog= Z4919 COG1120
MESVMSENLLEARNLNYFIGHRQIIKDISLSLQKGEVVAIIGPNGAGKSTLLRLLTGYIPSNSGECLLKGVPISRWPTQQLARIRAVMRQYSSLSFPFSVEEIIAMGRVPHENTHRKTAIDEAIMLTECEELRHRNYQQLSGGEQQRVQLARVLTQLWHPEPTESCLFLDEPTSALDLYHQQHTLRLVHRLTRQRPLAVCCVLHDLNLASLYADKIILLHKGKLVASGSPQDVLRDDILKQWYRADLGVTQHPETYQPQVYLRQ

SEQ ID NO: 5720 - protein, 333 aa, Xenorhabdus bovienii
  Peptide sequence Name=Xb4151_4152.C409.gene25.pep
  Gene classification: Gene name=BtuC; Function=ABC-type cobalamin/Fe3+- siderophores transport systems, permease components; Function class=P Inorganic ion transport and metabolism
  Homolog annotation: Query=4..327bp; Hit=5..325bp; Blast score=306; Percent Identity=58.0; E value=2e-83; Homolog= ZchuU COG0609
MSRSHSPSFGLMALGLLLFLLAISSANMGALPLSFKTLWESSLDDPQWQIWLNIRLPRILLAILVGGALAVSGAVMQGLFRNPLADPGLLGISSGAALTVATVIVLPFTLPASIALYGHIIAAFIGSLLVSFLIFSLNKYNHGNLSKLLLAGIAINALCMSFIGVLSYVSNDQQLRQFSIWMMGSLSQIEWPTLIIAASLIIPVCILAFSQSRKLNLLQLGDEEAHYLGINVQRTKYQLLLLSALLIGCAVALSGVIGFIGLVIPHLVRLRFGGDHTWLLPISVLGGACLLLSADTLARTLVSPAEIPVGLITGLIGAPYFLWLILKPSGGRL

SEQ ID NO: 5721 - protein, 272 aa, Xenorhabdus bovienii
  Peptide sequence Name=Xb4151_4152.C409.gene26.pep
  Gene classification: Gene name=FecB; Function=ABC-type cobalamin/Fe3+- siderophores transport systems, periplasmic components; Function class=P Inorganic ion transport and metabolism
  Homolog annotation: Query=21..257bp; Hit=34..273bp; Blast score=156; Percent Identity=38.0; E value=2e-38; Homolog= mll1151 COG0614
MKKWLLTFMFAISGNAFSAERIVTIGGDVSEIVFALGEGQNVVARDSTSQNPKALLSLPDVGYMRMLNSEGILSMRPSLVIVSESAQPSLALKQVENSGVKVIKVTSKASLEAVSEKILTVAKAVNQEKSGEMLISQYRQQLAEINTSNIPTKVIFVMSHGGIMPMAAGQQTAADQIIRSIGAQNAMQGFKGYRPLSQEGVIASQPDLLLVSTEGLKTLGGMDKLWQLPGLNFTPAGKKKQVIIVDEMGLLGFGIQTPAVMKQVREAAEKVQ

SEQ ID NO: 5722 - protein, 357 aa, Xenorhabdus bovienii
  Peptide sequence Name=Xb4151_4152.C409.gene27.pep
  Gene classification: Function=Putative heme degradation protein; Function class=P Inorganic ion transport and metabolism
  Homolog annotation: Query=6..345bp; Hit=4..335bp; Blast score=380; Percent Identity=56.0; E value=1e-105; Homolog= ZchuS COG3720
VNQSLYERYLQAKADNKAKYARDLAAYLNVSEGELLHSRVGIDAKRLNVDAPALLQELATVGETKAITRNDFAVHEQVGRYENTQFSPHVGLILNPRELDLRLFFDHWACVFSLVEPAKNGLRHSIQFFDRQGDALHKVYTTKDTDMAAWEALIEKYQTDENPALEIQPEKVSEHKEVTEQLKAQLDEEWRAMTNVHQFFMMMSRHNLNRQQIFNAVGNDLAYRVENSSLTQIIETAHNDQNEIMIFVGNRGCIQIFTGKLERLMPYQEENSPQKWVNIFNRDFTLHLIESAIVESWVTRKPTTDGFVTSLELFDAEGNQIAQLYGQRTEGTPEQAHWRKQIAALPKLESEKETCIV

SEQ ID NO: 5723 - protein, 686 aa, Xenorhabdus bovienii
  Peptide sequence Name=Xb4151_4152.C409.gene28.pep
  Gene classification: Gene name=CirA; Function=Outer membrane receptor proteins, mostly Fe transport; Function class=P Inorganic ion transport and metabolism
  Homolog annotation: Query=1..686bp; Hit=1..660bp; Blast score=754; Percent Identity=56.0; E value=0; Homolog= ZchuA COG1629
MNPIKLPNLKLSSLSVVILTGLSSAHATTILAEENKSSKDTLTVYATGNERDSFEAPMMVTVIEGNSANNRVAGNAHDLLRNLPGINVSGSGRTNGQDISMRGYSKKGVLTLVDGIRQGTDTGHLNGLFLDPSLIKQVEVVRGPSALLYGSGALGGVIAYQTVDAADLLQEGKNTGFRVFSRAATGDHSLGFGGAAFGKTEQLDGLFAFSSRDVGNIRYGNSLIGHNDETIGNMLAKGKWNINDSQSLSSELRYYRNQSHEPKNPQAITDNAKNDNPRADRTTTQHDAQLTYRLNPAEYNWLNTKADIYYSDVTINAKTKEKGFEGRKQETYGVKLENRSHLGANTFSVHQFTYGGEAYKQKQKPNGNTESFPDADIRFASGWVQDEITLRDLPVSFIVGTRYDNYNASNAKYDDISANKWSSKGAVSITPTPWSMLFTSYSQAFRAPTMGEMYNDSKHFHMPAMRGKPGFTNYWKPNPNLRPESNETLESGFGLRFDDLFSSNDELKFKVSYFDTQAKDYITSIVTMPDMRSTTSINIPKTKIWGWDASMSYESNWFSWNLAYNRTMGKNEETGESIADLSPDTLSSMLDIPLSNTGFSLGWIGKFTQHTQFRGINGDKNERGQKLSQYAGYGINDFYVSYHGDGKLKGLTTSVVLGNAFDKEYYSPLGAPQDGRNGKLFISYQW

SEQ ID NO: 5724 - protein, 348 aa, Xenorhabdus bovienii
  Peptide sequence Name=Xb4151_4152.C409.gene29.pep
  Gene classification: Gene name=AroG; Function=3-Deoxy-D-arabino -heptulosonate 7-phosphate (DAHP) synthase; Function class=E Amino acid transport and metabolism
  Homolog annotation: Query=1..347bp; Hit=1..347bp; Blast score=537; Percent Identity=73.0; E value=1e-153; Homolog= ZaroH COG0722
MHKTDELRTRSIGRLITPKALAEQYPISEKIRQNVTLSRKRIESILTGNDPRLLVIIGPCSIHDVDAALDYAARLQVLREKYQHSLEIVMRTYFEKPRTVIGWKGLISDPLLDGSCQVNKGISLARKLLNDINELGMPTATEFLDMVTGQYIADLISWGAIGARTTESQIHREMASALSCPVGFKNGTDGNTHIAIDAIRAARAKHMFLSPDKDGRMTIYQTNGNPHGHIIMRGGKKPNYKAEDIAAACQKLHEYQLTERLIVDCSHGNCQKIHRRQLDIAKDIGQQIQSGSTSIAGVMAESFLIEGTQKVVHGEPLTYGQSITDPCLSWQDTEQFINILSRAVKDRT

SEQ ID NO: 5725 - protein, 287 aa, Xenorhabdus bovienii
  Peptide sequence Name=Xb4151_4152.C409.gene30.pep
  Gene classification: Function=Uncharacterized BCR; Function class=S Function unknown
  Homolog annotation: Query=12..287bp; Hit=2..277bp; Blast score=432; Percent Identity=74.0; E value=1e-121; Homolog= ydiA COG1806
MTENHTSKTQENETLERSVFFISDGTAITAEVLGHAVLSQFPITVTSYTLPFVNSKMRAEEIKTQINAIYQETQLKPLVFYSIISDEVKSIITSSDGFCQDIVQTLVAPLQQEIGLEPKPELHRTHGLSKKNLGQYDARIAAIDYALAHDDGVSLRNLEQAQVIILGVSRCGKTPTSLYLAMQFGIQAANYPFTADDMDNLQLPAALKPFQHKLFGLTISPERLAAIREERRENSRYASLRQCRLELAEVEALFRKNKINYLNTTNYSVEEISTKIIDSMGLKRRMF

SEQ ID NO: 5726 - protein, 792 aa, Xenorhabdus bovienii
  Peptide sequence Name=Xb4151_4152.C409.gene31.pep
  Gene classification: Gene name=PpsA; Function=Phosphoenolpyruvate synthase/pyruvate phosphate dikinase; Function class=G Carbohydrate transport and metabolism
  Homolog annotation: Query=1..790bp; Hit=1..789bp; Blast score=1355; Percent Identity=82.0; E value=0; Homolog= ppsA COG0574
MSNNGLTPCNVLWYNQLGMNDVNRVGGKNASLGEMITNLAELGVSVPNGFATTAQAFNDFLEQSGVNQRIYQLLDETNVDDVNQLAKAGAQIRRWVIDTPFTAQLENDIQDAYLQLSEGEPGASFAVRSSATAEDMPDASFAGQQETFLNVQGIDAVMVAIKHVFASLFNDRAISYRVHQGYDHRGVALSAGVQRMVRSDLASSGVMFTIDTESGFDQVVFITSAYGLGEMVVQGAVNPDEFYVHKPTLQNNRPAIVRRNLGSKRIRMVYADSKEHGKQVRTEDLSDVLRNRFSLTDDEVEALARQALLIEKHYGRPMDIEWAKDGNNGKLYIVQARPETVRSNQQVMERYQLNTQGSVLVEGRAIGHRIGAGTVKVIHNLSEMDRIQAGDVLVTDMTDPDWEPIMKKAAAIVTNRGGRTCHAAIIARELGIPAVVGCGDATERLKEGQEVTISCAEGDTGFVYQNKLDFSIQSSQVDELPKLDVKIMMNVGNPDRAFDFACLPNEGVGLARLEFIINRMIGVHPRALLEFSQQTPELQEQINALMVGYDDPVEFYIGRLTEGVATLAAAFWPKRVIVRLSDFKSNEYANLVGGERYEPNEENPMLGFRGAGRYVSDSFRACFALECEAIKRVRNVMGLTNVEVMVPFVRTVAQAEAVVAELAAQGLKRGENGLKVIMMCEIPSNALLAEQFLEHFDGFSIGSNDMTQLALGLDRDSGVVSELFDERNDAVKQLLSMAIQAAKRQGKYVGICGQGPSDHEDFAEWLVKEGIDSLSLNPDTVVKTWISLAENN

SEQ ID NO: 5727 - protein, 369 aa, Xenorhabdus bovienii
  Peptide sequence Name=Xb4151_4152.C409.gene32.pep
  Gene classification: Gene name=PerM; Function=Predicted permease; Function class=R General function prediction only
  Homolog annotation: Query=8..355bp; Hit=8..354bp; Blast score=362; Percent Identity=59.0; E value=1e-100; Homolog= Z2716 COG0628
MEKSQSRQDLPKLLFVLFFILLLIATCFWVLSPFVLGFIWSGMVVIATWPLLEKLQQHLWGKRWIAVSIMTLLLVLLFVIPIALLVSSLLENSTPLIEWAKSPSTFQLPQLEWLSRIPVIGEDLYVKWQDTVADGSNILLTKIPPYIGKTATWFFTQAANAGRFLFHLVLMVLFSVLLYWKGEQVMLSIRHFAIRLADQRGDAVVLLAAQSIRAVALGVVVTALVQAIAGGIGLAIAGIPYAMILTVLMFICCVAQLGPLLVLVPSIAWLYWTGETTWGTVLVIWSLVLTTMDGVLRPFLIRLGADLPMVLILTGVIGGILSLGLIGLFIGPVVLAVSYRLLLAWMNEVPKPENKTEDTEKYFQKDHIE

SEQ ID NO: 5728 - protein, 1023 aa, Xenorhabdus bovienii
  Peptide sequence Name=Xb4151_4152.C409.gene33.pep
  Gene classification: Gene name=GlcD; Function=FAD/FMN-containing dehydrogenases; Function class=C Energy production and conversion
  Homolog annotation: Query=1..542bp; Hit=1..542bp; Blast score=909; Percent Identity=77.0; E value=0; Homolog= ydiJ_1 COG0277
MIPRIPQAPHVSELAQEYLTALKEVGFTGDTVSSYADRLTMATDNSIYQLLPQAVIFPRSSADVALLARVAGEERFYSLTFTPRGGGTGTNGQSLNNGIVVDMSRYMNRILEINPEQGWVKVEAGVIKDQLNQYLKPFGYFFSPELSTSNRATLGGMINTDASGQGSLVYGKTSDHVLGVRAVLLGGEMFDTRPMSTLFAESIAQEESVIGQIYKTVLERCREQRKLIVEKFPKLNRFLTGYDLRHVYSDDMQTFDLTRILTGSEGTLAFITEATLDITPLPKVRRLVNAKYDSFDSALRNAPFMVEAKALSVETVDSTVLNLAREDIIWHSVKELITDVADKDMQGLNIVEFSGNDEQQIDQQVYDLCQRLDELMEENQTGIIGYQICHHLVDIERIYAMRKKSVGLLGNSKGNAKPIPFVEDTCVPPQHLADFITEFRQLLDSHQLNYGMFGHVDAGVLHVRPALDMCDPQQEILMKQISDEIVRLTAKYGGLLWGEHGKGFRAEYSPDFFGDILYDELRRIKAAFDPLNRLNPGKICSPIDTDAPMMKVDAAKRGTYDRTIPVNVRTAFRGAMECNGNGLCFNFDVKSPMCPSMKVSQHRIHSPKGRATLVREWLRLLTEQGVNPKLLEQGLDQAHPSLRGLIDKTRYSWQAWRGEYDFSHEVKEAMSGCLACKACSTQCPIKIDVPSFRSSFLSLYHSRYLRPLRDHIVANVESSTPLMAKVPQVFNFFLKQPWVQKISQHTIGMVDLPLLSYPTLQQQLSGHYAARTTLEQLETLSQSQRKQHVLIVQDPFTSYHDAKVVADFVRLTEKLGYQPVLLPFSPNGKAQHVKGFLTKFAKTAEKTASFLNRIACLNIPMVGIDPALVLCYRDEYKDILGERRGNFSVQLVHEWLMDILPETPAQEKRDDSTSSYDWYLLGHCTEVTALPNSGKQWTDIFRHFGCQLNNVSVGCCGMAGTYGHEKKNIDNSIGIYKLSWAPALGNLGLERCLSTGYSCRSQVKRMEGQTVKHPLQALLEIIP

SEQ ID NO: 5729 - protein, 137 aa, Xenorhabdus bovienii
  Peptide sequence Name=Xb4151_4152.C409.gene34.pep
  Gene classification: Gene name=PaaI; Function=Uncharacterized protein, possibly involved in aromatic compounds catabolism; Function class=Q Secondary metabolites biosynthesis, transport and catabolism
  Homolog annotation: Query=1..136bp; Hit=1..136bp; Blast score=190; Percent Identity=64.0; E value=3e-49; Homolog= ydiI COG2050
VIWKRTTDVNALNQFNRECMLGHIGIEITQIGEDFIEGTMPVDQRTKQPFGLLHGGASVVLAESLGSLAGYLCLEGEQKVVGVEINANHIKAVSKGAVKGVCKPVHLGRSHQVWQIDIYNERQQLCCTSRLTTAVLS

SEQ ID NO: 5730 - protein, 184 aa, Xenorhabdus bovienii
  Peptide sequence Name=Xb4151_4152.C410.gene1.pep
  Gene classification: Gene name=PaaY; Function=Carbonic anhydrases/acetyltransferases, isoleucine patch superfamily; Function class=R General function prediction only
  Homolog annotation: Query=1..176bp; Hit=73..248bp; Blast score=286; Percent Identity=76.0; E value=1e-77; Homolog= Z4650 COG0663
MSTVLRQYLNLYPQVGQRVMLDSSSIVIGDVRLANDVSIWPLVVIRGDVNYVSIGARTNIQDGSVLHVTHKSPDNPAGFPLIIGEEVTVGHKTMLHGCKIGNRVLVGIGSILLDGAIIEDDVVIGAGTLVPPGKKLESGYLYIGSPAKQVRKLKPEELEGLLYSANNYTYWKDNYLADTSEGKE

SEQ ID NO: 5731 - protein, 89 aa, Xenorhabdus bovienii
  Peptide sequence Name=Xb4151_4152.C410.gene2.pep
  Homolog annotation: Query=1..84bp; Hit=1..85bp; Blast score=112; Percent Identity=65.0; E value=1e-24; Homolog= gi|37528507|ref|NP _931852.1| hypothetical protein [Photorhabdus luminescens subsp. laumondii TTO1] gi|36787945|emb|CAE17062.1| u
MNQAIQFPDREEWNEMESKVIFPAMVDGLLVQCMISSDELAERYGKDHHPLDLFHRHRWDLEEKFEAAILSGHDDQFGRYSLPSDVSAK

SEQ ID NO: 5732 - protein, 272 aa, Xenorhabdus bovienii
  Peptide sequence Name=Xb4151_4152.C410.gene3.pep
  Gene classification: Gene name=AroE; Function=Shikimate 5 -dehydrogenase; Function class=E Amino acid transport and metabolism
  Homolog annotation: Query=1..272bp; Hit=1..272bp; Blast score=328; Percent Identity=61.0; E value=3e-90; Homolog= aroE COG0169
MDKFAVFGNPIAHSKSPYIHRLFADQTGIDHLYGRVLAPIEHFEQTLDRFFERGGLGANITVPFKERAYQRSDELTERARISGAVNTLKLIEGNRLLGDNTDGVGLLADLQRLGFITKGRHILIIGAGGAAKGVLSPLLELGCAVTITNRTFARAQIIADKFSQLGDIQPIEMESLLSPDFDIIINATASGIDGQIPEVSPLIFCNDIACYDMYYQHGLTPFLDFARQNGISRLADGLGMLVWQAANAFELWHGVFPEIESVLTALRRELHA

SEQ ID NO: 5733 - protein, 189 aa, Xenorhabdus bovienii
  Peptide sequence Name=Xb4151_4152.C410.gene4.pep
  Gene classification: Gene name=SUA5; Function=Putative translation factor (SUA5); Function class=J Translation, ribosomal structure and biogenesis
  Homolog annotation: Query=2..189bp; Hit=3..190bp; Blast score=261; Percent Identity=68.0; E value=3e-70; Homolog= ZyrdC COG0009
MSNKVSPAFDVIITALKEEKVIAYPTEAVFGLGCDPDSEKAVNELLSLKNRPWEKGLILIADSYERLCLYIDDEQLNDIQKETVFSFWPGPVTWVIPAKTTTPKWLTGQFSTLAVRVTDHPLVKQLCSFYGKALVSTSANLSGLEPCRSAEEVRQQFGNRVPVLEGEVGGRKNPSEIRDALTGKLYRQG

SEQ ID NO: 5734 - protein, 358 aa, Xenorhabdus bovienii
  Peptide sequence Name=Xb4151_4152.C410.gene5.pep
  Gene classification: Gene name=Smf; Function=Predicted Rossmann fold nucleotide-binding protein involved in DNA uptake; Function class=L DNA replication, recombination and repair
  Homolog annotation: Query=1..357bp; Hit=1..361bp; Blast score=334; Percent Identity=49.0; E value=8e-92; Homolog= Zsmf COG0758
MKEMEIWLRMKMVSHLSTIKAVSIIEHLLRTQNYSNNELKACGLSPTQCLQFTKANSTELAICFTWLERPGNHLLTFSHPAYPPLLKQIHSPPLMLFVSGDVTVLSQKQVAMVGSRSASFYGEKWGKIFAGELAKNGVVITSGLAIGIDGICHQAALSAGGKTIAVLGSGLEKIYPYRHDSLARFIEENGALVSEFFPEMPPKAKNFPRRNRIISGLSLALLIVEAYEKSGSLITARCALEQGRDIFALPGALGTPSSEGNHWLIKQGAYLAVNPTDIMEHINGAFRWLNIEKEERVQVDQIELPFADVLVNVSHEVTPVDVIAQRSCLPVTEVMTRLLELELMGKVAVVAGGYIRVN

SEQ ID NO: 5735 - protein, 170 aa, Xenorhabdus bovienii
  Peptide sequence Name=Xb4151_4152.C410.gene6.pep
  Gene classification: Gene name=Def; Function=N-formylmethionyl-tRNA deformylase; Function class=J Translation, ribosomal structure and biogenesis
  Homolog annotation: Query=1..168bp; Hit=1..168bp; Blast score=251; Percent Identity=82.0; E value=4e-67; Homolog= def COG0242
MSVLQVLHYPDERLRTIAKPVEKVDAGIQSIIDDMFETMYAEEGIGLAATQVDIHQRIIVIDVSENRDQRLVLINPELMNEVGATGIEEGCLSVPEQRAFVPRFEQVKIKALDYHGQQFELEADDLLAICIQHEMDHLVGKLFIDYLSPLKRQRIRQKVEKIDRLRAKEK

SEQ ID NO: 5736 - protein, 315 aa, Xenorhabdus bovienii
  Peptide sequence Name=Xb4151_4152.C410.gene7.pep
  Gene classification: Gene name=Fmt; Function=Methionyl-tRNA formyltransferase; Function class=J Translation, ribosomal structure and biogenesis
  Homolog annotation: Query=1..314bp; Hit=1..314bp; Blast score=434; Percent Identity=65.0; E value=1e-122; Homolog= fmt COG0223
VSDSLRIIFAGNPDFAVHHLAALLKSQHQVVGVLTRPDKPAGRGKKLTPSPVKALAEEHSISVFQPKTLRTEESQQWIMHQQADIMIVVAYGLILPQAVLDIPRLGCLNVHGSLLPRWRGAAPIQRAIWAGDQETGITIMQMDAGLDTGNMLLKAACPITNQDTSSSLYEKLANIGPDALLNTLDLIILGNCQPSIQDGTLATYAEKLSKDEAKMDWHLPAIQLERCVRSFNPWPMSFFLIDEYPIKVWHAEAIAEQTTHSPGTIIKADKKGIQIATSDGILNITQLQASGKKAMPAADFLNSKRDWFTPGNKIK

SEQ ID NO: 5737 - protein, 428 aa, Xenorhabdus bovienii
  Peptide sequence Name=Xb4151_4152.C410.gene8.pep
  Gene classification: Gene name=Sun; Function=tRNA and rRNA cytosine -C5-methylases; Function class=J Translation, ribosomal structure and biogenesis
  Homolog annotation: Query=1..427bp; Hit=1..428bp; Blast score=587; Percent Identity=66.0; E value=1e-168; Homolog= sun COG0144
MKNTYNLRNIAAKAIHQVLEQGQSLSTVIPELQQRVSDKDKALLQELCFGVIRVLPQLEWFIGQLMAKPLKGKQRIFHYLIMVGIYQLTYTRIPAHAALAETVNGAISLKRPQLKGLINGVLRQFQRQQQTLVEQVNNVSCHLHPKWLLDHIQKAYPQDWQKIIDANNQKPPMWLRVNQRYHSANQYLALLQEANIDAELDENHPSAIRLLNPCPVNTLPGFDQGWVTIQDRSAQGCAELLTPCDGESILDLCAAPGGKTTHILEIAPKSKVLAVDIDEQRIKRVKENLQRLNLHAVVKTGDGRFPHEWATGEQFDRILLDAPCSATGVIRRHPDIKWLRRNEDIDQLVTLQTEILDAIWPYLKKHGTLVYATCSILPHENSQQIKAFLGRHTDAALSDTGTLDKPGIQIIPETTGGDGFFYARLTKY

SEQ ID NO: 5738 - protein, 458 aa, Xenorhabdus bovienii
  Peptide sequence Name=Xb4151_4152.C410.gene9.pep
  Gene classification: Gene name=TrkA; Function=K+ transport systems, NAD-binding component; Function class=P Inorganic ion transport and metabolism
  Homolog annotation: Query=1..458bp; Hit=1..458bp; Blast score=741; Percent Identity=81.0; E value=0; Homolog= trkA COG0569
MKIIILGAGQVGGTLAENLVDENNDITVVDTDTDRLRQLQDKFDLRVVNGHGSHPRVLREAGAEDADMLVAVTNSDETNMIACQIAYSLFNTPNKVARIRSSEYIYESEKLFQPNDIPIDYLISPEQLVIDYIYKLIQYPGALQVVNFAEGRVSIVAVKAYYGGSLVGNALSSLREHMPHIDSKVAAIFRQDRPIRPQGSTIIEAGDEVFFVAASQHIRAVMSELQRLEKPYKRLMIVGGGNVGAGLALRLEKDYSVKLIEHNQERATKLAELLHDTIVFYGDASDQELLSEEHIEQVDVFIALTNDDEANIMSAMLAKRMGAKKAMVLIQRSAYVDLVQGGVIDIAISPQQATISALLGHVRKADIVSVSSLRRGVAEAIEAIAHGDEHTSKVVGRKIGDIRLPPGTIIGAIVRGEEVIIANDYSIIQQGDHVIMFITDKKFVPEVEKLFQPSPFFL

SEQ ID NO: 5739 - protein, 66 aa, Xenorhabdus bovienii
  Peptide sequence Name=Xb4151_4152.C410.gene10.pep
  Gene classification: Function=Uncharacterized BCR; Function class=S Function unknown
  Homolog annotation: Query=1..54bp; Hit=1..54bp; Blast score=78; Percent Identity=75.0; E value=1e-15; Homolog= yhdL COG3036
MTTYRHKKGVIKDNAIEALLHDPLFRQRVEANKKGKGSYSRKEKHGKSSGWEANDDNFFKLLSLAF

SEQ ID NO: 5740 - protein, 137 aa, Xenorhabdus bovienii
  Peptide sequence Name=Xb4151_4152.C410.gene11.pep
  Gene classification: Gene name=SoxR; Function=Predicted transcriptional regulators; Function class=K Transcription
  Homolog annotation: Query=1..135bp; Hit=1..135bp; Blast score=186; Percent Identity=71.0; E value=4e-48; Homolog= ZyhdM COG0789
MYRIGQLAKLASVTPDTIRFYEKQGLMAHEERTEGGYRLYTEQDLQRLRFIRYAKQSGFTLEAIVELLSIRVDPEHHTCQESKQIVDSRLQEVEDKLLEMQKMRNSLKMLSDACCGSAHTSTYCSILEILEEGATNK

SEQ ID NO: 5741 - protein, 130 aa, Xenorhabdus bovienii
  Peptide sequence Name=Xb4151_4152.C410.gene12.pep
  Gene classification: Gene name=RplQ; Function=Ribosomal protein L17; Function class=J Translation, ribosomal structure and biogenesis
  Homolog annotation: Query=1..126bp; Hit=1..126bp; Blast score=204; Percent Identity=94.0; E value=2e-53; Homolog= rplQ COG0203
MRHRKSGRQLNRNSSHRQAMFRNMAGSLVRHEIIKTTLPKAKELRRVVEPLITLAKTDSVANRRLAFARTRDNEIVAKLFNELGPRFASRAGGYTRILKCGFRAGDNAPMAYIELVDRTVESQTEAASAE

SEQ ID NO: 5742 - protein, 329 aa, Xenorhabdus bovienii
  Peptide sequence Name=Xb4151_4152.C410.gene13.pep
  Gene classification: Gene name=RpoA; Function=DNA-directed RNA polymerase alpha subunit/40 kD subunit; Function class=K Transcription
  Homolog annotation: Query=1..329bp; Hit=1..329bp; Blast score=609; Percent Identity=98.0; E value=1e-174; Homolog= rpoA COG0202
MQGSVTEFLKPRLVDIEQVSSTHAKVTLEPLERGFGHTLGNALRRILLSSMPGCAVTEVEIDGVLHEYSTKEGVQEDILEILLNLKGLAVKVQGKDEVILTLNKSGIGPVTAADIIHDGDVEIVKPQHVICHLTDGSASISMRIKVQRGRGYVPASARIHSEEDERPIGRLLVDACYSPVERIAYNVEAARVEQRTDLDKLVIEMETNGTIDPEEAIRRAATILAEQLEAFVDLRDVRQPEVKEEKPEFDPILLRPVDDLELTVRSANCLKAEAIHYIGDLVQRTEVELLKTPNLGKKSLTEIKDVLASRGLSLGMRLENWPPASIADE

SEQ ID NO: 5743 - protein, 206 aa, Xenorhabdus bovienii
  Peptide sequence Name=Xb4151_4152.C410.gene14.pep
  Gene classification: Gene name=RpsD; Function=Ribosomal protein S4 and related proteins; Function class=J Translation, ribosomal structure and biogenesis
  Homolog annotation: Query=1..206bp; Hit=1..206bp; Blast score=354; Percent Identity=93.0; E value=3e-98; Homolog= rpsD COG0522
MARYLGPKLKLSRREGTDLFLKSGVRAIDTKCKLEQAPGQHGARKPRLSDYGVQLREKQKVRRTYGVLERQFRNYYKEATRLKGNTGENLLTLLEGRLDNVVYRMGFGATRAESRQMVSHKAIMVNGCVVNIASYQVSPNDVVSVREKAKKQARIKAALELAEQREKPTWLEVDAAKMEGVFKRIPERTDLSADINEHLIVELYSK

SEQ ID NO: 5744 - protein, 129 aa, Xenorhabdus bovienii
  Peptide sequence Name=Xb4151_4152.C410.gene15.pep
  Gene classification: Gene name=RpsK; Function=Ribosomal protein S11; Function class=J Translation, ribosomal structure and biogenesis
  Homolog annotation: Query=1..129bp; Hit=1..129bp; Blast score=228; Percent Identity=99.0; E value=1e-60; Homolog= rpsK COG0100
MAKAPIRARKRVRKQVSDGVAHIHASFNNTIVTITDRQGNALGWATAGGSGFRGSRKSTPFAAQVAAERCAEAVKEYGIKNLEVMVKGPGPGRESTIRALNAAGFRITNITDVTPIPHNGCRPPKKRRV

SEQ ID NO: 5745 - protein, 118 aa, Xenorhabdus bovienii
  Peptide sequence Name=Xb4151_4152.C410.gene16.pep
  Gene classification: Gene name=RpsM; Function=Ribosomal protein S13; Function class=J Translation, ribosomal structure and biogenesis
  Homolog annotation: Query=1..118bp; Hit=1..118bp; Blast score=185; Percent Identity=88.0; E value=6e-48; Homolog= PM1393 COG0099
VARIAGINIPDQKHTVIALTSIYGIGKTRSQQICEAACIAENVKISELSEEQIDKLRDEVAKYVVEGDLRREVTLSIKRLMDLGCYRGLRHRRGLPVRGQRTKTNARTRKGPRKPIKK

SEQ ID NO: 5746 - protein, 443 aa, Xenorhabdus bovienii
  Peptide sequence Name=Xb4151_4152.C410.gene17.pep
  Gene classification: Gene name=SecY; Function=Preprotein translocase subunit SecY; Function class=N Cell motility and secretion
  Homolog annotation: Query=1..443bp; Hit=1..443bp; Blast score=726; Percent Identity=97.0; E value=0; Homolog= secY COG0201
MAKQPGLDFQSAKGGLSELKRRLLFVIGALIVFRIGSFIPIPGIDATVLAKLLEQQRGTIIEMFNMFSGGALSRASIFALGIMPYISASIIIQLLTVVNPRLAEIKKEGEAGRRKISQYTRYGTLVLAIFQSIGIATGLPNMPGMQGLVINPGFAFYFTAVVSLVTGTMFLMWLGEQITERGIGNGISIIIFAGIVAGLPPAIGHTIEQARQGDLHFLLLLLVAVLVFAVTFFVVFMERGQRRIVVNYAKRQQGRRVYAAQSTHLPLKVNMAGVIPAIFASSIILFPGTIASWFGGGTGWNWLTTISMYLQPGQPLYVLLYASAIIFFCFFYTALVFNPRETADNLKKSGAFVPGIRPGEQTAKYIDKVMTRLTLVGALYITFICLIPEFMRDAMKVPFYFGGTSLLIVVVVIMDFMAQVQTLMMSSQYESALKKANLKGYNR

SEQ ID NO: 5747 - protein, 144 aa, Xenorhabdus bovienii
  Peptide sequence Name=Xb4151_4152.C410.gene18.pep
  Gene classification: Gene name=RplO; Function=Ribosomal protein L15; Function class=J Translation, ribosomal structure and biogenesis
  Homolog annotation: Query=1..144bp; Hit=1..144bp; Blast score=196; Percent Identity=88.0; E value=8e-51; Homolog= rplO COG0200
MRLNTLSPAEGAKHASKRVGRGIGSGLGKTGGRGHKGQKSRSGGGVRRGFEGGQMPLYRRLPKFGFTSRKAMITAEIRLSDFAHVEGDVIDLNALKAANIVGPQIEFAKVMLSGEVNRAVTVRGLRVTKGARAAIEAAGGKIEE

SEQ ID NO: 5748 - protein, 59 aa, Xenorhabdus bovienii
  Peptide sequence Name=Xb4151_4152.C410.gene19.pep
  Gene classification: Gene name=RpmD; Function=Ribosomal protein L30/L7E; Function class=J Translation, ribosomal structure and biogenesis
  Homolog annotation: Query=1..59bp; Hit=1..59bp; Blast score=91; Percent Identity=88.0; E value=2e-19; Homolog= rpmD COG1841
MAKTIKITQVRSSIGRLPKHKATLTGLGLRRIGHTVEREDTPAVRGMVNLVSYMVKVEE

SEQ ID NO: 5749 - protein, 166 aa, Xenorhabdus bovienii
  Peptide sequence Name=Xb4151_4152.C410.gene20.pep
  Gene classification: Gene name=RpsE; Function=Ribosomal protein S5; Function class=J Translation, ribosomal structure and biogenesis
  Homolog annotation: Query=1..166bp; Hit=1..166bp; Blast score=261; Percent Identity=92.0; E value=2e-70; Homolog= rpsE COG0098
MAHIEKQAGELQEKLIAVNRVSKTVKGGRIFSFTALTVVGDGNGRVGFGYGKAREVPAAIQKAMEKARRNMKNVALNSGTLHHPVKGGHTGSRVFMQPAHEGTGIIAGGAMRAVLEVAGVRNVLAKTYGSTNPINVVRATLDALDSMKSPEMVAAKRGKSVEEIQG

SEQ ID NO: 5750 - protein, 117 aa, Xenorhabdus bovienii
  Peptide sequence Name=Xb4151_4152.C410.gene21.pep
  Gene classification: Gene name=RplR; Function=Ribosomal protein L18; Function class=J Translation, ribosomal structure and biogenesis
  Homolog annotation: Query=1..117bp; Hit=1..117bp; Blast score=149; Percent Identity=92.0; E value=3e-37; Homolog= rplR COG0256
MDKKAARIRRATRARRKLQELGATRLVVHRTPRHIYAQVIAPNGSETLVAASTTEKAISEQLKFTGNKEAAAVVGKIVAERALEKGIKNVSFDRSGFQYHGRVQALADAAREAGLQF

SEQ ID NO: 5751 - protein, 177 aa, Xenorhabdus bovienii
  Peptide sequence Name=Xb4151_4152.C410.gene22.pep
  Gene classification: Gene name=RplF; Function=Ribosomal protein L6; Function class=J Translation, ribosomal structure and biogenesis
  Homolog annotation: Query=1..177bp; Hit=1..177bp; Blast score=298; Percent Identity=86.0; E value=3e-81; Homolog= rplF COG0097
MSRVAKAPVVIPAGVEVKLNGQVISIKGKNGELSRKIHNAVEVKHADGQLTFAPREGFADAWAQAGTTRSLLNAMVIGVNEGFTKKLQLVGVGYRAAVKGNAVSLSLGFSHPVEHQLPAGITAECPSQTEIVLKGADKQVIGQVAADLRAYRRPEPYKGKGVRYADEVVRTKEAKKK

SEQ ID NO: 5752 - protein, 130 aa, Xenorhabdus bovienii
  Peptide sequence Name=Xb4151_4152.C410.gene23.pep
  Gene classification: Gene name=RpsH; Function=Ribosomal protein S8; Function class=J Translation, ribosomal structure and biogenesis
  Homolog annotation: Query=1..130bp; Hit=1..130bp; Blast score=229; Percent Identity=93.0; E value=8e-61; Homolog= rpsH COG0096
MSMQDPIADMLTRIRNGQAANKVAVTMPSSKLKVAIANVLKEEGYIEDFKIEGDTKPELEVTLKYFQGKAVVESIQRVSRPSLRIYKKKDELPKVMAGLGIAVISTSKGVMTDRAARQAGLGGEILCYVA

SEQ ID NO: 5753 - protein, 101 aa, Xenorhabdus bovienii
  Peptide sequence Name=Xb4151_4152.C410.gene24.pep
  Gene classification: Gene name=RpsN; Function=Ribosomal protein S14; Function class=J Translation, ribosomal structure and biogenesis
  Homolog annotation: Query=1..101bp; Hit=1..101bp; Blast score=152; Percent Identity=92.0; E value=7e-38; Homolog= rpsN COG0199
MAKQSMKARDVKRAKLAEKFFAKRVELKAIISDVNASDEDRWNAVLKLQTLPRDSSPCRQRNRCRQTGRPHAFLRKFGLSRIKVREAAMRGEIPGLKKASW

SEQ ID NO: 5754 - protein, 179 aa, Xenorhabdus bovienii
  Peptide sequence Name=Xb4151_4152.C410.gene25.pep
  Gene classification: Gene name=RplE; Function=Ribosomal protein L5; Function class=J Translation, ribosomal structure and biogenesis
  Homolog annotation: Query=1..179bp; Hit=1..179bp; Blast score=323; Percent Identity=89.0; E value=4e-89; Homolog= HI0790 COG0094
MAKLHDYYKDEVVQKLMSQFGYHSVMQVPRVEKITLNMGVGEAIADKKLLDNAAADLTAISGQKPLITKARKSVAGFKIRQGYPIGCKVTLRGERMWEFFERLISIAVPRIRDFRGLSAKSFDGRGNYSMGVREQIIFPEIDYDKVDRVRGLDITITTTAKSDDEGRALLAAFNFPFRK

SEQ ID NO: 5755 - protein, 104 aa, Xenorhabdus bovienii
  Peptide sequence Name=Xb4151_4152.C410.gene26.pep
  Gene classification: Gene name=RplX; Function=Ribosomal protein L24; Function class=J Translation, ribosomal structure and biogenesis
  Homolog annotation: Query=1..104bp; Hit=1..104bp; Blast score=162; Percent Identity=94.0; E value=6e-41; Homolog= rplX COG0198
MAAKIRRDDEIIVLTGKDKGKRGKVKQVLSSGKIIVEGINLVKKHQKPVPALNQPGGIVEKEAAINVSNVAIFNAATSKADRVGFRFEDGKKVRFFKSNNETIK

SEQ ID NO: 5756 - protein, 123 aa, Xenorhabdus bovienii
  Peptide sequence Name=Xb4151_4152.C410.gene27.pep
  Gene classification: Gene name=RplN; Function=Ribosomal protein L14; Function class=J Translation, ribosomal structure and biogenesis
  Homolog annotation: Query=1..123bp; Hit=1..123bp; Blast score=212; Percent Identity=95.0; E value=5e-56; Homolog= rplN COG0093
MIQEQTMLNVADNSGARRVMCIKVLGGSHRRYANVGDVIKITIKEAIPRGKVKKGDVLKAVVVRTKKGVRRPDGSVIRFDSNACVLLNNNSEQVIGTRIFGPVTRELRNEKFMKIISLAPEVL

SEQ ID NO: 5757 - protein, 84 aa, Xenorhabdus bovienii
  Peptide sequence Name=Xb4151_4152.C410.gene28.pep
  Gene classification: Gene name=RpsQ; Function=Ribosomal protein S17; Function class=J Translation, ribosomal structure and biogenesis
  Homolog annotation: Query=1..84bp; Hit=1..84bp; Blast score=138; Percent Identity=94.0; E value=1e-33; Homolog= rpsQ COG0186
MTDKIRTLQGRVISDKMEKSIVVAIERVVKHPLYGKFIKRTTKLHVHDESNECGIGDVVEIRETRPLSKTKSWTLVRVVEKAVL

SEQ ID NO: 5758 - protein, 63 aa, Xenorhabdus bovienii
  Peptide sequence Name=Xb4151_4152.C410.gene29.pep
  Gene classification: Gene name=RpmC; Function=Ribosomal protein L29; Function class=J Translation, ribosomal structure and biogenesis
  Homolog annotation: Query=1..62bp; Hit=1..62bp; Blast score=63; Percent Identity=79.0; E value=5e-11; Homolog= HI0785 COG0255
MKAQELRDKSVEELNTELLNLLREQFNLRMQAASGQLQQSHLLKQVRRNIARVKTLLTEKAGA

SEQ ID NO: 5759 - protein, 136 aa, Xenorhabdus bovienii
  Peptide sequence Name=Xb4151_4152.C410.gene30.pep
  Gene classification: Gene name=RplP; Function=Ribosomal protein L16/L10E; Function class=J Translation, ribosomal structure and biogenesis
  Homolog annotation: Query=1..136bp; Hit=1..136bp; Blast score=227; Percent Identity=95.0; E value=2e-60; Homolog= rplP COG0197
MLQPKRTKFRKVHKGRNRGLAAGADVSFGTFGLKAVGRGRLTARQIEAARRAMTRAIKRQGKIWIRVFPDKPITEKPLEVRMGKGKGNVEYWVALIQPGKVLYEMDGVPEELAREAFKLAAAKLPIKTTFVTKTVM

SEQ ID NO: 5760 - protein, 233 aa, Xenorhabdus bovienii
  Peptide sequence Name=Xb4151_4152.C410.gene31.pep
  Gene classification: Gene name=RpsC; Function=Ribosomal protein S3; Function class=J Translation, ribosomal structure and biogenesis
  Homolog annotation: Query=1..233bp; Hit=1..233bp; Blast score=415; Percent Identity=96.0; E value=1e-116; Homolog= rpsC COG0092
MGQKVHPNGIRLGIVKPWNSTWYANTKEFADNLDSDFKVRQYLNKELVKASISRIVIERPAKSIRVTIHTARPGIVIGKKGEDVEKLRKTVAEIAGVPAQINIAEVRKPELDAKLVADSISSQLERRVMFRRAMKRAVQNAMRLGAKGIKVEVSGRLGGAEIARTEWYREGRVPLHTLRADIDYNTSEAHTTYGVIGVKVWIFKGEILGGMAAVEQAEKPAAQPKKQQRKGRK

SEQ ID NO: 5761 - protein, 110 aa, Xenorhabdus bovienii
  Peptide sequence Name=Xb4151_4152.C410.gene32.pep
  Gene classification: Gene name=RplV; Function=Ribosomal protein L22; Function class=J Translation, ribosomal structure and biogenesis
  Homolog annotation: Query=1..110bp; Hit=1..110bp; Blast score=166; Percent Identity=95.0; E value=4e-42; Homolog= rplV COG0091
METIAKHRHARSSAQKVRLVADLIRGKKVSQALETLLYTNKKAAGLVKKVLESAIANAEHNDGADIDDLKVTKIFVDEGPTMKRIMPRAKGRADRILKRTSHITVVVSDR

SEQ ID NO: 5762 - protein, 92 aa, Xenorhabdus bovienii
  Peptide sequence Name=Xb4151_4152.C410.gene33.pep
  Gene classification: Gene name=RpsS; Function=Ribosomal protein S19; Function class=J Translation, ribosomal structure and biogenesis
  Homolog annotation: Query=1..91bp; Hit=1..91bp; Blast score=161; Percent Identity=93.0; E value=1e-40; Homolog= HI0781 COG0185
MPRSLKKGPFIDLHLLKKVEKAVESGDKKPIKTWSRRSTIFPNMIGLTIAVHNGRQHVPVFVSDEMVGHKLGEFAPTRTYRGHAADKKAKKR

SEQ ID NO: 5763 - protein, 273 aa, Xenorhabdus bovienii
  Peptide sequence Name=Xb4151_4152.C410.gene34.pep
  Gene classification: Gene name=RplB; Function=Ribosomal protein L2; Function class=J Translation, ribosomal structure and biogenesis
  Homolog annotation: Query=1..273bp; Hit=1..273bp; Blast score=473; Percent Identity=92.0; E value=1e-134; Homolog= rplB COG0090
MAIVKCKPTSPGRRHVVKVVNPELHKGKPYAPLLEKNNKTGGRNNNGRITTRHIGGGHKQHYRLVDFKRNKDGIPAVVERLEYDPNRSANIALVLYRDGERRYILAPKGLKAGDQIQSGADSAIKAGNALPMRNIPVGSTVHNIEMKPGKGGQLARSAGTYAQIVARDGSYVTLRLRSGEMRKVLSDCRATLGEVGNAEHMLRVLGKAGASRWRGIRPTVRGTAMNPVDHPHGGGEGRNFGKHPVTPWGIQTKGKKTRSNKRTDQYIVRRRSK

SEQ ID NO: 5764 - protein, 100 aa, Xenorhabdus bovienii
  Peptide sequence Name=Xb4151_4152.C410.gene35.pep
  Gene classification: Gene name=RplW; Function=Ribosomal protein L23; Function class=J Translation, ribosomal structure and biogenesis
  Homolog annotation: Query=1..100bp; Hit=1..100bp; Blast score=154; Percent Identity=95.0; E value=1e-38; Homolog= rplW COG0089
MIREERLLKILCAPHVSEKASTAMEKSNTIVLKVAKDATKAEIKAAVQKLFEVEVEGVNTLLVKGKVKRHGQRIGRRSDWKKAYVTLKEGQNLDFGGGAE

SEQ ID NO: 5765 - protein, 201 aa, Xenorhabdus bovienii
  Peptide sequence Name=Xb4151_4152.C410.gene36.pep
  Gene classification: Gene name=RplD; Function=Ribosomal protein L4; Function class=J Translation, ribosomal structure and biogenesis
  Homolog annotation: Query=1..201bp; Hit=1..201bp; Blast score=345; Percent Identity=94.0; E value=2e-95; Homolog= rplD COG0088
MELVMKDAQSALTVSETTFGRDFNEALVHQVVVAYAAGARQGTRAQKTRAEVSGSGKKPWRQKGTGRARAGSIKSPIWRSGGVTFAAKPQDHSQKVNKKMYRGALKSILSELVRQERLIVVEKFSVEAPKTKLLVQKLKEMALQDVLIVTGEVDENLFLAARNLYKVDVRDAAGIDPVSLIAFDKVVMTADAVKQVEEMLA

SEQ ID NO: 5766 - protein, 49 aa, Xenorhabdus bovienii [sequence omitted]

SEQ ID NO: 5767 - protein, 123 aa, Xenorhabdus bovienii
  Peptide sequence Name=Xb4151_4152.C410.gene38.pep
  Gene classification: Gene name=RplC; Function=Ribosomal protein L3; Function class=J Translation, ribosomal structure and biogenesis
  Homolog annotation: Query=1..122bp; Hit=1..121bp; Blast score=187; Percent Identity=85.0; E value=2e-48; Homolog= rplC COG0087
MIGLVGKKVGMTRIFTEDGVSIPVSVIEIEENRITQVKDQESDGYRAIQVTTGSKKANRVNKPEAGHFAKAGVEAGRTLREFRLSLDDEEYTVGQSISVEIFANVKKVDVTGTSKGKGFAGTC

SEQ ID NO: 5768 - protein, 103 aa, Xenorhabdus bovienii
  Peptide sequence Name=Xb4151_4152.C410.gene39.pep
  Gene classification: Gene name=RpsJ; Function=Ribosomal protein S10; Function class=J Translation, ribosomal structure and biogenesis
  Homolog annotation: Query=1..103bp; Hit=16..118bp; Blast score=186; Percent Identity=100.0; E value=4e-48; Homolog= HI0776 COG0051
MQNQRIRIRLKAFDHRLIDQSTAEIVETAKRTGAQVRGPIPLPTRKERFTVLISPHVNKDARDQYEIRTHKRLVDIVEPTEKTVDALMRLDLAAGVDVQISLG

SEQ ID NO: 5769 - protein, 157 aa, Xenorhabdus bovienii
  Peptide sequence Name=Xb4151_4152.C410.gene40.pep
  Gene classification: Gene name=Bfr; Function=Bacterioferritin (cytochrome b1); Function class=P Inorganic ion transport and metabolism
  Homolog annotation: Query=1..154bp; Hit=1..154bp; Blast score=236; Percent Identity=83.0; E value=9e-63; Homolog= Z4695 COG2193
MKGDKKIIAHLNKLLGNELVAINQYFLHARMFKNWGLMRLNEVEYRESIEEMKHADKYIERILFLEGLPNLQDLGKLNIGEDIEEMLQSDLALEIRGAKDLREAIAYADSAYDYVSRDLMIEVLSDEENHIDWLETQLDLINRVGIQNYIQSQLVEE

SEQ ID NO: 5770 - protein, 64 aa, Xenorhabdus bovienii
  Peptide sequence Name=Xb4151_4152.C410.gene41.pep
  Gene classification: Gene name=Bfd; Function=Bacterioferritin -associated ferredoxin; Function class=P Inorganic ion transport and metabolism
  Homolog annotation: Query=1..64bp; Hit=1..64bp; Blast score=70; Percent Identity=53.0; E value=3e-13; Homolog= ZyheA COG2906
MYICLCNAISDKTIRNIVCQQHVRSIRELRDFVPVGSNCGKCIRQAREIMNEEIAQLSPINNFA

SEQ ID NO: 5771 - protein, 117 aa, Xenorhabdus bovienii
  Peptide sequence Name=Xb4151_4152.C411.gene1.pep
  Gene classification: Gene name=FtsZ; Function=Cell division GTPase; Function class=D Cell division and chromosome partitioning
  Homolog annotation: Query=1..83bp; Hit=1..83bp; Blast score=128; Percent Identity=92.0; E value=7e-31; Homolog= ftsZ COG0206
MFEPLELTNDAVIKVIGVGGGGGNAVEHMVRERIEGVDFFAINTDAQALRKTAVGQTIQIGNGITKGLGAGANPEVGRTAAEEIAKHCVLPLEVPTWYSSLPALGGGTGTGAAPGWG

SEQ ID NO: 5772 - protein, 418 aa, Xenorhabdus bovienii
  Peptide sequence Name=Xb4151_4152.C411.gene2.pep
  Gene classification: Gene name=FtsA; Function=Predicted ATPases of the HSP70 class involved in cell division; Function class=D Cell division and chromosome partitioning
  Homolog annotation: Query=1..418bp; Hit=1..420bp; Blast score=761; Percent Identity=91.0; E value=0; Homolog= ftsA COG0849
MIKSTDRKLVVGLEIGTAKVSALVGEILPDGMVNIIGVGSCPSRGMDKGGVNDLESVVKCVQRAIDQAELMADCQISSVYLGLSGKHISCQNEIGMVPISEEEVTQDDVDSVVHTAKSVRVRDEHRVLHVIPQEYAIDYQEGIKNPVGLSGVRMQAKVHLITCHNDMAKNIVKAVERCGLKVDQLIFAGLAASYAVLTEDERELGVCVVDIGGGTMDIAVYTGGALRHTKVIPYAGNVVTSDIAYAFGTPPSDAETIKVRHGCALGSIVSKDESVEVPSVGGRPPRSLQRQTLAEVIEPRYTELLNLVNDEILRLQEQLRQQGVKHHLAAGIVLTGGGAQIDGVAECAQRVFHTQVRIGRPLNITGLTDYVQEPCYSTAVGLLHYGKESHLGGDSDADKRTSVSGWFKKVSSWLRKEF

SEQ ID NO: 5773 - protein, 241 aa, Xenorhabdus bovienii
  Peptide sequence Name=Xb4151_4152.C411.gene3.pep
  Gene classification: Gene name=FtsQ; Function=Cell division septal protein; Function class=M Cell envelope biogenesis, outer membrane
  Homolog annotation: Query=2..223bp; Hit=34..259bp; Blast score=284; Percent Identity=62.0; E value=5e-77; Homolog= ftsQ COG1589
MVIGTIVWGGWMTLDWMKDSNRLALSKLVLTGERHYTTNDDVRRAIMAFGAIGTFMTQDVNIIQGQIERLPWIRQVTVRKQWPDELKIHLVEYVPYVRWNDTYMLDAEGNVFSLPIERSVKGHYAMLSGPEGKEKEVLAEYNKVAPLFTEHKMKLKTVIMTERNAWQLILNNDIRLELGNKNDVKRIKRFIELYPVLQKNTEKRVAYVDLRYDSGAAVGWAPLLIDAPVSINGQKNNSDWQ

SEQ ID NO: 5774 - protein, 306 aa, Xenorhabdus bovienii
  Peptide sequence Name=Xb4151_4152.C411.gene4.pep
  Gene classification: Gene name=DdlA; Function=D-alanine-D-alanine ligase and related ATP-grasp enzymes; Function class=M Cell envelope biogenesis, outer membrane
  Homolog annotation: Query=1..306bp; Hit=1..306bp; Blast score=415; Percent Identity=68.0; E value=1e-116; Homolog= ddlB COG1181
MVEKVAVLLGGTSAEREVSLQSGQSVVAGLKEAGINAYSVDTKDFDVTKLKGEGFSKAFIALHGRGGEDGTLQGVLEFLQIPYTGSGVMASALSMDKLRTKQLWQGAKLPVSPYAAINAQKFEQVNDFQLQEYVRELGLPLMVKPNLEGSSVGMTKVNDYSELRGALELAFQHDTDVLVEKWLLGPEYTVAFLGDEVLPSIRIQAPEVFYDYDAKYLSNETKYFCPSGLSAEKELELAEIASKAYKALGCSGWGRVDIMDDGNGNFYLLEVNTSPGMTSHSLVPMAARQSGLSFSQLVVKILELAD

SEQ ID NO: 5775 - protein, 491 aa, Xenorhabdus bovienii
  Peptide sequence Name=Xb4151_4152.C411.gene5.pep
  Gene classification: Gene name=MurC; Function=UDP-N-acetylmuramate -alanine ligase; Function class=M Cell envelope biogenesis, outer membrane
  Homolog annotation: Query=1..490bp; Hit=1..490bp; Blast score=742; Percent Identity=80.0; E value=0; Homolog= ZmurC COG0773
VNTQQLAKLRVSVPEMRKVRHIHFVGIGGAGMGGIAEVLANEGYQISGSDLAPNPVTQQLLALGATIYFNHRLENVRGASVVVASTAISADNPEIIAAREARIPVIRRAEMLAELMRYRHGIAIAGTHGKTTTTAMIAGIYAQAGLDPTFVNGGLVKAAGTHARLGTSRYLIAEADESDASFLHLQPMVAVITNIEADHMDTYQGDFENLKQTFVNFLHNLPFYGRAVMCIDDPVVKELIPRIGRYITTYGFSEEADIRITHYEQKAAQGFFTISRDDLPELHVVLNAPGRHNALNATAAVAVATEEGINDAAILASLAEFQGTGRRFDFLGEFSLKHINGKEGRVMLVDDYGHHPTEVDATIKAARAGWPDKRIVMLFQPHRYTRTRDLYDDFANILSQVDVLLMLDVYSAGETPIPGADSRSLCRTIRSRGKLDPIFVSDSEQISAMLSQVIENNDLVLVQGAGNIGKIARNLAETKLQPSFNEGEHHG

SEQ ID NO: 5776 - protein, 361 aa, Xenorhabdus bovienii
  Peptide sequence Name=Xb4151_4152.C411.gene6.pep
  Gene classification: Gene name=MurG; Function=UDP-N -acetylglucosamine; Function class=M Cell envelope biogenesis, outer membrane
  Homolog annotation: Query=1..346bp; Hit=1..346bp; Blast score=510; Percent Identity=75.0; E value=1e-145; Homolog= murG COG0707
MSGRNRRLMVMAGGTGGHVFPGLAVAQHLKEQGWEIRWLGTADRMEADLVPKQGIDIEFIQISGLRGKGIKALFAAPVRIFKAIRQAKTIMRRYQPDVVLGMGGYVSGPGGIAAWLCGIPVVLHEQNGIAGLTNRWLAKIAKTVLQAFPGAFSDAPVVGNPVREDVLALPVPAQRLAGREGSIRVLVVGGSQGARILNQIMPEVAERMGVHITIWHQAGKGAQEETHRKYENSAKSEFKVTEFIDDMAQAYAWADIVVCRSGALTVSEVSAAGLPAIFVPFQHKDRQQYWNALPLEKAGAAKILEQPQFTAEAVVDLLTQWQRPQLLEMAEKARSVAIVNATERVAAALIDAVENYSGRSK

SEQ ID NO: 5777 - protein, 397 aa, Xenorhabdus bovienii
  Peptide sequence Name=Xb4151_4152.C411.gene7.pep
  Gene classification: Gene name=FtsW; Function=Bacterial cell division membrane protein; Function class=D Cell division and chromosome partitioning
  Homolog annotation: Query=10..397bp; Hit=27..414bp; Blast score=534; Percent Identity=74.0; E value=1e-152; Homolog= ftsW COG0772
MTIPGLGKFKNWLTGNVETDATDIVMYDRTLVWMILGLAVIGFVMVTSASMPVGQRLAQDPFIFAQRDAIYLVLAFILSLITLRIPMEFWQRYSNIILLGTIIMLVVVLLVGSSVNGASRWVAIGPLRIQPAELSKLSLFCYLSSYLVRKVEEVRNNFWGFCKPMGVMIALAILLLAQPDLGTVIVLFVTTLALLFLAGAKLWQFLAIIGCGIFAVCVLIVAEPYRMRRVTSFLNPWDDPFGSGYQLTQSLMAFGRGDFFGQGLGNSIQKMEYLPEAHTDFIFSILAEELGYLGVVLVLSMVFFVAFRAMMIGRRALQLNQRFAGFLACAIGIWFSFQAFINVGAASGMLPTKGLTLPLVSYGGSSLIVMSTAIVLLLRIDYEVRLAKAQAFVRSPK

SEQ ID NO: 5778 - protein, 436 aa, Xenorhabdus bovienii
  Peptide sequence Name=Xb4151_4152.C411.gene8.pep
  Gene classification: Gene name=MurD; Function=UDP-N -acetylmuramoylalanine-D-glutamate ligase; Function class=M Cell envelope biogenesis, outer membrane
  Homolog annotation: Query=1..436bp; Hit=1..438bp; Blast score=617; Percent Identity=72.0; E value=1e-177; Homolog= murD COG0771
MAEYLGKKVVIVGLGLTGLSCVDFFMARGVTPRVMDTRLVPPGSDKLPDDVACHTGSLNTQWLMDADLIVASPGIALATPELQAAADAGIEIVGDIELFCREATTPIVAITGSNGKSTVTTLVGEMAKEAGWQVGVGGNIGIPALELLKQPCQLYVLELSSFQLETTYSLKAAAATVLNVTEDHMVRYPDGLSQYRAAKLRIYDQAKVCVVNEQDALTLPEAGKDSRCISFGVDSGAYQLESGRQQLVVNHQSLLETRQIRLTGQHNYTNGLAALALADAVGIPREASIQALQTYPGLEHRFQVVHMRNGVRWVNDSKATNVGSTQAALSGLTLEGTLYLLLGGDGKAADFTPLQPYVSGNNIRLYCFGCDGNQLAQLRPEISVLTETMEQAMRKIAPKLMTGDMVLLSPACASFDQFNGFEHRGHEFARLAEELG

SEQ ID NO: 5779 - protein, 360 aa, Xenorhabdus bovienii
  Peptide sequence Name=Xb4151_4152.C411.gene9.pep
  Gene classification: Gene name=Rfe; Function=UDP-N-acetylmuramyl pentapeptide phosphotransferase/UDP-N- acetylglucosamine-1-phosphate transferase; Function class=M Cell envelope biogenesis, outer membrane
  Homolog annotation: Query=1..360bp; Hit=1..360bp; Blast score=528; Percent Identity=85.0; E value=1e-150; Homolog= mraY COG0472
MLVWLADYLVKYHTVFHVFSYLTFRAIVGLLTALFIALWVGPTLIGYLQKLQIGQVVRDNGPESHFSKRGTPTMGGLLILFSITMSILLWTRLDNPYVWCVLAVLLGYGVVGFVDDYRKVVRKDTKGLIARWKYFWQSVIALGVAFAMYSMGKDTAATQLIVPFFKEVMPQLGLLYILLAYFVIVGTSNAVNLTDGLDGLAIMPTVFVAAGFAIVAWAMSNVKFALYLHIPHLVHASELVIVCTAIVGAGLGFLWFNTYPAQVFMGDVGSLALGGALGTIAVLLRQEFLLIIMGGVFVVETLSVILQVGSFKLRGQRIFRMAPIHHHYELKGWPEPRVIVRFWIISLVLVLIGLATLKVR

SEQ ID NO: 5780 - protein, 460 aa, Xenorhabdus bovienii
  Peptide sequence Name=Xb4151_4152.C411.gene10.pep
  Gene classification: Gene name=MurF; Function=UDP-N-acetylmuramyl pentapeptide synthase; Function class=M Cell envelope biogenesis, outer membrane
  Homolog annotation: Query=1..460bp; Hit=1..452bp; Blast score=496; Percent Identity=60.0; E value=1e-140; Homolog= murF COG0770
MIPLTLKQLTKLTGGVLYHTSEQQAATCQINTVEIDSRKMVRGGLFIALKGEKFDAHDFVADVAKQGAGALLVNRRLEIDCPQVVVENTRLAMGKLAAWVRQQSKARIVALTGSSGKTSVKEMTAAILCQRGHTLYTAGNFNNDIGVPLTLFRLTEEHQFAVIELGANHIGEIAYTAEMTCPESALVNNLFAAHLEGFGSLAGVAKAKGEIFAGLSSAGTAIINLDSNDWTHWQQGMSEPQAVWRFAVSPVPEADFYATDIQEQPLATSFCLHTPIGNIEVTLPLPGKHNIANALAASALAISVGASLSDIRAGLLELKPVSGRLFPIRLAEGKIVLDDTYNANIGSMIAAANTLSQMPGYHVMVVGDMGELGDQTVECHRQVGEALASTKIDKIMSVGEFSSHISETSGRGQHFANKAELVAALLPLLEQHEMISILIKGSRSAAMEEVVNTLKENFQC

SEQ ID NO: 5781 - protein, 495 aa, Xenorhabdus bovienii
  Peptide sequence Name=Xb4151_4152.C411.gene11.pep
  Gene classification: Gene name=MurE; Function=UDP-N-acetylmuramyl tripeptide synthase; Function class=M Cell envelope biogenesis, outer membrane
  Homolog annotation: Query=1..495bp; Hit=1..495bp; Blast score=692; Percent Identity=73.0; E value=0; Homolog= murE COG0769
VADRNLRDLLAPWGVDTPELPLREMTLDSRKAAAGDLFVAVKGHQTDGRNYIPQAIAQGVAAVIAEAKGKTDNGTIQAMHGVPVIYLDDLNNKLSKLAGEFYQHPGNKLKLVGVTGTNGKTTTTQLLAQWSQGLGEISAVMGTVGNGLLGMIVPSENTTGSAVDIQLDLQQLVNQKATFAAMEVSSHGLVQGRVAALPFQAAVFTNLSRDHLDYHGDMENYEEAKWLLFSSHDVKQKIINADDDVGQKWLTRLPETVAVTMENRLPKNWSGRWLSTSDIHYHDKGASITFTSSWGQGTLNSPLMGAFNVSNLLLALATLLSLEYPLQKLLEAASCLEPVCGRMEVFAARDRPTVVVDYAHTPDALEKALSAARLHCKGQLWCVFGCGGDRDKGKRSLMGGIAEQGADRVIVTDDNPRSEEPHSIVEDILTGFIDPGRAMAIHGRVEAVTSAIMQAAEEDVVLVAGKGHEDYQLVGNRRLDYSDRLTVARLLGVIA

SEQ ID NO: 5782 - protein, 591 aa, Xenorhabdus bovienii
  Peptide sequence Name=Xb4151_4152.C411.gene12.pep
  Gene classification: Gene name=FtsI; Function=Cell division protein FtsI/penicillin-binding protein 2; Function class=M Cell envelope biogenesis, outer membrane
  Homolog annotation: Query=3..591bp; Hit=4..588bp; Blast score=907; Percent Identity=75.0; E value=0; Homolog= ftsI COG0768
MKAARSLKLKKQEDKASFVSWRFALLCGGISFALFGLLIRVAYLQIINPDRLLKEGDSRSLRVQSIPTTRGMITDRNGRPLAVSVPVDAVWADPKEIFEKGGITDDTRWQALADTLSIPLNQLTRKIQDYPQGRFVYLARQVNTSIGDYVEKLRLPGIYLRQESRRYYPAGQVTAHIIGVTNIDDKGIEGVEKSFDNWLTGKPGSRIVRKDRNGRVIEDVSFTDSQAAHNLALSIDERLQTLVYRELTKAVILNKAESGTAILIDVKTGEVLAMANNPSYNPNNLAGTPKDAMRNRAITDIFEPGSTVKPLVVMSALNLNIVKENSVLDTKPYRLAYGARSHQIKDVAPRSELTITGILQKSSNVGVSKLALAMPASELVNVYSRFGMGKPTNLGLVGESSGIYPKRERWSDLERATFSFGYGLMVTPLQLARVYATIGSFGIYRPLSITKVDPPIPGTRVFPEPIMRTVVHMMESVALPGGGGVRAAIKGYRIAIKTGTAKKVGPDGKYVNKYLSYTAGIAPASNPRFALVVIINDPQAGKYYGGAVSAPIFGTIMSGVLRTMNVEPDALPADDKKEFVIDNKEDKSGRS

SEQ ID NO: 5783 - protein, 105 aa, Xenorhabdus bovienii
  Peptide sequence Name=Xb4151_4152.C411.gene13.pep
  Gene classification: Gene name=FtsL; Function=Cell division protein; Function class=D Cell division and chromosome partitioning
  Homolog annotation: Query=4..103bp; Hit=20..119bp; Blast score=129; Percent Identity=67.0; E value=4e-31; Homolog= ftsL COG3116
MAGERHGLVGVIGRDLIRNAKIPLVLLIAVIISAISVVTVAHKTRLLIAEKERSAIDFDSLDIEWRNLLLEENALGDHSRVENIATETLHMQHVDPAQENIVITQ

SEQ ID NO: 5784 - protein, 314 aa, Xenorhabdus bovienii
  Peptide sequence Name=Xb4151_4152.C411.gene14.pep
  Gene classification: Function=Predicted S-adenosylmethionine -dependent methyltransferase involved in cell envelope biogenesis; Function class=M Cell envelope biogenesis, outer membrane
  Homolog annotation: Query=5..311bp; Hit=4..310bp; Blast score=469; Percent Identity=77.0; E value=1e-132; Homolog= yabC COG0275
MANSHYKHTSVLLDEAVNGLNIRENGIYIDGTFGRGGHSRLILSQLGADGRLIAIDRDPQAIEAAKAITDPRFSITHGPFSELATYIEEAGLVGKIDGVLLDLGVSSPQLDDPERGFSFMRDGPLDMRMDPTRGQSATEWLMKAEADDIAWVLKTFGEERFAKRIARAIVARNQEGQITRTRELAELIAQASPVKEKHKHPATRSFQAIRIYINSELEEIERALNGALQVLAPQGRLSVISFHSLEDRIVKRFIRQHSRGPQVPAGLPLTETQLKAQGGRSLKSIGKLKPSEDEVVINPRARSSVLRFAEKAGE

SEQ ID NO: 5785 - protein, 152 aa, Xenorhabdus bovienii
  Peptide sequence Name=Xb4151_4152.C411.gene15.pep
  Gene classification: Function=Uncharacterized BCR; Function class=S Function unknown
  Homolog annotation: Query=1..152bp; Hit=1..152bp; Blast score=235; Percent Identity=80.0; E value=1e-62; Homolog= ZyabB COG2001
MFRGATLVNLDSKGRLTVPARYREKLNEESTGQMVCTIDLHQPCLLLYTLPEWEIIEEKLSRLSSMNLAERRVQRLLLGHASECQMDSAGRLLLANTLRQHAGLTKEVMLVGQFNKFELWDEQAWYQQVQNDIEAEQSTQEPLSARLQDLSL

SEQ ID NO: 5786 - protein, 335 aa, Xenorhabdus bovienii
  Peptide sequence Name=Xb4151_4152.C411.gene16.pep
  Gene classification: Gene name=PurR; Function=Transcriptional regulators; Function class=K Transcription
  Homolog annotation: Query=1..333bp; Hit=1..333bp; Blast score=551; Percent Identity=82.0; E value=1e-157; Homolog= fruR COG1609
VKLDEIARLAGVSRTTASYVINGKAKQYRVSDKTVEKVMAVVREHNYHPNAVAAGLRAGRTRSIGLVIPDLENTSYTRIANYLERQARQRGYQLLIACSEDQPDNEMRCVEHLLQRQVDAIIVSTALPPEHPFYQRWTNRSLPIIALDRALDSEHFISVVGDDLEDAKMLAQELRQFPSESVLYLGALPELSVSFLREQGFREAWESDQREVNYLYANSYEREAAAEVFASWLENNPVPQVLYTTSFSLLQGVMDTLLKRSGRLPEQLVIATFGDHELLDFLECPVLSVAQRHRDVAECALELVLASLDEKKRPEPGITRMRRHLCRRGSLSRKA

SEQ ID NO: 5787 - protein, 163 aa, Xenorhabdus bovienii
  Peptide sequence Name=Xb4151_4152.C411.gene17.pep
  Gene classification: Gene name=IlvH; Function=Acetolactate synthase, small subunit; Function class=E Amino acid transport and metabolism
  Homolog annotation: Query=1..163bp; Hit=1..163bp; Blast score=250; Percent Identity=85.0; E value=5e-67; Homolog= ilvH COG0440
MRRILSVLLENESGALSRVVGLFSQRGYNIESLTVAPTEDPTLSRMTIQTKGDAKVLEQIEKQLHKLVDVLRVSELTAGAHVEREIMLVKLQASGYGREEIKRSTDIFRGQIVDVTSALYTVQLAGTSEKLDAFLDAVRDVAEILEVARSGIVGIARGDKIMR

SEQ ID NO: 5788 - protein, 575 aa, Xenorhabdus bovienii
  Peptide sequence Name=Xb4151_4152.C411.gene18.pep
  Gene classification: Gene name=IlvB; Function=Thiamine pyrophosphate -requiring enzymes [acetolactate synthase, pyruvate dehydrogenase (cytochrome), glyoxylate carboligase, phosphonopyruvate decarboxylase]; Function class=E Amino acid transp
  Homolog annotation: Query=1..575bp; Hit=29..602bp; Blast score=963; Percent Identity=79.0; E value=0; Homolog= ZilvI COG0028
MEMLSGAEMVVRSLIDQGVKHVFGYPGGAVLDIYDALHTVGGIEHILVRHEQGAVHMADGYSRSTGKAGVVLVTSGPGATNAITGIATAYMDSIPMVVLSGQVASSLIGNDAFQECDMVGISRPIVKHSFLVKKAEDIPNTIKKAFYLATTGRPGPVVIDFPKDTVNPALKFPYVYPEKISMRSYNPTVQGHKGQIKRALKTLLDAKKPVIYVGGGAINSACSSELLKLAECLHIPVVSSLMGLGAFPATHRQSLGMLGMHGTFEANKAMHNSDLIFAVGVRFDDRTTNNLEKYCPEAIVLHIDIDPASISKTVSADIPIVGDAKQILGQMLELMNTLEDTQDPDALKDWWLSIEQWRSRKCLGYDRTTAKIKPQAVIETLYRLTEGKAYLSSDVGQHQMFAALYYPFDEPRRWINSGGLGTMGFGLPAALGVKLAKPDATVVCVTGDGSIQMNIQELSTALQYGLPVLVLNLNNRFLGMVKQWQDMIYAGRHSQSYMESLPDFVKLAEAYGHIGVSIQTYEELENKLAQALHEVTENQRLVFVDVTVDETEHVYPMQIRGGAMDEMWLSKTERT

SEQ ID NO: 5789 - protein, 600 aa, Xenorhabdus bovienii
  Peptide sequence Name=Xb4151_4152.C411.gene19.pep
  Gene classification: Gene name=FAA1; Function=Long-chain acyl-CoA synthetases (AMP-forming); Function class=I Lipid metabolism
  Homolog annotation: Query=9..600bp; Hit=6..597bp; Blast score=669; Percent Identity=53.0; E value=0; Homolog= VC2484 COG1022
VITDSLHSYHLINRLQQQSIEYPEKIAFRQWSPSEQLEMSWQDVTYRTESIAKALLSLGVEIQEKVAIFAHNCIAWSLADLAVLQLRAVTVPLYATSSRDQATFILKDAGVRVLFVGEQEQYNVAMTLLELCPQLNHLIVLDESVDLKSCPQAQYLSAFIVNAHAQYQPELDNRIAGQDLNDLFTLIYTSGTTGEPKGVMLDYHNIASQLYLHDQRLTLTKEDVSLSFLPLSHIFERAWSYYVMHTGALNVYLTDTNSVREAMAEVRPTVMCAVPRFYEKVHSAILEKVSRAPFLRRLIFRWAIKRGENRWMRQLQNKKACIFSLCSDQLADKLVLSKLRNIFGGRVRFLPVAGARLDDAIARFFLSAGINIKYGYGMTETCATVSCWEEKNYLPGSIGTPLPSIDVRISAEDEIQVRGPIVMKGYFNQPEETAHAFTEDGWLRTGDAGGLDETGNLFITERLKDLMKTSTGKYIAPQMLEGTLGQDRFIEYIAVIADSRNFVSALIVPSYDALEDYAKSIHLHYRDRIELLNNRQIIELFEQRLAELQKNIAKYHQVKRFILLPEAFSMEKGELTPTLKLRRKVISQHYHDEIESMYRD

SEQ ID NO: 5790 - protein, 315 aa, Xenorhabdus bovienii
  Peptide sequence Name=Xb4151_4152.C411.gene20.pep
  Gene classification: Gene name=LysR; Function=Transcriptional regulator; Function class=K Transcription
  Homolog annotation: Query=7..311bp; Hit=63..370bp; Blast score=360; Percent Identity=58.0; E value=1e-100; Homolog= leuO COG0583
MTGYNSVTTRRKESCEVQLRSVDLNLLTVFDAVMQMQNITRAAQALGMSQPAVSNAVARLKTMFDDELFVRYGRGIQPTARAKQLFGPLRQALQIVHNELPGVGFEPDNSARVFNLSICSPLDIRLAAQIVGGIKKHSPNIEVVIKTQINGNIEKQLKYQEIEFVISYIQLDQPDFHNSPLFNDELVLAVSKTHPRISKRINQQQLQEERHAIVALDNVDSFSKPYYESNELLRSVSYQGTDLNSVLNIVSQTYLVAIAPKWMVEHYSEQLNIRAIPLPNGRISRPCYLIWHGSTNRDKGHQWMKSLLSNLGEQE

SEQ ID NO: 5791 - protein, 530 aa, Xenorhabdus bovienii
  Peptide sequence Name=Xb4151_4152.C411.gene21.pep
  Gene classification: Gene name=LeuA; Function =Isopropylmalate/homocitrate/citramalatesynthases; Function class=E Amino acid transport and metabolism
  Homolog annotation: Query=1..526bp; Hit=1..522bp; Blast score=790; Percent Identity=73.0; E value=0; Homolog= ZleuA COG0119
MSQQVIIFDTTLRDGEQALQASLSVKEKLQIAYALERLGVDIIEAGFPVSSPGDFESVQTIAREIKNSRICALSRCVDNDIDVAAESLKVAEAFRLHLFLATSSLHVEHKLKKEFDDVVEMAVRSIKRARRYTDDIEFSCEDAGRSNIDSLCHIVEQAIKAGATTINIPDTVGYTTPYQFGGIIQNLFDRVPNIDKAIISVHCHDDLGMSVANSITAVQAGARQIEGTINGLGERAGNCSLEEVIMAIKTRQQILDVHTNINHKEIYRTCQLVSQICNTPIPANKAVVGSNAFAHSSGIHQDGVLKNRETYEIMTPESIGLKDTQLNLTSRSGRAAVKHRMSEMGYQEQDYNLDTLYKAFLRLADKKGQVFDYDLEALVFINQQQQENEYYRLDYFSTQSGTHIVPTATVRLACGDEIKSEAATGNGTVDAIYQAINRITGYSLELISYQLSGKGHGKDALGQVNIIVEHSGRRFHGMGLETDIIESSAKAMIPILNSIWQAEQVEKEKQRIQSNTSQNNFPNNDTKETA

SEQ ID NO: 5792 - protein, 373 aa, Xenorhabdus bovienii
  Peptide sequence Name=Xb4151_4152.C411.gene22.pep
  Gene classification: Gene name=LeuB; Function =Isocitrate/isopropylmalate dehydrogenase; Function class=E Amino acid transport and metabolism
  Homolog annotation: Query=12..373bp; Hit=3..364bp; Blast score=625; Percent Identity=82.0; E value=1e-179; Homolog= ZleuB COG0473
MTTPPTIHKQDSGSYHIAVLPGDGIGPEVMRQAYKVLDAIRQRFNLHITTSEYDIGGIAIDRHGCPLPQTTIAGCEKADALLFGSVGGPKWEHLPPAEQPERGALLPLRKHFKLFSNLRPARLYAGLESFCPLRQDIAERGFDILCVRELTGGIYFGQPKGREGKGKYERAFDTEIYHRFEIERIARIAFESARKRRHKVTSIDKANVLQSSVLWREVVSEVARAYSDVEIQHMYIDNATMQLIKNPAQFDVLLCSNIFGDILSDECAMITGSMGMLPSASLNEKGFGLYEPAGGSAPDIAGKNIANPIAQILSTALLLRYSFERDDAANAIEHAINHALEQGYRTTDLAGNDKAVSTDEMGDIIARYIAEEI

SEQ ID NO: 5793 - protein, 226 aa, Xenorhabdus bovienii
  Peptide sequence Name=Xb4151_4152.C411.gene23.pep
  Gene classification: Gene name=MutH; Function=DNA mismatch repair protein; Function class=L DNA replication, recombination and repair
  Homolog annotation: Query=7..226bp; Hit=9..228bp; Blast score=317; Percent Identity=73.0; E value=7e-87; Homolog= ZmutH COG3066
MYFTPPSPPENEQQLLERANALAGLSMGELAAQANLPIPPDLKRDKGWVGMLLEYYLGASAGSKPEQDFEHIGIELKTIPVDKKGSPLETTFVCVAPLTGNSGIRWENCHVRRKLSRVLWIPVEGERAISLAERRVGSPLLWSPDPIEEELLRRDWEELMDLIVLGKVENITARHGEVLQLRPKAANSRALTEAIGEFGQPIMTLPRGFYLKKNFTAPLLARHFFL

SEQ ID NO: 5794 - protein, 142 aa, Xenorhabdus bovienii
  Peptide sequence Name=Xb4151_4152.C411.gene24.pep
VAGKSNIAFYRQPNFTISLNLIDTTDAKVGAYLMILDAEGINNAQVFSSKRGSEMEYEYIPSTACSNQLTCSIYIKKTDNGSYPLVGTFYLSYHPVSGLVDITEVKISPGALLNLEVDRVDNTKFHFTLQAKQCNQAITSIS

SEQ ID NO: 5795 - protein, 62 aa, Xenorhabdus bovienii
  Peptide sequence Name=Xb4151_4152.C411.gene25.pep
  Gene classification: Gene name=Def; Function=N-formylmethionyl-tRNA deformylase; Function class=J Translation, ribosomal structure and biogenesis
  Homolog annotation: Query=1..60bp; Hit=107..166bp; Blast score=85; Percent Identity=70.0; E value=9e-18; Homolog= VCA0150 COG0242
VKVEALDRHGKAMVVESEDFLSIVMQHEIDHLNGIVFIDYLSPLKRQMALKKVKKFLSNKTS

SEQ ID NO: 5796 - protein, 349 aa, Xenorhabdus bovienii
  Peptide sequence Name=Xb4151_4152.C411.gene26.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335
MIAPMKINLTDAQKDALELMHDTTRDGRVRDRIKAVLLASEGWTAQMIAQALRIHESTVSRHLKDYFSEEKLAPENGGSESRLSAEQTTELVEYLMANLMHTTAQIVAYVRARWQVTFTVAGMTKWLHRQGFSYKKPMGAPHKFDADKQQQFIETYNALKEECGQNAPILFIDAVHPTLSTKLSYGWMKSGRKHVKVVETTGSRTRLNIMGALNLQRIEETIVREYPTINAKNVVLFFGSIRETYPLSQKIHIILDGAGYHRSGVVQFFAEVLNIELHYLPPYSPNLNPIERLWKYVNEQVRNNVYFPDTKTFRETLRHFFHVTLPEKAKELTTRLTDNFQILKPASSS

SEQ ID NO: 5797 - protein, 255 aa, Xenorhabdus bovienii
  Peptide sequence Name=Xb4151_4152.C412.gene1.pep
  Gene classification: Function=Uncharacterized BCR; Function class=S Function unknown
  Homolog annotation: Query=1..255bp; Hit=1..263bp; Blast score=254; Percent Identity=61.0; E value=5e-68; Homolog= ybgF COG1729
MNSNFRHYVLGLSLLVGVAAPWAATAQAPISNVGSGSTDERLSQLERISDAHSQLLTQLQQQLADSQRDIDTLRGQIQENQYQLNQVIERQKDIYQQLDKITNPSSGTEGGNTATPSAKTDGNPPAAPTSTGSEKGDYDAAVALAINTKEYDKAISAFQTFVKTYPKSKYLSNTNYWLGQLNYNKGKKDDAAYYFATVVKDYPKSQKSSDSLYKVGLIMQEKGQKVKAKAVYQQVVKQYPGTNSAKMAEKKIAGM

SEQ ID NO: 5798 - protein, 167 aa, Xenorhabdus bovienii
  Peptide sequence Name=Xb4151_4152.C412.gene2.pep
  Gene classification: Gene name=OmpA; Function=Outer membrane protein and related peptidoglycan-associated (lipo)proteins; Function class =M Cell envelope biogenesis, outer membrane
  Homolog annotation: Query=1..167bp; Hit=1..173bp; Blast score=239; Percent Identity=78.0; E value=1e-63; Homolog= pal COG2885
MQLNKVLKGLMLALPIMAVAACSTNKNGNNDQSGVGTVDNSAKAGLSAEELARQQMQELQNNNIVYFGFDKYDINSDFAQMLDAHAVFLRSNPSIKVTIEGHADERGTPEYNIALGERRANAVKMYLQGKGVSADQLAIVSYGKEKPAVLGHDEAAYSKNRRAVIVY

SEQ ID NO: 5799 - protein, 419 aa, Xenorhabdus bovienii
  Peptide sequence Name=Xb4151_4152.C412.gene3.pep
  Gene classification: Gene name=TolB; Function=Periplasmic component of the Tol biopolymer transport system; Function class=N Cell motility and secretion
  Homolog annotation: Query=1..419bp; Hit=13..430bp; Blast score=672; Percent Identity=79.0; E value=0; Homolog= tolB COG0823
MMWAALAHAEVRIEITQGVDSARPIGVVPFKWTGAGNAPEEIGSIIAADLRNSGKFNPIDPNRMPQQPSTASEVTPAAWSALGIDSVIVGQIQPAADGNYLVSYQLVDTAGAPGTVMAQDQFKIEKKWLRHAAHTASDQVFEKLTGIKGAFRTRLAYVVKKSSVGKYPYELRVSDYDGYNQFTVHRSPEPLMSPAWLPDGSQLAYVTFESGRSALVIQTLATTAVRQVASFPRHNGAPAFSPDGTKLAFVLSKTGSLNLYMMDLASGQIRQVTDGRSNNTEPSWMPDNQTLVYTSDQGGRPQLYKIDINGGAPQRLTWEGSQNQDADVSSDGSFIVMVSSASGSQHIAKQDLGTGSVQMLTDTFLDETPSIAPNGTMVIYSSTQGLGTVLQLVSTDGRFKARLPATDGQVKFPAWSPYL

SEQ ID NO: 5800 - protein, 328 aa, Xenorhabdus bovienii
  Peptide sequence Name=Xb4151_4152.C412.gene4.pep
  Gene classification: Gene name=TolA; Function=Membrane protein involved in colicin uptake; Function class=M Cell envelope biogenesis, outer membrane
  Homolog annotation: Query=2..102bp; Hit=36..132bp; Blast score=63; Percent Identity=54.0; E value=3e-10; Homolog= ZtolA COG3064
MQKTEMGGGGAGGTVIDAVMVDPNAVVQQYSQQQQQQANAKLAEQQRKKKAEQQAAELRVKQAEEQERLKSAEEERIKAQQASEEQKKQADAAASKAREEQKLAEEAAAKAKAEKERILQEQAEARQKAEVQAKKEAEETAKRKAASEAKVKAEAEAQAKAEAEAKTKAKAEAESKAKAEAEAETKAKTETKAKAKAKAEATKQAQEVDDLLGGLTSSAPKQGGASAAGQGGGKKSGPSQSDINNYKGQIQTAIQQKFHDPSLYLGRTCELRIKLAPDGLLIDIKAGAGDPALCRAAVAAALQTKIPRPPSKEIYEHFKNSSLDFKPQ

SEQ ID NO: 5801 - protein, 143 aa, Xenorhabdus bovienii
  Peptide sequence Name=Xb4151_4152.C412.gene5.pep
  Gene classification: Gene name=ExbD; Function=Biopolymer transport protein; Function class=N Cell motility and secretion
  Homolog annotation: Query=1..141bp; Hit=1..142bp; Blast score=160; Percent Identity=75.0; E value=5e-40; Homolog= tolR COG0848
MARTRSRRRELKSEINIVPLLDVLLVLLLIFMATAPIITQSVEVDLPDAVDSKAVSSSDNPPVIMEVSGIGQYNMIVNQERLELLPEQQIIAEAQALMKINPKTVFLIGGSKEVPYDEIIKALNMLRQAGVKSVGLMTQPIGA

SEQ ID NO: 5802 - protein, 229 aa, Xenorhabdus bovienii
  Peptide sequence Name=Xb4151_4152.C412.gene6.pep
  Gene classification: Gene name=TolQ; Function=Biopolymer transport proteins; Function class=N Cell motility and secretion
  Homolog annotation: Query=1..223bp; Hit=1..223bp; Blast score=355; Percent Identity=88.0; E value=1e-98; Homolog= tolQ COG0811
VTDMNILDLFLKAGFLVQLIMLILIGFSIVSWAIIIQRTRILNAATREAEAFEDKFWSGIELSRLYKESQSRRDSLNGTEQIFHSGFKEFARLHQVNSHVPEAVITGASRAMRISMNRELETVENHIPFLGTVGSISPYIGLFGTVWGIMHAFIALGAVKQATLQMVAPGIAEALIATAIGLFAAIPAVMAYNRLSQRVNKLEQIYDNFMEEFLAILHRQAFTPNTNKS

SEQ ID NO: 5803 - protein, 131 aa, Xenorhabdus bovienii
  Peptide sequence Name=Xb4151_4152.C412.gene7.pep
  Gene classification: Gene name=FcbC; Function=Predicted thioesterase; Function class=R General function prediction only
  Homolog annotation: Query=2..131bp; Hit=5..134bp; Blast score=171; Percent Identity=65.0; E value=1e-43; Homolog= ybgC COG0824
MLFRWPIRVYYEDTDASGVVYHAQYLAFYERARTEMLREKGFHQKYMLDEQIGFVVSRMTVDYRKPARLDDLLVVESEITNIRGASLTFTQRIVDCNGIAISSAESLVVCVNSSQMKPIALPKSIVAEFKQ

SEQ ID NO: 5804 - protein, 38 aa, Xenorhabdus bovienii
  Peptide sequence Name=Xb4151_4152.C412.gene8.pep
MWYFAWILGTLLACSFAIIAALALEQSESKKATESGEK

SEQ ID NO: 5805 - protein, 379 aa, Xenorhabdus bovienii
  Peptide sequence Name=Xb4151_4152.C412.gene9.pep
  Gene classification: Gene name=AppB; Function=Cytochrome bd-type quinol oxidase, subunit 2; Function class=C Energy production and conversion
  Homolog annotation: Query=1..379bp; Hit=1..379bp; Blast score=536; Percent Identity=75.0; E value=1e-152; Homolog= cydB COG1294
MLDYDVLRFIWWLLIGVLLIGFAVTDGFDMGVGVLLRVIGKNDTERRIMINSIAPHWDGNQVWLITAGGALFAAWPMVYAAAFSGFYVAMILVLAALFFRPVGFDYRSKLENSQWRNMWDWGIVIGSFVPPLIIGVAFGNLLQGVPLAIDSYMRVSYEGSFFGLLNPYGLLVGIISLMMIVTQGATYLQMRTTGELHLRSRTATHVCALVTAVAFLLAGVWLIYGIDGYVVTGGLDINGPSNPLHKEVAHQAGAWLINFNKYPALWAIPALGVTLPLLTMLATRMDKGGWAFLFSSLTVACIILTSGIAMFPFVMPSSIDPNISLTMWDATSSQWTLQVMFVVALIFVPLILLYTTWCYYKTFGRLDKNYIENNKNSLY

SEQ ID NO: 5806 - protein, 523 aa, Xenorhabdus bovienii
  Peptide sequence Name=Xb4151_4152.C412.gene10.pep
  Gene classification: Gene name=CydA; Function=Cytochrome bd-type quinol oxidase, subunit 1; Function class=C Energy production and conversion
  Homolog annotation: Query=1..518bp; Hit=2..519bp; Blast score=860; Percent Identity=85.0; E value=0; Homolog= cydA COG1271
MFDIVELSRLQFALTAMYHFLFVPLTLGMAFLLAIMETVYVLSGKQIYKDMTKFWGKLFGINFALGVATGLTMEFQFGTNWSYFSHYVGDIFGAPLAIEGLMAFFLESTFVGLFFFGWDRLSKKQHLAVTWLVGLGSNFSALWILVANGWMQNPIASDFNFETMRMEMVSFSELVLNPVAQVKFVHTVAAGYVTGAVFVLGISAYYLLKGRDIPFAKRSFAIASSFGIAAILSVIVLGDESGYEMGDVQKTKLAAIEAEWETQPPPASFTLIGIPDQDKMENKYSIQIPYILGLIATRSTDTPVVGLRDLMGQHEQRIRNGIKAYELLEELRSGNIDPAVRNAFNESKKDLGYGMLLKRYTQDVANATEEQIKSAAKDSIPRVAPLYFAFRIMVASGFLMLLVIGLAFLSVIRNRIGQQKWLLRAALFSIPLPWIAIEAGWFVAEYGRQPWAIGEVLPTAVAASTRSVGDLIFSMVLICGLYTLFLIAEMFLMFKFARLGPSSLKTGRYHFEQKTASSANNIE

SEQ ID NO: 5807 - protein, 291 aa, Xenorhabdus bovienii
  Peptide sequence Name=Xb4151_4152.C412.gene11.pep
  Gene classification: Gene name=SucD; Function=Succinyl-CoA synthetase alpha subunit; Function class=C Energy production and conversion
  Homolog annotation: Query=1..288bp; Hit=1..288bp; Blast score=476; Percent Identity=93.0; E value=1e-134; Homolog= sucD COG0074
MSILIDKNTKVICQGFTGSQGTFHSEQAIAYGTQMVGGVTPGKGGTEHLGLPVFNTVREAVEATGATASVIYVPAPFCKDSILEAIDAGIKLIITITEGIPTLDMLTVKVKLDQAGVRMIGPNCPGVITPDACKIGIMPGHIHKAGKVGIVSRSGTLTYEAVKQTTDAGLGQSTCVGIGGDPIPGSNFIDILKLFQEDPQTEAIVMIGEIGGTAEEEAAAYIKEHVTKPVVAYIAGVTAPKGKRMGHAGAIIAGGKGTADEKFAALEAAGVKTVRSLADIGDAVKVLLAGN

SEQ ID NO: 5808 - protein, 388 aa, Xenorhabdus bovienii
  Peptide sequence Name=Xb4151_4152.C412.gene12.pep
  Gene classification: Gene name=SucC; Function=Succinyl-CoA synthetase beta subunit; Function class=C Energy production and conversion
  Homolog annotation: Query=1..388bp; Hit=1..388bp; Blast score=657; Percent Identity=89.0; E value=0; Homolog= sucC COG0045
MNLHEYQAKQLFARYGLPAPAGYACTTPREAEEAASKIGSGPWVVKCQVHAGGRGKAGGVKVVNSKEDIRAFAEQWLGKRLVTYQTDAQGQPVHQILVEGATDIAKELYLGAVVDRGTRRVVFMASTEGGVEIEKVAEETPELIHKAIIDPLAGPMPYQGRELAFKLGLTSKQVGQFTKIFMGLAKLFLERDLAMVEINPLVITTQGDLICLDGKLGADGNAMFRQAELREMHDPSQEDPREAQAAQWELNYVALDGNIGCMVNGAGLAMGTMDIVKLHGGAPANFLDVGGGATKERVTEAFKIILSDENVKAVFVNIFGGIVRCDLIADGIIGAVEEVGVHVPVVVRLEGNNAELGAKKLADSGLNIIAASSLTDAAKQAVAAAGNK

SEQ ID NO: 5809 - protein, 404 aa, Xenorhabdus bovienii
  Peptide sequence Name=Xb4151_4152.C412.gene13.pep
  Gene classification: Gene name=AceF; Function=Dihydrolipoamide acyltransferases; Function class=C Energy production and conversion
  Homolog annotation: Query=1..404bp; Hit=1..405bp; Blast score=619; Percent Identity=81.0; E value=1e-177; Homolog= sucB COG0508
MSSVEILVPDLPESVADATVATWHKKAGDTVQRDDVLVEIETDKVVLEVPASEAGVLEAILEEEGATVLSKQLLGRIRLSDSTGIPAEVKEKTESTPAQRQTASLEEESNDVLSPAVRRLIAEHDLDPAAIKGSGVGGRIVREDVEKYIAAHKKESGKVAEAAPAQASQLPHRSEKRVPMTRLRKRVAERLLEAKNNTAMLTTFNEVNMKPIQELRKQYGDAFEKRHGMRLGFMSFYVKAVVEALKRYPEVNASIDGTDVVYHNYFDISIAVSTPRGLVTPVLRDADALGMADIEKSIKELAIKGRDGKLTVEELTGGNFTITNGGVFGSLMSTPIINPPQSAILGMHAIKDRPMAVNGQVEILPMMYLALSYDHRLVDGRESVGFLVTIKEMLEDPTRLLLDV

SEQ ID NO: 5810 - protein, 935 aa, Xenorhabdus bovienii
  Peptide sequence Name=Xb4151_4152.C412.gene14.pep
  Gene classification: Gene name=SucA; Function=Pyruvate and 2 -oxoglutarate dehydrogenases, E1 component; Function class=C Energy production and conversion
  Homolog annotation: Query=1..935bp; Hit=1..933bp; Blast score=1647; Percent Identity=83.0; E value=0; Homolog= sucA COG0567
MQNGAMKDWLDSSFLAGANQSYIEQIYEDYITDPNSVDASWREIFQQLPDIGLSGEQLHSQTRDYFRRLAKDATRYHTSVSDPAMDAKQVKVLQLINAFRFRGHQSANLDPLGLWKQEPVPDLDPAFHNLTKADFEETFNVGSFAIGKETLKLADLYDALKRIYCGSIGAEYMHITNTEEKRWIQQRLESIAVGSQFSADEKHRFLAELTAAEGLERYLGAKFPGAKRFSLEGGDALIPMLKELIRHAGKQGTREVVLGMAHRGRLNVLVNLFGKKPADLFDEFAGKHKEHLGTGDVKYHQGFSSDFETEGGLVHLALAFNPSHLEIVSPVVIGSVRARRDRLDEGRSNMVLPVTIHGDAAVIGQGIVQETLNMSQARGYEVGGTVRIVINNQIGFTTSNPKDARSTQYCTDIVKMVQAPIFHVNADDPEAVAFVTRLALDFRNTFKRDVMIDLVCYRRHGHNEADEPSATQPLMYQKIKKQPTPRKIYADKLIAEGLLAANDVTEMANLYRDALDHGECVVNEWRPMGLHSFTWEPYLNHEWDEDYPHKVDMKRLQDLGKRISTIPAEVEMHSRVAKIYGDREEMANGNKLFDWGGAETLAYATLVDEGIPVRLSGEDAGRGTFFHRHAVIHNQPNAAVYVPLENVHSSQGVFNVWDSVLSEEAVLAFEYGYATTEPRALTIWEAQFGDFANVAQVVIDQFISSGEQKWGRMCGLVMLLPHGYEGQGPEHSSARLERYLQLCAEQNMQVCVPSTPAQVYHMLRRQALRGMRRPLIVMTPKSLLRHPLAVSSLDELANGKFEPVIGEIDALDPKGVKRVVLCSGKVYYDLLDQRRKNEQADVAIVRVEQLYPFPRQNLQSLLEQYAHVHDFVWCQEEPLNQGAWYCSQHNFREVIPFGASLRYAGRPASASPAVGYTSVHQQQQQALVNDALNVE

SEQ ID NO: 5811 - protein, 238 aa, Xenorhabdus bovienii
  Peptide sequence Name=Xb4151_4152.C412.gene15.pep
  Gene classification: Gene name=FrdB; Function=Succinate dehydrogenase/fumarate reductase Fe-S protein; Function class=C Energy production and conversion
  Homolog annotation: Query=1..238bp; Hit=1..238bp; Blast score=450; Percent Identity=89.0; E value=1e-127; Homolog= ZsdhB COG0479
MKLEFSIYRYNPDVDNAPRMQDYTLEAEEGRDMMLLDALIQLKEQDPTLSFRRSCREGVCGSDGVNMNGKNGLACVTPVSVLRRGNKKIVIRPLPGLPVVRDLVVDMSQFYTQYEKIRPYLINDGKNPPAREHLQSPEQREKLDGLYECILCACCSTSCPSFWWNPDKFIGPAGLLAAYRFLIDSRDTETASRLDGLNDAFSVFRCHSIMNCVSVCPKGLNPTKAIGHIKSMLLKHSA

SEQ ID NO: 5812 - protein, 588 aa, Xenorhabdus bovienii
  Peptide sequence Name=Xb4151_4152.C412.gene16.pep
  Gene classification: Gene name=SdhA; Function=Succinate dehydrogenase/fumarate reductase, flavoprotein subunits; Function class=C Energy production and conversion
  Homolog annotation: Query=1..588bp; Hit=1..588bp; Blast score=1078; Percent Identity=90.0; E value=0; Homolog= sdhA COG1053
MKLPVREFDAVVIGAGGAGMRAALQISQMGLSCALISKVFPTRSHTVSAQGGITVALGNTHEDNWEWHMYDTVKGSDYIGDQDAIEYMCKTGPEAILELEHMGLPFSRLDNGRIYQRPFGGQSKNFGGEQAARTAAAADRTGHALLHTLYQQNLKNNTTVFSEWYSLDLVKNQDGAIVGCTAICIETGEIVYFKSKATILATGGAGRIYQSTTNAHINTGDGVGMALRAGVPVQDMEMWQFHPTGIAGAGVLVTEGCRGEGGYLLNKDGERFMERYAPNAKDLAGRDVVARSIMIEIREGRGCEGPWGPHAKLKLDHLGKDVLETRLPGILELSRTFAHVDPVKEPIPVIPTCHYMMGGIPTKITGQALTVNEKGEDVIIPGLFAVGEIACVSVHGANRLGGNSLLDLVVFGRSAGLHLKECLMEQGTSRDASESDVDAALQRLNRWNNTRSGEDPVEIRKALQACMQNNFSVFREGDAMAKGLEELKVIRERLQNARLDDTSSEFNTQRIECLELDNLMETAYSTAVSANYRTESRGAHSRFDYPERDDANWLCHSLYLPRTESMTRREVNMQPTLREAFPPKVRSY

SEQ ID NO: 5813 - protein, 115 aa, Xenorhabdus bovienii
  Peptide sequence Name=Xb4151_4152.C412.gene17.pep
  Gene classification: Gene name=SdhD; Function=Succinate dehydrogenase hydrophobic anchor subunit; Function class=C Energy production and conversion
  Homolog annotation: Query=1..114bp; Hit=1..114bp; Blast score=110; Percent Identity=72.0; E value=2e-25; Homolog= sdhD COG2142
MVSNASALGRTGIQDWLLLRASAIVIVLYVLYLVGFVATTSDITYEVWRSFFSSSLTKVFTVLALLSILVHAWIGMWQVLTDYVKPLALRLVLQLVIIVALLVYLIYGTIVVWGA

SEQ ID NO: 5814 - protein, 129 aa, Xenorhabdus bovienii
  Peptide sequence Name=Xb4151_4152.C412.gene18.pep
  Gene classification: Gene name=SdhC; Function=Succinate dehydrogenase/fumarate reductase cytochrome b subunit; Function class=C Energy production and conversion
  Homolog annotation: Query=5..129bp; Hit=5..129bp; Blast score=157; Percent Identity=72.0; E value=2e-39; Homolog= sdhC COG2009
VGKIVKKQRPVNLDLRTINQPVSAITSILHRISGVITFIAVGILLWLLGMSLSSQEGFLQASEIMTGFFAKFILWGILTALAYHICGGIRHVLMDFGFLEENLATGSASAKVAIVIAVILSILAGVLLW

SEQ ID NO: 5815 - protein, 427 aa, Xenorhabdus bovienii
  Peptide sequence Name=Xb4151_4152.C412.gene19.pep
  Gene classification: Gene name=GltA; Function=Citrate synthase; Function class=C Energy production and conversion
  Homolog annotation: Query=1..427bp; Hit=1..427bp; Blast score=771; Percent Identity=84.0; E value=0; Homolog= gltA COG0372
MADKKATLTISGAAAIELDVLTPTLGSEVIDVRTLGSKSFYTYDPGFTSTASCESKITYIDGDEGILLHRGFPIDQLATGSNYLEVCYILLYGEPPTPEEYETFKKTVIRHTMIHEQITRLFHGFRRDSHPMAVLCGVTGALAAFYHDALDVHNPHHREITAYRLLSKMPTVAAMCYKYSIGQPFVYPRNDLSYAANFLHMMFSTPCEEYKVNPVLERAMDRIFILHADHEQNASTSTVRTAGSSGANPFACIAAGIASLWGPAHGGANEACLRMLEEIQTVKHIPEFIARAKDKNDSFRLMGFGHRVYKNYDPRATVMRETCHEVLNELGLNDSLLEVAMELERIALNDPYFIEKKLYPNVDFYSGIILKAMGIPSSMFTVIFAIARTIGWIAHWTEMHDEGLRIARPRQLYTGHTQRDFKSQLEK

SEQ ID NO: 5816 - protein, 261 aa, Xenorhabdus bovienii
  Peptide sequence Name=Xb4151_4152.C412.gene20.pep
  Gene classification: Gene name=AraC; Function=AraC-type DNA-binding domain-containing proteins; Function class=K Transcription
  Homolog annotation: Query=1..255bp; Hit=1..253bp; Blast score=204; Percent Identity=42.0; E value=7e-53; Homolog= VCA0266 COG2207
MAWLRQSDHFDPDGLKYSSNVSVIGIAAEMGQYDSGFHQHDMGQLLFTQQGCIKITLANQLSILPPTRVAWIPPKTLHRAEMRGSIGYRSIYLDMSGIEWISKQSEILETTPLLQAILERIAISPFDTDWRQGKGAHLLAVFFDEMREAGKEPTLLPLPSDRRLARLPFDQLPPPLQMLATHIGASEKTITRIFLRETGMNYQQWRQQWRLIKAIELLAQDKTLSYVAQELGFANDSAFVTFFRKNMGKPPREYMAGACRR

SEQ ID NO: 5817 - protein, 387 aa, Xenorhabdus bovienii
  Peptide sequence Name=Xb4151_4152.C412.gene21.pep
  Gene classification: Gene name=ProP; Function=77 Permeases of the major facilitator superfamily; Function class=G Carbohydrate transport and metabolism
  Homolog annotation: Query=16..384bp; Hit=1..368bp; Blast score=287; Percent Identity=50.0; E value=1e-77; Homolog= VCA0267 COG0477
MLIFRAINSSSEENIMHTRPSLWLAITLMMFPQIVETIYSPALTNIASGFSVNATQASQTLSFYFFAFAIGIVVWGRMCDVIGRRPTIIAGLLLYGAASLLALLTEHFWLLLATRMLSAFGASVGSVGTQTIMRDTYRSEELSRVFSIMGIALAVSPAIGMISGSILNHFGGYKAVFAGLAILAVILMSWSVIRLPETRPVNVPKIALFGTAVTMFKDISIWRNAFLIAFFNICLFSYYQLAPFRFQQFGLSQAQFGYTGLLFTFGVGLGSLLNKHLLKKQWLSAKLISLAAMIVFLSGIGVYLLENSWLFIFPMLGIVTAYGLAIPNILASALNNYADRLGTAGALLGLLYYLLLGGGLALAGWSQALGSILICCGVSTVLLTRKW

SEQ ID NO: 5818 - protein, 258 aa, Xenorhabdus bovienii
  Peptide sequence Name=Xb4151_4152.C412.gene22.pep
  Gene classification: Function=Uncharacterized ACR; Function class=S Function unknown
  Homolog annotation: Query=12..258bp; Hit=1..247bp; Blast score=358; Percent Identity=68.0; E value=3e-99; Homolog= ybgI COG0327
MAKALNDGGSVMNNVELEHVLNTELNVREFQDYAPNGLQVEGRPHVQRIITGVTACQALLDEAVRLKADAVIVHHGYFWKNESPVIRGMKRRRLQTLLSNDINLYGYHLPLDAHPTLGNNVQLARQMGVKIIGQIDPLLPHGAFDQPITPTELTERLEKRLERKVLHCGDNAPEEIRTLAWCTGGGQSFIEQAAEFGVDAFVTGEVSEKTIHVAREMGLHFYAAGHHATERYGIKVLGEWLANHYGLDVTFVDIPNPA

SEQ ID NO: 5819 - protein, 69 aa, Xenorhabdus bovienii
  Peptide sequence Name=Xb4151_4152.C412.gene23.pep
  Homolog annotation: Query=1..68bp; Hit=1..68bp; Blast score=92; Percent Identity=75.0; E value=1e-18; Homolog= Pa|Phot4-264g05.p1k _g22| 28255 - 28464 201 69 aa, chain -
MSTYREYSWHQVLLRRTGAVTLGVIALPVMLFRQDRARFYSYLRKVWIKTSDKPVWLESSEMAAGIRNR

SEQ ID NO: 5820 - protein, 417 aa, Xenorhabdus bovienii
  Peptide sequence Name=Xb4151_4152.C412.gene24.pep
  Gene classification: Gene name=KdpA; Function=K+-transporting ATPase, A chain; Function class=P Inorganic ion transport and metabolism
  Homolog annotation: Query=1..387bp; Hit=1..382bp; Blast score=486; Percent Identity=65.0; E value=1e-137; Homolog= kdpA COG2060
MVASAFLLITSFLVILFILSRPLGSLIANLVEGELPRWLTNAETSLWRCCGLQKPGGNVKEMNWWQYALAIITFNIMGLLLLFMLLISQEHLPLNPQHFAGMKWDLALNTAISFITNTNWQAYSGENTLSYLSQMAGLTVQNFLSAATGIAVAFALMRAFSRQGVKTLGNAWIDITRITLYLLLPLSIIIALIFVSQGVIQNFSPYVLVHTLEGQQQLIPMGPVASQEAIKLLGTNGGGFFGANSAHPFENPNALSNFVQILTIFLIPCALCFAFGLVVGDNRQGHALLWAMTIVFIIAVTIVIYAEIMGNPHFIQAGASSNLNMEGKESRFGILASSLYSVVTTAASCGAVNAMHDSFTALGGMIPLWLMQIGEVIFGGVGSGLYGHVAICPTGCVYCRFDDWPRSGILGQENRCP

SEQ ID NO: 5821 - protein, 181 aa, Xenorhabdus bovienii
  Peptide sequence Name=Xb4151_4152.C412.gene25.pep
  Gene classification: Gene name=KdpA; Function=K+-transporting ATPase, A chain; Function class=P Inorganic ion transport and metabolism
  Homolog annotation: Query=1..174bp; Hit=383..556bp; Blast score=227; Percent Identity=77.0; E value=5e-60; Homolog= ZkdpA COG2060
MLLFVLLAVFIAGLMIGRAPEYLGKKIDVHDMKMVALAILVTPSLVLLGTALATSIDAGRAAIMNPSAHGFTEVLYALSSAANNNGSAFAGLNANSVFYNLLLGAIMFLGRFGVIFPVLAIAGSMISKKRQPISSGTLPTHGSLFTGLLILVVLLMGALTFIPALALGPVAEHLQLWQAPR

SEQ ID NO: 5822 - protein, 688 aa, Xenorhabdus bovienii
  Peptide sequence Name=Xb4151_4152.C412.gene26.pep
  Gene classification: Gene name=KdpB; Function=High-affinity K+ transport system, ATPase chain B; Function class=P Inorganic ion transport and metabolism
  Homolog annotation: Query=1..684bp; Hit=1..678bp; Blast score=1003; Percent Identity=78.0; E value=0; Homolog= ZkdpB COG2216
MKDKHQALFEPALIRHALIDAVKKCHPAIQWRNPVMFVVYLGSCLTTVLWLGMLTEQLTGNALFTGSIALWLWFTVLFANFAEALAEGRSQAQASSLKGVKKTTWATRLASASHDAAKEKVTSDHLRKGDIVLVEVGEIIPCDGEVLEGGASVDESAITGESAPVIRESGGDFASVTGGTRVLSDWLIIECSVNPGETFLDRMISMVEGAKRRKTPNEIALTILLTALTIIFLLSCISLLPFSLFSVQTNQSGDPISITVLVALLVCLIPTTIGGLLSAIGVAGMSRMLGANVIATSGRAIEAAGDVDVLLLDKTGTITLGNRQASQFLPAPGVTEEQLADAAQLSSLADKTPEGRSIMILAKQRFNMRERDLRALNATFIPFSAMTRMSGVNIGTRMIRKGAVDAIRRYVEANHNQFPDAIDLLVQQVASKGATPLVVAENQRVLGVVALKDIVKGGIKERFSEMRRMGIKTVMITGDNHLTAAAIAAEAGVDDFLAEATPEAKLALIRQYQSEGCLVAMTGDGTNDAPALAQADVAVAMNSGTQAAKEAGNMVDLDSNPTKLIEVVHIGKQMLMTRGSLTTFSIANDIAKYFAIIPAAFAVTYPQLNALNIMHLHSPESAVLSAVIFNAIIIIVLLPLALKGVSYRAMNALSLLRRNLWLYGLGGLLIPFVGIKLIDMLLTVLAFK

SEQ ID NO: 5823 - protein, 192 aa, Xenorhabdus bovienii
  Peptide sequence Name=Xb4151_4152.C412.gene27.pep
  Gene classification: Gene name=KdpC; Function=K+-transporting ATPase, c chain; Function class=P Inorganic ion transport and metabolism
  Homolog annotation: Query=4..188bp; Hit=4..188bp; Blast score=168; Percent Identity=50.0; E value=3e-42; Homolog= ZkdpC COG2156
MIWLRASIVLLTFLTLITGIAYPLLITGIANALFPHQAKGALIEHNGKWVGSELIGQSFTQAIYFHGRPSMTLEHPYNALSSGGSNFATTNPALTHQIYQRITQVRLFNHSENSAIPVDLITASGSGLDPHISPNAAEFQAQRVATARHLSINVINKLIQAYTAYPPLKYMGEPVVNVLELNLALDNLKPQG

SEQ ID NO: 5824 - protein, 905 aa, Xenorhabdus bovienii
  Peptide sequence Name=Xb4151_4152.C412.gene28.pep
  Gene classification: Gene name=KdpD; Function=Osmosensitive K+ channel histidine kinase; Function class=T Signal transduction mechanisms
  Homolog annotation: Query=5..905bp; Hit=4..894bp; Blast score=1140; Percent Identity=63.0; E value=0; Homolog= kdpD COG2205
MDQIEPLRPDPDDLLALANEKPRGKLKIFFGACAGVGKTYAMLQEAQRLLSQGLDVIAGVVETHERQETAALLTGLPQLPLKHIRYHERRIAAFDIDAAIARYPAIILMDELAFSNPHSSRHPKRWQDVEELLEAGIDVLTTINVQHLESLNDVVGAITGIRVRETIPDHIFDHADDVVLVDIPPDDLRQRLNDGKVYISGQAERAIEHFFRKGNLIALRELALRRTADRVDDQMRAFRDTRGKEPVWHTRDNLLLCIGCNAGNEKLIRTAARLAAKLGCEWHAVYVETPKLHRLPEIKRRTILKALKLAQELGAETATLSDPHEERAILRYAREHNLGKILVGRYHGSHSTSFSDKWLGFKWRPDFVERLGKLGPDLDLIIVALEDKKRWDKEQRDNRAFHEKWRIQIHGFLIAIILCTLITLFSHTFLLTLDKANLVTLYLLGVVIIALFYGRWPSVFAAFINVISFDIFFVQPRWSLAVTDMQYLLTFTVMLIVGVVVGNLTAGIRYQARVARYREQRTRHLYEITRELSRALNEEDVARISYHFLSNSFQAKTGLLLPDNNARLYQVKSNNGGQMQIDEAIAKWSFDKKQPAGAGTDTLPGVPYQLFPIATASQVFAVLAIESPNLRQLLVPEQQRLLQTFTGLIANALERLHLSRRAESAKLETEREQLRNSLLAALSHDLRTPLTVLFGQTEILMLDLSTENSPHTQQVNQIRQQILSTSRLVNNLLDMARIQSGGIQLNLEWHSLEEIVGSALRSLEYTLSRYTVELSLSANLLLHCDACLLERVFINLLENAIKYTHEQTPLGIRATTEYKQVHIEIWDAGSGIPQGQEQVIFDKFSRVRKESAIPGVGLGLAICRAIIEIHGGHIWAANNKKGGASFHFVLPLEEVPKIEEVIEEM

SEQ ID NO: 5825 - protein, 221 aa, Xenorhabdus bovienii
  Peptide sequence Name=Xb4151_4152.C412.gene29.pep
  Gene classification: Gene name=OmpR; Function=Response regulators consisting of a CheY-like receiver domain and a winged-helix DNA -binding domain; Function class=T Signal transduction mechanisms
  Homolog annotation: Query=1..220bp; Hit=5..224bp; Blast score=322; Percent Identity=69.0; E value=1e-88; Homolog= kdpE COG0745
LIVEDEKEIRRFVRLALEGENWRVFECDTLKRGLIEAATRKPDLLILDLGLPDGNGIDLIHDIRQWSSIPIIVLSARNNEQDKVAALDSGADDYLSKPFGINELLARVRVALRRATKANQPDPMIHFADISVDLINRRVLKSQKELHLTPTEYRLLTELLTNSGKVLTQRYLLNHVWGPHYIEHNHYLRIYMGHLRQKLEEDPARPKHLLTETGVGYRFMP

SEQ ID NO: 5826 - protein, 964 aa, Xenorhabdus bovienii
  Peptide sequence Name=Xb4151_4152.C412.gene30.pep
  Gene classification: Gene name=GlgX; Function=Pullulanase and related glycosidases; Function class=G Carbohydrate transport and metabolism
  Homolog annotation: Query=104..916bp; Hit=116..879bp; Blast score =499; Percent Identity=37.0; E value=1e-141; Homolog= DR0405 COG1523
MESQFWKKAYLILLGSLFSLLLTSCDNKNDLPKIAEEPMAHIPNKIPTEATIADDLQASAHWVDKRTLLWPEGADKPHVRLYYNRYNKVEVNDEGNFTDSYLVLTPTTLSKKTAERFPHLAELPAFQLPENTDVDRLITGELVALATNEEGLLLSATQVQIAGVLDDRFAGTAETLEYGALINDTEVTFRLWAPTAQNVGLVIYNENKQAIANHIMNRDAASGSWSWQGDTNLIGAYYRYALTVYHPYSRKVERYEVTDPYSHSLSTNSEYSQVINLDDEALKPQNWDDLSMPHPQKTPADIARMTLYEAHIRDLSVADNTVPQAWRGKYLALTANSSDMFKHLKALSQAGMTHIELLPVFDIASIDEFSRNVADLNQSFNRLCQVNTTVKNSRFADYCNRSMTVREVLQALQRGDSASNPQVQELNKMLAETDSYNWGYDPFHYSVPEGSYATHAEGSVRIKEFRTMVQAIKQQLGMNVIMDVAYNHTNAAGPTHRTSVLDKVVPWYYHRLDEITGNVENNTCCSDTAPEHRMFAKLIEDSLVTWVKHYKIDAFRFDLMGYHPKAQIVSALAKVRAINPSVYFFGEGWNSGQDDRFETASQINLKGSGIGTFSDRLRDAVRGGGPFDSADNIRINQGMGNGAGTLPNEIARLDANEARHLADLIRLGMAGNLADFAMIDKDGKVKAGREINYKGVAAGYAADPIEVINYVSKHDNQTLWDIISYKAAYEADLATRLRMQAISLSTVLLGQGLAFDQQGSELLRSKSFTRDSYNAGDWFNRVSYTYKDNNYDVGMPGKRDDGGNYALIHRVKNQVKKPGQSELLQMMAFYQELLRLRQFSPLMTLGKGESVKQRIDFRNVGPHQQLGLLVMTIDDGNTTDDDRDLRFDGLVVVINAASKSVTVRDLNTHGLKLNDIQSRLGNASLAAGIKITEDGMVTMPAWSAAVLVLPQKGIRGTGLPVRRK

SEQ ID NO: 5827 - protein, 57 aa, Xenorhabdus bovienii
  Peptide sequence Name=Xb4151_4152.C412.gene31.pep
MLLRLFASGEWGYPKATIKAPAVKLRLFSPPSLYKLGRMLNRLRQHLISHLIFLTLK

SEQ ID NO: 5828 - protein, 546 aa, Xenorhabdus bovienii
  Peptide sequence Name=Xb4151_4152.C412.gene32.pep
  Gene classification: Gene name=Pgm; Function=Phosphoglucomutase; Function class=G Carbohydrate transport and metabolism
  Homolog annotation: Query=1..542bp; Hit=1..542bp; Blast score=870; Percent Identity=77.0; E value=0; Homolog= pgm COG0033
VAIHPRAGQPAQQHDLINIAQLTSQYYTLQPHPENPAHQVKFGTSGHRGSSGRNSFNEAHILAISQAIVEVRAQQGITGPCYVGKDTHALSEAAFISVLEVLIANGVDVIVQENNGFTPTPAISHAILCYNRQGKNRADGIVITPSHNPPEDGGIKYNPPNGGPADTDLTSIIEKRANALLANDLNGVKRLPYERVLKSEYLHPQNLVDPYVTSLGDVVDMAAIQQAGLKIGIDPLGGSGIAYWQRIGEYYNLDLTLVNDKVDQTFRFMTLDHDGVIRMDCSSRWAMAGLLELRGKFDLAFANDPDYDRHGIITPVGLMNPNHYLATAVDYLFRHRPQWSEKVAVGKTLVSSAMIDRVVADLGRELLEVPVGFKWFVDGLYRGELGFGGEESAGASFLRFDGTPWSTDKDGIILCLLAAEMTATTGENPQQRYDKLAARFGTPSYSRIQAPASHQQKALLSKLSPEMVKANTLAGDPITARLTTASGNGASIGGLKVMSDNGWFAARPSGTEEAYKIYCESFLGAEHREKIEQEALEIVNQVFTAG

SEQ ID NO: 5829 - protein, 177 aa, Xenorhabdus bovienii
  Peptide sequence Name=Xb4151_4152.C412.gene33.pep
  Gene classification: Gene name=SeqA; Function=Negative regulator of replication initiationR; Function class=L DNA replication, recombination and repair
  Homolog annotation: Query=1..177bp; Hit=1..181bp; Blast score=222; Percent Identity=62.0; E value=1e-58; Homolog= seqA COG3057
MKTIEVDEDLYRFIASQTLHIGESASDILRRILKVDAGQPVQTTPPVRESVSVSKVPAARSRDVVRVVRELLLSDEYAEKKKSVERFMSILSTLYSLNSESFAKTTEAMHGRTRTYFAGSEQTLLASGKHTKPRHIPGTPFWVITNTNTGRKRSMVEHVMQDMKFPANVIEKVCGTI

SEQ ID NO: 5830 - protein, 259 aa, Xenorhabdus bovienii
  Peptide sequence Name=Xb4151_4152.C412.gene34.pep
  Gene classification: Gene name=MhpC; Function=Predicted hydrolases or acyltransferases (alpha/beta hydrolase superfamily); Function class=R General function prediction only
  Homolog annotation: Query=6..256bp; Hit=2..252bp; Blast score=311; Percent Identity=59.0; E value=4e-85; Homolog= ZybfF COG0596
MNSNNQLNYHFHTPENPQSSTPIVLIHGLFGDLSNLGILGRDLQQHYPVIQIDVRNHGISPQMENMNYRDMAQDVLSLLDELNVAKAIIIGHSMGGKIAMTMTAVAPERIEQIVVIDIAPVTYLTRHHDSIFSALNQVKEAGAQTRQAATEVMRKDIHEDGVIQFLLKSFRQGEWKFNLPVLRKEYEKIIGWEAIPAWPKPALFIRGGNSDYITEAYREDIMRQFPQATAWVIAGCGHWVHAEKPEAVLRAIHRFLAKK

SEQ ID NO: 5831 - protein, 47 aa, Xenorhabdus bovienii
  Peptide sequence Name=Xb4151_4152.C412.gene35.pep
MEFYLNRVIRFFIALFILLLSSFVLNAFAGNEAPYALYIKKTSFVIP

SEQ ID NO: 5832 - protein, 91 aa, Xenorhabdus bovienii
  Peptide sequence Name=Xb4151_4152.C412.gene36.pep
  Homolog annotation: Query=1..91bp; Hit=1..91bp; Blast score=119; Percent Identity=61.0; E value=8e-27; Homolog= gi|37528015|ref|NP _931360.1| hypothetical protein [Photorhabdus luminescens subsp. laumondii TTO1] gi|36787452|emb|CAE16549.1| u
MSKGYFLTVSDKTTCGGEILTGTSSIKFYGRQAAIEGSTVTCGRYSGNYVIVGGVGSFLDKGTKLAGTLDSQSTCPCNASLICSIPDSYQK

SEQ ID NO: 5833 - protein, 186 aa, Xenorhabdus bovienii
  Peptide sequence Name=Xb4151_4152.C412.gene37.pep
  Gene classification: Gene name=Tra8; Function=Transposase, IS30 family; Function class=L DNA replication, recombination and repair
  Homolog annotation: Query=1..179bp; Hit=1..179bp; Blast score=151; Percent Identity=48.0; E value=5e-37; Homolog= NMB0443 COG2826
MTYKQLTETERYQIFSLKEAGFSPREISKSLNRNPSTISRELRRNQEAKKYAPEQAQLKAVARRHCSTKAVKLKPEIEMWIKQLILQDLNPEQTVGYLKRENIISLHHETVYRLIYKDKFNEGDLWQHLRITKKPYRKRYGSYERRGKIKNRVSIDKRPKLVDKKQRIGDWEGDTLVGKDLIKVHY

SEQ ID NO: 5834 - protein, 70 aa, Xenorhabdus bovienii
  Peptide sequence Name=Xb4151_4152.C412.gene38.pep
  Gene classification: Gene name=Tra8; Function=Transposase, IS30 family; Function class=L DNA replication, recombination and repair
  Homolog annotation: Query=1..62bp; Hit=227..288bp; Blast score=82; Percent Identity=54.0; E value=6e-17; Homolog= NMB1770 COG2826
MTFDNGLEFVEHELISKNVEPKIYFSHPYSPWERAINENTNGLIRDYFPKGTDFNKVSELEITSQGASIV

SEQ ID NO: 5835 - protein, 68 aa, Xenorhabdus bovienii
  Peptide sequence Name=Xb4151_4152.C412.gene39.pep
  Gene classification: Gene name=Tra8; Function=Transposase, IS30 family; Function class=L DNA replication, recombination and repair
  Homolog annotation: Query=1..62bp; Hit=227..288bp; Blast score=81; Percent Identity=54.0; E value=2e-16; Homolog= NMB2148 COG2826
MTFDNGLEFVEHELISKNVEPKIYFSHPYSPWERAINENTNGLIRDYFPKGTDFNKVSELEINLRAQA

SEQ ID NO: 5836 - protein, 319 aa, Xenorhabdus bovienii
  Peptide sequence Name=Xb4151_4152.C413.gene1.pep
  Gene classification: Function=Predicted permeases; Function class=R General function prediction only
  Homolog annotation: Query=5..245bp; Hit=8..243bp; Blast score=80; Percent Identity=26.0; E value=3e-15; Homolog= mll1169 COG0679
MFMIVVPIFLIIFIGYIFGRLRPDSGKSDKLINEYVLYIALPALLFLAIARADINELQQWGFITASLSGIGAAYILGILVAKFMGISLPQSSILSMGACYGTTGYMGVPILISVYGESAALPAAIATILHNIPAIMAVIITYDIFSTHQSGNKISISQSLVGALKTTLSNPLTISVIAGLVFVFLGIPVPNFLRSFAEFLGNASGPTALFALGLGLSRLKIKEHINSDALKLAMPMLCLKLGIQPLITFLCAYYLFGMQQTDNIWLIAAIVMAAQPIGAGVYVFSNKYGFKQEVISLSIIISLLIALVTIPTILQLLPI

SEQ ID NO: 5837 - protein, 1686 aa, Xenorhabdus bovienii
  Peptide sequence Name=Xb4151_4152.C413.gene2.pep
  Homolog annotation: Query=13..624bp; Hit=33..631bp; Blast score=431; Percent Identity=39.0; E value=1e-119; Homolog= gi|16124072|ref|NP _407385.1| putative invasin [Yersinia pestis] gi|22127755|ref|NP _671178.1| hypothetical [Yersinia pestis
MLKKQRKQWTTQQRLRQVAWVNIFAQVAFPVAGVFTPAVAADKTPGHSQATRPQTLQTESYRLAAGESIKSVAKRHGLTVTELKKLNQLRTFHKPFTALGAGDEIDVPKSPSGHLLAESLTQAAAAESPAGHTENNTERWLASTVSRAAGMLKGGHVLDSAKNQLRGMAMSEANQTVQNWLQHYGTVKLQANVDDRGRLDGSQFDMLLPLYDTEKQMAFTQFGLRHIDSRTTANFGLGQRHFFDTGMLGYNAFLDHDITRDHTRFGLGAEYARDFMKFGANGYFRASGWKDGKKLKDYEERPASGFDLRAEGYVPSYPQLGGKLIYEQYFGDEVGLLSEDRRQKDPAAFTLGASYTPIPLVTLGLDRRQSTSGGGETLFNLGLNYEIGTPWSKQVDPDAVAFKRNLQGGRYDLVERNNQIVLEYRKKNLIRLMMENRINGRGGAVIPLNVNVSAQHGLKEIVWDTAGLVAGGGKLDSVNAPTRAENLAAEPVRGGTRYLLTLPPFHDKGNNTYTLSGIAYDTQGNASERMETLIQVVSSAVNPDGSGFEPAEKSMVADGKTQTVIRLKLTDKDGKPVSGVAGNLKLTDDKTTLTGDGKDPELGTEVREVPEGSGIYEITATAGTRHGKWKITPTIDGHELTPTVIDFGSSLAEMIDTDRTEFKPENGNLNQEGDSTDLVLNLKDKDGNPITGAADKITLTDDKNELYGQNPTPSLGAVREDPPGSGIYKAKVTAGQKKGTWKITPAVEGKTLKPAVIAFGQSLADVLDTQSSTVEPADGSSPLPADGVSTKTLRVVLKDKQGKPVTGAKDSIRVNAAGQLSGEGQDPQIGDVKEVSDGVYEIVVTAGQKTGHWTLTTTVDGTEMKKETVIEFDENNAPAVNNLQLNGILHINETLHARYQFKDNGGNTADRSFYVWGDKGTTAKQVMALADAAGVKEPVLAQKNGEGRVTAGAADNEKVKYVIARSDAGKVLEVSILAANGANLRAKAPVTTDIADPAANRGLTGGNGKGGVADPDAKPGIDKIVLSGDLEINQPLTAEYTFNGNGGDATDLSQFAWHDKGTPAADYQPVPDNGKNAQDKTGKVTRTLEQADAGKTVAITVKPVNGNNEVGEAKTVDIGMTDTNINQTTPKGAKPGTILDPNAIPSIKNVVLHGYRSVNSTLKATYEFEPNNGYVEDKTTYTWRRVATIGGTPEDISKQGATGTVDGQGGQIESYKLSDDDIDKFVEIVLTPKNGRSKPGTDILKNSGQNEGNELQGGNTIGQIIDPSRGPGIADLKIHGKLAVDEELTATYKFEAKGGHDQDNSLFLWGIKYPAGDPDYNKSPEFLVEQFNSDDKDHIVPPNNTNTIPGYRLKPEDSGRVIQVAIQARSKLARGKSYNRDTRQEADEGNNLEGNLDGTVKGVASDFTITPDKPEKDADGTMAVKVERDKTITLTVKTENGGQAVGGVPVTIKMTAINRQKKADTVTVNLEAKEGVLAGKEDTYRGHTDEKGHLVINVTDPNGIGTRTTLSVEVHDGANQTLTKTWDVIFTVITSPDTPLANYWGHMEDYITVNGKKYSRPPLHSEAPLHSEERDDIPDTINRELWVTPQWRVAADYCNKLGELPTSDQLMDIHNAYPNGTLYNSYGWPVNYFDNNNNNIGNFWFWSSNIVGEGYETKNIVVDINNGDVWRLETGHYFHIICRIKN

SEQ ID NO: 5838 - protein, 62 aa, Xenorhabdus bovienii
  Peptide sequence Name=Xb4151_4152.C413.gene3.pep
MRKSQKNKPAKVNILEDTSFEFEQSTGLENYLGRSVKKDVNNAGGGILRRGIYLGFTINKLA

SEQ ID NO: 5839 - protein, 234 aa, Xenorhabdus bovienii
  Peptide sequence Name=Xb4151_4152.C413.gene4.pep
  Gene classification: Gene name=XerC; Function=Integrase; Function class=L DNA replication, recombination and repair
  Homolog annotation: Query=3..197bp; Hit=9..197bp; Blast score=212; Percent Identity=54.0; E value=3e-55; Homolog= fimB COG0582
MLKRKYLTQSEIEMLLTESGKHAHAARNICMMFMGFIHGFRVSELLSLKLSDVDLDSRSLRVQRLKNGFSTIHPMVSREIQLLRQWLKGRPNYLPGTPQANSEVSDWLFLSRSGQRMSRQQVYKIIRQTSLKAKLSICANPHMLRHACGYALADNGVDTRLIQDYLGHRNIRHTVRYTASNAGRFETVWDGKGKRKQLTISTKLSTHLNRLILTVVNFFLPRKNYANLLIVNPK

SEQ ID NO: 5840 - protein, 329 aa, Xenorhabdus bovienii
  Peptide sequence Name=Xb4151_4152.C413.gene5.pep
  Gene classification: Gene name=AraC; Function=AraC-type DNA-binding domain-containing proteins; Function class=K Transcription
  Homolog annotation: Query=207..319bp; Hit=4..116bp; Blast score=82; Percent Identity=34.0; E value=5e-16; Homolog= PA4436_2 COG2207
MKQLAITALVFSHTSVTSVAMPIEILTIAANAIGGPIPHVRIISPANQEMSGTNRLLTEPTPTSHSDLYHGQQPDIILVGSLGFPVWQPQYCSPEIIEWLKAMDKKHIPIVSVCSGTFILAKAGLLKTSATIHPHFSREFKDLFPHISLYTDKKITRDNNRFCISSAYGCSKSMMSIVELIYGQYAREQCSQFLFGEHDPKVSSDSISFAPYRQHSDSLIHKLQDWMHTSPSEILSVADLANRIHLCERQMKRRFKIATGKTPIQYIQQIRLSQAKHWLEKSQKTIEEISHEVGYEDTRYFRELFKRYNGLTPKEYRQKNHHSGNFSAG

SEQ ID NO: 5841 - protein, 720 aa, Xenorhabdus bovienii
  Peptide sequence Name=Xb4151_4152.C413.gene6.pep
  Gene classification: Gene name=SunT (BS); Function=ABC-type bacteriocin/lantibiotic exporters, contain an N-terminal double -glycine peptidase domain; Function class=Q Secondary metabolites biosynthesis, transport and catabolism
  Homolog annotation: Query=14..718bp; Hit=20..718bp; Blast score=963; Percent Identity=72.0; E value=0; Homolog= VC1446 COG2274
MVDAFSFTSDTDTEDHTNNHALDCVAYLGTQFHKVASVRQLHHALGLDSLTLTDWQLREAIDAVGLHSKFDRLTADTAATLPLPALIELGQCWWVLLEVSPDQFTVLNPITEKQEIRPLHGTQATPDEAKHSEYKILLVADKSLTKQQVKFGLSWFYPSIFRQKNQLRDIFLFAIVLQLFALASPLLFENVIDKVLVGRSLSSLHVLGLAMLALAVAEPLYGFLRNTVFGHMASQINAELSGRLYRHLVGLPLPYFKQRQTGQIIARVREMAQIRQFLTGSTLMLLLDLIFIILFLGVMFHYSTLLTGIVISSLALYFLLWIAIGPLIRRKVETEYEADAHATSFLTESVMGIETIKTTATEKRFLRQWQKVLSQQLIRRFSAQKSGLAAGQGIALIQKIVAALLLWWGVRSVLNGELSPGELIAFNMLAGHVTQPILRLAQVWQDFQHTLIALRRVGDILDEPMESSKQGLAASPELAGQIEFRNIRFRYHADTPEVLANLSLTIKAGEFIGITGPSGSGKSTLTRLLQRLYVPQHGQVLVDGMDLAIADPVSLRRNMSVVLQESILFSGSIADNIRLCKPNASDEEVYRAATLAGATDFINEFPHKFAHSVGEKGSNLSGGQRQRIALARALLNDPKILILDEATSALDYESEAAIMSNLDEIRHNRTVISIAHRLNTIRHADKIFVLDQGTIVESGSHDDLLQQNGLYAQLWHQQTE

SEQ ID NO: 5842 - protein, 451 aa, Xenorhabdus bovienii
  Peptide sequence Name=Xb4151_4152.C413.gene7.pep
  Gene classification: Gene name=AcrA; Function=Membrane-fusion protein; Function class=Q Secondary metabolites biosynthesis, transport and catabolism
  Homolog annotation: Query=19..451bp; Hit=35..467bp; Blast score=530; Percent Identity=68.0; E value=1e-150; Homolog= VC1447 COG0845
MFKAILRKGIKNLRTPSPHYDFLPTHLALSQRPPSPFARYTAITLSIGVLVVLLWAYLGKLDVQATATGRLIASGRSQVIQAYEQSRLLSIHIQNGQHIEKNAPLLMLNTLGVNQDVTRLLEQREYLIEEKIRYQALLGKHDPESLPLFQQQTLSQQEKIQTHYEHEKHEFDAIITNLYAEMNVNLSSQKAKNGDIQALTNLRQNINQRLQARKILSQKQVISRVEYLEQEKELLETERVITQQKAELGILMTQYKSLEERLKGINMQKEREWFEKKKQAEMQLGVLKQELSKMQEREALEIVRSPVAGTVQQLSVHTLGAVLQPAQNLMVIVPDDHVQLAEIQILNKDVGFVRPGQHVTVKVDAFPYTRYGTIEGELLSISRDSTTDGRLGLVFPAQISLRQNNIIVDGKPVEITAGMSITAEIKTDQRRVIDYLLSPIQEYQSEALREK

SEQ ID NO: 5843 - protein, 685 aa, Xenorhabdus bovienii
  Peptide sequence Name=Xb4151_4152.C413.gene8.pep
  Gene classification: Gene name=MdlB; Function=ABC-type multidrug/protein/lipid transport system, ATPase component; Function class=Q Secondary metabolites biosynthesis, transport and catabolism
  Homolog annotation: Query=1..683bp; Hit=37..719bp; Blast score=953; Percent Identity=70.0; E value=0; Homolog= VC1448 COG1132
MISNGKPIIIPDKNINNNDDYLFTLNKLKKEHHVSIKNKRSVNKKLNTLSLPAILFDDNGHPFILAKHDEQRVLIQKPNQEAPEILDKESFIRLWSGRWIKIKQKSNQFNIRWFIPEFIRQRKNLTEILLFSFILQILALISPLVVQVVMDKVLVHQALSTLDVLIFGLVAASLIEVVLRGLREYQYAHTANRIDIKLGLKLVRHLLGLPLLFFKSRQVGAIVTRVRELETVREFLTGSMFTLCIDVLFMFVFIYVMSLLSGTLTLLFLATIPFYGLLAWWVTPKIEKAVEKQFIHAAINTSFLTETVAGAETLKSLAAEPRFIRRWDSQTENMVSTSYDVQQWDNRSSHLVMLLQKVTSAVIIWLGASEVLSLHMTIGQLIAFNMMVSHTQQPLAKLVQLWGQFIRSRIAIDKLGDMLNLPTEQQSGKERVSLQGAISFSDIVFRYQPDLSPTINRFTLDIRAGETLGVVGTSGSGKSTLARLLLRLYTPEHGTITLDGIPLQEFNIESLRQQIGIVLQENFLFNKTVHENIAQSRPDAPLSDIIEAARLAGAHDFILKLPMGYDTIIAEGGQSLSGGQRQRLAIARTLLSDPTILILDEATSALDDESQSIIQSNMADIAQGRTVITIAHRLSTVRQCDRIIVLHQGQIIEQGSHEQLLQQGKQYRKLWQLQQELKQEVTSHV

SEQ ID NO: 5844 - protein, 127 aa, Xenorhabdus bovienii
  Peptide sequence Name=Xb4151_4152.C413.gene9.pep
  Homolog annotation: Query=1..124bp; Hit=2..121bp; Blast score=155; Percent Identity=70.0; E value=2e-37; Homolog= gi|37525300|ref|NP _928644.1| hypothetical protein [Photorhabdus luminescens subsp. laumondii TTO1] gi|36784727|emb|CAE13627.1|
MDNDMSEKFVQTISSVNYNKGVFSLYFVGQEPNRMANGILAENDQELQLKQVIHMPASGFMYMVSMVKSMLEDPRMEAEMNKLIAAGFLPVPEMSEGEMPAPAEPETAVAETIEPKKRPARDTEKSK

SEQ ID NO: 5845 - protein, 153 aa, Xenorhabdus bovienii
  Peptide sequence Name=Xb4151_4152.C413.gene10.pep
  Gene classification: Gene name=HlyC; Function=ACP; Function class=O Posttranslational modification, protein turnover, chaperones
  Homolog annotation: Query=1..153bp; Hit=1..153bp; Blast score=234; Percent Identity=71.0; E value=3e-62; Homolog= VC1450 COG2994
MMITHQPATLSDTEIQAMIGGVMLLCQHSPLHRRYLVAEWQQRIFPSFQLNQFCYYEDEHQRPVAFCNWAFLSDSSRDAILSGEREISQEDWRSGQHIFFPEMIAPFGHAKSIARDLRRRVFAAWKGQKACTVRGMLDTQNDHCIRRVQWFTV

SEQ ID NO: 5846 - protein, 4716 aa, Xenorhabdus bovienii
  Peptide sequence Name=Xb4151_4152.C413.gene11.pep
  Gene classification: Function=RTX toxins and related Ca2+-binding proteins; Function class=Q Secondary metabolites biosynthesis, transport and catabolism
  Homolog annotation: Query=1..1991bp; Hit=14..1988bp; Blast score =2412; Percent Identity=64.0; E value=0; Homolog= VC1451 COG2931
MGKSSNRSAAYAFTGKYEDDNDGNTIHAIGIGGVINAYGGNDYIVVGSVGATVNTTWGNDTVVGAAGYLNINDTSGTLTVKGGSGYTSINKTSDGTIDFAGAAGGLKINHTGDKGRIDYSGASGYNGITRKGWEGDFTFKGAGGYNELWHETNQGNFYFAGVGGGNKIDRTWFDRYQGSHGDLTFNGAGAANIISSRVESGDIVFAGAGAANNLVRRGKTGNVTLTGAGASNRIERTRQTDDVYSETKGDIKFEGAGGYNSLYSDVAHGNIRFAGVGGYNHITRKGTATDFDNEGMEYAKAEDIVLKNATMSGDWIGYNVQVTGLKSARESNTYLFAFADGMYTKINKVQLRNDPETGKLIYHSTSWYKEGNHLKTLDKQDISVQGGFKDVKIDGAYTLSNLTVEHQQSVTVHAVEEKLAEDQWMNHGDGVLVDVADVTLSNAKMGGYAIDSKGSTADVQVVKSNHKSNTYIYAKRIDKYTKIVVIELRNDPKTGMLQYNAQAWFSLEDRMAKLANEDISSANGYQAVPAGIYTLSDLHYSTKAVRTASGRVSGMHEYRDLALFKSATGSGESSGDVRYTGAGGGNVIQSNVTRGNVYFDGAGIANVIEHTSEFGNTEFNGGGAANVIVKKGKEGNLTFNGVGIANVLLHQGLRGDMDVNAGGAANILVRVGDGRYLAHLLAVGNISIHKGNGNSRISMSGGFNTHTQIGHGDAFWSGVGGFNVLTQMGKGHVSSILLGGANVLSKVGEGDLESGMLGGANIITHISNDRETSNTKAIALGGANILTKKGKGDVLSVMGGGANVLTHVGDGKTTGILLGGANILTKVGNGDTTGIMLGLGNILTHVGNGQTLGVMAAAGNIFTKVGEGTTIAAMVGAGNIFTHVGQGNAWALMGGIGNIFTKVGDGDALALMLAAGNVFTHVGDGMSVALMVAKGNIATKVGHGEMLSAMIGEGNILTQIGNGDTFAAMLGKANILTKVGNGLTAALMVSEANIYTHVGDGTSIGLFVGSVNVMTKVGNGTTLAAMFGKANIMTHVGDGLTGVLALGKANIMTKVGNDFMGVVAASEANVVTHVGGGTTAALLLGKGNVLTKVGDGTTVGLLVSKIGNVMTHLGDGTTIGFAKGEANIITKSGDGLGINAAWGKANIMTHIGEGDRYNFAKGEANIITKVGDGQEITVVQGQANIVTHVGNGDDYTGAWGKANVITKVGDGRNVVLAKGDANIVTQIGNGDSFNALWSQGNVVTKVGDGMQVTAAKGKGNITTTVGNGLSVTTVHGDLNVNTKVGDGVSVNVAWGKLNVNTRVGDGLNVSVMKGQANANIRVGDGLNINASYARNNVAIQVGNGDFYSLAVAESNTESNKLSALFGNVKQTLLGVAGSQGISHLVNGDEANTSGTHKGRGAIDLPEVSALNGFQLTEVKQVTSDLQQSLKGSVTGVDTPDIGSIQNTLGNEKRLKSNQSRNLIVNGDFEQGADGWQATNGIEASYAAQAYGLSNEGHGERVSELDADTHADKDSNTSIYQDISDLTANESITLSFDFAKRAGISADNGMEVLWNGKTVFSISAGNAEWQNKTLSLTAQTGSNRLEFKGTGTNDGLGYILDNVVAKSEQPDSAIADHVQQDAAAQNALQDKEKAEADRQRLEQERDTQLAAVSGSQAQLEATDLEALNRNGQDQRDAINHEAQAITKELTEQAKGLSALDSHSKHHGKSGEQWRAQFAEGLLGQVQTQLNSADETAQQQLDRSQHAASERFGDLRDAVAKSEAGVSKGEQNQQQSQKEIEQTRTNAEFRKQQALSQKTQAEHAESNAKAAVQKAGQRGQHEVSEADSQTARVQSDAKAAKQSDNYKPNRTGAAGSGLSGSAYESNAAENQPERVKTDNPIGFAPKNETNTGFSKELQYLDEDLDELAEAKEALNRLQINATKRGKNTGATLISAYTETSVGQPVSKTADVSTEWVRNTPKISGLDLSGLQALGETHVQQGSADAPEMSATAIRAQKVADVYRWLDSDNNIATDTYIPVPGFERGDADIPENIRQKLVTFIEGYLEGTDNSVPKDQVAPLAKLFVDATIDCNWDKRVEFVSKLEQYGYSFEPVHGDKSIVSFWSGKNFKQYRSVLDAVQTDGKKVVYDIDVKGNSFAIELNKTLMRWGNVYLDSDNAEHNALQTAINTSARSNTGFWSSLYATGSRDDVYVIAEGGLRLGNYFWNVELPVLRQLQREGLVGEIRLLDKPAREYQGAAPESIGRRLTEAGVSVKARFDSLSIGEQERLLTLNPTGYKPDTLIDLDIKLSAIDNMLNQALPFYGLRTERNLLVREADDEGFEVRRWPGHDGDDFKTIIVEDAGDPAQIRAIERFILANYDDYGKLPDALYLVADQIVSHEQGRTRIVAKKADGSWNYKPKTDLMSASEFKDAAYVKGKILGDSYRNVLEAFGSYEKALQNGADYDLDVVEKLISLHQQVEGYLLGHPDSKRLPAMTNLLSQINVRMEESRVLAEPTLTSVGKGNFSELYNKLGNANLKDSKHLYIDEQGDFVTRGKSNIQIAMKAEGAEKAVEQIKAAVTREYGQEVAETVFSNLKSRDLSKDGKGIDVSGLRKVHQAIEQQLSPVSATLFVWKPSDHSQLGHAALQIGQGRFQVSAEDAEGFNEKNYVSWWPKGGKSTSPGHIFNVSTEENPDVSLRWRDLSQPASQNETLAFDVGSEEGDNFGLKDGTYKLEKFIEKLQAAKGVDAKFEDISEGFAMAALANPNLLKSAGIPEHISRPFIEQWENGNIDMQDIGRDFAEALRTAAKQKVTPELTEKRITNIIRQFAERELSDIQDFKASEADQGRVFRINLAGLDTAAMQTEWNKISQNPDARYQILNGNCSSIVAKVLKAGGADKVIGHTWRPNFGIWTPTELFNYAQKLQEAQIEIIANKPKRIVGEDLEALGQPDKKDNVLEKVAIDNDGKPPRDREPFNPVTRFLNNELYGAKEERRNVYDYTQTALDTAVTNGTADKVTLRGDAGRLTGYYHQGEQKTDASAEPNTAKKVVLFIHGSGSSAEEQASVIKNQYQKQGIDMLAVNLRGYGSSDGRPSEKGLYHDARTMFRYLVNDRGVRPENIIIHGYSMGGPIAADLARYAERNGHTVSGLLLDRPMPSMTKAITAHEVPNPAGMTGVLAKAVNGQFSVEKNLQGSSKQTPIMLLTDNEGLGEAGEKLRAKLVIDGYQVSGEHTFYSHEASSRLMNQYAEQIVTGLFDVKRQPDESTALKGLRSDLKRYGEALEPQKSAPGKTKDIRATQDFLTGYQQGHAEQTVDGFRSDMNIKQLVDLLVKGNWTAEQKGSLAWEIESRALKVTFQPQAEKHNRLFNDVVSSGVADTKASKHLAPQLLLLNLSNDGFGGRCDPLSKLVLVAKQLENNGQDGVARKLLEKMYSAAAVLSNPTLYSDTERGNANKLLGSLAALHARNPMHDTSIKVWQEKLEDKQALTVNGVIGKVTAANADGKPVLLELDAPGHAMAAWAKGSGDNRVYGFYDPNAGIVEFSSAEKFGDYLTRFFGKSGLNMEQSYKLPKNAAGEIIFKRVVVMDGSVLATYNPTRADKTTMQGILDLNIFDETPIKTHSDVEITHEVKVPLKDNLPEGVDRVVNNENVEHWEPAFVKPQAEGGDSRFNSQVIIQTENDPVAAKAAARLAGKHPDSSVIVQLDANGRYRVVYGDPATLSGKLRWQIVGHGRDESVQHHTRMSGYSADELALKLKQFRTDFKQAGSPDHISLVGCSLISDDKRDGFARHFISELDKQGIRTTVSARSSEVAVDSIGRKFTRNAEEQWVHKLMDNKIVLGWNDKGELETHAERIRRGISENDINLSRIGHIDTDAKAKGAIAENAETFHAPEQHKKVNDDASATSSAKSSNNKLSYSGNIQVQAGDGEFTVINWGTTNVGIKVGTGGFKSLAFGDNNVMVHLGNGDSKHSVNIAGYQALEGAQLFMGNRNVSFNMGRSNDLIVMMDKSIPTPPLVNPFDGASRISGVLQNIAGSFESPDWLTAQDQQWTLESAKKYVSDLSGLDLTSSVDYNTLTDLDTENEKSSRGLKSDIETTLNKKYNQWLGRNGNAREMGNVSRADKFRQENETLAFNFAVGGQGADIQVTTGNWNFMFGDNIQSILDTNLGSLFGLMTQEYTSTGMAKTTFTFSPKDLPRQLKNKLLGNLAGVSADTTLADIFGVDYTADGHIVSRSGQSVDGVAILREMLEVIGEFSGNQLQAFTDPAKLLDSLEAGLNTGADGVKSFAESHGLQAKAPEENKEGHVSISTEGKPVQEVAELPSDRALGFNLPSLFTTLFKQNKQVEMASLVADLKQNLTADLLNIQDKTFDFLRNSGHLQGDGDMHVSLGNYNFNWGGDGKDLGAYLGDNNNFWGGRGDDVYYSVGTSNIFTGGEGNDMGVLMGRENMMFGGAGNDVAVLAGRINYAYMGDGDDQVFVFGEGGVIEGGKGRDYIVASGNFNSIHAGEGQDYVVAIGNNNQVSLGEGDDFATVFGNYNNIDGNAGNNAIKLMGYHAVINGGTGDDHLIANVASKFSQLNGGDGDDLLVLGGYQNNFKGGTGVNSFVVSGDVIDNVVEDIKRGDKIIFNNLNWQKLWFQRSGYDLVLLTGRDVTDTSAQGKFEAIGSVTFNDYFNGNRADIVTQMGDKDTQGEREYTALSANSVDSLVQAMSGFAPNMGDTGFIDTLDSQTKSTIVTAWADTTSGKSKLA

SEQ ID NO: 5847 - protein, 581 aa, Xenorhabdus bovienii
  Peptide sequence Name=Xb4151_4152.C413.gene12.pep
  Gene classification: Function=Uncharacterized BCR; Function class=S Function unknown
  Homolog annotation: Query=5..549bp; Hit=4..559bp; Blast score=150; Percent Identity=26.0; E value=3e-36; Homolog= VCA0110 COG3519
MDQFERYFQRELAYLRELEKCVREEKPHLNEVLGGRDPGVEKLNEGFAALAAPISQKIDDAFPELTQPLLQRLKVQPVRGIPATAIMQLDGGEGADVAFSLPAGTKIQTVSEQSFITPRQCDVLPLTLLSREITHQTDETLIILTFQYTGKDGYWDTQPIELFLSHDESVADALLLGLCRFCGDGELYHNGQTYVMDTLRFIPHAGESRLVLSPPAAAGNWAPQMLTESLYLPHIHHFLTLDMPYPVKSRRLPMTESNVFSLTLKLNTLLPLSEAQIAESFLLHCVPVVNLQLERLSLPFIADNVRYPLPLPAHQGLLNILDITLKGEPNEQGQSRGEAGRFCPVSELTAMSRHQPEYENAWFYALEVTRDALGRLRYTLAFYDSHSRPLENPPKRQFTCYFVGFSQAPIQLAVGETCRAESLPDRFQMKNLTPVSKSYPPVIDDQRHWQLLSHYSMSSYVLVSAESFRQVLKDYNFYGETDRQTSRHLQRMIDGIQAIQSTPGDWLERGQPFRCLHVEITLDETAYASPGEMFRFANTLYQFLPFFLSHDMRMRMDVTGQPSGEQWRLFPLPLRGYRPIM

SEQ ID NO: 5848 - protein, 654 aa, Xenorhabdus bovienii
  Peptide sequence Name=Xb4151_4152.C413.gene13.pep
  Gene classification: Gene name=VgrG; Function=Uncharacterized BCR; Function class=S Function unknown
  Homolog annotation: Query=1..602bp; Hit=1..622bp; Blast score=405; Percent Identity=38.0; E value=1e-113; Homolog= VCA0018 COG3501
MDGLVFTCQIGRLPGTTFQVADFSLREALSELYHLTLTVVSALDNIVLSEQLGMSASLTITRDGVVERTINGIVAGAEQGNTDGRRTWYSFNVRPEMWRMTLNQDSRLFQRQSVPDILKQLLKEHRIRSDSKFYEDEGHHPVREYTTQKRESAYDFWCRLAAEEGITFWFEEDKLFFSNSHLGMLAGIFLTYNPQPETDNTDASAWQWRYGEFLCPDEFTHKDNNFLRPSYPLQHQAMSEPGYGHAVFESYGRFQLDAEGKPLSMLRLNQLNSESKRGTATTNCIQLRPGKIFILSHHPITAMNDRWQVVSVSHHGAQPQAAGIAGEGTTLTNEVTFIPGRDNWRPPYRYKPQADGDEVATVVGPEGEEIFVNEHGAIKVHFHWNRYDAPGDGSSCWVRVAQGWNGHGFGFMAIPRIGQEVLVSYLNGDIDRPIVTGCTYNGRNRPPLNLPAEKTRTTFRTQTHKGQGFNELRFEDAKDSEEVYIHAQKDFTGQIEHDVCWHIKHDQKQSIDHNHYMDIQGDEHSQVMGSRKYSTEGDISQRITGSQHIQAGDALVSESGQETHHKSGGKIVLEAATEITLKVGGSFLKVTQAGIQSSAINVGQGSGGSGRGVSLQLPEGIPPLQAVKFSVKKYCALQAQEQASWVIKPQGGQS

SEQ ID NO: 5849 - protein, 256 aa, Xenorhabdus bovienii
  Peptide sequence Name=Xb4151_4152.C413.gene14.pep
  Homolog annotation: Query=5..246bp; Hit=3..244bp; Blast score=240; Percent Identity=51.0; E value=2e-62; Homolog= Pa|Phot2-44g08.q1ka _g181| 129578 - 130327 1542 249 aa, chain -
MTVCWITWLHAQEKAPIFFIVNQLAIPNPVDTFYANGWVEQAFPLYNGTPLAHLMEQGPWLIQPTADSLVPLGRLLDRHALSDSSWGWAYRSDATWQAQLHHWKRHQLATLRGESVVFRLMDTRIARTLMPAMQPTDWTSLLNPVTELMLDLLVPTVFSRPADCPPSLVERPFVLEPHLIAAWEQSDLALEGYADTLTYELWEAQGALALQLDTPNGALQQRLTQWLTQRSRQGSRLQALTLRDFLADSGLDTLRA

SEQ ID NO: 5850 - protein, 512 aa, Xenorhabdus bovienii
  Peptide sequence Name=Xb4151_4152.C413.gene15.pep
  Homolog annotation: Query=123..432bp; Hit=89..410bp; Blast score=181; Percent Identity=37.0; E value=2e-44; Homolog= gi|16121180|ref|NP _404493.1| hypothetical protein [Yersinia pestis] gi|22127131|ref|NP _670554.1| hypothetical [Yersinia pes
MNNTGRLDCAPCDDIFKHWLEFQLLDLQGTPLTGIPYRLRSRDGIIDARGVTDGQGLLREENLSPLPMTLHVDGQALAEQLTEKLLTENRISTQGGTHHRIQPGDVSDALPDLPGWTRENLTASQFYPDPTFGGFQVMPSHNRRHVLEIARIVEPVFAKSCLQSAGCTDAGTDTEPHTHFGETSIFMPFSASQPQEQAQKPAQAGFFLLPQMMTQSTTSALGVGAGAAANNQKTEGTPPLLSRNEKQVLNGAWDRAFPDYQLMSTMQTVLGVMIRGIWNGSDGDLLTRDNLTKIADVKGTAPTRVRYRFVEDARTGQLNAVGYHTSKESGLDQVKVRNMSHNKELNRYEFWADENANEPTLIWYPDNPGFIAPNSTGNQQVLDLSSRPTVLPIPEDTGIQIESYPMPEERSFQDYILVFPISNIPPIYVYLSASLKGKEATDAAKKLGYDQRIPAQKAPFNSHGQTVFFNKKTKTYITPDVDGHNVNNGWKMMDKKGKRIGTYDSELNRLKD

SEQ ID NO: 5851 - protein, 147 aa, Xenorhabdus bovienii
  Peptide sequence Name=Xb4151_4152.C413.gene16.pep
  Homolog annotation: Query=1..144bp; Hit=1..144bp; Blast score=161; Percent Identity=53.0; E value=2e-39; Homolog= Pa|Phot5-379e03.q1k _g8| 5914 - 6369 205 151 aa, chain +
MFNIVTKDSAVKFFGELTLPSSIIIDDFKEEFHLPITYWSLIDYKKSWYNALKEGLHKKNHAALAVSMYDPISVNFIFIWIIYFEGEDVFLQNQTLFIEDCQNFSPSKLNDFIDPRYTETENGDRVSEWSTDINSILEFYKELENSI

SEQ ID NO: 5852 - protein, 244 aa, Xenorhabdus bovienii
  Peptide sequence Name=Xb4151_4152.C414.gene1.pep
  Gene classification: Gene name=GapA; Function=Glyceraldehyde-3 -phosphate dehydrogenase/erythrose-4-phosphate dehydrogenase; Function class=G Carbohydrate transport and metabolism
  Homolog annotation: Query=1..244bp; Hit=88..331bp; Blast score=418; Percent Identity=87.0; E value=1e-117; Homolog= gapA COG0057
VGVDVVAEATGIFLTDETARKHIAAGAKKVVLTGPSKDDTPMFVMGVNHNAYAGQEIVSNASCTTNCLAPLAKVINDKFGIVEGLMTTVHATTATQKTVDGPSAKDWRGGRGAAQNIIPSSTGAAKAVGKVIPELNGKLTGMSFRVPTPNVSVVDLTARLAKPATYKEICDAIKEASEGELKGILGYTEDDVVSTDFNGEKLTSVFDAKAGIALNDNFVKLVSWYDNETGYSNKVLDLVAHISK

SEQ ID NO: 5853 - protein, 290 aa, Xenorhabdus bovienii
  Peptide sequence Name=Xb4151_4152.C414.gene2.pep
  Gene classification: Function=Uncharacterized enzymes related to aldose 1-epimerase; Function class=G Carbohydrate transport and metabolism
  Homolog annotation: Query=1..288bp; Hit=8..300bp; Blast score=337; Percent Identity=52.0; E value=6e-93; Homolog= yeaD COG0676
MLDKIFSLPIVEQISPYISQRNIEGFPLIVLSHPKVRGAISIQGAHLITWQPSGEKPVLWLSDNTEFNTGTAIRGGIPICWPWFGSTSAPSHGFARILPWEFRAHHENENGVILTFTLQDNAETHKLWPHEFTLIARFKLGETCEIELESHGEYQTTCALHSYFNISDVNQIRVSGLGAHFIDTVADKKQYVHQDLTFKGRIDRIYTEPEDFSLLSDTPWKRTIEIHHYHHSDVVCWNPGAELSSSMKDMSKEGYKNMVCIETACINSPQLSRNNNPARLSVVIRCRKNP

SEQ ID NO: 5854 - protein, 248 aa, Xenorhabdus bovienii
  Peptide sequence Name=Xb4151_4152.C414.gene3.pep
  Gene classification: Function=Outer membrane protein V; Function class=M Cell envelope biogenesis, outer membrane
  Homolog annotation: Query=4..248bp; Hit=5..248bp; Blast score=211; Percent Identity=45.0; E value=8e-55; Homolog= yeaF COG3713
MTNKVFIAVVGLCLSSSVAYAGEWSIGLSALYEAKPYKGLKTKDKILPVPMVSYESENFYFQTLAAGYYLWNQPKDKLSVDLFYAPRAFHPKDSTDEQMKKLDRRRDTVMGGFTYKHHEDWGSLRASLAADILGESNGISADFAYLYSFKQNGWLLEPGIGIVWDSKKQNRYSYGIKKNESVRSGLAEYTPGDSWSPYLELSGYYTFDNNWTAFMMGRVEHLPSEVKNSPMTNRSYSGTIWSGITYTF

SEQ ID NO: 5855 - protein, 355 aa, Xenorhabdus bovienii
  Peptide sequence Name=Xb4151_4152.C414.gene4.pep
  Gene classification: Gene name=Alr; Function=Alanine racemase; Function class=M Cell envelope biogenesis, outer membrane
  Homolog annotation: Query=1..353bp; Hit=1..354bp; Blast score=448; Percent Identity=59.0; E value=1e-126; Homolog= ZdadX COG0787
MPRPILATIHLDAFRHNLAVIRQKVGDSKIWSVVKANAYGHGLDRIWQSLMQTDGFALLDMNEAIYLREHGWQGPILLLEGFFKLSDLQLIDQYGLTTTVHSYWQLKAIEEARLNNPIDIYLKINSGMNRLGFTPEEYSQVVSMANCIKNIKSVTLMTHFANSDNEIGIDEQFAVVECLKMDLLPRCLANSGAVLWHPKTHGDWVRPGIILYGASPSGKWRDIADVGLKPAMSLHSEIIAVHDLPKGAKIGYGSRYTTQYPTRIGTVACGYADGYPRHASTGTPILVGGVRTQLLGAISMDMMTVDLTPCPQTEIGSTVELWGENLPVDEVAESAGTIGYELLCALAIRVPVVVN

SEQ ID NO: 5856 - protein, 433 aa, Xenorhabdus bovienii
  Peptide sequence Name=Xb4151_4152.C414.gene5.pep
  Gene classification: Gene name=DadA; Function=Glycine/D-amino acid oxidases (deaminating); Function class=E Amino acid transport and metabolism
  Homolog annotation: Query=1..419bp; Hit=1..419bp; Blast score=644; Percent Identity=72.0; E value=0; Homolog= dadA COG0665
MKVLILGGGVIGVTSAWYLAQEGHEVTVVDRQDSAAEETSAGNAGQISPGYATPWGAPGIPLKAVKWMFQRHAPLAIRPDGSLFQLRWMWQMLRNCDADHYAMNKSRMVRLAEYSRDCIKQLRADTGIQYEGRQGGTLQLFRTARQFDNAANDIAVLEQEGVPYQLLTAEQLASVEPALAHVSHKLTGGLQLPNDETGDCQIFTKALAKMAEEAGVKFVFSNQVKQILVDGNKITGIRCDGGIMTADNYVVAMGSYSTNILKEFVKIPVYPLKGYSLTMPIMDEARAPTSTVLDETYKIAITRFDNRIRVGGMAEMVGFNMNVPNNRCETLKMVVQDLYHSGGNIAEAAFWTGLRPMTPDGTPIVGPTKYSNLYLNTGHGTLGWTMACGSGKLLSDLISGKTPEIAADDLSVFRYINGFNTKVLRVKHRLHTA

SEQ ID NO: 5857 - protein, 240 aa, Xenorhabdus bovienii
  Peptide sequence Name=Xb4151_4152.C414.gene6.pep
  Gene classification: Gene name=FadR; Function=Transcriptional regulators; Function class=K Transcription
  Homolog annotation: Query=1..234bp; Hit=1..234bp; Blast score=382; Percent Identity=76.0; E value=1e-106; Homolog= fadR COG2186
MVIKAQSPAGFAEEYIIESIWNNRFPPGSMLPAERELSELIGVTRTTLREVLQRLARDGWLTIQHGKPTKVNNFWETSGLNILETLARLDHDRVPQLIDNLLAVRTNIAAIFIRTAFRHNPEKSLEVLAEKESVEDTAESFSAVDYDIFRGLAFASGNPIYGLIINGLRGLYTRVGRYYFSNPDARMLALNFYQQLSTMCREQSYDKIMDCVRSYGKESGTIWHDMQSVMLNDLTEARHS

SEQ ID NO: 5858 - protein, 516 aa, Xenorhabdus bovienii
  Peptide sequence Name=Xb4151_4152.C414.gene7.pep
  Gene classification: Gene name=NhaB; Function=Na+/H+ antiporter; Function class=P Inorganic ion transport and metabolism
  Homolog annotation: Query=1..516bp; Hit=1..513bp; Blast score=632; Percent Identity=72.0; E value=0; Homolog= nhaB COG3067
MEISIRHAVVKNFLGNSPDWYKLAIIVFLIINPLVFFFVNPFVAGWMLVVEFIFTLAMALKCYPLQPGGLLAIEAVIIGMTSPKQISHEISNNLEVILLLIFMVAGIYFMKQLLLFVFTKLLLTIRSKKMLSLAFCLASAFLSAFLDALTVIAVVISVSVGFYSIYHHFLSASQNNNSDLNDDQFIDGEDKKQTLEQFRAFLRSLMMHAGIGTALGGVMTMVGEPQNLIIAKHVGWDFVTFFIRMSPVTIPVFVCGLLVCLLVEHFKLFGYGAELPVHVRSVLEDYDKKTSEKRTRQEKTQLAVQALIGIWLILALAFHLAEVGLIGLSVIILATAFCGITEEHDLGKAFEEALPFTALLTVFFSVVAVIIDQQLFTPFIQYVLQSSPASQLSLFYLFNGLLSAVSDNVFVGTVYINEALIALKNGLISQQQYEFLAVAINTGTNLPSVATPNGQAAFLFLLTSALSPLIRLSYGRMVVMALPYTIVMTLVGLLSVEFWLVPATEYLMKLGLITPL

SEQ ID NO: 5859 - protein, 130 aa, Xenorhabdus bovienii
  Peptide sequence Name=Xb4151_4152.C414.gene8.pep
  Gene classification: Gene name=DsbB; Function=Disulfide bond formation protein DsbB; Function class=O Posttranslational modification, protein turnover, chaperones
  Homolog annotation: Query=1..124bp; Hit=43..166bp; Blast score=165; Percent Identity=66.0; E value=1e-41; Homolog= dsbB COG1495
MCIYERIALFGILGAALLGAITPKTPLRWLAILLWLYSGWQGLQLAWDHTMMQLHPTPFNTCEFFVRFPSWLPLNEWLPSVFQATGDCSVKQWSFLTLDMPQWLIGIFAAYLVVGVLVLISQFFIIRGKN

SEQ ID NO: 5860 - protein, 82 aa, Xenorhabdus bovienii
  Peptide sequence Name=Xb4151_4152.C414.gene9.pep
  Homolog annotation: Query=4..79bp; Hit=24..98bp; Blast score=73; Percent Identity=53.0; E value=6e-13; Homolog= Pa|Phot5-509b06.p1k _g15| 9415 - 9714 1800 99 aa, chain -
MGWVLAGCSGQQTDHSSKRHKNYQYSDLGINLSENASMNCFDAGGILARAIQINGNQTPVCQLANGRRCDERALLDGGCTSI

SEQ ID NO: 5861 - protein, 304 aa, Xenorhabdus bovienii
  Peptide sequence Name=Xb4151_4152.C414.gene10.pep
  Gene classification: Gene name=MesJ; Function=Predicted ATPase of the PP-loop superfamily implicated in cell cycle control; Function class =D Cell division and chromosome partitioning
  Homolog annotation: Query=5..304bp; Hit=10..311bp; Blast score=535; Percent Identity=84.0; E value=1e-152; Homolog= ydaO COG0037
MNNHKNQYNFNKLQKRLRRDAGQAIADFKMIEEGDRIMVCLSGGKDSYTLLSILQNLQKSAPVNFSLVAVNLDQKQPGFPEHILPAYLEELGIEYKIVEENTYGIVKEKIPEGKTTCSLCSRLRRGILYRTATELGATKIALGHHRDDILQTVFLNMFYGGKLKGMPPKLISDDGKHIVIRPLAYCREKDIERYAEARAFPIIPCNLCGSQPNLQRQVIKDLLRDWDKRYPGRIETMFRAVQNVVPSHLSDFNLFDFKNITHGSEVIDGGDLAFDREELPSQPAVESDDQLDFQADRLDVVEIK

SEQ ID NO: 5862 - protein, 327 aa, Xenorhabdus bovienii
  Peptide sequence Name=Xb4151_4152.C414.gene11.pep
  Gene classification: Gene name=CorA; Function=Mg2+ and Co2+ transporters; Function class=P Inorganic ion transport and metabolism
  Homolog annotation: Query=1..327bp; Hit=1..327bp; Blast score=375; Percent Identity=54.0; E value=1e-104; Homolog= ydaN COG0598
VETIYGSVFKDSDAVYSCQLNGKGGIMAFGENEAATAEQPFWQHLDYKNQASQRWIMGTALLPTSVKEGLSGESIRPKVLRTGEGTMITLRTVNRNENARPDHLVSFRIYINDRMIISSRHRKVRCIDQAMDDLHNGVGAKSTGHWLVEIAGAITDEMNDFIEELHDSLIGFEDDILEQKVPGRGELVLLRKQLIVLRRYMAPQRDVFLRLASERLPWMNDEDRRLMQEIADRLGRGLDDLDGSIARTAVLADEISSMMADAMNRRIYMMSLLTMVFLPTTFLTGLFGVNLGGIPGNEYRFGFGIFCLLLFILITIFAWWLRRTKWL

SEQ ID NO: 5863 - protein, 538 aa, Xenorhabdus bovienii
  Peptide sequence Name=Xb4151_4152.C414.gene12.pep
  Gene classification: Gene name=OppA; Function=ABC-type dipeptide/oligopeptide/nickel transport systems, periplasmic components; Function class=E Amino acid transport and metabolism
  Homolog annotation: Query=2..538bp; Hit=10..544bp; Blast score=739; Percent Identity=66.0; E value=0; Homolog= mppA COG0747
MHNFKLLPSVLLMTGLSFSVSAANVPIGTQLDGRQELVRQLKDEPASLDPIKSFGLTEAQVLRDLLEGLVNQDVYGEPIPGVAIDWKTTDNQTWVFTLRQNAHWSNGDKVTASDFVYSWRRLVNPANASSFSWFAALSGIQNAQEIIDGKLPSEKLGVEAIDPYTLKVSLDRPVPYFPNMTTNFSLYPVHKQSVDKYGNDWTRVGHLVGNGAFMLTGRVVNEKIVLTPNPYYWDHKSTVLKKVTFLPINQESHATKRYLAGDLDITESFPKNRYQKLLRDIPGEVFTPDQLGTYYYAFNTQRAPTNDIRVRRALSMTIDRKLIAGKILGTNEKPAWRFTPDVTAGFQPEKSQHEVLTQQELDDQARTLLKEAGYGFGNPLKLSLLYNNLENNQRIAIAISSEWKKKLGVEVKLVNQEWKTYVDNRNTGNFDVVRASWTGDYNEPSSFLSLLTSTHSGNLAKFHNSAYDTLLKEASQETDEMARNRDYNQAEKIITEQAPIAPIYQYTNGRLIKSWLKGYPITNPEDVAYSHSMYIIKH

SEQ ID NO: 5864 - protein, 167 aa, Xenorhabdus bovienii
  Peptide sequence Name=Xb4151_4152.C414.gene13.pep
  Gene classification: Gene name=Tpx; Function=Peroxiredoxin; Function class=O Posttranslational modification, protein turnover, chaperones
  Homolog annotation: Query=1..167bp; Hit=1..167bp; Blast score=240; Percent Identity=71.0; E value=5e-64; Homolog= tpx COG2077
MTQTVKFQGSDITINGDFPQVGQTTKEFSLVAKDLADVTLSQYAGKRKVLNIFPSIDTGVCATSVRKFNQVASELNNTVVLCISADLPFAQSRFCGAEGLSNVVMLSTLRGGKFHEDYGVAISQGPLVGLTARAVVVLDENNQVIYSQLVDEITNEPDYDSALSILK

SEQ ID NO: 5865 - protein, 158 aa, Xenorhabdus bovienii
  Peptide sequence Name=Xb4151_4152.C414.gene14.pep
  Gene classification: Gene name=SPS1; Function=Serine/threonine protein kinases; Function class=T Signal transduction mechanisms
  Homolog annotation: Query=5..156bp; Hit=136..281bp; Blast score=85; Percent Identity=32.0; E value=3e-17; Homolog= DRA0335_1 COG0515
MLFPLLDAIDTLHQAGYLHCDISLDNILIQDDQLPILLDLGSARKATERLSDEKEVTISPGFTAVEQYTVNEEGQQGPWTDIYSLGAVLHTLIVGTPPPVSIVRNIEDNYLPLSKLCPAGYSSSFLHIIDRTLKIKLSERPLSITELITQIKASTIKT

SEQ ID NO: 5866 - protein, 527 aa, Xenorhabdus bovienii
  Peptide sequence Name=Xb4151_4152.C414.gene15.pep
  Gene classification: Gene name=TyrR; Function=Transcriptional regulator of aromatic amino acids metabolism; Function class=K Transcription
  Homolog annotation: Query=1..518bp; Hit=1..510bp; Blast score=657; Percent Identity=65.0; E value=0; Homolog= tyrR COG3283
MRLEVTCQDRIGLTRELLDLLVLRNIDLKGIEISPARRIYLNFTQIDFNTFRLLMAEIRRINGVIDVRTVAFMPSEKEHRAMWTLLESVPEPIFSIDMKGNIDLVNPASLVLFGLNKERIGQKNIGHLISNYNFLRWLESEHHQPHSANLVIKGQDYCMDIIPMQLTDENQSVKCVGAVIMLRSTTRVALVPSRKKFTVSDDSAFDKIVAVGPKMVHVVEQIRKIAMLDAPLLLIGDTGTGKDEFAKACHLRSSRRKQPFLGLNCASMPDDVAESELFGYAAGAYPNALEGKKGFFEQANGGTVLLDEIGEMSPQMQIKLLRFLNDGTFRRVGEDDEVKVDVRIICATQKNLVELVQKGEFREDLYYRLNVLTITLPPLRERQADIMPLADFFVTRFAEEQGLEKPKFAHELEHFLCSYHWPGNVRQLRNAIYRALTQFEGHQLRPQDIQLPELETEVAFSDDILSGSLDEISKRFERSVLIRLYRHYPSTRKLAKRLGVSHTAIANKLREYSLSGKKQMAEHEDDE

SEQ ID NO: 5867 - protein, 362 aa, Xenorhabdus bovienii
  Peptide sequence Name=Xb4151_4152.C414.gene16.pep
  Gene classification: Function=Predicted membrane protein; Function class=S Function unknown
  Homolog annotation: Query=1..344bp; Hit=1..344bp; Blast score=455; Percent Identity=68.0; E value=1e-128; Homolog= ycjF COG3768
MTDPLKPRIDFDDCLKTQSEPSLKSKKEFNGQENEFCPVAPEREAEEQKSEFEGAVNAALKPKRSFWRKVFSGAVLLLGISVVAQFIQWIYQSWQQHDWISLGVAAAGSMIVFAGIGTVISEWQRLYRLRQRTEERDIAKSLLQSHGIGKGRQFCEKLAEQAGIGQQHPALQRWQAAVHETHNDREIVMLYSKHVQPVLDVQAKKEISRSAAESALMIAVSPLAIVDMAFIAWRNIRLINRIAALYGIELGYFSRIRLFRLVLLNIAFAGASELVREVGMDWLSQDIAARLSARAAQGIGAGLLTARLGIKAMELCRPLPWIDSDKPKLGDFRHQLITQLKSTLPTKMKSAVKGTENSAVIK

SEQ ID NO: 5868 - protein, 465 aa, Xenorhabdus bovienii
  Peptide sequence Name=Xb4151_4152.C414.gene17.pep
  Gene classification: Function=Predicted ATPase; Function class=R General function prediction only
  Homolog annotation: Query=1..464bp; Hit=1..464bp; Blast score=752; Percent Identity=76.0; E value=0; Homolog= ZycjX COG3106
MKRLQNELKSLVNRGVDRHLRLAVTGLSRSGKTAFITSLVNQLLHVHSGARLPLFSAVRDGRLLGVKRVPQRDFGVPRFAYDENITALHDTPPYWPIPTQGVSEIRLALRYRSEDSLLRYLKETSTLYLEIVDYPGEWLLDLPMLEQNYLAWSRQMNGMLKGERADWAKPWLELCQQCDPLAPADENLLARIAQAYTHYLHQCKAQGLHFIQPGRFILPGDLAGAPALQFFPWLDINGIGESQLAKADKHTNIGMLRERFAYYCDHIVKGFYKEHFLRFDRQIVLVDCLQPLNSGPPAFNDMRLALAQLMQSFHYGKRTLFRRLFSPCIDKLMFAASKADHVTADQHANLISLLQQLVQEAWQNAAFEGISMDCVGLASVQATESGIVLHDGEKIPAIKGNRLSDDKLLTFFPGEVPQRLPNNDFWQKQGFNFESFRPKQVNVDTPLPHIRMDSAMEFLLGDKLT

SEQ ID NO: 5869 - protein, 120 aa, Xenorhabdus bovienii
  Peptide sequence Name=Xb4151_4152.C414.gene18.pep
  Gene classification: Gene name=PspC; Function=Putative stress -responsive transcriptional regulator; Function class=K Transcription
  Homolog annotation: Query=7..120bp; Hit=8..119bp; Blast score=132; Percent Identity=57.0; E value=7e-32; Homolog= pspC COG1983
MSNTYRRKLYRLPEQGMVKGVCAGLASYFNVPVPLMRTITVLSLFFGLFGFTVLVYIILTFVMDPAPAGYQAEDINKRPSGQKILDEVDYQLRAGEMRLRQMERYITSDTYSVRSRFRQL

SEQ ID NO: 5870 - protein, 73 aa, Xenorhabdus bovienii
  Peptide sequence Name=Xb4151_4152.C414.gene19.pep
  Homolog annotation: Query=1..73bp; Hit=1..72bp; Blast score=94; Percent Identity=72.0; E value=6e-19; Homolog= gi|37526475|ref|NP _929819.1| Phage shock protein B [Photorhabdus luminescens subsp. laumondii TTO1] gi|36785906|emb|CAE14958.1| P
MGYIFLGIPLILFVLFVLPIWLWLHYSNQSRGQLGSNEIQRLEQLAENARHMQERIKTLEEILDAEHPNWRQS

SEQ ID NO: 5871 - protein, 223 aa, Xenorhabdus bovienii
  Peptide sequence Name=Xb4151_4152.C414.gene20.pep
  Gene classification: Gene name=PspA; Function=Phage shock protein A (IM30), suppresses sigma54-dependent transcription; Function class=I Lipid metabolism
  Homolog annotation: Query=1..217bp; Hit=1..217bp; Blast score=226; Percent Identity=74.0; E value=1e-59; Homolog= pspA COG1842
MGIFSRFADIVNANISSLLDKAEDPQKMIRLMIQEMEDTLVEIRSTSARTLAEKKQLLRRIGVGENQIEGWQEKAELALSKEKEDLARAALIEKQKISNLIYALKNELSILDETLGRIKGEVTELENKLTEARARQQSLTLRHQAAASSREVRRQLDSGKIDEAMARFEQFERRIDHMEAEAEAIGLGKQKSLEQQFTELKADDEISAQLAALKAKMSVKDSQ

SEQ ID NO: 5872 - protein, 339 aa, Xenorhabdus bovienii
  Peptide sequence Name=Xb4151_4152.C414.gene21.pep
  Gene classification: Gene name=PspF; Function=Transcriptional regulators containing an AAA-type ATPase domain and a DNA-binding domain; Function class=T Signal transduction mechanisms
  Homolog annotation: Query=1..333bp; Hit=6..330bp; Blast score=453; Percent Identity=67.0; E value=1e-127; Homolog= ZpspF COG1221
MHQFIDNLLGEANCFIEILEQVSALAKLNKPVLVLGERGTGKELIARRLHYLSPRWQGSFISLNCAALNENLLDSELFGHEAGAFTGARSKHQGRFERADGGTLFLDELATAPMQVQEKLLRVIEYGYLERVGGNQSLQVDVRLICATNEDLPAMAARGKFRADLLDRLAFDVVQIPPLRQRQQDIMLLAQHFAIQMCRELNLSFFPGFTDEAKQQLLTYHWPGNIRELKNVIERSIYRHRDNEKELDTIIINPFASSQIFSSQMSIPACNHNEVMPYSLPCLPFDLRQWQNDSEKQLIIQALEESQFSQKKAAGKLNLTYHQLRGLIKKHHINIHVMD

SEQ ID NO: 5873 - protein, 571 aa, Xenorhabdus bovienii
  Peptide sequence Name=Xb4151_4152.C414.gene22.pep
  Gene classification: Gene name=OppA; Function=ABC-type dipeptide/oligopeptide/nickel transport systems, periplasmic components; Function class=E Amino acid transport and metabolism
  Homolog annotation: Query=47..559bp; Hit=29..541bp; Blast score=743; Percent Identity=70.0; E value=0; Homolog= sapA COG0747
MRYLIYWIILLLSASTLAADNAIPETTKATHQAIPDDTLDNLSYMSAALRQNGFIYCVNGNLNTFNPQMAISGLTVDTLAAQIYDRLLGVDPLTYRLIPELASRWEVRDNGATYRFYLRHNVAFQSTDWFTPTRTMNADDVVFSFRRLFDKTHYYHYVNGGDYPYFDSLQFGDSVLSIQKIDKYTVEFRLNAPDASFPWHLATHYASILSEEYGQKLHKINRQEQIDWKPVGTGPFMLEDYRAEQFIRLIRHDKYWKGKPYMEQVVIDAGAGGTGRISKLLTGECDVLAYPPANQFSVLHDNPNLHQTLRSGMNIAYLAFNTSKPPLDKLAVRQAIAYAINNQRLMKSIYYGTAETAASILPRASWAYDNSAEITEYNPEKSRKMLTELGLNGLELTLWVPTASQSYNPSPLKMAELIQADLAQVGIKMSIHPVEGRAQENQLMDKTHDMTLAGWSTDSNDPDSFFRPLLSCAAIASQTNLSHWCDSAFDDALHQALLNQQLASRIENYHIAQKILAQQLPVLPLAYPTQLQIFRYNIKGLVLSPFGNSSFAGVYRVQETTTPTGNKKGSK

SEQ ID NO: 5874 - protein, 321 aa, Xenorhabdus bovienii
  Peptide sequence Name=Xb4151_4152.C414.gene23.pep
  Gene classification: Gene name=DppB; Function=ABC-type dipeptide/oligopeptide/nickel transport systems, permease components; Function class=E Amino acid transport and metabolism
  Homolog annotation: Query=1..321bp; Hit=1..321bp; Blast score=405; Percent Identity=71.0; E value=1e-113; Homolog= sapB COG0601
MIIYILRRLLLLLVTLFFLSLISFSLMYFTPHGPLSGASLTDAYVFYLHSLLQWDFGISSINGERIIEQLYSVFPATMELCILSFSMALLIGIPLGIIAGVWRNKKADTIISTFALLGFSIPVFWLALLLTLLFSLYLGWLPVSGRFDLLYRMEQVTGSALADAWLSKEPYRNEMIVNVILHMILPVITLAVAPMTEVIRLMRNSAEEVSASNYIKSAATRGLSRLTIIRRHLLHNALPPIIPKLGLQFSTMLTLAMVTEQVFNWPGLGHWLIIAIRQQDYSAISAGVMVIGALVISVNVLTDIIGAIANPLKHKEWYALR

SEQ ID NO: 5875 - protein, 295 aa, Xenorhabdus bovienii
  Peptide sequence Name=Xb4151_4152.C414.gene24.pep
  Gene classification: Gene name=DppC; Function=ABC-type dipeptide/oligopeptide/nickel transport systems, permease components; Function class=E Amino acid transport and metabolism
  Homolog annotation: Query=1..295bp; Hit=1..296bp; Blast score=374; Percent Identity=70.0; E value=1e-104; Homolog= ZsapC COG1173
MPLDNFYREKKMPSPLKVIWRFFYADILAMTGFYGVLILIALSLLGGQIAPYQLDQQFMYQLMPPSWSHHGNVAFFLGTDDLGRDIFSRLLIGTSSTFGAALIVTAAAAIAGLAIGSLAGMTHGLRSAVLNHILETLLSIPSLLLAIIVVAFVGASLQHAMIAIWLALLPRIVRTIYTAVHDELDKEYIIAARLDGASNYRILRYAVFPNITAAIVSELTRALSIAILDIAALGFLDLGAQLPSPEWGAMLGNSLELIYSAPWTVMLPGAAITLSVLLVNLLGDGLHRAINAGVE

SEQ ID NO: 5876 - protein, 331 aa, Xenorhabdus bovienii
  Peptide sequence Name=Xb4151_4152.C414.gene25.pep
  Gene classification: Gene name=DppD; Function=ABC-type dipeptide/oligopeptide/nickel transport system, ATPase component; Function class=E Amino acid transport and metabolism
  Homolog annotation: Query=1..331bp; Hit=1..330bp; Blast score=541; Percent Identity=78.0; E value=1e-154; Homolog= sapD COG0444
MPLLDIRNLTIEFMTSEGPVKVVDRMSISLTEGEILGLAGESGSGKSLIAKAICGVTKDNLSVTADRFRFNDIDLLRLTLRQRRKVIGHNISMIFQEPQSCLDPSESIGKQLIQSIPGWTYKGRWWQRFNWRKRRAIELLHRVGIKDHYAIMHCYPYELTDGECQKVMIAIALANQPRLLIADEPTNAMEPTTQAQIFRLLSSLNQNNNMTILLISHDLQMMSKLVKRINVLYCGQTVESATPDELLVTPHHPYTQALIRSIPDFGNNPLPHKGRLNTLSGAIPSLEHLPIGCRLGPRCPYAQKTCIETPRLRGVKNHSFACHFPLNMEEQ

SEQ ID NO: 5877 - protein, 269 aa, Xenorhabdus bovienii
  Peptide sequence Name=Xb4151_4152.C414.gene26.pep
  Gene classification: Gene name=OppF; Function=ABC-type dipeptide/oligopeptide/nickel transport system, ATPase component; Function class=E Amino acid transport and metabolism
  Homolog annotation: Query=1..267bp; Hit=1..267bp; Blast score=403; Percent Identity=76.0; E value=1e-113; Homolog= sapF COG1124
LIETLLEVKNLTKTFRYRTGLFRHHHLDAVKPVSFTLQPKKTLAIIGANGSGKSTLARMLSGVIEPTSGDILINNHQLAYGDYSYRSQRIRMIFQDPSTSLNPRQRIGQILDVPLILNTELSSSEREKQINQTLRQVGLLPDHAYYYPHMLASGQKQRVALARALILQPQIIVADEALASLDMSMRSQIINLMLELQEKHGIAYIYVTQHLGMMKHISDQVLVMHQGEVVERGNTAEVLASPLHDITRKLISSHFGEPLSAEAWRQDIT

SEQ ID NO: 5878 - protein, 262 aa, Xenorhabdus bovienii
  Peptide sequence Name=Xb4151_4152.C414.gene27.pep
  Gene classification: Gene name=FabI; Function=Enoyl-[acyl-carrier -protein] reductase (NADH); Function class=I Lipid metabolism
  Homolog annotation: Query=1..262bp; Hit=1..262bp; Blast score=454; Percent Identity=87.0; E value=1e-128; Homolog= fabI COG0623
MGFMTGKRILITGVASKLSIAYGIAKAMHDQGAELAFTYQNDKLKLRVEEFAASLDSNIILPCDVAEDESIDALFAELGKVWPKFDGFVHSIGYAPAEQLDGDYVNAVNREGFKIAHDISAYSFVAMAKSCRNMLNPNSALLTLSYLGAERAIPNYNVMGLAKASLEANVRYMANAMGAEGVRVNGISAGPIRTLAASGIKDFRKMLAHCEAVTPIRRTVTTEDVGNAAAFLCSDLAGGVTGEIMHVDGGFSIAAMNELELK

SEQ ID NO: 5879 - protein, 292 aa, Xenorhabdus bovienii
  Peptide sequence Name=Xb4151_4152.C414.gene28.pep
  Gene classification: Gene name=PdxK; Function =Pyridoxal/pyridoxine/pyridoxamine kinase; Function class=H Coenzyme metabolism
  Homolog annotation: Query=1..291bp; Hit=2..287bp; Blast score=414; Percent Identity=69.0; E value=1e-116; Homolog= pdxY COG2240
MKNVLSIQSHVVFGHAGNSAAVFPMRRMGVNVWPLNTVQFSNHTQYPQWRGCVMPPEHLAEIAQGIGEIDKLVSCNAVLSGYIGSAEQGNHILDIVRQVKQANPEAWYFCDPVMGHPEKGCIVAPGIAEFLCEKALPISDIIAPNLLELETLSMRKIENVEQAISAARALCEKGPEIVLVKHLNRAGYRADRFEMLLVTKEHSWHISRPLINTGERQPVGVGDLTSGLLLVNLLKSTSLTDEALQAALEHVASAVYEVMLETQERGEYELQIIAAQDKMVIPTHQFSAAQID

SEQ ID NO: 5880 - protein, 428 aa, Xenorhabdus bovienii
  Peptide sequence Name=Xb4151_4152.C414.gene29.pep
  Gene classification: Gene name=TyrS; Function=Tyrosyl-tRNA synthetase; Function class=J Translation, ribosomal structure and biogenesis
  Homolog annotation: Query=1..428bp; Hit=1..428bp; Blast score=741; Percent Identity=83.0; E value=0; Homolog= ZtyrS COG0162
MEPLMFSNNLIKQLQDRGLVAQVTDEEALAERLAQGPVSLYCGFDPTADSLHLGHLVPLLCLKRFQLTGHKPIALVGGATGLIGDPSFKATERKLNTEETVKEWVEKIRKQVSPFLDFDCGENRAEIANNYEWFGEMDVLTFLRDIGKHFSVNQMINREAVKQRLHRDDVGISYTEFSYNLLQSYDFANLNGKYGVELQIGGSDQWGNITSGIDLTRRLHQKQVFGLTVPLITKSDGTKFGKTEGGAVWLDPKKTSPYKFYQFWISTADADAYRFLKFFTFMSIEEINALEEEDKNSGKAPRAQYVLAEQVTGMVHGEAGLAAAKRITNSLFSGIVADLTEEDLAQLAQDGMPAIELEKDADLQQALVTAGLVPSRGQARTMIGSNAVSINGEKQSDAEYTFADSDRLFERYTLLRRGKKHYCLINWK

SEQ ID NO: 5881 - protein, 217 aa, Xenorhabdus bovienii
  Peptide sequence Name=Xb4151_4152.C414.gene30.pep
  Gene classification: Gene name=PdxH; Function=Pyridoxamine phosphate oxidase; Function class=H Coenzyme metabolism
  Homolog annotation: Query=1..217bp; Hit=1..218bp; Blast score=320; Percent Identity=73.0; E value=5e-88; Homolog= pdxH COG0259
MSEHNETGIADLRREYIRGGLRRKDLTKEPIELFELWLKQACEAKLIDPTAMCIATVDEHGQPYQRIVLLKHFDARSLVFYTNLGSRKAKHLTQNNRISLHFPWYQLERQVSFLGKAERLSPTEVVKYFHSRPRDSQIAAWVSQQSSRISTRGILEGKFLELKQKFQSGEVPLPSFWGGFKVEFDSVEFWQGGAYRLHDRFLYQREGEEWHIDRLAP

SEQ ID NO: 5882 - protein, 370 aa, Xenorhabdus bovienii
  Peptide sequence Name=Xb4151_4152.C414.gene31.pep
  Gene classification: Function=Uncharacterized BCR; Function class=S Function unknown
  Homolog annotation: Query=1..369bp; Hit=1..369bp; Blast score=511; Percent Identity=69.0; E value=1e-145; Homolog= Z2654 COG2377
MKSGRYIGVMSGTSMDGVDVVLAEISDKIVAQQVSYSHPFPQELKQKLLSICQGQQTTLSMVGQFDYELGTLFSEAVKGLMNKAGLTASDITAVGCHGQTVWHEPDGEKPFTMQIGDNNRVAALTNITTVGDFRRRDMAYGGQGAPLVPAFHMAVLGHPTERRIILNIGGIANISALLPDSAVKGYDTGPGNMLMDAWIWRHKQLPYDKDAQWANEGIVNQRLLQKMISDPYFARIAPKSTGREYFNMAWLEKQLADFPDVSSVDIQATLAELTAVSIAQQVILSGGCERLLVCGGGARNPRVMSRLSDLLPITEVATTDRYGLSGDDMEALAFAWLAFRTMSGLSGNLPSVTGADRETILGAIYPVASR

SEQ ID NO: 5883 - protein, 157 aa, Xenorhabdus bovienii
  Peptide sequence Name=Xb4151_4152.C414.gene32.pep
  Gene classification: Gene name=SlyB; Function=Outer membrane lipoprotein; Function class=M Cell envelope biogenesis, outer membrane
  Homolog annotation: Query=1..156bp; Hit=1..154bp; Blast score=124; Percent Identity=58.0; E value=5e-29; Homolog= slyB COG3133
MFKRFLVGAVVVTTLSGCADMGALSSDTYSIDQAKQVQNVTYGTILSVRPVYIKGAQAGNQNMLGLIGGAVLGGLLGNTVGDGTGQRLATAAGAIAGGMAGQGIEGAINKTKGVELDIRTDSGRNIVVVQKQDQVVFSKGQRVKIADGGNSTTVSPL

SEQ ID NO: 5884 - protein, 143 aa, Xenorhabdus bovienii
  Peptide sequence Name=Xb4151_4152.C414.gene33.pep
  Gene classification: Gene name=MarR; Function=Transcriptional regulators; Function class=K Transcription
  Homolog annotation: Query=3..138bp; Hit=7..142bp; Blast score=174; Percent Identity=74.0; E value=3e-44; Homolog= slyA COG1846
LTLGSDLARLVRVWRALIDHRLKPLKLTQTHWVTLYNISQLPPEQSQIQLAKAIGIEQPSLVRTLDQLEEKQLITRHTCANDRRAKRIKLTEESETFIREVDSVIGSTRKDILEGITHDELILLASVIKKIEKNISQLHKQVI

SEQ ID NO: 5885 - protein, 135 aa, Xenorhabdus bovienii
  Peptide sequence Name=Xb4151_4152.C414.gene34.pep
  Gene classification: Gene name=GloA; Function=Lactoylglutathione lyase and related lyases; Function class=E Amino acid transport and metabolism
  Homolog annotation: Query=1..135bp; Hit=1..135bp; Blast score=215; Percent Identity=76.0; E value=1e-56; Homolog= gloA COG0346
MRLLHTMIRVGNMQRSIDFYTQVMGMRLLRTSENPEYKYSLAFVGYTDESQGAVIELTYNWDVESYEMGTAFGHIALGVDDVAATCERIKLSGGNVTREAGPVKGGTTVIAFVEDPDGYKIELIENQSGSSALGN

SEQ ID NO: 5886 - protein, 216 aa, Xenorhabdus bovienii
  Peptide sequence Name=Xb4151_4152.C414.gene35.pep
  Gene classification: Gene name=DnaQ; Function=DNA polymerase III epsilon subunit and related 3'-5' exonucleases; Function class=L DNA replication, recombination and repair
  Homolog annotation: Query=1..211bp; Hit=1..211bp; Blast score=337; Percent Identity=75.0; E value=4e-93; Homolog= Zrnt COG0847
MSNKKDQNMLSGRFRGYYPVVIDVETGGFNAQTDALLEIAAITLKMDEEGWLMPADTLHFHIDPFEGANLDPAALAFTGIDPTNPLRGAVSEYTALHAIFKMIRKGMKDNNCNRAIIVAHNASFDHNFVMAAAERSGLKRNPFHPFATFDTAALSGLVLGQTILAKACITAEIPFDSNQAHSALYDTDRTALLFCELVNRWKRLGGWPLPSPNNES

SEQ ID NO: 5887 - protein, 127 aa, Xenorhabdus bovienii
  Peptide sequence Name=Xb4151_4152.C414.gene36.pep
  Gene classification: Function=Glutaredoxin-related proteins; Function class=O Posttranslational modification, protein turnover, chaperones
  Homolog annotation: Query=13..121bp; Hit=2..110bp; Blast score=197; Percent Identity=87.0; E value=2e-51; Homolog= ydhD COG0278
MSIEKNERPVEETTTIGKIERQIKENPILLYMKGSPKLPNCGFSAQAVQALSACGERFAYVDILQNPDIRAELPKYANWPTFPQLWVDGELVGGCDILIEMYQSGELQALIKDTADKYREQAGCDSE

SEQ ID NO: 5888 - protein, 192 aa, Xenorhabdus bovienii
  Peptide sequence Name=Xb4151_4152.C414.gene37.pep
  Gene classification: Gene name=SodA; Function=Superoxide dismutase; Function class=P Inorganic ion transport and metabolism
  Homolog annotation: Query=1..192bp; Hit=1..192bp; Blast score=310; Percent Identity=79.0; E value=6e-85; Homolog= sodB COG0605
MSFELPALPYAKNALEPHISAETLEYHYGKHHNAYVVNLNNLVKDTEFAGKSLEEIIKTSEGGIFNNAAQVWNHTFYWNSLSPNGGGEPTGKVADAINSAFGSFTEFKQQFTDAALKNFGSGWTWLVKKADGSVAIVNTSNAATPLTGKDKPVLTVDVWEHAYYIDYRNARPQYLEHFWALVNWKFVEENLA

SEQ ID NO: 5889 - protein, 341 aa, Xenorhabdus bovienii
  Peptide sequence Name=Xb4151_4152.C414.gene38.pep
  Gene classification: Gene name=PurR; Function=Transcriptional regulators; Function class=K Transcription
  Homolog annotation: Query=1..341bp; Hit=1..341bp; Blast score=585; Percent Identity=80.0; E value=1e-167; Homolog= purR COG1609
MATIKDVAKRAGVSTTTVSHVINKTRFVAEDTKIAVWAAIKELNYSPSAVARSLKVNHTKSIGLLATSSEAPYFAEIIESVENSCYSKGYTLILCNSHNNLDKQKAYLAMLAQKRVDGLLVMCSEYPEQLLGMLEDYRNIPMVVMDWGESRGDFTDAIIDNAFHGGYLAGRYLIERGHRDIASIPGPLARNTGGGRHQGFLKALKEANIDIRNEWIVQGDFEPESGYQAMYQILNQKHRPTAVFCGGDVMAMGAICAADELGLRVPQDISIIGYDNIRNARYFTPALTTIHQPKERLGQMAFSMLLDRIINKRENVQTIEVHPRLVERRSVTDGPFIDYRR

SEQ ID NO: 5890 - protein, 302 aa, Xenorhabdus bovienii
  Peptide sequence Name=Xb4151_4152.C414.gene39.pep
  Gene classification: Gene name=LysR; Function=Transcriptional regulator; Function class=K Transcription
  Homolog annotation: Query=1..301bp; Hit=1..301bp; Blast score=431; Percent Identity=69.0; E value=1e-121; Homolog= ydhB COG0583
MWSEYSLEVVDAVARTGSFSAAASELHRVPSAISYTVKQLEEWLAVPLFERRHRDVELTEAGGIFVKEARSVIKKMHHTRHQCQQVANGWRGQFSIAVDQVVKPERTLQLILDFYRHFPDIELLIYPEVFNGVWDALVDGRVDVAIGATRASPVGERYSFRDMGFMPWLCVASPAHELVSIAEKLHDDQMRAYSSLCLEDTSRSLPKRDTWALDNQRRLIVPDWDIGLACLMDGLCVGMVPKHRALPLIRRGKLIALELEQPLPDSPCCLAWSQKSHSPALSWLLDYLGDSETLNAEWLQED

SEQ ID NO: 5891 - protein, 393 aa, Xenorhabdus bovienii
  Peptide sequence Name=Xb4151_4152.C414.gene40.pep
  Gene classification: Gene name=ProP; Function=77 Permeases of the major facilitator superfamily; Function class=G Carbohydrate transport and metabolism
  Homolog annotation: Query=10..386bp; Hit=7..383bp; Blast score=395; Percent Identity=58.0; E value=1e-110; Homolog= ZydhC COG0477
MTTNKNSISFMFYLAGLSMLGYLAIDMYLPAFGVMKTELNTSESAISASLSIFLGGFAFAQLLWGQLSDRLGRKPVLIIGLSLFSISCLGMLWITDSTQLLVLRFLQAVGVCSAAVCWQALVVDRYDPERTKRVFAMIMPLVALSPALAPLVGAWLLSHVGWKIIFLVLMAVTLLLLIPTFFLTNKHKAIDTDSDKKGVSFFTLLKSPIFSGNVLIYAACSAGFFAWLTGSPTILADMGYDPTDIGLSYIPQTLAFMVGGYGCRILLEKTKSETVFPFLLAGYAVSMVIIYLISQFYEPSFMAILIPFCFMAAMNGASYPIAVANALSVYPKNSGKAAALQNALQLGFCFVASLIVSVFMKNPLLSTTTVMVSTVALMAIGYWLQKQKYDKKD

SEQ ID NO: 5892 - protein, 383 aa, Xenorhabdus bovienii
  Peptide sequence Name=Xb4151_4152.C414.gene41.pep
  Gene classification: Gene name=Cfa; Function=Cyclopropane fatty acid synthase and related methyltransferases; Function class=M Cell envelope biogenesis, outer membrane
  Homolog annotation: Query=1..383bp; Hit=1..382bp; Blast score=600; Percent Identity=72.0; E value=1e-172; Homolog= Zcfa COG2230
MSSSCIEDKKIITDPWHRIASELLQEADIEINGKRPFDIHVKNPNFYKRVLKEGSLGLGESYMDGWWDCERLDVFFHKILRAGLEYRIPKNAKDILKIITARIFNLQSPKRAWVVGEEHYDLGNDLFTRMLDPHMQYSCGYWKDSNTLEEAQTSKLRLICEKLQLSSGMTLLDIGCGWGGLAAYAAKNYGVSVTGVTISAEQQKYAQERCKDMDVKVILEDYRNLNFQFDRIVSVGMFEHVGPKNYASYFNIVRKNLKPDGLFLLHTIGSNRDKLNVDSWVNKYIFPNGCLPSVAKIAKASNGKLVMEDWHNFGADYDRTLMSWYEHFTASWSEIEHNYSPRFKRMFSYYLNACAGAFRARDIQLWQIMFSPRGIENGLRVPR

SEQ ID NO: 5893 - protein, 215 aa, Xenorhabdus bovienii
  Peptide sequence Name=Xb4151_4152.C414.gene42.pep
  Gene classification: Gene name=RibC; Function=Riboflavin synthase alpha chain; Function class=H Coenzyme metabolism
  Homolog annotation: Query=1..212bp; Hit=1..212bp; Blast score=318; Percent Identity=73.0; E value=2e-87; Homolog= ZribE COG0307
MFTGIIQGKAPIVAIDEKAHFRTHIVKFPAELLPGIETGASVSHNGCCLTVTNIDSNLISFDLMKETLRLTNLGDLNVGDLVNLERAAKFGDEIGGHLMSGHVITMAEIAKIFTSENNHEIWFRIHDKQLMKYILHKGFIGIDGISLTIGDVVNNRFCVHLIPETLGRTTLGKKRLGQKVNIEIDPQTQAIVDTVERVMAQKEQEKVLSQTEEEE

SEQ ID NO: 5894 - protein, 457 aa, Xenorhabdus bovienii
  Peptide sequence Name=Xb4151_4152.C414.gene43.pep
  Gene classification: Gene name=NorM; Function=Na+-driven multidrug efflux pump; Function class=Q Secondary metabolites biosynthesis, transport and catabolism
  Homolog annotation: Query=1..456bp; Hit=1..456bp; Blast score=548; Percent Identity=65.0; E value=1e-156; Homolog= ZydhE COG0534
VQKYLNEARSLLALGIPIIIAQFSQTAMGFVDTVMAGKAGAVEMSAVAVGTSIWLPTILFGQGLLMALTPIVAHMNGSGQRKNVAVQIQQGFWLATFLSILVIAVLYNCRFIIEAQHNVDPVLAQKAINFIHAIMWGAPGYLFYQTLRGQCEGLSKTKPAMIIGIVGLLVNIPVNYIFIYGKFGAPELGGVGCGVATATVYWVMFLLLLAYVKHTPSQKDIHTFDNFTGPNWRTQKHIVLLGLPIALALFFEVTLFAVVSLLVSPLGVAAVAGHQIALNFSSMMFMFPLSFGIAATIRVGYNLGKKSTEGAKISAYTSLAVGLMIACMTAAFTTLFREPIALMYNDNYEVVTLASHLMLFAAIYQISDSVQVIGSGVLRGYKDTRSVFFITFIAYWILGLPSGYILALTHYVTEPMGPQGFWIGFIIGLTAAAVMVGLRILWLQKQPTHFVLERSAH

SEQ ID NO: 5895 - protein, 469 aa, Xenorhabdus bovienii
  Peptide sequence Name=Xb4151_4152.C414.gene44.pep
  Gene classification: Gene name=PykF; Function=Pyruvate kinase; Function class=G Carbohydrate transport and metabolism
  Homolog annotation: Query=1..469bp; Hit=1..470bp; Blast score=746; Percent Identity=83.0; E value=0; Homolog= pykF COG0469
MKKTKIVCTIGPKTESETKLTELLNAGMNVMRLNFSHGDYEEHGQRIKNLRAVTAKTGKKAAILLDTKGPEIRTIKLEGGNDVSLTAGQTFTFTTDKSVVGNQECVAVTYAGLPADLKPGNTILVDDGLIAMTVKNITETEVICEVLNNGDLGENKGVNLPNVAINLPALAEKDKQDLIFGCEQGVDFVAASFIRKRSDVLEIRDHLKAHGGEHIQIISKIENQEGLNNFDEIMEASDGIMVARGDLGVEIPVEEVIFAQKMMIEKCNAARKVVITATQMLDSMIKNPRPTRAEAGDVANAILDGTDAVMLSGESAKGKYPIEAVSIMATICERTDRIMNSRIENIKTQKLRVTEAICRGAVEIAEKLEAPLIVVATYGGKSARSIRKYFPNAPILALTTNEITARQLLLVKGVSTQIVKEIASTDDFYRIGKEAALASGIANKGDAVVMISGALVPSGTTNTSSVHVL

SEQ ID NO: 5896 - protein, 78 aa, Xenorhabdus bovienii
  Peptide sequence Name=Xb4151_4152.C414.gene45.pep
  Homolog annotation: Query=1..78bp; Hit=1..78bp; Blast score=92; Percent Identity=70.0; E value=2e-18; Homolog= gi|37526506|ref|NP _929850.1| major outer membrane lipoprotein precursor (murein -lipoprotein) [Photorhabdus luminescens subsp. lau
MNRTKVIFGAVILASTLLAGCSNATKVEQLATQVNTLGSKVDQLRNDLSAVHSDVQSAKEEAARANKRLDNQVRSYKK

SEQ ID NO: 5897 - protein, 316 aa, Xenorhabdus bovienii
  Peptide sequence Name=Xb4151_4152.C414.gene46.pep
  Gene classification: Gene name=ErfK; Function=Uncharacterized BCR; Function class=S Function unknown
  Homolog annotation: Query=8..269bp; Hit=49..312bp; Blast score=306; Percent Identity=60.0; E value=1e-83; Homolog= ycfS COG1376
DTIRARSLSDDALSLEAIAAKYQIGLLAMLEANPGVDPYLPKLGAKLIIPSQMLLPDTLRQGIIINLAEFRLYYFPKGKNYVVVYPIGIGQLERDTPTMTTSVSQLIKNPTWTPTTNIRKDYASRGIILPTVVPAGADNPMGDFALRLAAGRGEYLIHGTNANFGIGMRVSSGCIRLRPDDIENLFYSVPRGTRVQVINEPIKYTVEPTGKRYVEIHQPLSDKQADDPQTRPIQRTKGLIKFIDNRETDAVLVDQAIIRRSGIPVRVNKGIALSNQEEQEVSRPIETHEEAIHSVSPVKLPPLNQPSPIYQTEPLS

SEQ ID NO: 5898 - protein, 1229 aa, Xenorhabdus bovienii
  Peptide sequence Name=Xb4151_4152.C415.gene1.pep
  Homolog annotation: Query=10..1081bp; Hit=7..1041bp; Blast score =1192; Percent Identity=55.0; E value=0; Homolog= gi|16122366|ref|NP _405679.1| putative phage host specificity protein [Yersinia pestis] gi|22126075|ref|NP_669498.1| putative p
MTLHIIEGAKGGGGGGGGGHTPYEMPDNIQSTATAKILVALGEGEFVNDLTAKDIYLDGTPLQNDNGTINFAGVKWEFRPGTQHQNYIKGMSAAENEIRLGTEIKTAVPWTKYISNTKLSAVRVRLGWPALRMQKENGDTVGFRVDYAIELSTDGGSYQAVFDTHIDAKTTTLYERSYRINLPDAKTGWTVRVVRKTPDSTSERINDKMNIMAFTEIVDAKLRYPNTALLYVEFDARLFNGNTPLISCKPKGRIIRVPANYDPVNRTYSGIWNLTFKWAHSNNPAWVLYDILLNDLCGLGDKIDRTQIDEIELYRVAQYCDQLVPDGKGGGGMEPRFTCDVYIQSREEAHKVLTDIGAIFRGSVHWGANQFVAAADMPDDIKYIFTQASVINGDFVYSGGGERNRSTVAMVSWSNPNNHYNDEVEVVSDDNLIRRYGINQIDISAIGCTRQSEAQRRGKWAILTNSRDGMISFRVGLDGQIPMPGHIIGVAHKNRAGRTIGGRIQSVNDRNITLDRKPDVKAGDRLLVNLPTGKSEGRTVQAVNGNIVTVTTTYSESPVSGAGWAVDAHDLFIQQYRVVGIKDNNDGTFEINGLYHDPDKYDRIDTGARIDERPISIIPASVQQPPNSIRIESFSFVQQGISTTTVRIAWEKAEGAAAYVGEWRRDSGNWISIPRTASLGFEIPNAYSGRYQARIKAINSFDIPSLFISSEEVNIVGKQGNPPAPLGFRTTPIIFGIQIDWGFAPQTDDTLKTEIQYSRTNDGEGLLLLADIPYPQRMHTMQGLAAGVAFYFRARLVDKSGNQSPWTAFVRGESSSDTNWIIDAAGNQFLTAEAGKRLQEQMDYQSESILINGTAIQQNSRELLTRDGENKAEIKRLDRVFADEKTAWAQSIKEVKSSVGENRSAVQENQKSINKLDSSLAESEQRVQAQFKHQSALIDTKATTVFDHIGGSATYTVRAGIKDANGNYHSAGMVIGAQMVNGQVRTDIGFNANNFTFVNPANDKFEPFVAAKNGQLFIRDGFIEDGSITNAKIGNYIQSGNYIAGRAGWKIDKGGGAEFNHVTVRGEIHATSGTFTGTINGADGRFSGAVYATKIVGDVVSVTLGNVSLGNRDSIFFHKRLTEAMPFDRVFIYGPIMTQRYVGSLGGSGEASVSVYVNNVHVAGQNFFMESSDRGPQCISGTLFSPPITIPANTTPTIKVVLVTHGAGITYPTPGIGMLFKASSQWSNM

SEQ ID NO: 5899 - protein, 148 aa, Xenorhabdus bovienii
  Peptide sequence Name=Xb4151_4152.C415.gene2.pep
MIVKKTAKYILYFMLIILFLWWFFLSHVTFLKESDTLSEVNSGESDYYAKYYKPEPINLFGIYLTIMEKEPIFVVLYDKEDKYIGQTSPFKMMNMYSFFEGNPTLPEKNPQDILDTHFYIVVVGDFESAYDIDINHKKWWSKVLQYFH

SEQ ID NO: 5900 - protein, 279 aa, Xenorhabdus bovienii
  Peptide sequence Name=Xb4151_4152.C415.gene3.pep
  Homolog annotation: Query=184..274bp; Hit=1..91bp; Blast score=174; Percent Identity=90.0; E value=1e-42; Homolog= Pa|Phot5-387a07.q1k _g23| 27702 - 27986 118 94 aa, chain - [Photorhabdus asymbiotica]
MAIFSAKTVKGGAVTDINVDIFMLNEIPNSMEKMGWEMAPKIMRHWFERPKIEFTQEEKVRYIKEIDSIDIPKDRVNDSIVKMEWAMNFNQVKEATEELVQKWASPNGIKLLKKRLNVNSNKIGYSDSAIELDTYAQVNYKEIGSLTDTIDDYFGAIGKATLKLAVRGHADKIKTKNVFITEGLGIYLKDSYDFFNPDEFLGVWSRDGVLSKVKTAVYMGFYNDNMWRELATGEYSKHVPVYNRNFREWQKKHNKGGDFIVFSDVLWISPLPKDRVIYL

SEQ ID NO: 5901 - protein, 245 aa, Xenorhabdus bovienii
  Peptide sequence Name=Xb4151_4152.C415.gene4.pep
  Gene classification: Gene name=Hcp; Function=Hemolysin-coregulated protein (uncharacterized); Function class=R General function prediction only
  Homolog annotation: Query=1..153bp; Hit=1..153bp; Blast score=145; Percent Identity=48.0; E value=3e-35; Homolog= Z0248 COG3157
MSYLIYLSLKGKKQGLISAGCSTPESIGNRYQAGREDQIQVLSLNHMMTRDQNINHHPVSFVKPIDKSSPLLAMAIDGNELLDAVFMFYRISPMGQLERFYEVKLTSATLVDFSCHYPHSIDDNDQIPSETVLLDYKSITCSHLAAGTTGYSISQLQGREEERPLLSGFSSILPLAETITALFSHQFKLKNQQNGDNCQHIAYGVKTNKGPVEGVCQTSGVTKQFDTKQEENLNVEYLFQTKIGI

SEQ ID NO: 5902 - protein, 325 aa, Xenorhabdus bovienii
  Peptide sequence Name=Xb4151_4152.C415.gene5.pep
  Homolog annotation: Query=5..231bp; Hit=130..291bp; Blast score=129; Percent Identity=37.0; E value=5e-29; Homolog= Pa|Phot4-254a01.q1k _g20| 20305 - 21432 664 375 aa, chain -
MQDKNSETKGLDDSSLVTVTTPEYVKDSIKEAIEKHALSRNHPDATLQDKGFVILSNDVGSDSETNAATPKAIKTAYDLANTANQNANNANSNTNTRLAKDQNGADIPDKDDFVNNLGLRDTVNQAENALQKSAIVQQTGISNDLVMSQNVTTMLISERIKKEDAELLAVPIGGILMWGSDLPPPNNFLPMEGGQIDPDKYPELLKHYPSGHLPDWRGYVPRGWDKTGGVDSEVGRALGSFQADAIRDITGVIRTGGRKTDEISDNTTGAFTTIDQGRGSHVYSDAFGDNGYVYEDREFRASAVVPTSVENRMKNVAVLFLVRGR

SEQ ID NO: 5903 - protein, 243 aa, Xenorhabdus bovienii
  Peptide sequence Name=Xb4151_4152.C415.gene6.pep
  Gene classification: Gene name=DnaQ; Function=DNA polymerase III epsilon subunit and related 3'-5' exonucleases; Function class=L DNA replication, recombination and repair
  Homolog annotation: Query=23..182bp; Hit=19..176bp; Blast score=68; Percent Identity=30.0; E value=5e-12; Homolog= TP0643 COG0847
MRNRQQAQLIAEQILKEDIVILDTETTGLKSDDEIIEISIINADGNVLLDTLIKPQKKIPPDATRIHRITNEDVQHKPLWSDVYKKYREIVEGKTVVIYNKSYDTKIIRQTCKKYELPTPRIKSECAMLLYAKYEGIINKRTCEYKWHKLTDAIYKNNIQVTGEAHRALTDARMTLELLKFMACAEVNVSPRVHMNDSVHYKKNKPSNSIQPTKKKSNFQKIILKFFVVVIFFLMLNMIWPLF

SEQ ID NO: 5904 - protein, 61 aa, Xenorhabdus bovienii
  Peptide sequence Name=Xb4151_4152.C415.gene7.pep
  Homolog annotation: Query=2..61bp; Hit=3..62bp; Blast score=67; Percent Identity=53.0; E value=8e-11; Homolog= gi|223238|prf||0611193A protein P,replicatory
MEKILLSEYVKKNGQVKAASLVGVHQTAISKALRAGRKIFLIRQEDGSYKAEECRPFPSQK

SEQ ID NO: 5905 - protein, 59 aa, Xenorhabdus bovienii
  Peptide sequence Name=Xb4151_4152.C415.gene8.pep
MITKDRRGQWMGFSIAMFILTIATVFAFKGEMLFAGTLITIDLVGLAAVFAIGRKSNIK

SEQ ID NO: 5906 - protein, 91 aa, Xenorhabdus bovienii; identical to SEQ ID NO: 5467
  Peptide sequence Name=Xb4151_4152.C415.gene9.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 5907 - protein, 96 aa, Xenorhabdus bovienii; identical to SEQ ID NO: 5468
  Peptide sequence Name=Xb4151_4152.C415.gene10.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 5908 - protein, 215 aa, Xenorhabdus bovienii
  Peptide sequence Name=Xb4151_4152.C415.gene11.pep
  Gene classification: Gene name=PlsC; Function=1-acyl-sn-glycerol-3 -phosphate acyltransferase; Function class=I Lipid metabolism
  Homolog annotation: Query=3..199bp; Hit=1..197bp; Blast score=223; Percent Identity=56.0; E value=9e-59; Homolog= aas_1 COG0204
MDMLIKFIRLVVRVLFRVTVEGDDKQFNHPKCIITPNHISFLDGLLIGLFLPVKPVFAVYSHLATPAFLRLIKPYADVVPLDPNNPMAVRTLVKEVDNGRPIVIFPEGRITITGSFMKIYDGAAFVAAKSGAKVVPIRIDGAEQSIFGRLKEIMKLHWFPKITIKVLPAVDFPMPDAPDSSTRRRLAGEHLHTIMMDVRMQTRPKETLFGHVLND

SEQ ID NO: 5909 - protein, 174 aa, Xenorhabdus bovienii
  Peptide sequence Name=Xb4151_4152.C415.gene12.pep
  Gene classification: Gene name=AroK; Function=Shikimate kinase; Function class=E Amino acid transport and metabolism
  Homolog annotation: Query=1..164bp; Hit=1..164bp; Blast score=160; Percent Identity=47.0; E value=8e-40; Homolog= aroL COG0703
MKQTLFIVGARGAGKTTIGKLLAEALSYTFIDTDESIQAFCGMTIADLVEQYGWTHFRELESQILKNASQNKCVISTGGGMILSSENRQYMQQNGIVVYLQAPAEVLIKRLSLNPENTQRPSLTGKSITEEIESILTEREQLYRECANFIVDANSSTENISSLINGYILNQKIG

SEQ ID NO: 5910 - protein, 417 aa, Xenorhabdus bovienii
  Peptide sequence Name=Xb4151_4152.C415.gene13.pep
  Gene classification: Gene name=ProA; Function=Gamma-glutamyl phosphate reductase; Function class=E Amino acid transport and metabolism
  Homolog annotation: Query=1..416bp; Hit=1..416bp; Blast score=581; Percent Identity=71.0; E value=1e-166; Homolog= ZproA COG0014
MLEQMGKAAKAASWQLAQLSTSQKNQALSHIADLLEKETEVILAANQQDMEQAREQNMSEALLDRLLLTPGRLSAIANDVRQVCRLADPVGQILDGQSLDNGLQLSRRRVPLGVIGVIYEARPNVTIDVASLCLKTGNAVILRGGKETHHTNQVMVKVIQQALEQSGLPATAVQAIGKPDRELVAELLKMNSYVDMLIPRGGAGLHKLCREQSTIPVITGGIGVCHTFVDESVDVEKALDVITNAKVQRPSACNSLETLLIHEQIASDFLPALSARMKEQGVTLHAGVSAMALLKEGPAKVVEVIEEDYCDEWLSLDMNVEIVSGIDQAISHIRTYGTAHSDAILTESLQQADYFVSHVDSSAVYVNASTRFTDGGQFGLGAEVAVSTQKLHSRGPMGLDALTTYKWIGYGDYLSRR

SEQ ID NO: 5911 - protein, 367 aa, Xenorhabdus bovienii
  Peptide sequence Name=Xb4151_4152.C415.gene14.pep
  Gene classification: Gene name=ProB; Function=Glutamate 5-kinase; Function class=E Amino acid transport and metabolism
  Homolog annotation: Query=1..365bp; Hit=1..365bp; Blast score=577; Percent Identity=82.0; E value=1e-165; Homolog= proB COG0263
MNGSQTLVVKLGTSVLTGGSRRLNRAHIVELVRQCAQQHEKGHRIIIVTSGAIAAGREHLGYPDLPATIASKQLLAAVGQSRLIQLWEQLFSIYGIHVGQMLLTRADLEDRERFLNARDTLQALLDNHIIPIINENDAVATAEIKVGDNDNLSALAAILGSADKLLLLTDIEGLYTADPRNNPEAKLIPEVHDISDELKMMAGDSVSGLGTGGMATKLQAAGIAGRAGVDVIIAAGNRPEVVADVIEGKSVGTRFHGQACPMENRKRWIFGAPPAGEIIVDHGAEAAILEKGSSLLPKGIKNVKGNFSRGEVIRVRSLSGKELARGVCRYNSDALRLIAGHHSQQISQILGYEYGAVAVHRDDMIVS

SEQ ID NO: 5912 - protein, 133 aa, Xenorhabdus bovienii
  Peptide sequence Name=Xb4151_4152.C415.gene15.pep
  Homolog annotation: Query=1..123bp; Hit=1..123bp; Blast score=145; Percent Identity=53.0; E value=2e-34; Homolog= gi|24111730|ref|NP _706240.1| curlin genes transcriptional activatory protein [Shigella flexneri 2a str. 301] gi|30061857|ref|N
MALPVSYSRNKLLKSFSALGPYIRELKCQNGYFFFDCLAVCVSAKVVPEKREFWGWWLELEEDEKGFVYNYQIGLFDKNGEWKSMGIKKIADLEHLESTLQAFHKRLTDSFDTFKLTLIPSKNTIALQTQIMA

SEQ ID NO: 5913 - protein, 415 aa, Xenorhabdus bovienii
  Peptide sequence Name=Xb4151_4152.C415.gene16.pep
  Gene classification: Function=Hydrolases of the alpha/beta superfamily; Function class=R General function prediction only
  Homolog annotation: Query=1..411bp; Hit=1..410bp; Blast score=483; Percent Identity=55.0; E value=1e-136; Homolog= ZyafA COG1073
MTKQNLSESLFKPQLKQQETSTLVKYIRPQSTAASGRMLGGERREHWYRMIDWLAWIWRGINPLEIQDVLSRIAVIDAERSDDHLLDTVIGYRKGNWAFEWTQQAMYWQREALRAEQTSEAGTYWLKAAMLYSIAAYPHLRGDELAEQAAVLASKSYENAAHSSDYELKKLEFKLEGGKSVTGLLHLPPNVQEPCPTILVCTSLDNVQSDFWRLFRDHLAPLGFAMLTVDMPAVGYSAKFKLTQDTCILHQQVLQQLNQIPWIDHTRVGVMGFRFGANIAVRLAYLEPQLIKGVAVIGPIVHTLLNDEKRQQNIPSMYIDVLANRLGIYHVDEAALRLELSCYSLKNQGLLGRRCSVPMLSVYWKDDVFSPREDSKLIAMSSMDGSLLAIPSTPVYSGFNKALHETSVWLKGKAT

SEQ ID NO: 5914 - protein, 153 aa, Xenorhabdus bovienii
  Peptide sequence Name=Xb4151_4152.C415.gene17.pep
  Gene classification: Gene name=Apt; Function=Adenine/guanine phosphoribosyltransferases and related PRPP-binding proteins; Function class=F Nucleotide transport and metabolism
  Homolog annotation: Query=1..152bp; Hit=1..152bp; Blast score=281; Percent Identity=88.0; E value=1e-76; Homolog= gpt COG0503
MSEKYVVTWDMLQMHARKLAQRLLPVEQWKGIIAVSRGGLVPGALLARELGIRHVDTVCISSYDHDNQRELTVVKKAEGDGEGFIVVDDLVDTGGTAQAIRNMYPKAHFVTIFAKPAGRPLVDDYVIDIPQDTWIEQPWDMGVMFIPPICNKP

SEQ ID NO: 5915 - protein, 486 aa, Xenorhabdus bovienii
  Peptide sequence Name=Xb4151_4152.C415.gene18.pep
  Gene classification: Gene name=PepD; Function=Di- and tripeptidases; Function class=E Amino acid transport and metabolism
  Homolog annotation: Query=1..485bp; Hit=1..485bp; Blast score=739; Percent Identity=72.0; E value=0; Homolog= ZpepD COG2195
VSALSTLSPQPLWDIFAQICSIPHPSHHEEALAFHIIEWAKSKNFHVERDEAGNILLRKPATKGMENRQSVVLQAHLDMVPQKNNDTQHDFTKDPIRTYIDGDWVTAEGTTLGADNGIGMASALAVLADESVKHGPLEVLLTMTEESGMDGAFGLRSGWLQADVLINTDSEEEGEIYMGCAGGINFVSTLLLSRETLPTGYQTLQLTIKGLKGGHSGGDIHLGLGNANKLLARFLAAHSDELNLKLIDFQGGTLRNAIPREGSTVIAIPTTQLEKLHQLKDDYLDTLRNEYAVVEANLIVLLDEIETSSQALTTDCQTRFLSMLNTIPNGVIRMSDVAEGVVETSLNVGVVTMEEDKVEIICLIRSLIDSGKAYVVDMLNSLAKLADAETATSGNYPGWQPDANSPVMHLVRETYQQLFDKIPNIMVIHAGLECGLFKKPYPDMDMVSIGPTIRGAHSPDEKVHIKSVGQYWQLLTAILKAIPVKE

SEQ ID NO: 5916 - protein, 370 aa, Xenorhabdus bovienii
  Peptide sequence Name=Xb4151_4152.C415.gene19.pep
  Gene classification: Gene name=DinP; Function =Nucleotidyltransferase/DNA polymerase involved in DNA repair; Function class=L DNA replication, recombination and repair
  Homolog annotation: Query=20..368bp; Hit=1..349bp; Blast score=532; Percent Identity=72.0; E value=1e-151; Homolog= dinP COG0389
MKLYIYTVILVWKEACRGEMRKIIHIDMDCFFAAIEMRDNPSLRDIPIAVGGSADRRGVISTANYPARLFGVRSAMSTAMALKLCPQLKVIPGRMASYKEVSQHIRQIFSRYTELIEPLSLDEAYLDVTDCQHCHGSATLIAQQIRQVIFDELQLTASAGVAPIRFLAKIASDINKPNGQYVISPEQVEVFVKSLPLRKIPGVGKVTSKRLSDMGLETCADVQNYDKVALIKKLGKFGLALWERSHGIDDRQISPDRLRKSVGVEKTLAQDIHEWRDCVELIEKLYPELEKRLGKVKPDLRIARQGIKLKFDDFQLTTQEHIHPLLDKSDLIQVAKQAWEIRREGRGVRLVGLHVTLQNPQLERQLLLEW

SEQ ID NO: 5917 - protein, 396 aa, Xenorhabdus bovienii
  Peptide sequence Name=Xb4151_4152.C415.gene20.pep
  Gene classification: Gene name=AraJ; Function=Arabinose efflux permease; Function class=G Carbohydrate transport and metabolism
  Homolog annotation: Query=11..391bp; Hit=1..381bp; Blast score=173; Percent Identity=33.0; E value=3e-43; Homolog= mlr2770 COG2814
MSITNIMPSKIPISVYLLGLSLFAMGSSEFLIAGVLPKIAEDLQVSLPSAGMLISAFAVGVLFGAPSLAVATLRWPRRATLLLSQALFVAATAIGMLSPDYWPLLIARVVSGIAYAGFWAVAATTAVNLVTQDRTARALAVVVSGLSLAMVVGGPLGTVISDIAGWRAGFWAVAAATSVTAIALWFMLPEIQPGQGEAPVLDTELKTMAQPKLWVAYTTTMLTTAAYMATFGYLGALLIDISKLAVVWVPAVLALFGIGAFIGLTIGGRTADKYPFKTLMIGTLGIIVSSIALTFLAENVITTCLVFLLGVSGFVVNPAVMNRVYTIAANAPTLAGATNVSAFQLGITLAPLLAGFAIGAGYGLSSVAGVGALLAIIALVPILIDARLHHKNCHND

SEQ ID NO: 5918 - protein, 128 aa, Xenorhabdus bovienii
  Peptide sequence Name=Xb4151_4152.C415.gene21.pep
  Homolog annotation: Query=64..126bp; Hit=536..598bp; Blast score=64; Percent Identity=52.0; E value=4e-10; Homolog= gi|22964644|ref|ZP _00012250.1| COG0318: Acyl-CoA synthetases (AMP-forming)/AMP-acid ligases II [Rhodopseudomonas palustris]
MRIREYFERLLHDTPDNANAIEYEHNWWTWGKSRTTVTLNALQPVTRLIEDIQRLDIKILIGSKWGELVKATVVLVPKATVEAAELINWTKERIGTVFAPKAIDFVNSIPTTENGKHDKSVLRTSHSR

SEQ ID NO: 5919 - protein, 680 aa, Xenorhabdus bovienii
  Peptide sequence Name=Xb4151_4152.C415.gene22.pep
  Gene classification: Gene name=BetT; Function=Choline-glycine betaine transporter; Function class=M Cell envelope biogenesis, outer membrane
  Homolog annotation: Query=5..678bp; Hit=3..676bp; Blast score=1028; Percent Identity=77.0; E value=0; Homolog= betT COG1292
MNTPDSPKNTQKDTLNSVVFFTSAGLIIVFSLFTIFFTDATSIWIKNTLDWVSKTFGWYYLLAATLYIVFVIFVAASRFGSIKLGPEQSKPEFSLLSWAAMLFAAGIGIDLMFFSVAEPVTQYMRPPTGEGETIEAARQAMVWTLFHYGLTGWSMYALMGIALGYFSYRYNLPLTIRSALYPIFGNRIKGSIGHAVDIAAVIGTIFGIATTLGIGVVQLNYGLKVLFGLPQGLGVQGGLILLSVVMAIVSVTSGVNKGIRFLSELNVLLALGLILFILFVGNTEFLLNGLVQNVGDYISRFMGMTLNSFAFERPTEWMNNWTLFFWAWWVAWSPFVGLFLARISRGRTIRQFVMGTLIIPFVFTLLWLSIFGNSVLYEILHGNRQLAETVLEHPEQGFYGLLALYPAFTFSASVATITGLLFYVTSADSGSLVLGNFTSNLSDINNDAPNWLRVFWSVAIGVLTLGILMTDGISALQNMTVIMGLPFSFVIFFVMAGLYKSLRVEDFRKASSLQNTSPTLVHDNGSLNWKQRLSRMMNFPGTKSTQRMLDMVCRPAMQEVAKELELRGAKVQFNTLPSEGDERLSPLELIVELGDEQNFVYQVWPRRYSVPGFTYRARSGKSYYYRLETFLMEGTQGNDLMDYTKEQIISDILDHYEKHLNFIHLNREAPGQTLIFPNGG

SEQ ID NO: 5920 - protein, 198 aa, Xenorhabdus bovienii
  Peptide sequence Name=Xb4151_4152.C415.gene23.pep
  Gene classification: Gene name=AcrR; Function=Transcriptional regulator; Function class=K Transcription
  Homolog annotation: Query=1..194bp; Hit=1..194bp; Blast score=239; Percent Identity=65.0; E value=2e-63; Homolog= ZbetI COG1309
MPKIGMQSIRKQQLIDATLAVVNEVGMQDASIAQIARKAGVSNGIISHYFKDKNGLLEATMRYLLHQLGMAVARRLRLLDNATPAQRLKAIVEGNFDASQISSAAMKTWLAFWASSIHQPNLYRLQQVNERRLYSNICIEFRHVLPKAEARLAAQGLAALIDGIWLRSALSSKPFDIKSAFTITFDYIEQKLGTPYTA

SEQ ID NO: 5921 - protein, 492 aa, Xenorhabdus bovienii
  Peptide sequence Name=Xb4151_4152.C415.gene24.pep
  Gene classification: Gene name=PutA; Function=NAD-dependent aldehyde dehydrogenases; Function class=C Energy production and conversion
  Homolog annotation: Query=1..492bp; Hit=1..490bp; Blast score=768; Percent Identity=76.0; E value=0; Homolog= PA5373 COG1012
MTRFGLQKLYIHGTYVNSVNPDKNTFDAINPANGEVIAQLQSATEQDVELAVKSAQKGQKIWAAMTAVERSRILLKAVDILRERNDVLAELETLDTGKPLSETQYVDIVTGADVLEYYAGLIHSLEGQQIPLRESSFVYTRREPLGVVAGIGAWNYPIQIALWKSAPALAAGNAMIFKPSEVTSLTALKLAEIYTEAGVPDGVFNVLTGAGHEVGHTLTVHPEIAKMSFTGGIVTGKKVMANASGSNLKEVTMELGGKSPLIIFDDADLDRAADIAMMANFFSSGQVCTNGTRVFVPKTLAPQFEAKIVERVKRIRIGSPLDPNTNFGPLVSFPHMESVLRYIESGKSSHARLLCGGERLLEGELAKGAFVAPTVFSDCTDDMLIVQEEIFGPVMCILTYETEDEVINRANNTDYGLAAGLVTQNLSRAHRVIHQLEAGICWINTWGESQAAMPVGGYKHSGIGRENGLVTLQNYTQTKSIQVELGHFESLF

SEQ ID NO: 5922 - protein, 563 aa, Xenorhabdus bovienii
  Peptide sequence Name=Xb4151_4152.C415.gene25.pep
  Gene classification: Gene name=BetA; Function=Choline dehydrogenase and related flavoproteins; Function class=N Cell motility and secretion
  Homolog annotation: Query=3..553bp; Hit=5..555bp; Blast score=935; Percent Identity=79.0; E value=0; Homolog= PA5372 COG2303
MVFDYIIIGAGSAGNVLATRLTEDSDVTVLLLEAGGPDYRFDFRTQMPAALAYPLQGTRYNWAYETDPEPHMNNRRMECGRGKGLGGSSLINGMCYIRGNALDFDNWATLSGLEDWAYLDCLPYFRKAETRDMGANDYHGDDGPVSVTTPKPVNNELFHVMIEAGIQAGYPRTDDLNGYQQEGFGPMDRTVTPEGRRASTARGYLDQARSRSNLTIITHALTDTLEFEGKMAVGVNFYQGNTSTLTQAKARKEVLLCAGAIASPQILQRSGIGPEEILNEFGIPVVQILAGVGQNLQDHLEMYLQYECLKPVSLYPALKWYNQPKIGAEWLFKGTGIGASNQFEAGGFIRTSEKFTWPNIQFHFLPVAINYNGSNAVNEHGFQAHVGSMRSPSRGRVKITSRDPRQHPSILFNYMSTAQDWQEFRDAIRITREIMAQPALASYCGREISPGTDIQTDEQLNTFIRERAETAFHPSCSCKMGTDEMAVVDGQGRVHGVKNLRVIDASIMPEIITGNLNATTIMIAEKIADKIRGRNPLPRSQAKYYVANGAPARKSAQNTPSVN

SEQ ID NO: 5923 - protein, 145 aa, Xenorhabdus bovienii
  Peptide sequence Name=Xb4151_4152.C415.gene26.pep
  Gene classification: Gene name=WecD; Function=Histone acetyltransferase HPA2 and related acetyltransferases; Function class=K Transcription
  Homolog annotation: Query=13..140bp; Hit=11..138bp; Blast score=78; Percent Identity=41.0; E value=2e-15; Homolog= TM1720 COG0454
MEIKYSVGRENPELIQPAFAIRKQVFTDEQGFDAEIDIDEYDDIALHVLIFDGEKPIGVLRAVPMDNNMLKVGRVAVLKAYRGKGIGRKVMEFIEDYGRKNGIVGIGLSSQCHAQPFYESLGYQARGEIYLEEGAEHIFMTLDLA

SEQ ID NO: 5924 - protein, 56 aa, Xenorhabdus bovienii
  Peptide sequence Name=Xb4151_4152.C415.gene27.pep
MPISRLMILSIVSKVTAIKQKKVNSAIQYPVSKNKLILKGDLKKGCPYFSSVINLT

SEQ ID NO: 5925 - protein, 173 aa, Xenorhabdus bovienii
  Peptide sequence Name=Xb4151_4152.C415.gene28.pep
MKKKILSSLILAGLVALLAGCDDGSPKVEDSARQAEESATQMKNDAEQKTTGIVDSAKEKSQEVKESAIREGHSLVDKSKEVQNQISHSANHLADQMKSKAADVKNEVTKSVNDTLDKVKTKTDDIQHQATDKVNQFKDDVKSKAEEIKSDANKQADDFINSFKSDGNKTEES

SEQ ID NO: 5926 - protein, 771 aa, Xenorhabdus bovienii
  Peptide sequence Name=Xb4151_4152.C415.gene29.pep
  Gene classification: Gene name=CirA; Function=Outer membrane receptor proteins, mostly Fe transport; Function class=P Inorganic ion transport and metabolism
  Homolog annotation: Query=48..771bp; Hit=26..744bp; Blast score=731; Percent Identity=50.0; E value=0; Homolog= HI0113 COG1629
MANNSQNLGKRPIMAIIRKILRSTFSGTLVLGSALSSQVLAAENPSDQKSEKQNEVVKLPSLSVVGSLHNSTSAGSSSLKKTDIERTQADNVAQLLDQLPGVSMSGSPRPGGQTLNIWGMGESEDIKITLDDAPKGFEKYLQGSIFIEPELIKRIDVDKGPHNLLNGNGGFGGSVKIVTKDAGDLLRPDENFGGLLKYSYHTNDRQNIYSGAIYGRDPDGFADALLYASKRDGGNIKRPDGTHFEYSQNNQTSYLLKTNFYLNDTHTLSFSAMRSESDGWQPWAAKRDKMNVPSEWDIERYGWEGAWQRKLVFRNQIDQNYTAKWNIAPEENPWLNLTLTSAYSVTKQNDRRPEGKDVTLTSASLMGQKSWVKYIDTMVDINNKSVFSTGSIEHEFLLGTRWHKNDRDTLIFDKNTVNNSEFNYGYYQPYYMPAGEQQTYSIYMQDSLKLGSITITPGVRYDHIKNIGEENKAPRYNNKLPEINHDYSGVTYTGWSPHLGILWQTNKNLSLFADISRTWRAPVVDEQYEVQSDRTSLPGSSRNLEVEKMTGIRLGAILDFDNLMLENDSLQIRTTLFRNRGKDEIFKTRGVYCKAQADGASSTSCEKPIANHRNLPGYTIEGLEIETFYDSNKLFGKLSFSTMRGQRDASMRDPWIGQKTWIAEIPPTSAHAMLGFKIPQWQMSMGWKGDFIRKQDRSPVDGDPKASYWSLPTSKGYALHGLFASWRPPYMKGFEARVTVDNLFNRDYYPYLGETISGIGRNFKFSISQQF

SEQ ID NO: 5927 - protein, 96 aa, Xenorhabdus bovienii; identical to SEQ ID NO: 5468
  Peptide sequence Name=Xb4151_4152.C415.gene30.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 5928 - protein, 91 aa, Xenorhabdus bovienii; identical to SEQ ID NO: 5467
  Peptide sequence Name=Xb4151_4152.C415.gene31.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 5929 - protein, 170 aa, Xenorhabdus bovienii
  Peptide sequence Name=Xb4151_4152.C415.gene32.pep
  Homolog annotation: Query=53..170bp; Hit=1..118bp; Blast score=197; Percent Identity=84.0; E value=5e-50; Homolog= gi|37526335|ref|NP _929679.1| hypothetical protein [Photorhabdus luminescens subsp. laumondii TTO1] gi|36785766|emb|CAE14814.1
MRLTVLKQYARGVSKNAPELGAELLDSLTSTKWYLWHGNAIKALEHLDDCAAMCDEDILHYGNNKSLLKHIDEMYTYIENNSMMIPNYGEMYRYGEAISSSFVESTINEVIAKRMVKKQQMQWSQQGAHYLLQTRTAVLNGDLKTQFEHWYPGIKLGDKTDHYWTEAVAA

SEQ ID NO: 5930 - protein, 108 aa, Xenorhabdus bovienii
  Peptide sequence Name=Xb4151_4152.C415.gene33.pep
MYKGNMEKLMIESGFTPKDIKFLESINKKNGTNLMDNIIDLDKRFYKLIFIVPLIFFGFAFLFLIADDVNVVGFIISTIITIPPILFMLSFRMSYRASIFMKKYKRKE

SEQ ID NO: 5931 - protein, 266 aa, Xenorhabdus bovienii
  Peptide sequence Name=Xb4151_4152.C415.gene34.pep
  Homolog annotation: Query=18..255bp; Hit=9..245bp; Blast score=102; Percent Identity=32.0; E value=8e-21; Homolog= gi|37524038|ref|NP _927382.1| hypothetical protein [Photorhabdus luminescens subsp. laumondii TTO1] gi|36783461|emb|CAE12301.1
MDIYANRENDYFATMGMLTARSVTESALSVSIFLNNFRIKAYFKSEIKKFTDNNLNIILSKSSTKASKMQAIQDLKKEKLYLSQQENIIRNNILEKYAVIEIKKELDFFTYVLKGFGIVAGGAQIITGAAMVTATSQTVVGYVAGSALIVNGMSNIEENLNSLLKKDPDYKGYLRRGYEHAFLFMGSDKKTANLVYGGVDIALSGYGAFRNVLKPDSWRLFNYVKDDYVTSYKLMSGYALTFEVVADGVTLKSTYDSYNDPQNNSK

SEQ ID NO: 5932 - protein, 159 aa, Xenorhabdus bovienii
  Peptide sequence Name=Xb4151_4152.C415.gene35.pep
  Gene classification: Gene name=Hcp; Function=Hemolysin-coregulated protein (uncharacterized); Function class=R General function prediction only
  Homolog annotation: Query=1..159bp; Hit=1..159bp; Blast score=182; Percent Identity=57.0; E value=9e-47; Homolog= Z0248 COG3157
MANIIYLTINGKKQGLISSGCSSENSIGNLCQNGHENKIYIYELNHSLSREQNVNHFPITIKKPIDKSTPLLGMAISDNEELECIFDIYRTDNSGGLVLFFTIKVTNATISNIDIICPHSLTHNDAQPQESISLKYKSITWQHHTAGTSGYSIWDDRIY

SEQ ID NO: 5933 - protein, 91 aa, Xenorhabdus bovienii; identical to SEQ ID NO: 5467
  Peptide sequence Name=Xb4151_4152.C415.gene36.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 5934 - protein, 96 aa, Xenorhabdus bovienii; identical to SEQ ID NO: 5468
  Peptide sequence Name=Xb4151_4152.C415.gene37.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 5935 - protein, 291 aa, Xenorhabdus bovienii
  Peptide sequence Name=Xb4151_4152.C416.gene1.pep
  Gene classification: Gene name=MurI; Function=Glutamate racemase; Function class=M Cell envelope biogenesis, outer membrane
  Homolog annotation: Query=1..290bp; Hit=1..286bp; Blast score=364; Percent Identity=65.0; E value=1e-101; Homolog= murI COG0796
MRQRMAIAPQAENTFSLEATTSDLPKTARPTILIFDSGVGGLSVYQEIRQLLPELHYIYAFDNEAFPYGEKTAEVIIERVVQVVDEIQKRHPLAIVIIACNTASTVSLPALRERFSFPVVGVVPAIKPAAKLTCNRVIGLLATRATVNRDYTKELIARFATDCQVHSIGSAELVELAERKLHGEKIPLEILEKILKPWLRMKEPPDTVILGCTHFPLIAEELSQVFPDGTRLIDSGAAIARRTVWLVKNQNSLFLTTADNLAYCTKIDLNSEALRPVLRDYGFLTLEKLAT

SEQ ID NO: 5936 - protein, 616 aa, Xenorhabdus bovienii
  Peptide sequence Name=Xb4151_4152.C416.gene2.pep
  Gene classification: Gene name=CirA; Function=Outer membrane receptor proteins, mostly Fe transport; Function class=P Inorganic ion transport and metabolism
  Homolog annotation: Query=5..616bp; Hit=4..614bp; Blast score=690; Percent Identity=57.0; E value=0; Homolog= ZbtuB COG1629
MTNNKRILLSAASVAVFSSWSHFAVADNQEPLVVTANRFKQPVSSVLAPMTVVTREEIDRWQSSSLVDVLRRLPSIDIAQNGGIGQHASLFVRGTESHHTLVLIDGIRLNQAGITGAADYSQIPLSMVQRIEYIRGARSAVYGSDAIGGVINIITKREQKGTTLNAGIGSHGYQNYNGSTQQKLGENTLLTAAAGYTYTKGFDVVAGGGTGGYRQPDRDGFMSKMLWLGVDHKFNDQFSGFARVHGLNNRTAYDAYYDSYNQMLIDTRELFSRTYDAGLQFTQGIYSAQWITSYSHVKDYNYDPKYGRYGKGSSLSNSKQYNVQWGNSWQVSHGAISGGVDWKRESVAAGSNNIPVQKDVDNTGLYLTSQQKIHDVTLEGAVRSDRHSEYNWNTTWQTGMGWEFIDGYRLIVSYGTAFKAPTLNQLYSKWGNESLKPEKSKQWEGGIEGLTGALNWRLSVYHNDIEQLINFANNRYENIGKAKIKGVEWTGTMDTGIFQHQLTLQYVDPRDGNNKQLARRAKQQVKYQLDWELYNIDWGVTYQYIGQRDDADYSVYPPKPLKLGGVSLWDISASYPITNHLTIRARIANLFDKNYETAYGYRTPGREYFLTGSYNF

SEQ ID NO: 5937 - protein, 366 aa, Xenorhabdus bovienii
  Peptide sequence Name=Xb4151_4152.C416.gene3.pep
  Gene classification: Gene name=TrmA; Function=SAM-dependent methyltransferases related to tRNA (uracil-5-)-methyltransferase; Function class=J Translation, ribosomal structure and biogenesis
  Homolog annotation: Query=5..362bp; Hit=6..363bp; Blast score=582; Percent Identity=78.0; E value=1e-166; Homolog= ZtrmA COG2265
MQNVLPTEDYENQLMEKVHRLKGMMMPFSAPEPEVFRSPASHYRMRAEFRIWHEQDDLYHIMFDQQTKQRIRIDQFPVANELINQMMQSIIAGVKDNSLLRHKLFQVDYLSTLSNKIIVSLLYHKKLNDEWREHAITLRDQLKANGFDVQLIGRASKTKIILDHDYIDEELPIAGKTMIYRQVENSFTQPNASINTHMLEWAVGITKGAKGDLLELYCGNGNFSLALAQNFDRVLATEIAKPSVAAAQFNIEANQIDNVQIIRMSAEEFTQAMNGEREFNRLHGIDLKSYQCETIFVDPPRSGLDDATVKMVQGYSQILYISCNPETLSQNLETLTQTHKISRLALFDQFPYTHHMECGVLLEKRI

SEQ ID NO: 5938 - protein, 125 aa, Xenorhabdus bovienii
  Peptide sequence Name=Xb4151_4152.C416.gene4.pep
  Homolog annotation: Query=1..119bp; Hit=8..126bp; Blast score=159; Percent Identity=75.0; E value=6e-39; Homolog= Pa|Phot2-60c06.p1ka _g4| 3904 - 4296 1034 130 aa, chain -
MEQYRQDKSTMLLALIVGLATHGTFSAFFNSLVPFSIFPIIALVLSLYCLHHRYLNYPMADGLPKLVAGCFFLGIFIYSAIIRVEYPEIGSNFLPVVIDAALVFWIYRKIKGRKQQAILTSESHG

SEQ ID NO: 5939 - protein, 216 aa, Xenorhabdus bovienii
  Peptide sequence Name=Xb4151_4152.C416.gene5.pep
  Gene classification: Gene name=AcrR; Function=Transcriptional regulator; Function class=K Transcription
  Homolog annotation: Query=5..212bp; Hit=19..226bp; Blast score=325; Percent Identity=90.0; E value=2e-89; Homolog= yijC COG1309
VVSNVTGVRAKQKEKTRRSLIEAAFSQLSAERSFTSLSLREVAREAGIAPTSFYRHFRDVDELGLTMVDESGLMLRQLMRQARQRIAKGGSVIRTSVSTFMEFIGNNPNAFRLLLRERSGTSAEFRAAVAREIQHFIAELADYLEQASHMPRHFTEIQAEAMVTIVFSAGAEALDIDEEKRRRLEERLVLQLRLISKGAYYWYRREQEKKTVPKTS

SEQ ID NO: 5940 - protein, 65 aa, Xenorhabdus bovienii
  Peptide sequence Name=Xb4151_4152.C416.gene6.pep
  Gene classification: Gene name=Lpd; Function=Dihydrolipoamide dehydrogenase/glutathione oxidoreductase and related enzymes; Function class=C Energy production and conversion
  Homolog annotation: Query=2..49bp; Hit=3..50bp; Blast score=84; Percent Identity=79.0; E value=2e-17; Homolog= VC0151 COG1249
MQYTHFDAIVIGSGPGGEGAAMGLVKQEKNVAVIERYNSVGGGCTHWGTNSIESSPPCCQSYYRI

SEQ ID NO: 5941 - protein, 427 aa, Xenorhabdus bovienii
  Peptide sequence Name=Xb4151_4152.C416.gene7.pep
  Gene classification: Gene name=Lpd; Function=Dihydrolipoamide dehydrogenase/glutathione oxidoreductase and related enzymes; Function class=C Energy production and conversion
  Homolog annotation: Query=12..427bp; Hit=29..444bp; Blast score=716; Percent Identity=81.0; E value=0; Homolog= udhA COG1249
VSVVAVPIGVPIPSKALRHAVSRIIEFNQNPLYSDNSRILRSSFSEILRHADVVISQQTKMRQGFYERNRCQMFAGEAAFIDEHRVSVRYADGSVDILSADKIIIATGSRPYCPPDVDFTHSRIYNSDTILQLDHEPRHVIIYGAGVIGCEYASIFRGLGVKVDLINTRDHLLSFLDQEMSDALSYHFWNSGTVIRHNEEYEKIEGLDDGVIVHLKSGKKVKADCLLYANGRTGNTDKLGLENVGLETDSRGLLKVNRVYQSSNENIYAVGDVIGYPSLASAAYDQGRIAAKAIMTGSANLHLVEDIPTGIYTIPEISSIGKTEQQLTAMKIPYEVGRAQFKHLARAQIAGMNVGSIKILFHRETKQILGIHCFGERAAEIIHIGQAIMEQKGEGNTIEYFVNTTFNYPTMAEAYRVAALNGLNRLF

SEQ ID NO: 5942 - protein, 305 aa, Xenorhabdus bovienii
  Peptide sequence Name=Xb4151_4152.C416.gene8.pep
  Gene classification: Gene name=LysR; Function=Transcriptional regulator; Function class=K Transcription
  Homolog annotation: Query=1..298bp; Hit=1..298bp; Blast score=496; Percent Identity=85.0; E value=1e-140; Homolog= oxyR COG0583
MNIRDLEYLVALAEYRHFRRAADSCHVSQPTLSGQIRKLEDELGVMLLERTSRKVLFTQQGMLLVEQAKTVLREVKVLQEMAYLQGESMSGPLHIGLIPTVGPYILPLIIPELHKLFPKLEMYLHEAQTQNLLAQLDSGKLDCVILALVKETEAFIEVPLFEEPMKLAIYEGHRWANRTHIKMEELAGEKLLMLEDGHCLRDQAMGFCFQAGAKEDTHFRATSLETLRNMVSAGSGITLLPDLAVPKEKKRDGVCYLECIEPEPKRTIILVYRPGSPLRSRYEQLAEAIRAKMGDYFEVFGKTLK

SEQ ID NO: 5943 - protein, 459 aa, Xenorhabdus bovienii
  Peptide sequence Name=Xb4151_4152.C416.gene9.pep
  Gene classification: Gene name=ArgH; Function=Argininosuccinate lyase; Function class=E Amino acid transport and metabolism
  Homolog annotation: Query=1..456bp; Hit=1..456bp; Blast score=751; Percent Identity=84.0; E value=0; Homolog= argH COG0165
MALWGGRFSQEADQRFKQFNDSLRFDYRLAEQDIIGSVAWSKALVTVGVLVSEEQQKLELALNELLGEVRANPKAILKSDVEDIHSWVEGQLIAKVGDLGKKLHTGRSRNDQVATDLKLWCKDQIADIQQALVELQQALVITAENNQDAVMPGYTHLQRAQPVTFAHWCLAYAEMLDRDESRLQDALKRLDVSPLGCGALAGTAYDIDREQLASWLGFASATRNSLDSVSDRDHVLELLSDASISMIHLSRFAEDLIFFNSGEAGFIELSDRVTSGSSLMPQKKNPDALELIRGKCGRVQGALTGMMITLKGLPLAYNKDMQEDKEGLFDALDTWRDCLHMAVLVLDGIQVKRGRCEEAAKQGYANATELADYLVVKGVPFREAHHIVGEVVIAAIAEGKALEELSLFELQKFSEAISLDVYDVLSLQSCLDKRLAKGGVSQQQVAQAIAAVKQRLTID

SEQ ID NO: 5944 - protein, 403 aa, Xenorhabdus bovienii
  Peptide sequence Name=Xb4151_4152.C416.gene10.pep
  Gene classification: Gene name=ArgG; Function=Argininosuccinate synthase; Function class=E Amino acid transport and metabolism
  Homolog annotation: Query=3..403bp; Hit=4..403bp; Blast score=605; Percent Identity=70.0; E value=1e-173; Homolog= BU050 COG0137
MTKSIKKIVLAYSGGLDTSAIIPWLKEHYDNCEVVAFVADVGQSREDLEGVEQKALRSGASECHVIDLREEFIKEYVYPVLKTGALYEGSYLLGTSMARPIIAKAQVELALKVGADSVAHGATGKGNDQVRFESTYTALAPHLKVVAPWREWDLRSREALLDYLKVRDIPTTATLEKIYSRDENAWHISTEGGVLESTWNAANKDCWVWTAEPEDAQNEPEYVTVTVEKGEVVGVNGKGLSPYQCLNALNELGAKHGIGRIDIVENRLVGMKSRGCYETPGGTIMMAALRGIEQLVLDRDSFKWRQQLGLEMSYVVYDGRWFAPLRQSIQAAAETLADSVSGAVVLKLYKGQVTAEQKKSTYSLYSEEFATFGEDEVYDHRHAEGFIRLYSLSSRIRTLNSKK

SEQ ID NO: 5945 - protein, 257 aa, Xenorhabdus bovienii
  Peptide sequence Name=Xb4151_4152.C416.gene11.pep
  Gene classification: Gene name=ArgB; Function=Acetylglutamate kinase; Function class=E Amino acid transport and metabolism
  Homolog annotation: Query=1..257bp; Hit=2..258bp; Blast score=339; Percent Identity=71.0; E value=2e-93; Homolog= argB COG0548
MEPLVIKLGGVLLDSEEALARLFSTLQSYRKTHKRPLVIVHGGGCLVDELMQRLQLPIVKIQGLRVTPADQINIVTGTLAGTANKALLACAIKYRLPAIGLCLGDGGVVQVSQFDEEFGHTGKAHPGKPDLLKILLDVGYMPIISSIGITENGELMNVNADQAATAIAQVLNADLVFLSDVSGILDGKGQKIPELTAEKIEQLIEHGIITDGMIVKVNAALEAAKTLKHPVDIASWRHTEQLIALFNGIPTGTRISA

SEQ ID NO: 5946 - protein, 334 aa, Xenorhabdus bovienii
  Peptide sequence Name=Xb4151_4152.C416.gene12.pep
  Gene classification: Gene name=ArgC; Function=Acetylglutamate semialdehyde dehydrogenase; Function class=E Amino acid transport and metabolism
  Homolog annotation: Query=1..334bp; Hit=1..334bp; Blast score=496; Percent Identity=71.0; E value=1e-140; Homolog= argC COG0002
MLNTLIVGASGYTGAELAAYLQRHLHVHLSGLMVSSQSSDAGKCFSDLYPQYKGIVDLPLQPLTDVAEAVNGIDVVFLATAHEISHDIVPIFLQAGCTVFDLSGAYRVQNTQFYSKYYGFEHKNTAWLDKAVYGLAEWQAEKIKTAQLIAVPGCYPTVSQLSLKPLLEKNLLDTEQWPVINAVSGVSGAGRKATINNSFCEVSLQPYGIFNHRHQPEIATHLGTEVIFIPHLGNFSRGILATITCKLKSGVTEKQIREAYQLAYHDKPLVRLYTEGMPALKAVVGLPFCDIGFAVQGQHLIIVGAEDNLLKGAAAQAVQCMNIRFGFAETQALL

SEQ ID NO: 5947 - protein, 385 aa, Xenorhabdus bovienii
  Peptide sequence Name=Xb4151_4152.C416.gene13.pep
  Gene classification: Gene name=ArgE; Function=Acetylornithine deacetylase/Succinyl-diaminopimelate desuccinylase and related deacylases; Function class=E Amino acid transport and metabolism
  Homolog annotation: Query=4..381bp; Hit=4..381bp; Blast score=597; Percent Identity=74.0; E value=1e-171; Homolog= argE COG0624
VNIKLPSFIRLYHQLIATPSISATDAELDQSNEILINLLAGWLKDLGFNIEIQPVPETRGKFNMLATLGSGSGGLLLCGHTDTVPFDEGRWTQDPFTLSERDGKLYGLGTADMKGFFAFIIDALRDVDPSKLTHPLYILATADEETSMAGARYFAANTAIRPDFAIIGEPTSLQPIHAHKGHLAHVIRIEGKSGHSSDPARGVNALELMHESITQLMELRTTLQERYHNPAFVIPHPTMNFGHIHGGDAANRICACCELHMDIRPLPGLTVQDMDELLHKALEPVKQRWPGRLSVTPLHPPIPGYQCLTDHKLVGVIENLLGAKAETVNYCTEAPFIQELCPTLVLGPGSIEQAHQPDEFLGMEFIEPTRKLISQLIEHFCLQTH

SEQ ID NO: 5948 - protein, 295 aa, Xenorhabdus bovienii
  Peptide sequence Name=Xb4151_4152.C416.gene14.pep
  Gene classification: Gene name=MetF; Function=5,10 -methylenetetrahydrofolate reductase; Function class=E Amino acid transport and metabolism
  Homolog annotation: Query=1..294bp; Hit=1..294bp; Blast score=522; Percent Identity=83.0; E value=1e-148; Homolog= metF COG0685
MSFFHANQREALNQNLAELEGQIRVSFEFFPPSTTAMEQTLWNSIERLSKLKPKFVSVTYGANSGERNRTHSIIKGIKDKTGLDAAPHLTCIDANREELRNIAHDYWESGIRHIVALRGDLPESNGKPEMYGADLVELLKKEADFDISVAAYPEVHPEAKSAQSDLINLKRKIDAGANRAITQFFFDVESYLRFRDRCVATGIDVEIVPGILPVSNFRQLQRFATMTNVRIPSWMTRMFEGLDDDPESRNLVGASIAMDMVKILSREGVKDFHFYTLNRAELSYAICHTLGVRPC

SEQ ID NO: 5949 - protein, 49 aa, Xenorhabdus bovienii
  Peptide sequence Name=Xb4151_4152.C416.gene15.pep
LQDSEAIWEYLVTKNPVAAVKMDELFETAAERLIEFPYMGHAGEISGTL

SEQ ID NO: 5950 - protein, 878 aa, Xenorhabdus bovienii
  Peptide sequence Name=Xb4151_4152.C416.gene16.pep
  Gene classification: Gene name=Ppc; Function=Phosphoenolpyruvate carboxylase; Function class=C Energy production and conversion
  Homolog annotation: Query=1..878bp; Hit=1..883bp; Blast score=1343; Percent Identity=76.0; E value=0; Homolog= ppc COG2352
MNQQYSAMRSNVSMLGKLLGNTIKEALGESILDKVETIRKLSKSSRAGNEADRQQLLSTLQNLSNDELLPVARAFNQFLNLANVAEQYHSISPHGEAASNPVALEALFNRLKDKKFSNDDLINAVNELAIELVLTAHPTEIARRTLIHKLVEVNACLSQLDHDDLADYERINIMRRLRQLIAQSWHTDEIRKIRPTPIDEAKWGFAVVENSLWEGVPAFLREFNEQLEESIGYSLPVEAVPIRFTSWMGGDRDGNPNVTAEITRHVLLLSRWKAADLFLKDIQVLVSELSMSECTPELRQLAGGDGVLEPYREIAKQLRTQLNSTLTYLEKHLKGERVLPPVGLLLHNEQLWQPLYACYQSLKTCGMEIIANGQLLDTLRRIRCFGLSLVRIDIRQESTRHTDAIAELTQYLELGDYASWSETEKQTFLLRELNSKRPLIPHCWQPSEETLEVFETCKVIAESPQDAIAAYVISMAKVPSDVLAVKLLLKEAGCSLKLPVAPLFETLDDLNNAESVIQQLLGIGWYRELIQDKQMVMIGYSDSAKDAGVMAASWAQYRAQDALIKVCEQESVTLTLFHGRGGTIGRGGAPAHSALLSQPPGSLKGGLRVTEQGEMIRFKFGLPQVTISSLALYASAILEANLLPPPEPKPEWKQVMDTLSDVSCDMYRDYVREQPEFVPYFRAATPEQELAKLPLGSRPAKRRPTGGVESLRAIPWIFAWTQNRLMLPAWLGAGAALQHVIDAGKLSVLADMCRDWPFFNTRIAMLEMVFAKADLWLAEYYDQRLVDKKLWPLGITLRNQLAEDIKTVLTISQDEQLMADLPWIAESIALRNVYTDPLNVLQAELLQRSRQQEQPDPHLEQALMVTIAGVAAGMRNTG

SEQ ID NO: 5951 - protein, 812 aa, Xenorhabdus bovienii
  Peptide sequence Name=Xb4151_4152.C416.gene17.pep
  Gene classification: Gene name=LysC; Function=Aspartokinases; Function class=E Amino acid transport and metabolism
  Homolog annotation: Query=1..449bp; Hit=1..448bp; Blast score=672; Percent Identity=75.0; E value=0; Homolog= ZmetL_1 COG0527
MSALATAGAEFGRQLHKFGGSSLADVKCYQRVAEIMANYSQPGDLMVVSAAGSTTNQLIDWLKLSQSDRISAHQVQQSLRRYQQELIRGLLPEVIAEELVAHFISDLEKLSVLLDKPITDITYAEVVGHGEIWSARLMAAVLEHKGISSAWLDARQFLRAERAAQPQVDVNLSQPLLSQLLIQNPSKRLVVTGFISRNQKGETVLLGRNGSDYSATQVGALAGAKKVTIWSDVAGVYSADPRKVKDACLLPLLRLDEASELARLAAPVLHTRTLQPVSVSDIDLQLRCSYQPEQGSTRIERVLATGTGAKIVTSHDDVCLIELHISSAHDFKQIYKDIDSLLKRAQIRPLATGLHADCNLIQLCYTSEVVNSALDVLQDASLPGKLSLREGLALVALVGAGVCKNPLHSHRFYQQLKDQPIEFIWHAEEGISLVAVLRLSQTSHLIQGLHQSLFRAEKRIGLVLFGKGNIGSRWLELFAREQKNISARSGFEFILAGIVDSRRSLLNYQGLDASRALAFFGDEATQHEDDALFLWMRAHPYDDLVVLDVTASEELAKDYIDFASYGFHVISANKIAGSSNSNTYRMVRDAFAKTGRHWLYNATVGAGLPINHSVRDLRESGDTILSISGIFSGTLSWLFLQFDGSVPFSDLVEQAWQQGLTEPDPRIDLSGQDVMRKLIILAREAGYEIEPDQVRVESLVPVEARTGSIEDFFENSAVINEQMLQRLEASQEMGMVLRYVARFDATSGKAKVGVEAVRADHPLASLLPGDNVFAIESRWYRDNPLVIRGPGAGRDVTAGAIQSDLNRLSQLL

SEQ ID NO: 5952 - protein, 386 aa, Xenorhabdus bovienii
  Peptide sequence Name=Xb4151_4152.C416.gene18.pep
  Gene classification: Gene name=MetC; Function=Cystathionine beta -lyases/cystathionine gamma-synthases; Function class=E Amino acid transport and metabolism
  Homolog annotation: Query=4..383bp; Hit=4..383bp; Blast score=605; Percent Identity=77.0; E value=1e-173; Homolog= metB COG0626
MGCKQATVAVQSGANIDEQYGCVVPPIYLSSTYNFTGFNEPRAHDYSRRGNPSRDVVQQVLAELEGGAGAVMTSSGMSAIHLLCTVFLQPGDLLVAPHDCYGGSYRLFDSLSKRGAYNVIFVDQSDNQALKQALAQKPKLVLIETPSNPLLRIVDIQYICGLAHKVGALAVVDNTFLSPVLQKPLDLGADLVVHSCTKYLNGHSDLIAGAIIAKDPVIAENLAWWANNIGITGAAFDSYLLLRGIRTLSARVMLQQNNAAAIAEYLQQQPQVKKLYYPALKNHPGHEIALKQQTGFGAMLSFELDGDEQTLRHFLSALKLFTLAESLGGVESLISHTATMTHAGMAAEARAQAGITDSLLRVSVGIEDSQDLIADLDKAFQAAATR

SEQ ID NO: 5953 - protein, 105 aa, Xenorhabdus bovienii
  Peptide sequence Name=Xb4151_4152.C416.gene19.pep
  Gene classification: Gene name=MetJ; Function=Transcriptional regulator of met regulon; Function class=E Amino acid transport and metabolism
  Homolog annotation: Query=1..105bp; Hit=1..105bp; Blast score=191; Percent Identity=92.0; E value=1e-49; Homolog= metJ COG3060
MAEWNGEYVSPYAEHGKKSEQVKKITVSIPLKVLKILTDERTRRQVNNLRHATNSELLCEAFLHAFTGQPLPNDDDLRKERHDEIPEAAKDIMRELGIDPETWEY

SEQ ID NO: 5954 - protein, 71 aa, Xenorhabdus bovienii
  Peptide sequence Name=Xb4151_4152.C416.gene20.pep
  Gene classification: Gene name=RpmE; Function=Ribosomal protein L31; Function class=J Translation, ribosomal structure and biogenesis
  Homolog annotation: Query=1..69bp; Hit=1..69bp; Blast score=117; Percent Identity=81.0; E value=2e-27; Homolog= rpmE COG0254
MRKGIHPKYEAITASCSCGNVITINSTVNHNLNLDVCGECHPFYTGKQRDVATGGRVDRFNKRFSVPGSSK

SEQ ID NO: 5955 - protein, 732 aa, Xenorhabdus bovienii
  Peptide sequence Name=Xb4151_4152.C416.gene21.pep
  Gene classification: Gene name=PriA; Function=Primosomal protein N' (replication factor Y) - superfamily II helicase; Function class=L DNA replication, recombination and repair
  Homolog annotation: Query=1..732bp; Hit=1..732bp; Blast score=1028; Percent Identity=68.0; E value=0; Homolog= priA COG1198
MTVVQVALPVPLTRSFDYLLPEGLPLPMTGVRVLVPFGKRNAIGIVTGTAGNSQIPLEQLKPLAAILDAQPLFPDDLWQLLQWSACYYHYPLGEVLFHAMPVLLRQGKPAEFTPLWQWQVTEAGHEFPLEQLKRSVKQQQALASLRLKPIYRHQISELEFSESALQSLKKKALIDLHPIQPEAENWHEQFQIIGERLQLNTEQATAVGTVRAEDQIFSPWLLAGITGSGKTEVYLSVLENILAQGKQALILVPEIGLTPQTIRRFRERFNAPVDVLHSALNDSERLSVWLRAKRGDNAIVIGTRSALFTPFAHLGVIIIDEEHDSSYKQQEGWRYHARDLAVFRAKKENIPIMMGTATPALETLFNVQQGKYRQLTLTQRAGEAKPAVQHLLDLKGLPLTVGLSQPLINRIGEHLKADNQVILFLNRRGYSPALLCHECGWIAECQRCDHYYTLHQSHRHLRCHHCDSQRPIPRQCPQCGTTHLIPVGLGTEQLEDGITKLFPDIPVTRIDRDTTSRKGALEQQLAAVHQGGARILIGTQMLAKGHHFPDVTLVVLLDVDGALFSADFRAAERFAQLYTQVSGRAGRAGKRGEVVLQTHHPEHPLLQVLLEKGYDAFARQAMEERQQVFLPPFASHILLRSEDHDNQQAPAFLQQMRQLFEHHALRDEHLWIMGPVPALQAKRGGHFRWQLLIQHPSRIFLQKMMAAIYPQITALPQARKVKWNIDVDPTEG

SEQ ID NO: 5956 - protein, 341 aa, Xenorhabdus bovienii
  Peptide sequence Name=Xb4151_4152.C416.gene22.pep
  Gene classification: Gene name=PurR; Function=Transcriptional regulators; Function class=K Transcription
  Homolog annotation: Query=3..336bp; Hit=4..337bp; Blast score=479; Percent Identity=68.0; E value=1e-135; Homolog= cytR COG1609
MEKKNGTLATMKDVANVAGVSTATVSRTLMNPDKVSARTRQKVESAVLEVGYYPHNLAKNLRRNESRAILVIVPNISDPFFTEVIRGIEETAAEHGYLVLIGDCKHQQQQEHAFINLLITKRIDGMVLLGSNIPFDVSKEEQKNLPPMVMANEFAPDLELPTVHIDNLTSAFNATYHLQKLGHKRIACITGPETMPLCHYRLQGYIQALHRTGEAIREDYIVRGDFTHESGAELAEILLNLPEPPSAIFCHSDIMAIGAMWQAKKMGLKLPEDLSVIGFDNLNLAQYSEPPLTTVAQPCYEIGYYSILLLLEQLQGRMVSKGSRLLDAELLIRASTCSPKS

SEQ ID NO: 5957 - protein, 262 aa, Xenorhabdus bovienii
  Peptide sequence Name=Xb4151_4152.C416.gene23.pep
  Gene classification: Gene name=FtsN; Function=Cell division protein; Function class=D Cell division and chromosome partitioning
  Homolog annotation: Query=1..262bp; Hit=1..319bp; Blast score=141; Percent Identity=36.0; E value=7e-34; Homolog= ZftsN COG3087
VAQRDYVSRGRSNPRQKGTGKKKNQAQGLPKTTLAVAVALVVMFIGGLYFIAHTKNDSAQNTPPPAHHAKNQGLPPKPEERWTYIKELENRPVGLPSTQEPTSANQPTNQPAKLTQEQLQLLAQMEADIRQPPTPLKEVPYNSEPVPRSQVIITLPEQKPFVAQEKTPPAQSLAPNETNKSPKPAINESKLMLQCGSFRTTEQAESVRASLAFAGIESQITTKDNWNRVVVGPYKNKESAEKMRSHVTDAGVPGCILRPSGG

SEQ ID NO: 5958 - protein, 176 aa, Xenorhabdus bovienii
  Peptide sequence Name=Xb4151_4152.C416.gene24.pep
  Gene classification: Gene name=HslV; Function=Proteasome protease subunit; Function class=O Posttranslational modification, protein turnover, chaperones
  Homolog annotation: Query=1..176bp; Hit=1..176bp; Blast score=296; Percent Identity=89.0; E value=5e-81; Homolog= hslV COG0638
VTTIVSVRRNGQVVIGGDGQATMGHTVMKGNVRKVRRLYNDKVIAGFAGGTADAFTLFELFERKLEMHQGHLTKAAVELAKDWRTDRMLRKLEALLAVADENASLIITGNGDVIQPENDLIAIGSGGSYAQAAARAMLETTELSAREIAERALTIAGDICIYTNHNHNFEELPSKA

SEQ ID NO: 5959 - protein, 443 aa, Xenorhabdus bovienii
  Peptide sequence Name=Xb4151_4152.C416.gene25.pep
  Gene classification: Gene name=HslU; Function=ATP-dependent protease, ATPase subunit; Function class=O Posttranslational modification, protein turnover, chaperones
  Homolog annotation: Query=1..443bp; Hit=1..443bp; Blast score=741; Percent Identity=88.0; E value=0; Homolog= hslU COG1220
MSEMTPREIVSELDNHIIGQDKAKRAVAIALRNRWRRMQLDETLRHEVTPKNILMIGPTGVGKTEIARRLAKLANAPFIKVEATKFTEVGYVGKEVDSIIRDLTDAAVKMVRLQSIEKNRYRAEELAEERILDVLLPPAKNNWGQTETQSEPSTARQAFRKKLREGQLDDKEIEIDVASAPVGVEIMAPPGMEEMTNQLQSMFQNLAGQKQKTRKMKIKDAFKLLVEEEAAKLVNPEELKQQAIDAVEQHGIVFIDEIDKICKRGQTSGPDVSREGVQRDLLPLVEGCTVSTKHGMVKTDHILFIASGAFQVSSPSDLIPELQGRLPIRVELQALTTEDFERILTEPNASLTEQYKALMATEGMNIDFTTDGIRKLAEAAWRVNETTENIGARRLYTVLERMMEDISFDASERQGHSVEINADYVKEHLDELVADEDLSRFIL

SEQ ID NO: 5960 - protein, 305 aa, Xenorhabdus bovienii
  Peptide sequence Name=Xb4151_4152.C416.gene26.pep
  Gene classification: Gene name=MenA; Function=1,4-dihydroxy-2 -naphthoate octaprenyltransferase; Function class=H Coenzyme metabolism
  Homolog annotation: Query=7..302bp; Hit=6..301bp; Blast score=357; Percent Identity=66.0; E value=1e-98; Homolog= ZmenA COG1575
MNSTTSISQMQAWLESLRPKTLPLAVAAVVSGSALAAWTGHFKWPVALLALLTAALLQILSNLANDYGDVAKGSDTEKRIGPMRGMQKGVITAEQMKTALKITVLTSCLSGIALITVACNSPSDIIGFLALGVLAIVAAITYTVGTKPYGYMGLGDLSVLIFFGWLSVIGTYYLQANTFDLSTVLPATACGLLSVAVLNINNLRDIESDRQNGKNTLAVRLGAKKARYYHAALLICAILCLAAFTLLHLKSWSGWLFLLAVPLLLKHMWKVLHDQTSEGMRPMLVQMVKAALLTNVLFSIGLVFN

SEQ ID NO: 5961 - protein, 167 aa, Xenorhabdus bovienii
  Peptide sequence Name=Xb4151_4152.C416.gene27.pep
  Gene classification: Gene name=MenG; Function=Demethylmenaquinone methyltransferase; Function class=H Coenzyme metabolism
  Homolog annotation: Query=1..161bp; Hit=1..161bp; Blast score=262; Percent Identity=84.0; E value=1e-70; Homolog= menG COG0684
MKYDTSELCDIYQEDVNVVEPLFSNFGGRTSFGGQIITVKCFEDNGLLYDVLEENGSGRILLVDGGGSVRKALVDAGLAQLAVSNEWEGIVVYGAVRQVDSLAELDIGIQAMAAIPAGSNSEGIGESDIRVNFGGVTFFSGDYLYADNTGMILSDVPLEIDEEDDEV

SEQ ID NO: 5962 - protein, 80 aa, Xenorhabdus bovienii
  Peptide sequence Name=Xb4151_4152.C416.gene28.pep
  Gene classification: Function=Uncharacterized BCR; Function class=S Function unknown
  Homolog annotation: Query=1..79bp; Hit=3..81bp; Blast score=63; Percent Identity=67.0; E value=6e-11; Homolog= yiiU COG3074
MSFEVFEKLESKVQQAIDTITLLQMEIEELKERNAALSQDIQSAASSHDSLVRENEQFKQEQLAWQERLRTLLGKMEDVQ

SEQ ID NO: 5963 - protein, 265 aa, Xenorhabdus bovienii
  Peptide sequence Name=Xb4151_4152.C416.gene29.pep
  Gene classification: Gene name=GlpF; Function=Glycerol uptake facilitator and related permeases (Major Intrinsic Protein Family); Function class=G Carbohydrate transport and metabolism
  Homolog annotation: Query=1..262bp; Hit=1..260bp; Blast score=343; Percent Identity=69.0; E value=1e-94; Homolog= glpF COG0580
MSQTTTPTLSGQCISEFLGTALLVFFGLGCVAAARLAGAQLGLWEISIIWGFGVALAVYLTAGISGAHLNPAVTIALCLFASFDRKKVLPYIIAQMLGGFAAAAIVYMMYYNLFLDYEQVHNIVRGSQESLFTAGVFSTYPASQLSVLHAFIVEIIIAAVLLCLILALTDDGNGIPRGPMAPLLIGILIAVIGGSFGSLTGFALNPARDFGPKLVAYLAGWGDIALTGGRDIPYCLVPLVAPFIGAILGALGYRKLIARHLPRAV

SEQ ID NO: 5964 - protein, 507 aa, Xenorhabdus bovienii
  Peptide sequence Name=Xb4151_4152.C416.gene30.pep
  Gene classification: Gene name=GlpK; Function=Glycerol kinase; Function class=C Energy production and conversion
  Homolog annotation: Query=5..505bp; Hit=7..506bp; Blast score=882; Percent Identity=84.0; E value=0; Homolog= ZglpK COG0554
MTIENITEKKYIVALDQGTTSSRAVVLDHDANIVCISQREFPQIYPKPGWVEHDPMEIWASQSSTLVEVLAKSDISSDQIASIGITNQRETTIVWEKETGRPVYNAIVWQCRRTADICTKLKQKEGLEEYIRHNTGLVVDPYFSGTKIKWILDNVEGIRHRAENGELLFGTVDTWLVWKMTQGRVHVTDYTNASRTMLFNIHNLDWDQKILDELDIPRIMLPKVSSSSEIYGQTNIGGKGGTRIPIAGIAGDQQAALYGQLCVHPGMAKNTYGTGCFLLMNTGTDAVRSSHGLLTTIACGPRGEVNYALEGAVFVGGASIQWLRDELKLIADAADSEYFATKVKDSNGVYVVPAFTGLGAPYWDPYARGAIFGLTRGANSNHIIRATLESIAYQTRDVLDAMQADSGTRLKSLRVDGGAVANNFLMQFQADILGTRVERPDVRESTALGAAFLAGLAVGFWKDLDEVKSKATIEKEFRPGIETTERNHKYNGWKKAVARAQEWEDRA

SEQ ID NO: 5965 - protein, 395 aa, Xenorhabdus bovienii
  Peptide sequence Name=Xb4151_4152.C416.gene31.pep
  Gene classification: Gene name=ProP; Function=77 Permeases of the major facilitator superfamily; Function class=G Carbohydrate transport and metabolism
  Homolog annotation: Query=1..390bp; Hit=3..392bp; Blast score=412; Percent Identity=65.0; E value=1e-115; Homolog= ZemrD COG0477
MRKIEHFNLLVMLIALAAVGQMTQTIYVPVIADMASDFGQPAGEVQRVMAAYLFSYGISQIFYGPLSDKIGRRPVILAGMTLFLVATTCALFASSLLVLVIASVFQGLGTGVAGVMVRTMPRDLYTGTSLRYANSLLNMAVLVSPLLAPMIGGMVGYYFGWRACYWFLLSLGATVAFFLFQHLPETRPVQTKQSTMLVSFQQLLSNSAFVAYLIMLVGGLAGVAVFEASSGVLMGAVLGLDSLTVSILFILPIPAAFLGAWYAGRDGKTFYRLMWHSVMCCLLAGVLMWLPGWFGIMNVWTLLIPATLFFFGAGMLFPLATTGAMEPFPYLAGAAGALVGGLQNVGSGVTTWLSAMLPQNSQFSVGMLMFSMALLILFCWLPISQRVQRQEHTAS

SEQ ID NO: 5966 - protein, 248 aa, Xenorhabdus bovienii
  Peptide sequence Name=Xb4151_4152.C416.gene32.pep
  Gene classification: Gene name=Hmp; Function=Flavodoxin reductases (ferredoxin-NADPH reductases) family 1; Function class=C Energy production and conversion
  Homolog annotation: Query=1..248bp; Hit=1..248bp; Blast score=399; Percent Identity=73.0; E value=1e-111; Homolog= Zfpr COG1018
MANWVTGKVTDITNWTDSLFSIKVHAPIERFTAGQFAKLALEIEGERIQRAYSYVNSPDDNSLEFYLVTVPEGKLSPRLAELKNGEELLVTEQAAGFFVLDEIPDCQTLWMLSTGTAIGPYLSILQQGENLERFENIVLVHAVRLEQDLSYLPMMQQLEKKFQGKLRIQTIVSREKCPDSLMGRIPALIESGELEAAVGLPMQAENSHIMLCGNPQMAKDTQQLLKEQRNMAKHLRRKPGHITSEQYW

SEQ ID NO: 5967 - protein, 228 aa, Xenorhabdus bovienii
  Peptide sequence Name=Xb4151_4152.C416.gene33.pep
  Gene classification: Function=Uncharacterized membrane protein; Function class=S Function unknown
  Homolog annotation: Query=81..218bp; Hit=1..138bp; Blast score=148; Percent Identity=49.0; E value=6e-36; Homolog= yiiR COG3152
LYFSRNTGMVSSKVGESGSKYINCERVSGVTEGSPAKADNGKLIPKAINIVIRSLFMPVFMLYSLSVNTGKTASTIGKEYMTLQQWGFSFKGRIGRREFWIGIGICFALIFMLLTLHGLNTLPMHYATAGIALILYPTAAIIAKRLHDRNKRGGWMLLLVLAWVLLSLDWSAMTPIWQWGIGRFIPTLIFVMIVLDCGVFRGMEGSNRFGEMAETVEYISASEPAPKR

SEQ ID NO: 5968 - protein, 226 aa, Xenorhabdus bovienii
  Peptide sequence Name=Xb4151_4152.C416.gene34.pep
  Homolog annotation: Query=21..220bp; Hit=1..195bp; Blast score=211; Percent Identity=58.0; E value=5e-54; Homolog= Pa|Phot2-60c06.p1ka _g46| 38262 - 38858 1649 198 aa, chain +
MYSFPIVDAVFPVFTLNEYNMKTGMNKLLMTILIAFGISLPLSALAGEPSVTPDTRSQLMYLLPDSPTFEETIPVFREKYNKKYPEIPLHEYKVIVSKDISLPFIRAASKINEKIYSSAVLERGSEKIKSLQITLLPPQSEPEKEHNLALIKQYITALISQFEPTLSPEQANKQLERLLQAAQSHRFFSQKIGAIRYVIVNSSENIMTFAIEPIKLSLSDAPASKN

SEQ ID NO: 5969 - protein, 255 aa, Xenorhabdus bovienii
  Peptide sequence Name=Xb4151_4152.C416.gene35.pep
  Gene classification: Gene name=TpiA; Function=Triosephosphate isomerase; Function class=G Carbohydrate transport and metabolism
  Homolog annotation: Query=1..255bp; Hit=1..255bp; Blast score=387; Percent Identity=81.0; E value=1e-108; Homolog= tpiA COG0149
MRHPLVMGNWKLNGSTHMVNDLIAGLRKELSNVDGCGVAIAPPTVYVSLAKNALAGSRIALGAQDVDVNLSGAFTGETSAEMLKDVGAKYIIIGHSERRTYHKESDELIAKKFTILKEQGLIPVLCIGETEQENEAGQTEAVCARQIDAVLNTLGAEAFKDTVIAYEPVWAIGTGKSATPAQAQAVHKFIRDHIAKQDAAIAGQVIIQYGGSVNAGNAAELFTQPDIDGALVGGASLKADAFAVIVKAAAEAKKA

SEQ ID NO: 5970 - protein, 52 aa, Xenorhabdus bovienii
  Peptide sequence Name=Xb4151_4152.C417.gene1.pep
KWAFWQKSDSWMRNAWHRLAFACEAKAFLCLRDFAKLIHDVAPFFCQRIDSV

SEQ ID NO: 5971 - protein, 155 aa, Xenorhabdus bovienii
  Peptide sequence Name=Xb4151_4152.C417.gene2.pep
MTDMLNMSAEQFTFEEVKRPKPQGKCTPQLQQCINDFFTGVKQDRTDEIMALIRSPMDENEEENILYLRKLYYGHYESPYQRDDLVKSEIHKTVVSEIYNYFESLDKTRKLENGRDLFPFLFSPKKYDISTIVPKNVSLCEVFMNMIHIQDEKLM

SEQ ID NO: 5972 - protein, 61 aa, Xenorhabdus bovienii
  Peptide sequence Name=Xb4151_4152.C417.gene3.pep
  Homolog annotation: Query=21..61bp; Hit=7..47bp; Blast score=63; Percent Identity=68.0; E value=5e-10; Homolog= gi|1073741|pir||S46408 hypothetical protein - Aeromonas salmonicida gi|451856|gb|AAA72049.1| [Aeromonas salmonicida gene, comple
LYEGKRHDLMRLIFLLTCLPMTLIEHLSVVKETRSDINRQYDLVDIIFLVVSAIMAGAEGW

SEQ ID NO: 5973 - protein, 212 aa, Xenorhabdus bovienii
  Peptide sequence Name=Xb4151_4152.C417.gene4.pep
  Homolog annotation: Query=1..212bp; Hit=160..371bp; Blast score=335; Percent Identity=77.0; E value=3e-91; Homolog= gi|1073741|pir||S46408 hypothetical protein - Aeromonas salmonicida gi|451856|gb|AAA72049.1| [Aeromonas salmonicida gene, co
MLDILNLKGSIVTLDALHCQRETVEKISEKKAHMVVQVKKNQPKLWAAVQLQFQAVFDVGKEQIVTEVKQEAHGRREERYVFQLKPQFSPEMAEKWPTIRSIIAVERHRSENGKDTVDTSYYISSLSPRHKSLGHYIRQHWRIENSQHYILDVVFKEDDSRIVLDGAIEILALFRRIVLNMVKQCNCGAPSQRNKLKKAGWSDDYRAQVFFG

SEQ ID NO: 5974 - protein, 268 aa, Xenorhabdus bovienii
  Peptide sequence Name=Xb4151_4152.C417.gene5.pep
  Homolog annotation: Query=1..263bp; Hit=1..244bp; Blast score=207; Percent Identity=42.0; E value=2e-52; Homolog= Pa|Phot5-381a01.p1k _g19| 24012 - 24770 259 252 aa, chain +
MKTTLKLLTILPITLFLTGCEFISNAISSYWQTYNDKSEPFSPPENNQWITVEGIAPPNTKPNLVTTYASNRCLATHNTASGKLYHLPRYHWNKFNISTDPETGSFKEKVPFHGGGWCQWKINTVTVSLVYNEVNQLIKGAVPYDGTGIKAFINGAEKPKEMKEFLNIIDYRPTIYPFLRRDYDDGDKIGLYGKSGGLSYFGLRLIEGNDWKINYTPILDESKMPKIIISENPPGVYPRGSARVEYPDGKVDLNRDSIDYWKINNTSQ

SEQ ID NO: 5975 - protein, 624 aa, Xenorhabdus bovienii
  Peptide sequence Name=Xb4151_4152.C417.gene6.pep
  Gene classification: Function=Predicted lipase; Function class=I Lipid metabolism
  Homolog annotation: Query=8..494bp; Hit=6..497bp; Blast score=125; Percent Identity=26.0; E value=1e-28; Homolog= VC1418 COG3675
MSNANSIYCHDCSGMLKNKIEIQLVDEHNKPITNMPYTLKNHKMAREGITDGNGMIHEEHLTSSPLRLFLDGQKLADEMEQRPLRLKRYHEYTRSTESMAKISAVFAESQKSGRQYRYAKIGELVDKIPVIEGWKEEDPLPSYHFPDSEPMGIEVMPTAFERYRYVIEVCPFRAWSLVLHHQKDYSLVNAYNLSLMSILTYSNDNSGHWGSVTHFFNKQLLDLSRSPYQVNDERFMPVVYDVPFSERYTKVVYIDSKVQGNTGHTQLFYAANKQEIIVGWRGTEMTETQDLMTDGTFQPIELGSTANGVSSGFSEKGKVHKGFWDAFHLITEIKVSEGNDKKTVFEEIIKLTESKKLFVCGHSLGGALALLHSAQLKSYNPCLYTYGMPRLFTQSAVQELTEIIHYRHVNENDFVPSVPFNKDMDNVAFQAGRKFLGYAIEVFDAAGSLEAKIIKSNNSDNDPFLHHGKLVYFYALPDSESKFYLLPELNEETIKTTQKFIKKQKNVDRYIMQDIHSFFQGNENPTGKRGTGLFDHSSTLYAEYIDKRLRELCSLSPDKKLQRKPEDLSFLESQPNSIRAIFQRAKTEEYFFLREIDNQLAITLEVTQKDERGPRALKRYFEKR

SEQ ID NO: 5976 - protein, 264 aa, Xenorhabdus bovienii
  Peptide sequence Name=Xb4151_4152.C417.gene7.pep
  Homolog annotation: Query=14..262bp; Hit=1..249bp; Blast score=278; Percent Identity=56.0; E value=6e-74; Homolog= Pa|Phot2-44g08.q1ka _g181| 129578 - 130327 1542 249 aa, chain -
MERAITMESTGSAISWQVWLNEPSKAPVFFILNSLAKPNPIESFYHHDWVEQAFPLYSGTPMRNMLKQSPWLVQPKVNHLTQIGAALDRYELSDNSWGWAYRSHTPWQEQLKHWQQRQWVMMNGEPVLFRMMDARILGTLMPAFTPSDWSLMLTPVTELMVDTPQPARFSRPEGCGEGNSDIPFTLGEHLLAVWLRSPYGLKVLTSSLYNDLWENHGAMAKQWDQPEGSLEPRIEQWLRQKLEAGQRIEKISSQDYLLAMEQEK

SEQ ID NO: 5977 - protein, 688 aa, Xenorhabdus bovienii
  Peptide sequence Name=Xb4151_4152.C417.gene8.pep
  Gene classification: Gene name=VgrG; Function=Uncharacterized BCR; Function class=S Function unknown
  Homolog annotation: Query=16..664bp; Hit=4..664bp; Blast score=408; Percent Identity=36.0; E value=1e-114; Homolog= VCA0018 COG3501
MMKNIIDRLPAAKSGLRFTFQVAGLPEDTFSVGEFSLLEGLSELFTLNLTLVKTHSLNPFKPLDEVDLTALLMQEAELQIFHGVQVQRKITGIISHADWAGTDGNKTLYTLTVRPALWRLKLNQESRIFHQQNVPAILNGLLKKHKVRADSKLYDPHQDREYVTQKRESDYGFFSRLAAEEGISFWFEDETLFFSDSHLGMTAGLPLAYNPQPETAHGLDTIYQVRLGVGMSPQRSLHKDFNYDNPRYHLSHMASSEGFRDFGSQTPYTVFESYGRFQKDAAAKPFLKYRHEALDNQKKTGSGNSNCIKLMPGKIFEIISHPHLPLNARWQIVGISHHGRCPQALGDNSGEGTTLSNHFSFIDGLADYRPPFHYKPLADGDETATVVGPEGEEIFVNKDGAIKVHFHWNRYDKADDGASCWVRVAQGWNGNGFGFMAIPRIGQEVIISYLNGDIDRPIVTGCVYNGLNRPPLDLPAQKTRTTFKTKTHKGKGFNELRFEDAKGSEEIYFHGQKDFTAHIENDALWHIKHDQKQRIDNNRYHDIRADDHHQVAGSRKITTEGDVSHRIAGSQHTQTGDATVIDSGQEIHLKSGGKVVLEAASEITLKVGGSFLKVTPAGILCSPINVGQGSAGNGRGLALQLPEGVEPLPQVGKLPMAEALPVTEFPVQPACAELAQQDASLVIKPVKE

SEQ ID NO: 5978 - protein, 585 aa, Xenorhabdus bovienii
  Peptide sequence Name=Xb4151_4152.C417.gene9.pep
  Gene classification: Function=Uncharacterized BCR; Function class=S Function unknown
  Homolog annotation: Query=6..568bp; Hit=3..573bp; Blast score=179; Percent Identity=27.0; E value=6e-45; Homolog= VCA0110 COG3519
MKNNKESMYLRERAYLRELAQRVAKDSPHLSDFLTLSHDPDTERVFEAFALLIARLRDKIEDDLPEITHGILSRIWPSALSPIPPTTVMQFHPTDGEHQGTVDIPAGTPVSADVNGQLLTFKTCRSLHIEPLIVRDRTVKKTGTHSEIVLTLCQTGTPSPVWQSGSLSFFLGTDNERAAQLTLWLDQHICDMHLRTQGEQRKLNSFPYGWHNLFDALLLPMGNRTYAGLQLLLEYYALPHLYHFMTVDISDSCRDVPLNADGSFELVFRFEGELPLDNVDDAFMLGCVPAIHLETLTSLPLPLNEGNHRYPLLLGESVQLFRLRDIQVVQQPDETQQRGSPYRYLPIGQFTPSSPSLAEDGEPETLYYLLQNERDLLGRLTHQLHFFDLTGKPAQHLPVLSVVGDILGYHTQAITLKPGEITLTQEGSPAHLNVHNILPVSADYPSLLQDNSGWPLLSCLSSPPVLLFATDSLKQLLRLFDPYPELNRPLSRHIRRHIDGIVRVEEHLTDRMKRGRPVRGHRVGLTLNPDCYHNPGEMYRFCRLINEAMACFISQSTFVRLAVYTSNNSGVLWAFKEVYGTRREM

SEQ ID NO: 5979 - protein, 132 aa, Xenorhabdus bovienii
  Peptide sequence Name=Xb4151_4152.C417.gene10.pep
  Homolog annotation: Query=13..131bp; Hit=13..131bp; Blast score=116; Percent Identity=52.0; E value=8e-26; Homolog= gi|37525067|ref|NP _928411.1| hypothetical protein [Photorhabdus luminescens subsp. laumondii TTO1] gi|36784493|emb|CAE13381.
MKKPGLLLLMGWMVSLSAGAKTVIYTDSQHPPVNLPPEAQVIWLDAPEQQQRQIFARLPADPQQAATQARTILQSPQWRGQEQQLINAYRAVVHARQAGVRKYPAVVFDDRDVVYGTADVAKATALREQYQP

SEQ ID NO: 5980 - protein, 322 aa, Xenorhabdus bovienii
  Peptide sequence Name=Xb4151_4152.C417.gene11.pep
  Homolog annotation: Query=1..322bp; Hit=1..321bp; Blast score=423; Percent Identity=65.0; E value=1e-117; Homolog= gi|16763044|ref|NP _458661.1| hypothetical protein [Salmonella enterica subsp. enterica serovar Typhi] gi|29144529|ref|NP_8078
MNTSRLAFPVVITLAAACAPVTQAAINTAQIVAGSLSPACIQWQVSGICYWLFCSWHGCTVKTSVKVTHFLPQAVVSTYHAPGGNPWSEMAHISPLSGGLENAVTGALSGLTTGGGNHTVQVAGKRSPRLRFKYADAIGHPATTLIGGQIPGYSCRSAATPLMPYFLSTLDTVAWRSGLPESLYPEALVPGLRELGSQPVGNMWGNLYPRSGFVTQADEDKAAAVVAQRVADIITRTGQPHVYQPLAGQRRDGYWPPEPMQENTGTKNHQWQRLSPQLSQSCAVFPDGRHTAAADSNQAYALWQPYSCCQRRGQRFLGSTAI

SEQ ID NO: 5981 - protein, 477 aa, Xenorhabdus bovienii
  Peptide sequence Name=Xb4151_4152.C417.gene12.pep
  Homolog annotation: Query=31..472bp; Hit=27..468bp; Blast score=523; Percent Identity=63.0; E value=1e-147; Homolog= gi|37525069|ref|NP _928413.1| hypothetical protein [Photorhabdus luminescens subsp. laumondii TTO1] gi|36784495|emb|CAE13383
MRRKSVLLIAGGLVVASVQGQTSGLSVALPAVSHSALGYGAQSSGAVSDTLFYTLGGGSVISEPASRAGSTRLAGLELGWSSDLMCGNFDLKTTVSNQLNGITAGMKNLMSEVIQGATGAVASLPAMIIQRANPGLYDMLTNGVLQANVAFDKAQFNCQNMAKRMMDFAQNNKWSQSAALQEYKNQVNGGDGDAVRVNNAGTKATGAGGHSWIGGQRQGGKGQNAIRPTRDLASAGFNMMNQLPVLSQSSVSTFNCEGSACRKFSTAREAAEAVVSVLGDRAIRTCAHAAECSSGGEQHQPGTTVAGTGFAPMLEAHTKTNAEHLVKLISGTEKPTRVNLTKLKTGSLAVTQGVIQALQRDPDKAALTARLAGELAMSETIETALLMRRMLITGMSEPNAAAQSEALAEGDRRIAALDREINALKNEMELKQALSRNSILTIIERDTQRIHAHPQKQVADSQDARFYQLEAPNREVR

SEQ ID NO: 5982 - protein, 111 aa, Xenorhabdus bovienii
  Peptide sequence Name=Xb4151_4152.C417.gene13.pep
MAKKRARLKRGIGLSLIIALAMAVTLATGWAGMNYPDTLSALNRGMARHQSLWLLWRLSLYGGLLWGGWKIWQRVKHQAEYRTTLRRMMVVSLLFILLGEYALSASQGSVS

SEQ ID NO: 5983 - protein, 504 aa, Xenorhabdus bovienii
  Peptide sequence Name=Xb4151_4152.C417.gene14.pep
  Homolog annotation: Query=1..500bp; Hit=1..503bp; Blast score=653; Percent Identity=63.0; E value=0; Homolog= gi|37525071|ref|NP _928415.1| hypothetical protein [Photorhabdus luminescens subsp. laumondii TTO1] gi|36784497|emb|CAE13385.1| unn
MTTNSYLEYFLTLLGWVVNNGLWHILIATGLFTLPLVVKVIAIWLKVRECGEEEGPNGLQSLARIENTLYSAFFVMVFCCVPLVNVSFSTLQYDTARAKSCGTWTPGAPENSGYAPVISSLNNQTAAVPIWWAVVHRLSKGLTQAAVAAIPCRPDLRQLRFDVQHTRIKSPALAAELQDFTHDCYALALYQWQQRDPEHTSDPIILNDIGWLGSRTFLAGDYRTLQSRTPRADFPWQESRDNGRPYTGQGGYPSCQVWWSAANIGLKDRVLAQADPGLWLRLSATLKMLGKNTPAYQEAVIRRLVSPVNLTVSQAGQVYAGYGGNADPTLWDGSTRIGASAGALLGGLLAYPMFDAVRQALPMMQAVILMALYILIPLLLLVAAYEFKTVFTLTCVIFALNFLTFWWELARWLDSHLLDALYGSDTHSLFNLAGMQNTSDDLIMGLVMGTLFIVLPMIWLGALAWAGVRMGDVGGLMSQGVGQVRQSAGMFGQMVMQKMMSKGK

SEQ ID NO: 5984 - protein, 140 aa, Xenorhabdus bovienii
  Peptide sequence Name=Xb4151_4152.C417.gene15.pep
MRDIDKNHKNKKVKKQSDHFIPYKTTYDLRLTKREPNLINILMQVQGYEYGFFTVLGVRPLSQRGNPKSTSIYVVRCRCGKYAVRSLRAIRNPANMNDMCEHCRHLYNLRRRNHFLTEGKDVDLSELTGITDKKPLDIKE

SEQ ID NO: 5985 - protein, 305 aa, Xenorhabdus bovienii
  Peptide sequence Name=Xb4151_4152.C417.gene16.pep
  Homolog annotation: Query=1..305bp; Hit=1..306bp; Blast score=323; Percent Identity=56.0; E value=2e-87; Homolog= gi|16763053|ref|NP _458670.1| hypothetical protein [Salmonella enterica subsp. enterica serovar Typhi] gi|29144536|ref|NP_80787
MAQKSTRSKVELFRKEFIACARNGHGSFATVADRERIARQFLHFLKERGIKLRQMDSLKTKYIEHYIAQRKADHISHRTLQNEMAALRTILAQAGKHKLAAADNPRLSNRVLGIANTDRRGTKMALTPTGFQAAFQQVERKDRGVAAVMQLAYVLGLRTKEAVEAGKSLATWKKALENGHTSVRIVFGTKGGRPRQTVILDRVALHHAIDYAEREQAGRSGRLIDKPTIYQAIDRYRYVVRRAGLVGKQAPHSMRYHFAQQSGAHYKAQGFSEREALALVSMDLGHGDGRGRYIRQVYCQNIEDE

SEQ ID NO: 5986 - protein, 51 aa, Xenorhabdus bovienii
  Peptide sequence Name=Xb4151_4152.C417.gene17.pep
MWSGLLLSAAMAKLVPAYYADVIGPCGAGGFADTGEKNVGGTDSPECIGIA

SEQ ID NO: 5987 - protein, 493 aa, Xenorhabdus bovienii
  Peptide sequence Name=Xb4151_4152.C417.gene18.pep
  Gene classification: Gene name=AtoC; Function=Response regulator containing CheY-like receiver, AAA-type ATPase, and DNA-binding domains; Function class=T Signal transduction mechanisms
  Homolog annotation: Query=176..493bp; Hit=134..438bp; Blast score =252; Percent Identity=43.0; E value=7e-67; Homolog= yfhA COG2204
LIEKPRVLICWIGNKDIESAENDEIGPILATLQDSEFDRCYLIYSYPERRVTPYLAWLRKQTNLPVTAHFEALSSPVHFGEIYEAANKHLQHIVASGSELCVQLTPGTPAMQAVWVLLGKTRYSATFYQSSPEKGVEKVDIPFEIAAEYIPAANTISDEKIVQLSAYGVAVNTAFDSIITQSKRMLRLKSQAQILATKHVPVLIYGETGTGKEMFARAICNASPRTSAPFIAINCGAIPPELVDSTLFGHCKGAFTGAVSNSKGVFEQADGGTLFLDEFGELKPDVQVRLLRVLQEGVITPVGASEPVKVNVRLITATHSDLMQEVGKGRFRADLVYRIAVGVLHLPPLREREGDILLLADTLLQGISEQDQSLQNKQLSVEAKNFILRCPWRGNVRELHSTLLRAAIWSPDAVITADDIKEALFMIPEEQQGTSLVDILEGIDLQKVISKIANDYLYRALEVTGNNKTHAAQLLGLKSQQTFTNWLKKHQIE

SEQ ID NO: 5988 - protein, 223 aa, Xenorhabdus bovienii
  Peptide sequence Name=Xb4151_4152.C417.gene19.pep
  Homolog annotation: Query=32..202bp; Hit=9..177bp; Blast score=95; Percent Identity=32.0; E value=7e-19; Homolog= gi|15645056|ref|NP _207226.1| phage/colicin/tellurite resistance cluster terY protein [Helicobacter pylori 26695] gi|7465169|pi
MAELKKFQIQTARPLPVIVLADTSGSMASDGKIEALNQGLKDMLLSFKDESRLRAEIQVSVITFGNNKAEVNLPLAPAHLLQDFIPLSAEGSTPLGGALSLASQMIEDKSVIPSRAYKPVVVLVSDGYPNDDWEGPFSSFASGERSSKATRFAMSIGGDADEDMLSEFANDPEAPLFRAENASDIRRFFRAVTMSVSVQSRSANPTQSTPLQISAADDQDWEF

SEQ ID NO: 5989 - protein, 230 aa, Xenorhabdus bovienii
  Peptide sequence Name=Xb4151_4152.C417.gene20.pep
MRLSAGGASVTGPAHLQNGLPNQDALSISGLRGGWSIAVADGLGSRPLSHIGSRKAVHLIRHLAQRGQNLQHSNIAQWLCRDWLAHFGDEYQAYETTCLWAWVDAKGHGVAGQIGDGLVLIKSQGIFNVLSGVRAGFGNQTATLAQAAPSECRSQRIELTQSGDGVLMMTDGIADDLVPESLESFFDVIYQRQLRSNKRQMRTWLTKELQNWSTPQHGDDKSIAGFFRMD

SEQ ID NO: 5990 - protein, 471 aa, Xenorhabdus bovienii
  Peptide sequence Name=Xb4151_4152.C417.gene21.pep
  Homolog annotation: Query=12..268bp; Hit=5..287bp; Blast score=122; Percent Identity=31.0; E value=1e-26; Homolog= gi|15645060|ref|NP _207230.1| protein kinase C-like protein [Helicobacter pylori 26695] gi|7465336|pir||H64573 protein kinase
MTSTTKTSKKPEVQDTKGSFYELKREMSRGGQGIIYRTQFPQTLIKGFTNKDELARQHWRNQIAWLIRQDLSDLKLARPVALLAEPRCGYVMELMDGLVPLQSLLDSFLNAGEESLADYLQAGGLRRRVRILSQLARTLNQLHSRGMLYGDLSPGNIFVSDDPKHAETWLIDCDNISLFTHSGLTFHTPDYGAPEVIRGEALLSSLTDIWSFAVIAYQLLTHNHPFKGEVISDGEPELEEEALRGEHPWINDGQDESNRCYTCLPMQLIEHSRLPELFSRCFEQGRIRASDRPTMAEWLAALTEIDEHLYTCKHCGGDTILPADLPAEDVASHDTLCFFCDEPVESELVLFEEFLSVVEGSEDQLSEQVNWIPTGRKVWLQVGDRKELKRLLPTFSYDRWPEDHVRLEYTEKGLGIHALPQGQLHLQQGKTIKQLARYQGLKASLRGQNATAFQLHIGELNASHVLWQFKW

SEQ ID NO: 5991 - protein, 1132 aa, Xenorhabdus bovienii
  Peptide sequence Name=Xb4151_4152.C417.gene22.pep
  Gene classification: Function=Superfamily I DNA and RNA helicases and helicase subunits; Function class=L DNA replication, recombination and repair
  Homolog annotation: Query=777..1124bp; Hit=68..353bp; Blast score =147; Percent Identity=30.0; E value=5e-35; Homolog= HP0447 COG1112
MNINDFPMMSEDILVLSTDESTDGFEAEQAIFIRPDEQKWLAVQGNKYISITCGPADHELFSRLVLCDQVRWRLTLLQQKGKLWVQYCTPVEVSAMQLELGVDEFIADDLYGKQEIADKRIDLACEWFAENFVVSGLKEGDWLTIARFSNNSIAGSFQIIGKGWRADVERKSDGGLLIKRVTRHLRSDSAFSLLVGQFSFCDTSVAVVLKKSASQQALLDAALRDNTSYLELWNLYNEKEWQNELRRAESLRSLRFIDCVGVDEGQDNAWRLTPKSLDDYREFQKRLRELELPADTQYDLGTVAPDWAEELSMDESRAAANIPRGMLRFEADYVFFKPASNRRDIRPKQPDGWLYLSLAGYRTAGKRRLAAKQKIDSGKRMPQLKWLLEGIPVPAARYRTIPGLTPYAKEIFKGGKPTEMQEQALDAALNTPDLAIIIGPPGTGKTQVIAALQRRLAEEAQNQNIAGQVLISSFQHDAVDNALERSDVFGLPGARVGGKHRADDDESLIDSWLEQQTMHLHGKVRDEHARYPELEFFNRLSIKLAFARLAGGPNSRRAEEFSAILQDLEELEKIGSIPLSMLKSQLEDYIEQLRKQASDTTDSAIDNQLIQRIRALRVDAVSFNDDGSDRAWDLLRWIQRYDLDCAPERVSLLQAAADNLSLSTSDFHELSMWREHLLEQFLPDYRPVALKNQADPAGLALLDDIERHLDGKLRQRKQGVAWVLEQLADSLTVDRRAAQNVVNEYSMVVGATCQQAAGQQMANLKSVAGLDSSGIEFETVVVDEAARANPLDLFVPMSMARRRIVLVGDDKQLPHMLEPDIEGQLQEEHQLTEVQRAAFHSSLFERMRLKLLELEKRDQWPRVVMLDTQFRMHPVLGNFISKQFYESAGMREVKSGRDVADFAFDEKMLNALGELEPYFRDRVCQWIDLPRSEGKDRTHGSSRVREIEATRIAQEVERLVRAGGESFSIGVITFYAAQRDLIMEKLAQVRIDGVPLMEPRDGSFEPHEDFRLARKVRGDGSISYEERLRVGSVDAFQGKEFDVVLLSCVRTFDPSKPALGAQDDAAAREAQLNRRFGFLRLPNRMNVAMSRQRQMLICVGDAVLVTNPDAKEAVPALAALYQLCGGVYGSVR

SEQ ID NO: 5992 - protein, 497 aa, Xenorhabdus bovienii
  Peptide sequence Name=Xb4151_4152.C417.gene23.pep
MAVFAETGTYMAFSSHPYGKKEPLLWPVMVHRVLYPDAKRPQLNIFQRAVLGLIRARVTRPETMAELTGLHSSLINLILVQSASHGWLVDNADALTASGERLLDDEDDDAASFKSGYLLQDAVTGQFWPRLITELKQIEPVNALAKYPEFITERKTGKPLRPYVVASNKGRLAQLDPDVLMKAYKNYSNDFRASRQLDQLRLEPEIRLQGVQRLDDNPQSARVLIWVTPDKRGADLWSVKDPFALRENAPWLQEALRQVIERDAFLLRRLEPLVEIPQAENQSVTEWLAAVQRNIEFTLLTEYPWAEKQPDIKRYMTALLIYREKIQHAGANEHELEAAITECQKLLEVVMQWLIRTFPANVGLLPKYKQGNTRNAINQVILEKLNIPSFTQDVIRILSGQHFDKVERACRQPTDSLKALLFAAAIGAYNTPQHPLNVLEDRELQLTKMLELARLRNQSGHGQSSYTGKTAVKLTSQSVLESIQYALSVTERFEEWM

SEQ ID NO: 5993 - protein, 528 aa, Xenorhabdus bovienii
  Peptide sequence Name=Xb4151_4152.C417.gene24.pep
MAKKNHQNRKYNAPKIPPQKMTPPLAAAEKANTDVALSASFVSASDLFASFGMTLDIDMSGECLESIKARTQKEGEESFARWLMQFFQACEAMKTLKEKLEEEQKEVSQRLLSHDEKSQRLASQQQQLEDEKHALKLARDGVEQEKVSIVSKRAELTEKERVMNEREINAQFGFAEQNALTMRQLEKHQAQQLSQHQEQLQTLLSEKRQLEEERHRASSELDAIKYRCTEAEAERVRALDLREQDIEQRIKAVDCEKVRLKRWEKELDAEKNDIQKRVSDEIERELGRHSSEVSRMQRKLQKAYDDYDLLKNEHADFQDLKHAMGNTPVAAVLERLERFQAENNELIRKQQSSDMDELLREKDALSKSKYNLERQCYALRVELDETKRELSGKRVAATELQGIALEKRTLEYHKNALELQINELANSIEHLSNAQKTQTPFPAMSLMDSDTQYRARTELETVDDLNQFATELQHRIAQAEEHVELFYPLEEIQVLLGGLAMSQLHIFQGISGTGKTSLAKAFAKAMGG

SEQ ID NO: 5994 - protein, 334 aa, Xenorhabdus bovienii
  Peptide sequence Name=Xb4151_4152.C417.gene25.pep
  Gene classification: Function=Transposase; Function class=L DNA replication, recombination and repair
  Homolog annotation: Query=3..332bp; Hit=2..335bp; Blast score=241; Percent Identity=43.0; E value=1e-63; Homolog= PA2319 COG3547
MQNVTLIGIDLGKHSFHVHCQDKSGKALLRKKFTRARLMEFLAGSPSATVVMEACAGAHFMARRIAAFGHEAKLISPQFVRPFVKSNKNDFVDAEAICEAASRPSMRFVQPRTEAQQAMRALHRVRESLVRDRVKTTNQMHAFLLEFGISMPIGTAVIKRLSTVLAENELPPYLAQLLMRLHAHYLYLVEQLTELETALEQELRRDETGQRLQTILGVGPITASVLSSQLGDGKQYGCSRDFAASTGLVPRQYSTGGKNTLLGISKRGDKNLRRLLVQCARVFIQRIDYQSGRLAEWVKAQLERKHSNVVACALANKLARIAWAITTRQTVFER

SEQ ID NO: 5995 - protein, 201 aa, Xenorhabdus bovienii
  Peptide sequence Name=Xb4151_4152.C417.gene26.pep
  Gene classification: Function=Protein containing von Willebrand factor (vWF) type A domain; Function class=R General function prediction only
  Homolog annotation: Query=4..187bp; Hit=13..185bp; Blast score=75; Percent Identity=27.0; E value=3e-14; Homolog= mlr6511 COG2304
VGTIDFDASGSMSISVDVTPQELQYLLQRKAFEYIEREPSRITLAKKSAKKIIDKLPSDMNISLVAAFDCRHVSASLPFSPTQRPVLKRAIDRITPDGKTPLALALEKAGALVDGVNRDAIILLISDGDETCGGDPCAVARALKENKPRLQVNVVDIMNSGAGNCIASQTGGKVFTANNANQFNQVINQAMQDYIPENCNE

SEQ ID NO: 5996 - protein, 461 aa, Xenorhabdus bovienii
  Peptide sequence Name=Xb4151_4152.C417.gene27.pep
  Homolog annotation: Query=3..460bp; Hit=3..476bp; Blast score=277; Percent Identity=37.0; E value=3e-73; Homolog= gi|22126008|ref|NP _669431.1| putative virulence factor [Yersinia pestis KIM] gi|21958956|gb|AAM85682.1|AE013815_1 putative vir
VKKTFLRGDKLESYLPLGENGQAVHLSALQLRETLRLRQLSDVANSLAIPQGNEQGDRIDWYAGFSGNVVPWSAATYDERQSALRQLEAHQAAIEQLSAQMIQQKAHEMRLFGALLSKTIQFPDQEHIYLVDGKPVVTFWGFVNAKQQARPNPLECLRTVRSVTPSVAPTESTVETVVATPPPVSKRSRRWLLPHWLWWLLPLLLILLALLLLRGCLPDVHIWGMTPSTHSTPPLQGEIISKEGKPVPERSVPALSVSESHALPLVQGMSSVNGTASVNSTESVNGTSPVSPELNPIEPMLPTQPIPPVADGVSNGTPKPSLPEINVPPVKVSPPAEALTIPDIAVQQGTTDFFNGSWHAGAGIQDSRTGKPLSLKYQIADGKGQVEMARGDGVHCQAPVKAVMNSGALQLDNIGEAKCSDGSVYTMPEVVCQSGSEGTAECQGRYDEKTLFPMSMKREAN

SEQ ID NO: 5997 - protein, 1006 aa, Xenorhabdus bovienii
  Peptide sequence Name=Xb4151_4152.C417.gene28.pep
  Homolog annotation: Query=6..1004bp; Hit=38..1021bp; Blast score =1011; Percent Identity=54.0; E value=0; Homolog= gi|23104641|ref|ZP _00091103.1| COG4457: Uncharacterized protein conserved in bacteria, putative virulence factor [Azotobacter
MLATITDFKEKVTLIRDSGIQFLDFAFALPKKKEYGEFLLTEEDNPVIRLVYNERDENFLVPSASGSSAFAADSDYSLVLEKSLEIYNDIWLPLPFFRFNSSRSFAQGPTNWSRVKFHALDTPDEQGNTWRVTLAFDTKVSPDRRNTQYLEPVDDDVRSGVSFALAETHHEMGDFLLLKWVDDWLRETYTERATTLWRQYHEDTENCLNRKEHQAHYLNLINALNVLLQVPEIQLNDVKLQDNPINVDLVLDIGNSRSCGILIEEHRDGDQGLSNLYQLQLRDLSEPQYIYTDPFDSRLEFAQAEFGKQDFSVKSGRSDAFTWPTIGRVGEEAFRMASQRLGTEGSTGLSSPKRYLWDDAPYSPGWRFSRAFVKSDREPQATAPPMTYMINDKGEALYALKPSERMPVFTPEYSRSTLMTMMLSEVLAQALMQINSPAQRLKMRHASTPRQLKNIILTVPPAMPKPERAIFQKAMTQAIRLVWKALDWEDMDQGVDENGREDKNVSRKRTLPDVHVKWDEATCGQLVYLYNETQNYFGGRSEEFFAATVRPDNKREAGNDRTLKIASIDIGGGTTDLVITRYTLDEGNGSNVRIVPTQLFREGFKVAGDDILLDVIQLYLQPAFEAALLNIGYQDLDAEALMSRLFGSEALEAGKQVLRQQLTLQIFAPVALAILHRYEKFTPEAGEQVISATFNDLLSHQPTDKVCEYVDEEVKRSLPAGIENPFSILNVPLNINLMKLHNEFIDARHNRINICGSLRGLCEVLWHYNCDILLLTGRPSRLPGIQALIRHLQPVPPARVLPLHGYETGGWYPFNKKGLIDDPKSTAAVGAMLCLLAEKSRLSNFYFRTANFKPYSTIRYFGMLDSNNLLKDSNVFYRDIDLDTPGFQLDNQQYFESRGEMRLGFRQLDNERWSATPLYTLKIPGTRLATALSGDAVLRLKLEVEEGRGQEAETNGSPEKFRISEMDIVESTQNPRPQDVSFKLNTLVGSGLGETHYWLDSGSIKI

SEQ ID NO: 5998 - protein, 893 aa, Xenorhabdus bovienii
  Peptide sequence Name=Xb4151_4152.C417.gene29.pep
  Homolog annotation: Query=5..889bp; Hit=66..964bp; Blast score=806; Percent Identity=49.0; E value=0; Homolog= gi|23104642|ref|ZP _00091104.1| COG4458: Uncharacterized protein conserved in bacteria, putative virulence factor [Azotobacter vin
MKHFTPEQLKQAWLDVAQGAGQAIEWVEEVRGNAPRLNTEADRLKLKLRRSRNTAQRLAKAATHPMTIGFFGLSQAGKSYLISSLAAGENGRLETQMGSYQLDFLEHINPPGGGKEATGLVTRFSRHVRPSNPDWPIELQLFNEAEIAKIFANTFIHDFNQEKIDWNYDEKRINTLLTSLNERRQAYKVPGVAEDDVVALWDYLIRHAEKSQSKMALQYWPAAVELAPWLSIDDRAQLFGELWGNIHEFTEAYRRFAHTLQRLGGASVVRAPLNVLVTEQNGRLVQTNSIMNVDMLERLNKSNDLQITVCPERENGLAAPVSVSLAELTALTVELHVPLLSSTRERLFEEVDLLDFPGYRGRLGVESLNYLQNTAESDDSNPLAQLILRGKVAYLFERYTLNQEMNVLVVCTPSNEQSNVKDVGGVLDEWIRYSQGADADSRARRPAGLVWAITKLDLRITQELTKSEDMLREVWGQGGMIKIAMTERFGHFPWMQEWQPGRAFNNAFLVRKPCQATPFITMKEGCEAEFSQETASKLTLMKKTFLEDAAIQRHIASPEQAWDAMLQLDDGGMRRLADYLGIVAQREMKLERITEQLNETRHELVKGNLHAWYQPDGAEEVEKKRLISEDILKALQNRAGRHGELLAGLVPQRKALQELYMQEAELDLSIEGKDENESIAAFGIGSDFDLFSDTPDETVSAHSHEQEFAHRVIKLWINYLRTVPEQTSMTDFIGLSRSIVEMLVDELITAIQRMDVEGELMAVLANTEQAGVRREKMMERQVSRVMHIMNDFITWLGYQNILSEKRPASRINKGQPIFARPDKKDPALWKGDERLYRLTNEQLNYSALFIYDWLFGFGEIIKENAGHSAGREITAVQNERLGTIIHRIQLSSE

SEQ ID NO: 5999 - protein, 333 aa, Xenorhabdus bovienii
  Peptide sequence Name=Xb4151_4152.C417.gene30.pep
  Homolog annotation: Query=1..332bp; Hit=1..337bp; Blast score=165; Percent Identity=33.0; E value=1e-39; Homolog= gi|23104643|ref|ZP _00091105.1| hypothetical protein [Azotobacter vinelandii]
VIKPELRPYEPVEPGYAVLRIEDWQGATEGVRVSIQRNQDRCFLNGQGQWVNNEEWLILPELQEVDGAVEARVGPELVDALLAERQVAYRVTVIDDIQREVGGLKIANGVLSSLAKGEHTPSDNVSEHVPPAQEPPVSMPTETASVESVVELTVSKSHELPEPQPIPVNERIDAAASASAKKSNKGMLIVLTLLVVAGVLWWLLKPQEKPEPVISSASATAPCAMENMTKGNGLEFVKSCLRSQPSSLQVQEIISQAKNAGQCDIAQRLYAYKSQSGDKQIALRYAQEYDPKTATKKGCFVADAQTAIYWYEILINQDPQNSEAKARLAALKK

SEQ ID NO: 6000 - protein, 663 aa, Xenorhabdus bovienii
  Peptide sequence Name=Xb4151_4152.C417.gene31.pep
  Gene classification: Gene name=SPS1; Function=Serine/threonine protein kinases; Function class=T Signal transduction mechanisms
  Homolog annotation: Query=17..663bp; Hit=403..1032bp; Blast score =416; Percent Identity=37.0; E value=1e-116; Homolog= PA0074 COG0515
MKHLNWLKAVFSALVLMASAGALAAQKPLLQEGKQTLYQRVLTYPGCELSAKVGEKGKIQPAFSRFYVYQREKQGSEEWLWVGPDSYGNSRGWMKANCSVDWKMQLTLAFTNPSGRNPMLFFRDKTDVEKILNTAKPATQLQPLLNDLKAGKSVPSVLAREPDYMIDQQKNFYLLPMLGSDDIFTDTGYQVRVLNVASVSEAGKTASVLSGKNASTSPDKEKNMMKGFSASVVFVIDSTISMGPYIDRTKQAIEKIYQRIEQENLLGQVKFGLVAYRSNVTAVPDLEYDSKMYVDPNTVKDGKDFLAKVRDLKQATVSSSKVNEDAYAGVMTALDKVDWTKFGARYVILVTDAGALEGDDKLSSTQLDATQVRLEATYRGVALYALHLKTPSGHKNHASAENQYRDLTLNAFLHKPLYYPINSGDVNSFGTIVDNLANAITSQIKTAWRGEETVGSALGANESYMGKKTELSKEPLLHDAALLGHAMRLAYLGDKQGTQAPPVFKSWISDRDLVHQNIPATEVKVLLTKSELSDLSEVMKKVVNAANEGLISPDDMFASLRSLAATMGNDPKQAKNKQATKLGEMGLLGEYIEGLPYLSEVLSLDEDTWKSWDGLEQERFIRRLNTKLNYYQRYNEDVDRWISLAPDSDPRDNVYPVPLENLP

SEQ ID NO: 6001 - protein, 225 aa, Xenorhabdus bovienii
  Peptide sequence Name=Xb4151_4152.C417.gene32.pep
  Gene classification: Gene name=PhnL; Function=ABC-type transport systems, involved in lipoprotein release, ATPase components; Function class=R General function prediction only
  Homolog annotation: Query=1..223bp; Hit=7..232bp; Blast score=206; Percent Identity=50.0; E value=2e-53; Homolog= PM1823 COG1136
MQIQRGQADQGFTVSLPRLSLNAGEIAALTGPSGCGKSTLLEMIGGILRPDSLECYQLGIPPRDITASLLEGEENQLAQVRAKDLGFVLQHGGLLPWLSVEQNIQLPRQIAGLVARSEWLDTAITRLSIAGLMKKMPSQLSIGERQRVAFARAIAHQPQLLLADEPTAALDPHNAETLFSLIVEMVKALNLVAIIVSHDWQRVTDFGLKRYAATVDGKQSVFTTC

SEQ ID NO: 6002 - protein, 393 aa, Xenorhabdus bovienii
  Peptide sequence Name=Xb4151_4152.C417.gene33.pep
  Gene classification: Function=ABC-type transport systems, involved in lipoprotein release, permease components; Function class=R General function prediction only
  Homolog annotation: Query=1..393bp; Hit=18..410bp; Blast score=342; Percent Identity=49.0; E value=5e-94; Homolog= PM1824 COG0577
MALADLIHDRKVALCIIFSLIAVITPLLLLFGLKNGIVSQLRHTLLDDPRTREVRMLGNGNYNHTWLMQLAARPDVDFVIPLTRSLNTQADLVRDTQRFVSNAEIIPTALHDPLLVNAKEPQNEQQVVLSASAAERLQIKTGDSLRLVIARKRDGINEHVQHTLTVIDVIDGAKFGRPAAFVTLLLLVAMEDYRDGYQVTLFKVHDGTPTRERTTFAKARLYANSIDSVAELAEWLQQQHIETITQQAEIESVRAIDHVLGLIFTVIAWISATGCIASLVGAFMANIDRKRKDMAVLRLLGFRRQAVVLFVLIQALLLTGSAWGVGLLLYFVASQLFNNVLGASLPETAFVCHLEPWHLLMALLSVLVVALGVAAVGALRALKIEPAESLREI

SEQ ID NO: 6003 - protein, 516 aa, Xenorhabdus bovienii
  Peptide sequence Name=Xb4151_4152.C417.gene34.pep
  Gene classification: Function=Uncharacterized BCR; Function class=S Function unknown
  Homolog annotation: Query=14..512bp; Hit=9..504bp; Blast score=466; Percent Identity=46.0; E value=1e-131; Homolog= PM1825 COG1262
VRFNHGLNIALAGLFLAILPFSASAVWEEKYYNPKPLPDDVILPMPCEGAMAFRKVSIPLSQPLQDYSITLGGGANDEWGYLEQARAEHIAGSFAEGKSGKGRYFLMAKYELTDLQYQALTGQCPTPNMKLRLSKVNIGWVDAMNFANQYNLWLLKNQPKALPVEDGKPGFLRLPTETEWEFAARGGLAVSTAEFRDQRFPMPEGITSYAWFSGTQSSNGKLQLAGLLKPNPLGLHDMLGNASEMMFEPFHLNKLDRRHGKAGGYIVRGGNFLTPQSDIRSSLRGEEPYYTGQSDNKNKTLGFRLVLVSPTLTSRDRIKEIAEEWKALGTDNPQVKEKKSPDSIDNLGSISAQVKDTALKKQLEQLRADLRANAQLRDEQRDQAIRTSLQLGAFLCTKLKDDGEFYDRLNGLYEKTCKAGSELDANCSRRQSQLDQHKKVLNFIVNYYADTLVDMGVTYNAELISPQIRVVQQQMSARGKTNLNGYLNTYWKNLQEYWKNGRVARDSWLESCKKNN

SEQ ID NO: 6004 - protein, 235 aa, Xenorhabdus bovienii
  Peptide sequence Name=Xb4151_4152.C417.gene35.pep
  Homolog annotation: Query=18..234bp; Hit=19..235bp; Blast score=172; Percent Identity=41.0; E value=5e-42; Homolog= gi|23104648|ref|ZP _00091110.1| hypothetical protein [Azotobacter vinelandii]
MVLQSMRSMISLCMIFLLVACQTPQGPSAQTGKVDSRLTQSQDVEFFNKSGWQACAAGAAAGALACLLINGDHQAICIAAAAIVGCGVGVGANAYLDNQRTKYASKEQLLAASINDVKAENQRIKNVTATVKEVIKTDKLTLAQINKDIAAKVVKKDQVQKQLKGLDANIVYLRNTIKEMKEHENQWQNVSTQIAKDGTKTKDLNNQIVQMRKNIGSLQQELDSLYEQRTAIKVS

SEQ ID NO: 6005 - protein, 160 aa, Xenorhabdus bovienii
  Peptide sequence Name=Xb4151_4152.C417.gene36.pep
  Homolog annotation: Query=2..157bp; Hit=6..162bp; Blast score=91; Percent Identity=35.0; E value=5e-18; Homolog= gi|23104649|ref|ZP _00091111.1| hypothetical protein [Azotobacter vinelandii]
MRILMMLVISMALTGCVTNAQECDPTAGDMSIITKFNCNYSGTWDQRVVDKEKVLQHEQTLNKEFKAVYDAIEREKKAGQTNLESRKRSQVALQKSLNRLFSQLKTKAAGKVKMEKQIAELEKRMREAQQKPSQSEMQKQLELQQLQNQLNELQDSLMIP

SEQ ID NO: 6006 - protein, 93 aa, Xenorhabdus bovienii
  Peptide sequence Name=Xb4151_4152.C417.gene37.pep
  Homolog annotation: Query=1..93bp; Hit=1..92bp; Blast score=70; Percent Identity=48.0; E value=7e-12; Homolog= Pa|Phot5-476a02.p1k _g22| 10970 - 11251 1146 93 aa, chain - [Photorhabdus asymbiotica]
MKKIILPLLLSMFLVGCGGEPTFDASNDEAMKASAEKMAKNMSPEEMEKFEKAFLKLSMQSVLVAKDGDDALTLMKEKLNGKTAKQIIEMAEK

SEQ ID NO: 6007 - protein, 96 aa, Xenorhabdus bovienii
  Peptide sequence Name=Xb4151_4152.C417.gene38.pep
MYQSGYFVTAEIKARDNVNLNIVVKALKSLQEKTLLEPGCEIFSIQQSNENPAIFVMWEKFIDRDALKKHYEYEHTKYYFSLNFTDVVQIFTADTI

SEQ ID NO: 6008 - protein, 186 aa, Xenorhabdus bovienii
  Peptide sequence Name=Xb4151_4152.C417.gene39.pep
  Homolog annotation: Query=43..169bp; Hit=35..160bp; Blast score=103; Percent Identity=41.0; E value=1e-21; Homolog= gi|30262695|ref|NP _845072.1| conserved hypothetical protein [Bacillus anthracis str. Ames] gi|30257327|gb|AAP26558.1| conser
LLPLENFSWSLPSNTDHLPNSFIEIEKSFLRPAGFQFSAIPYQEKESHEYSAIRFGINGKTIVFRQAKTTPNKMGQFVTLWKRPTPDSEIMPFEQRDNIDFCMIATHSGNQKGIFLFNTHILIKKGIFSTQDKAGKRAIRIYPSWVSPISKQAIQTQKWQSSYFINLDNQITAFEQFHKLFSYRYY

SEQ ID NO: 6009 - protein, 61 aa, Xenorhabdus bovienii
  Peptide sequence Name=Xb4151_4152.C417.gene40.pep
  Homolog annotation: Query=1..59bp; Hit=1..59bp; Blast score=74; Percent Identity=66.0; E value=4e-13; Homolog= gi|21233683|ref|NP _639981.1| transposase [Proteus vulgaris] gi|21202867|dbj|BAB93583.1| transposase [Proteus vulgaris]
MKRKSPQKFTDNFKREAVNLVVEQSYTVPQAAETLGIPTKLLYTWRKHYVEQSKPSALTPR

SEQ ID NO: 6010 - protein, 91 aa, Xenorhabdus bovienii; identical to SEQ ID NO: 5467
  Peptide sequence Name=Xb4151_4152.C417.gene41.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 6011 - protein, 519 aa, Xenorhabdus bovienii
  Peptide sequence Name=Xb4151_4152.C418.gene1.pep
  Gene classification: Gene name=GshA; Function=Gamma-glutamylcysteine synthetase; Function class=H Coenzyme metabolism
  Homolog annotation: Query=1..517bp; Hit=1..518bp; Blast score=746; Percent Identity=68.0; E value=0; Homolog= gshA COG2918
LIPDVSKALSWLEANPTVLNGICRGIERETLRVTPDGHLAMTGHPEPLGASLTHKWITTDFAESLLEFITPVDSDIERTVAFLKDLHRYTAQNLGNEKMWPLSMPCFIDKEENITLAQYGTSNVGRFKTLYREGLKSRYGALMQTISGVHYNFSLPISFWQAWLGIKDAESGKEQISDGYFRLIRNYYRFGWVIPYLFGASPAICSSFLRGRETTLPFEETEKGTCYLPYATSLRMSDLGYTNKSQSDLNITFNNLHSYVEGLKKAIHKPSIEFAALGSKKDGKHLQLNTNVLQIENELYAPIRPKRVTQESESPSDALLRGGVEYIEVRSLDINPFTAIGVNEIQIRFLDLFLIWCALADAPEMSSKELDCCRQNWNKVILEGRKPGLNIGIGYGIEQQPLKTVGQELFKDLERVAEVLDTCSGTQYQSACKELVGMFENPSLTFSARVLGNMKAQGIVGFGLELATKYHRELLEEPYSILSEECFSVERHASIERQKSLEQQDSMDFEDYLKLHAGY

SEQ ID NO: 6012 - protein, 171 aa, Xenorhabdus bovienii
  Peptide sequence Name=Xb4151_4152.C418.gene2.pep
  Gene classification: Gene name=LuxS; Function=LuxS protein involved in autoinducer AI2 synthesis; Function class=T Signal transduction mechanisms
  Homolog annotation: Query=1..171bp; Hit=1..171bp; Blast score=306; Percent Identity=85.0; E value=4e-84; Homolog= luxS COG1854
MPLLDSFTVDHTRMEAPAVRVAKTMKTPHGDTITVFDLRFCVPNKEVMPEKGIHTLEHLFAGFMRNHLNGDGVEIIDISPMGCRTGFYMSLIGEPAELRVAESWKAAMADVLKVKDQNQIPELNIYQCGTYEMHSLQEAQDIARHILDADVRVNLNDELALPEDKLVELQV

SEQ ID NO: 6013 - protein, 90 aa, Xenorhabdus bovienii
  Peptide sequence Name=Xb4151_4152.C418.gene3.pep
MKLKYLSSGIIITALILTPAISAANEVESRYKQPIKTLSIQQENTTLPYILTTGDANGSNCGNGNNSSGKGGNGGKNGNGGGKGGGKGKA

SEQ ID NO: 6014 - protein, 135 aa, Xenorhabdus bovienii
  Peptide sequence Name=Xb4151_4152.C418.gene4.pep
MKLSTIIIMTSILSFPFSSLHAESENKLSVKTSDCNKLNGEPGQNGKNGIPNSNCKDGGKGGDGKNSGQSGGNGGNGGNGAPDGGNGGDGGDGASGGSDSNGDANGGNGGDGGDAGKGRKSGSNGGYDGQRGKNG

SEQ ID NO: 6015 - protein, 135 aa, Xenorhabdus bovienii
  Peptide sequence Name=Xb4151_4152.C418.gene5.pep
  Gene classification: Function=Predicted transposase; Function class=L DNA replication, recombination and repair
  Homolog annotation: Query=11..88bp; Hit=11..83bp; Blast score=58; Percent Identity=39.0; E value=2e-09; Homolog= sll1791 COG3293
MNKKSIAQWFISDELWQKIEPLLPPHKTHHPLGCHRRRVDNRAAMNAIFFVLRTGCQWNALNATGICSSSSAHRRFQEWVAGGVFERLWQNGLLASEKIGAIDWGKLALDGCLTKAPLAGSKKQAATQQTGENKA

SEQ ID NO: 6016 - protein, 133 aa, Xenorhabdus bovienii
  Peptide sequence Name=Xb4151_4152.C418.gene6.pep
  Homolog annotation: Query=1..127bp; Hit=94..223bp; Blast score=115; Percent Identity=46.0; E value=1e-25; Homolog= gi|21228333|ref|NP _634255.1| Transposase [Methanosarcina mazei Goe1] gi|20906799|gb|AAM31927.1| Transposase [Methanosarcina m
LLTDGQGLPLAIAVAPANIHDIRLVIATLDGLQTGRRGYGTKLHLDKAYEAEWLEKELKTRGYVPCIQSRKEEQDALAEQYDFKVNRWVVERTHSWLNRFRRILVRWEKRVENYEAMLHLACSLIVWNIILLG

SEQ ID NO: 6017 - protein, 252 aa, Xenorhabdus bovienii
  Peptide sequence Name=Xb4151_4152.C418.gene7.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=1..249bp; Hit=1..249bp; Blast score=275; Percent Identity=51.0; E value=3e-74; Homolog= VC1591 COG1028
MMRFENKVVVITGAGSGIGEATAKRFSQEGAIVVLVGRNVDKLNRVYSELSSSYARVIQADVSDQDSVKMMIDETIEHFGKIDILVNNAGLYIPSTILDTSLDDGKKVLAANLDGVIYCSHFALPHLLKSKGCIVNNASVSGIRADWGNAYYCTAKGAVVNLTRAMALDHGSQGIRVNAVCPSLIITPMTEYMSDDVLQKFDSRISMKRAGTPAEVASAIAFLASEDASFINGVNLPIDGGVTASNGQPNFS

SEQ ID NO: 6018 - protein, 260 aa, Xenorhabdus bovienii
  Peptide sequence Name=Xb4151_4152.C418.gene8.pep
  Gene classification: Gene name=FliR; Function=Flagellar biosynthesis/type III secretory pathway protein; Function class=N Cell motility and secretion
  Homolog annotation: Query=1..260bp; Hit=1..260bp; Blast score=203; Percent Identity=58.0; E value=1e-52; Homolog= ZfliR COG1684
MIPFDSEMLSRLVSDFFWPLVRLLALFSTAPIFSEKQTPIKVRMSLALAITFLLVPNIPSPQIPVFSVAGVWVMIQQVLIGVALGLTMQIAFAAIRHAGEILGLQMGLSFATFFDPTGGPNMPILARILNLLMMLMFLALDGHLWLLSILAGTFDSIPIQPMQLNPKGFLLLAQSAHLIFINGMMLAMPLITLLLVLNFALGMLNRMTPQLSVFVIGFPLTLTVGIFTLSLLFPMLAPFTERLMAEIFDRLAVIIGELVL

SEQ ID NO: 6019 - protein, 89 aa, Xenorhabdus bovienii
  Peptide sequence Name=Xb4151_4152.C418.gene9.pep
  Gene classification: Gene name=FliQ; Function=Flagellar biosynthesis/type III secretory pathway protein; Function class=N Cell motility and secretion
  Homolog annotation: Query=1..89bp; Hit=1..89bp; Blast score=75; Percent Identity=79.0; E value=1e-14; Homolog= fliQ COG1987
MTPESVMALGIEAMKVALALAAPLLLSALICGLVISLLQAATQINEMTLSFIPKILAVFVTIVIAGPWMLNLLLDYMRVLFSSIPTIIG

SEQ ID NO: 6020 - protein, 262 aa, Xenorhabdus bovienii
  Peptide sequence Name=Xb4151_4152.C418.gene10.pep
  Gene classification: Gene name=FliP; Function=Flagellar biosynthesis/type III secretory pathway protein; Function class=N Cell motility and secretion
  Homolog annotation: Query=16..261bp; Hit=3..244bp; Blast score=292; Percent Identity=75.0; E value=3e-79; Homolog= fliP COG1338
MTGTPMTGKKFVSLLRPVHLATLLMALLLPLFPMNAAAALPGIISQPMANGGQSWSLPVQTLVFITALGFIPAALLMMTSFTRIIIVLGLLRNALGTPSAPPNQIMIGLALFMTFFIMSPVFDKVYQDAYLPFSEDKISLEAALDKGAQPLRQFMLRQTRQTDLALFARLADQDAFETADSVPIRVLVPAFITSELKTAFQIGFTLFIPFLIIDLVVASVLMALGMMMVPPATISLPFKLMLFVLVDGWQLLLGSLAQSFYV

SEQ ID NO: 6021 - protein, 165 aa, Xenorhabdus bovienii
  Peptide sequence Name=Xb4151_4152.C418.gene11.pep
  Homolog annotation: Query=2..160bp; Hit=1..148bp; Blast score=159; Percent Identity=55.0; E value=1e-38; Homolog= Pa|Phot5-451c10.q1k _g23| 14529 - 14981 809 150 aa, chain +
MMANQPSLYASFQHGAASDAAPVNAKANTLSANTVKPAASPEPLPASQTLMQVSSALGGILLLIFVMTWLIRRLGLAPAKNKNHRLLNVKASCSLGPKERVVVLEIEDSWLVLGVTSQQINVLHQMPVPSDNAEKETALKTLPFSQMLKNTLQRKSKNDKDDDEK

SEQ ID NO: 6022 - protein, 135 aa, Xenorhabdus bovienii
  Peptide sequence Name=Xb4151_4152.C418.gene12.pep
  Gene classification: Gene name=FliN; Function=Flagellar motor switch/type III secretory pathway protein; Function class=N Cell motility and secretion
  Homolog annotation: Query=1..135bp; Hit=1..137bp; Blast score=171; Percent Identity=67.0; E value=3e-43; Homolog= fliN COG1886
MSDAKQPAEARLTEDMWAEALEQQAAQQTSDSGASIFENLEPQDALAQLSDIDLIMDIPVKLSVELGRTKMTIKQLLRLSQGSVVPLDGLAGEPLDILINGYLIAQGEVVVVSDKYGIRITDIITPSERMRRLSR

SEQ ID NO: 6023 - protein, 335 aa, Xenorhabdus bovienii
  Peptide sequence Name=Xb4151_4152.C418.gene13.pep
  Gene classification: Gene name=FliM; Function=Flagellar motor switch protein; Function class=N Cell motility and secretion
  Homolog annotation: Query=1..333bp; Hit=1..333bp; Blast score=537; Percent Identity=80.0; E value=1e-153; Homolog= fliM COG1868
MSDNILSQAEIDALLNGDSATADDIEPTASGESEIRPYDPNTQRRVVRERLQSLEIINERFARQFRMGLFNMLRRSPDITVGAIKIQPYHEFARNLAVPTNLNLVHLKPLRGTALFAFEPSLVYIAVDNLFGGDGRFPTKVEGREFTYTEQRVINRMLKLALDAYRDAWDSIFKIEVEYVRSEMQVKFTNITTSPNDIVVTTPFQVEIGALCGEFNICIPFAMIEPLRERLTNPPVENVRQEEGQWRESLVKQVQHSELELVANFVDIPLRLSKILQLRRGDVLPIERPERLIAHVDGVPVLTSQYGTLNGQYALRVEHLINPVLNALDEEKPNE

SEQ ID NO: 6024 - protein, 158 aa, Xenorhabdus bovienii
  Peptide sequence Name=Xb4151_4152.C418.gene14.pep
  Gene classification: Gene name=FliL; Function=Flagellar basal body -associated protein; Function class=N Cell motility and secretion
  Homolog annotation: Query=1..158bp; Hit=1..154bp; Blast score=150; Percent Identity=49.0; E value=7e-37; Homolog= fliL COG1580
MSDYSYERKRTNPIWIILLILIAVLSAAIGGYSWWTMKQPTKNSTEKAKVISTPVFMTLENFTVNLIDNEDHIDRVLYVGVTLRLPDEKTRQRFHDYLPEVRSRMLLLLSRQKAIDLAKNDGKMRLMADIKQTLHPTMIPGEPDQVVTDVLFTTFILR

SEQ ID NO: 6025 - protein, 454 aa, Xenorhabdus bovienii
  Peptide sequence Name=Xb4151_4152.C418.gene15.pep
  Gene classification: Gene name=FliK; Function=Flagellar hook-length control protein; Function class=N Cell motility and secretion
  Homolog annotation: Query=70..395bp; Hit=4..324bp; Blast score=115; Percent Identity=33.0; E value=1e-25; Homolog= fliK COG3144
MNLTLLPTDIKLTEKSQPTLNDPLTRNNSSEFGQHLNAEIASVRKTAIEADKNGLNNEKCSGDTPIEGELAPLLAVADNTVIRVDGKTLAGGKLLTETSTLESDIDFAVLKDEDLLSAEALVAAMPIQLAGLINAQSIPADGTENTDELLRGENTGAETLLGQHVKSGKNAKVDAALSTTDRTDHTKDGEQDKSIRSFATQETTLSNNAEQSTKTRPTLATAAGQVKLAINNKAEQHSASQNNGKELNQFQTAIQGIPALVAVAAETFQPESPAIPAASPLLPAGQQTTGQFQLNSTPTPLLSAHIGSEEWQQQLNQHVLFFNRNGLQQAELRLHPQELGALHIRMNVEDNQAQLHFVSAHQHVRTALEAALPGLRHALAENGIQLAQSSVGGDTQGNWQQEQTSNSPSHSHHSAKAQGQNSTAVTQMPTTHESAIKITPQQLASIRGGVDIFA

SEQ ID NO: 6026 - protein, 148 aa, Xenorhabdus bovienii
  Peptide sequence Name=Xb4151_4152.C418.gene16.pep
  Gene classification: Gene name=FliJ; Function=Flagellar biosynthesis chaperone; Function class=N Cell motility and secretion
  Homolog annotation: Query=1..145bp; Hit=1..145bp; Blast score=93; Percent Identity=48.0; E value=1e-19; Homolog= ZfliJ COG2882
MQQHSPLVTLRELAQDAAEKAAKQLAQIRQSHQQMEQQLTALTNYQDEYRTRLNDTLSSGMSSSTWQNYQQFMKTLEMAIEQHRLQLTQWKNRLEQAMSQWQDKQQRLNAFDTLQQRAEHNLKLHQNRMEQKQMDEYAQRSAQRRMKQ

SEQ ID NO: 6027 - protein, 454 aa, Xenorhabdus bovienii
  Peptide sequence Name=Xb4151_4152.C418.gene17.pep
  Gene classification: Gene name=FliI; Function=Flagellar biosynthesis/type III secretory pathway ATPase; Function class=N Cell motility and secretion
  Homolog annotation: Query=1..453bp; Hit=40..493bp; Blast score=653; Percent Identity=78.0; E value=0; Homolog= ZfliI COG1157
MTARLGRWLATLDSLEKRLEKTPRVRRYGRLTRATGLVLEATGIQMPLGATCLIERQNGSTVEEVESEVVGFNGEKLLLMPLEELEGIVPGARVYARSYGEDSAGGRRLPLGTELLGRVLDGSGRPLDGFPAPDTGYRALLTTPPINPLQRTPISDVLDVGVRAINSLLTVGRGQRMGLFAGSGVGKSVLLGMMARYTQADVIVVGLIGERGREVKDFIENILGVEGLARSVVVAAPADVSPLLRMQGASYATRIAEDFRDRGKHVLLIMDSLTRYSMAQREIALAIGEPPATKGYPPSVFAKLPALVERAGNGVSDGGSITAFYTVLTEGDDQQDPIADSARAILDGHIVLSRSLAESGHYPAIDIEASISRAMTSLIDNDHYRRVQQFKQLLASYQRNRDLINVGAYAAGSDPLLDRAIQLYPHMAQFLQQGMSERSEYDAACIQLQQLLPI

SEQ ID NO: 6028 - protein, 234 aa, Xenorhabdus bovienii
  Peptide sequence Name=Xb4151_4152.C418.gene18.pep
  Gene classification: Gene name=FliH; Function=Flagellar biosynthesis/type III secretory pathway protein; Function class=N Cell motility and secretion
  Homolog annotation: Query=10..232bp; Hit=14..233bp; Blast score=177; Percent Identity=49.0; E value=8e-45; Homolog= ZfliH COG1317
MSDKSNKGIWQPWQPNELTQWETLRAKLKPKDDESEPSEQERLLDQARMLDALKEQARQTGHEQGFTAGQAQGYEQGIQEGRQAGLEQGLQEARQQQQIVVEQWKALLEDFSHSLDGLDTVIASRLMQLSLTAAQHILGQPAVCDGTALLNQIREFIQQEPMFSGKPQLRVHPQNIPLVEQQLGEILALHGWRLIADNKLHPGGCKASADEGDLDASLATRWHEMCRLAASGEL

SEQ ID NO: 6029 - protein, 330 aa, Xenorhabdus bovienii
  Peptide sequence Name=Xb4151_4152.C418.gene19.pep
  Gene classification: Gene name=FliG; Function=Flagellar motor switch protein; Function class=N Cell motility and secretion
  Homolog annotation: Query=2..330bp; Hit=3..331bp; Blast score=455; Percent Identity=78.0; E value=1e-128; Homolog= fliG COG1536
MSLTGTERSAVMLMTLGEDQAAEVFKHLNSREVQQLSIAMAGMRQVSNQQLAEVMAEFEEDAGQYAALSINANDYLRSVLVKALGEERASSLLEDILESRDTTTGIETLNFMEPQMAADMIRDEHPQIIATILVHLNRGQAADILALFDDRLRNDVMLRIATFGGVQPSALAELTEVLNNLLDGQNLKRSKMGGVRTAAEIINLMKNQQEESVIEAVRTYDGELAQRIIDEMFLFENLIGVDARSIQRLLQEITTDSLLVALKGCDQALRDHFLNNMSQRAAEIMRDDLATRGPVRMSQVEAEQKSILLVVRRLAENGEIILNGGDDTYV

SEQ ID NO: 6030 - protein, 569 aa, Xenorhabdus bovienii
  Peptide sequence Name=Xb4151_4152.C418.gene20.pep
  Gene classification: Gene name=FliF; Function=Flagellar biosynthesis/type III secretory pathway lipoprotein; Function class =N Cell motility and secretion
  Homolog annotation: Query=19..568bp; Hit=14..550bp; Blast score=579; Percent Identity=59.0; E value=1e-165; Homolog= fliF COG1766
MSAATTDVENQNKGFSAIISRIKADPKVPLLVAGSAAIAIVVALFLWMRSPDYRVLYSNLSDKDGGEIVTQLTQMNIPYRFAENSSALMIPADKVHEARLKLAQQGLPKGGAVGYELLDKEKFGISQFSEQVNYNRAKEGELSRTIESLDPVESARVILSIPKPSLFVREQKSPTASVTVRLLQGRTLDEGQVNAIAHLVSSGVAGLPPSNVKIVDQSGRLLTQADANGLDLNTTQLKYIQEVEKRFQHRIETILTPVVGRGNVHAQVTAQLDFSRREQTAEEYKPNQPPNEAAVLSKQSSSSEQSGGSLVGGVPGALSNQPSAAPSAPIEKPNPDTKGKGDEKSDQNRNSTYNNYERLVNNSRNNRHDELINYQVGKTISHTQLQVGAVERLSVAVVINYATTQGENGPETKALTPEQLSQIEALTREAMGFSTKRGDSLNVVNTPFNDTAEVIEPLPFWQHPVLLEKTLELGRWLLLALVAWLLWRKMIVPQIAKKRAAEKAALNAQKNQQKQQAPESNAELDEKMRRKLARQRVNAEIQSQRIRELAEKDPRVVALVIRQWMSNEQ

SEQ ID NO: 6031 - protein, 103 aa, Xenorhabdus bovienii
  Peptide sequence Name=Xb4151_4152.C418.gene21.pep
  Gene classification: Gene name=FliE; Function=Flagellar hook-basal body protein; Function class=N Cell motility and secretion
  Homolog annotation: Query=2..103bp; Hit=3..104bp; Blast score=82; Percent Identity=51.0; E value=6e-17; Homolog= fliE COG1677
MSIQAIEGVLQQMKAQALQATNIANPMPVQGGFASHLTAAVEKINQTRLSATKLSQDFTLGVPGVELNDVMVNMQKSSISLQMGIQVRNKLVSAYHEIMNMQV

SEQ ID NO: 6032 - protein, 83 aa, Xenorhabdus bovienii
  Peptide sequence Name=Xb4151_4152.C418.gene22.pep
MDVSARKKLVSEYLCKLAGKQDLDDSVNIFETGLVNSLAAIQLISFLEKNFKIKVEIDDLDNANFSSIQAVCNFLDRKVAVNA

SEQ ID NO: 6033 - protein, 387 aa, Xenorhabdus bovienii
  Peptide sequence Name=Xb4151_4152.C418.gene23.pep
  Gene classification: Gene name=CaiA; Function=Acyl-CoA dehydrogenases; Function class=I Lipid metabolism
  Homolog annotation: Query=6..374bp; Hit=3..372bp; Blast score=189; Percent Identity=33.0; E value=4e-48; Homolog= VNG1482G COG1960
MLNRFLSPLQNEWLQVFEQFSATEIAPYADEWDLAEAIPATVVQKLAHNGWLGGLAKPENGGLGFDVTTFGLLNMAIGAGSGSLTGLLNVHAMVLKTIEDWGSQDQKQRFLAPLVKGEIIGAFAQTEVSAGGDSKNLSTQFAEDGNYLRANGQKSWITFAQIADLFLVFGKYQGLDTAVLVPKDTPGLKVTAKKNMLGFKSAYLAVLDFKDCRVPKTNIVGKPGFGQNLISNNALDYGRISVAWAALGIQQAALAASARRANSRITFDTLLADQGIIRGYLAEMSSSLLASQLICLSATKAKETRDEDALEQILQAKLFSSHEAGIAAAKAVQIHGGHGCDESNGISRLYRDAKILQVVEGSNELQKMLIGKAVCNRYRHNAAQTIP

SEQ ID NO: 6034 - protein, 542 aa, Xenorhabdus bovienii
  Peptide sequence Name=Xb4151_4152.C418.gene24.pep
  Gene classification: Gene name=EntF; Function=Non-ribosomal peptide synthetase modules and related proteins; Function class=Q Secondary metabolites biosynthesis, transport and catabolism
  Homolog annotation: Query=8..521bp; Hit=449..939bp; Blast score=267; Percent Identity=34.0; E value=2e-71; Homolog= PA3327_1 COG1020
MATGRFITDYFESTARDNQNPAIRWGKGNALSWGELYERAQRLAHYLVSERGICQGDCVAIGLERSPEFLVAAYAVLLAGGVYFPVEAKTPVARLASMFATAQCRIAFCNVAQGSLFTQAKPGLELIGREFLTEISTSHCLDHRCLNFHQSENTGKKARQRQATDPAYLIFTSGTTGIPKGVLVNHGAFINRLEWHQAHSEMTDSDIILQRTALTFDVSLWELFLPALNSASNYLLQPGLEAFPRGIVAALVSENITVVHFVPSLLKPVLQELQELQDDSVETPSLSALRRVYVSGESLPASLVTQFQKILASRCLLTNLYGPTEAAIDVSFYDCVETVPDAIPIGQPLTGCQLYILEPDSLTLKADSEEGEIAIGGICLAEGYYNRKDLTDKVFIFHPELQQRLYLTGDLGWHEKGRGFFCQGRKDTQVKLRGLRIELGEIEHHLLNYPAITEAVACVVEDEDQEQWLVAAIVAGERELNEQDIRQFLAAQVPAYMLPTRYWQARNLPRSGSGKLDRKTIAQNMRDLFFTDHHRGGNLSHE

SEQ ID NO: 6035 - protein, 1553 aa, Xenorhabdus bovienii
  Peptide sequence Name=Xb4151_4152.C418.gene25.pep
  Gene classification: Gene name=EntF; Function=Non-ribosomal peptide synthetase modules and related proteins; Function class=Q Secondary metabolites biosynthesis, transport and catabolism
  Homolog annotation: Query=1..1058bp; Hit=1..1009bp; Blast score=197; Percent Identity=23.0; E value=1e-49; Homolog= BS_ppsA_1 COG1020
MNKPTFELSRSQQAVFKMEAFHLSGYPFYLGGVARLSGNVSLDQLVRAAETVRNTQDVCHIGFVNDPLETVHPEVVGWEILWRGIRHNTPQAAVERVDFSRHPDPGSAFESWVERQLLVEEDLSLTPIRIFAVRFRQEQSGWFVKAHHAAVDGAALAILLERLADALVQRSGKVNSPLYSIHAERERDYENSRRMARDAAYWRTVFGEPNTYGDTASVSATKISCRYPIGDYRSSKPHTMRVRIALSEAQNEMLHKFSHRGGSVFRLFFAAVAYTQMVIEDGNGALLQAPMLNRWREDEKQSVGMAVAPVLIPVFREAGETVADCYRSLRKHLQKAVMHSRYAPGARWGDFASQEWRQIVPAFGVSYQTGVFQKTVSGAEIEIDHIQAVEALFATVHIHDRFEGGDFKIEADFRKVWSSDQCHAFLQTVIDYALEAAAEVMGQQETTRQTKEVNVQTDCLAEPIGVHLCDAFQRYADNWLFKQEAGEGVGNLTYRQGWQWICKFSAQLRDRRDRRFEHHPVVILGRRSPEMTLAYLTCLIENVTVVPVCPTTPLARLSTIVRNSGASLCIYTGTDQDLAEALNLPLLRASLDKDLCDAGLHPEIQPEFIHPEQARSQQTGSNPAYILYTSGSTGEPKGVVISPVALANYALAAKGEYASEAPFNAPLFTSFGFDLTQTAILIPVLSGGFIQAHEQDIRDNPELLRTLLSDEALTGVKCTPSHLSLLIEHSVRRRNPLTFIVGGENLSVALVNRALGFFPSGSRVINEYGPTEATVGCCIYLMNESSMSESDENDRASTVIAPIGKALGQAEMSIRDAWGQNMPRGFKGEIGIGGSVLADGYINNSAQTEAQFVCSADGQHRWYRTGDLGLQDEQGIFYCLGRIDDEFKVRGHRIHPAEIEKAVAEALADLGHDDDRRELKALKLAIDGYETVALCSSQSVPYDNSAFQKNLKNTIPDAWLPGLYCTVQPWPMNANGKVDMAALTVAAKAKLAAADPAQFRATDRQGQREPEAYSLPTWLDGEFLRPIWPETVDLTASFLAQGGDSIKAIRLVALLARQGVRVGASELLTSTALGAVLERVCSEKPDVAVTDSTVLEAPEANWVNYLPSVRWFQEHHFKYGERLQQGVVLELPSSICAGRINSAVAAVKARHKIFALRSNRSLSEFYFSSLEPEQHDGDMLLQDQVLAQDESLEGRLHRLQGEVCLENKPSVHEVVCDPAANKNYLIWVCHHLICDVHSWIFLLDELDQVLNESAVLLNVDKANVDKASAVVEQGAFLWGKWLRDHVSYAEPAPHDHAFYPPAAVPVTLALSVTGEDFRLMEQRYKAERTQLIAAALLEIVQDNGMLPEQPTVLFENHGRLFSEAETPAVWHAVMANSVGWFTGFNQLNLHVPSGYQSGFLPGFFLRTLKSQRYEDSPDWKEQLGLNGVRTRPLICINDIGFGLSEHGTWRHFNLVDSLSGGFRHPDEKSVADFDVLIYDDRESGSVFVELRLGIPEAGDVDAKRYLMQLNERLSDWNDALHRAQVEQALIPADFPLCQLSQPELDLIINGASA

SEQ ID NO: 6036 - protein, 414 aa, Xenorhabdus bovienii
  Peptide sequence Name=Xb4151_4152.C418.gene26.pep
  Gene classification: Gene name=FabD; Function=(acyl-carrier-protein) S-malonyltransferase; Function class=I Lipid metabolism
  Homolog annotation: Query=8..309bp; Hit=2..299bp; Blast score=114; Percent Identity=29.0; E value=2e-25; Homolog= BS_fabD COG0331
MRTVTDSAKTVFLFPGVGAQQPDMFAAFRTYPEYRACLEEVSELSQVDLFSVIHGEQRDTLKQVRIAQLALTATTVAIAGILRTRCGLVPEFMMGHSLGQYPALCAAGYLDLATLTKVVNLRSEVVEACARRYEQGDMCWVLHLPAEVVVQAVDKARKDDGIELYVSAIDAFDQVTVSGVMADIRRFAPRMEALGGLLYPLKIGGPFHSPLMMEAQEKLAALLDFLPDTDKQGTLLSRLVCNVSGAELPAEDLKPSILQHLTSPVQWLRSLQYAAQNGVTRYLEISPKTVLSYLNQRAGLPMQPLCEPDEIFTFAEALSTAESRLERFFRHCYFHLYSSRLPDIKDAAAIAQLRQIRDAVTQRIKGSHLPFEDCGFLHQHTQQWLEMIEGRGDTSLSVEKMKLQSLFDAVGRGV

SEQ ID NO: 6037 - protein, 1114 aa, Xenorhabdus bovienii
  Peptide sequence Name=Xb4151_4152.C418.gene27.pep
  Gene classification: Gene name=EntF; Function=Non-ribosomal peptide synthetase modules and related proteins; Function class=Q Secondary metabolites biosynthesis, transport and catabolism
  Homolog annotation: Query=13..1070bp; Hit=6..1043bp; Blast score=277; Percent Identity=25.0; E value=5e-74; Homolog= BS_srfAB_1 COG1020
MKQLNDSNKPNYIEELLQVTPQANGLLFHALKDGNSTYHIGVAFSLKADVSEEEILDVWYQIQQSQPALRAVFVWKGIRVPHQAVYALPRIPLEYIRVDSTTPEASLKQRDLDWLAQSKATPFELDAEVFRIICFHDIDAGILRIAFSFHHILMDGWSSSLLISLWLQGLRQQKIVPLAVRLYSQQLWKGLSQEELRLSREHWHRVFQYLPDGETSATTKLLAEPLFRSAEHTEIKHKAGEKITDEKVIANRIWDKERKAAIELICRCAGVTPASFIYLCWALVLAKLTFQKTVTFGCTFSGRGAALTQNVDRQPLGLFTNTVPLILTLDGKWRLEVALRAVFQALQQTHQHEKTPPLLIREETGIRDELYDSIVVIDNYPIDTELQNADCGAFLTDLHSEETTHFGLTLTVSGVDQWTVELSAGETFASDPDAVNRVFNAFESLAADLIKGSVDVRIEDLVLKLNPDGAEEAALVMGEHNAQTPDINALLLCIYQRLNQSPQEISLIEGQHRISNRELLRGVFALQERLRGAGFVPGDRVAVHLEKGLLSTQAILAILFSGGSYFCINPKDPRQRKKNLLALANCGIVLCGASLNGELDADIGRYLLLDIETEITWPESTGEPTLWRNRRSEDEFYFIFTSGTTGAPKGISIRNESVANLLDWFVRETHLTPADRVLGLTDLNFDPSVEDLFGSLVAGATLIYPSSNVLLERQTFIDLLRDESITLINFIPGAIAQLIQGAPFFPAMRLWIFGGEELPQWLRDDLLRQGYAVSNHYGPSETTVDCLTARQSLSADVSIGWPIQNVIACCADVFGKPLPAGIRGELWIGGQAVAHGYATNPVESDKYFVKYSKQAFYRTGDAVTFSHQSGFKYLGRIDDQVKVNGVRIEPRELERAVETLEEVKACCLLSATGREGKRQWRLFIDSCESSAMLESRVREHIRRHFPESWIPALIVVIDGFERTITGKIDRQRLLEREMQRLPIQTALDHAPLTDPVEAKVQAVWSAVLETPVVDANVNFFDAGGDSIKIIALQSQMQRAFNQKIGVAVLFEHPTITAFANWIKQSNLSPENEEAEVMLSDSGKQLSQENTLSSARSGKNRLADRRRKVKGSSVS

SEQ ID NO: 6038 - protein, 2165 aa, Xenorhabdus bovienii
  Peptide sequence Name=Xb4151_4152.C418.gene28.pep
  Gene classification: Function=Polyketide synthase modules and related proteins; Function class=Q Secondary metabolites biosynthesis, transport and catabolism
  Homolog annotation: Query=5..815bp; Hit=6..811bp; Blast score=442; Percent Identity=34.0; E value=1e-123; Homolog= mlr9053_1 COG3321
MKREYTGSEVAIIGISCRFPQSPDWQSFWRNLLAGHELVSFFSREELLAAGAPSEIIDLPNYVPAKASLEDAECFDYEFFGYSQREARKMDPQLRVLHEVSFNAFLDAGLPVGESMLKAGVFIGSTLNLARLEQFAGASQDISEMFDVGNYNDPASFAAQIAYRMKLNGPAVHVQSACSTSLSAVHLACKALLAGECEMALAGGACITDPVAGGYLHQDGMILSPDGHCKTFSDDGKGTVNGNGVAVVLLKLLEDALADGDPIHAVIVESGMNNDGDRKVSFEAPSVQGQAEVISQVYRLADIPFSSLGMIEAHGTATVLGDPIEIQALNNVARELLSPDELQQFRCAVGSVKSNMGHLDAAAGIAGLIKAALSVRFGKIPPSLHFNKPNPHLDLDNTPFWVPTQITDWPAKQAIRRAGVSSFGIGGTNVHVLLEQPPETVDKDASHRKSAQILPLSAKSPSALARLAESYSIHLSLINQGFAEEETSSLEVIARQLQENRTEYPCRAAFVANHRDDWKQQLDNWTLMDGAYASMAELIWLFPGQGSQSPAMGLRLAAEYPEFGDIYLGLLDKAAALLSVQKAVLIDKQTLIDSIKRPEQLSTLYLQPILYAVQAALGVWLQRLGCKPTALLGFSLGEFAAAAIAGVFSIEEGMELVVARAELMDSMPKGAVFAASRKSKNSKEDFDGDFPAMLWCISELSPGTWTLATEEGLVADAENWLTQHGFAFKRVAVSHAFHTPMIEPAAKAFGELLKSYDLQPAQCAVYSTALGRKIEADEMRDPQYWVNQMLSPVQLGAALKQMAQEHPASLFAQIGVGMDLLQHTRKWLHLNGERWVPTLGSGGADHEVNSTLQFIARVWIQGGGIEWNRIHPQTSIERTITKTHLPGHAFERRVCLPQAITKAAQAISSLFFGSHYYGLEWEKINPSTPENAAQSGDTPTTWIICPQVQERERRLAETLALNNRQLTFIECANWRGSDANLYAELESWLLQQGLAVSAAMDIIVTGLLDDLDTRQAQFWAFWLPTVLARWSATQRFAPKIRLFFPTTEMAAWSGSETLNAEKNQLLGSLLILPEEYPNITALCVDLENSEVENVARGLQPWINQDWHGGQFYCFRRNDFWQRSVTSQVQKQPLTHPLPDISRNSWVLVTGANGGMGAAIAEHLAQVYHCNLLLLVRKSLPKKRDWLTEIESNGSHAEFLRWVLSLEAKGSRIELLQADLGDGESLAQAFAPVFQMVARGEGIDYVFHTAGRGEGAMLQMRSEAESIATLAPKVTGTRFLCDNLSRLGNPALLLFSSLGNLLPKEKIGQIAYVAANAGLEAYADQIRSKGGKALAIAWDDWAESGMATRSAQQLDRALKNPAQDTAPDAPIWRRRLCAKDDWWLDEHRIDTETAVMPAMGMVVLVHHALIEWRTVAAEAFSLQEIAIERPLVVANDAELDVAVIFADDLNSFELFSGNGKFSPEIWLKHASGKIKYRDGHTARSGETVSLKTLPSQPPFLNLFSAKDNIGVSPKGALTFGPRWRNVIAVDQTGVNEVLNLLQLPSAYRGEAETSGLHVALLDTATLIASPEHEDGQFAPVSIGAFTQFAPMGDRVKSHVQIQDLGANKLLQVNIYSEEDNLLVTISDLLLVDASAALQHTVMRLNAREAGSVDFSFRSQSETRKEPGPLEVEIQVKAAGLNFKDVLIALGVLPAPADPTMTFGQEAAGIVTRVGRQVNGIRVGDRVMCAGHSCLAEHVIMPQRVVAPIPQTLGFQQAAGIPVAFTTAWIALKHAANLKKGERILIHSAAGGVGMAAMQIALYLGAEVWVTAGSEEKRRLLREMGAQGVANSRTREFGDSFRRDLGERPFDVILNALAGELLEESLSLLAPQGRFLELGLRDILQNWSLGLSIFAEGGSFHAVQAGAEHPAYQEAWAEVAALLEDEILKPLPTKVYPAKEITEAFQFMAQGRHIGKIVIAMEERSKTLSFVEKLKAEGLSNLEGTQIAVAMAALVGQTKLPYIAVSKLPIGSVLEKQRHTQQMLFSSGSTRNVPAAIDGDADGSLKGANADDLLQAMRTILEGFLGVDDLDVDASFFSLGATSLDLIQFAKKLEQRLERDIPVALLFKAASLRELSKELAPEQSVAEEPQMPQQELGDKRRTLQARRKLRGVVSGQERSSQGSEDNE

SEQ ID NO: 6039 - protein, 1061 aa, Xenorhabdus bovienii
  Peptide sequence Name=Xb4151_4152.C418.gene29.pep
  Gene classification: Gene name=MdlB; Function=ABC-type multidrug/protein/lipid transport system, ATPase component; Function class=Q Secondary metabolites biosynthesis, transport and catabolism
  Homolog annotation: Query=542..1058bp; Hit=18..533bp; Blast score =202; Percent Identity=30.0; E value=1e-51; Homolog= yojI COG1132
MNNTGLIRIGIFLVAIYLALVGSVFADTIDQKQIISQKQDSDLEQIVSELSRRWDIEQVPTGGLSVIVGDKVRTWRLGKEEAGTFELASSSKAFTGLLIALLEQEGVLNQQDAITRWIPELAEHPEMGYSAVLLKNLLFHTSGISGDTIDLLQPYDAPDALAKLPVLLQKIPLAYPVGAKEEYATLNYSLLGLAAERATGKSFATLMREKIFLPLGMKNTTVEGDRSVEGSAAASARIPGYKISFTRARPYDAPRYLQNTPAGYVFSTPQDMGIWLQFLLHRQPLSNNKGDGDEQRSALYAALEQAKRPYGGNGDAGYAYGWDVKTDITTSWSHPGQNPNATAYVAFDPKAGVAVSLLGNSNSPQVIQLGQAIFEHLRGASAKGLPENFPVDDGDWISTVAAVIFWLGGILLFVAVMYKRENRDKGGRDGASVLASRVETAIIQESFVRSAESIAEKPVWRAFLSRLIVQNVALVSVLAITPPLLLGLSWTNLRVWGPLSLPVAAVGLLFLVNAVSLFFFLLTQRSGRYTSKTFSSLMIAKVVGLTVISGLLNSALVLFIIQAIDSPPAYFLYSAILLFSCIYFYISARKAAEQQIMRFGHAFVQGWRMEIIRKLLASDYKNIEQLSSGKIQSVVGENSQELAKSVLAFVPFFANLLTIIFLFTYLMVFKSPVATSVLLACALPMIVLYYCISERANRIMPQALSTRSEFMDTVEDLQKGYKGLRREAVKRSFYRHAQGVSDRFKALRIQYDLGFLNAFFIGESLLTILLVAVALMFPLLIPHFDGNVSKEYLIILLYLIGPLNAVMSAMPELIRLKSLMNNMVMFSQSIQADSPAEVMPKIQDVKTLELSAVYFHYPATGGECFGVGPISLKAESGKSYFLTGGNGSGKSTLAMILAGLYAPERGTVRINGEEASQHQLLEQTRAIFSDNWLFKRVYDPALLPLREAVNQNIALLGLTQKATLLSDGAFDNIKLSTGQRKRLSLAMLLADPSPLVVLDEWAADQDPRSKARFYKEWLPMLKAQNRIVFVVTHDDEYFSEADVLITMKNGQLIELKGESYA

SEQ ID NO: 6040 - protein, 2179 aa, Xenorhabdus bovienii
  Peptide sequence Name=Xb4151_4152.C418.gene30.pep
  Gene classification: Gene name=EntF; Function=Non-ribosomal peptide synthetase modules and related proteins; Function class=Q Secondary metabolites biosynthesis, transport and catabolism
  Homolog annotation: Query=661..1954bp; Hit=33..1282bp; Blast score =548; Percent Identity=33.0; E value=1e-155; Homolog= PA2402_1 COG1020
MLNQLLSENHFDHSNQSRAPKDTILNCCIHELFERQVEKTPDAVAVRFGEQSLSYAELNRRANQLARFLRDDLHVGPDTLVGVCVERSIEMVVALLAVLKAGGAYVPLDPHYPAERLDYMLHDAAPRALLSHGAVPAGVRALLDQYAMSTNVSVIDLEADVSQWSGQNSDNLHPADNGLTSSHLAYVIYTSGSTGRPKGVMNQHVGVVNRLVWMQKAYRLNASDAVLQKTPFSFDVSVWEFFWPLMYGARLVVAKPEGHKDPAYLSALIQEHRITTLHFVPSMLSAFLDQAPSEVDDCLQRVFCSGEALPARSMHRFRERFAKVELHNLYGPTEAAIDVTAWNCCLDETDSLIPENVIPIGKPIDNIQIYILDADGQPCPVGVAGELHIAGVGVARGYLNQPELTAEKFIKNPFSPALNGVMYRTGDLARYLPSGDIEYLGRNDFQVKLRGFRIELGEIEARLMKHPAVRDAVVLAQGESAEDKRLVGFVIAAERALQRQSRESVKESIQRLINDTVPDYMRLAAIVIVSGFPLSASGKIDRKSFPVITFDEFTAQDVEPPKNALEQTLVEVWSELLGVKNIGRNAHFFNLGGHSLLSLKMVLALRRRGLFVDGYTLYQYPVLSELATQLQVSDPQETRSDMAECSMVEASAWAQLSQKEIDVLTAAIPGGLTNIQDIYPLGALQQGMLYHYLTNLAGDPYVLWQVVRFRNADLLHAYVNALRGTIARHDTFRVSVHYKGLSQPVQVVWRDAELTVEELKPTMDCDDPLVILKQHCDPAMLRFDITKAPLQRCLYCYDPKRDEWVLLHLIHHMTVDHTTVEKMQQEIEAQLSSEPPAPIVPISFRQVNADLVRATGAEAQKAFFDAMLRDYEPTPAPFGAGEYLGGNAVVVEAWRPLQERLCSQIRQQAKAHGVSAAAVFHLAWAKVIACLTGCNDVVFGTVLLGRMFAGENAENIMGPFINTLPIRIRLDNLAVFECLWNAQDTLTQLVRHEQASLALAQKSVQTQGTAPLFTSLLNYRHSEVRNIPSADPFQAMNPSSINGVSYSGSMERTHYPVSVNIDDFTNDFVINAQAEQGLDPELICDYLQTALQEIVTALESAPERRIGRIHVLPAQEKDKLLWQWNQTESDFPRQTCLHTLIEDQVRRTPDAIAVVFEDQVLSYVQLNQKANQLARFLREDLHVGPDTLVGVCIERSIEMVVALLAVLKAGGAYVPLDPHYPAERLDYMLHDAAPRALLSHGAVPAGVRALLEKYAMSANISVIDLKADALQWSGQKADDLHPTDSGLTSSHLAYVIYTSGSTGRPKGVMNQHVGVVNRLVWMQKAYRLNANDAVLQKTPFSFDVSVWEFFWPLMYGARLVVAKPEGHKDPAYLSALIQEHRITTLHFVPSMLSAFLDQAPPEVGDCLQRVFCSGEALPARSVHRFRERFAKVELHNLYGPTEAAIDVTAWNCCLDETDSLIPENVIPIGKPIDNIQLYILNAYGQPCPVGVAGELHIAGVGVARGYLNQPELTAEKFIRDPFSPALNGVMYRTGDLARYLPGGDIEYLGRNDFQVKLRGFRIELGEVEAALLSHDSVKECVVLVREDVPGDARLVAYATPASGYVDQVPEERSQTLRMHLQTNLPLFMVPSHLLWLDAFPLTANGKLDRKALPSPADAPMGQTITVQPPQEGTETQLAQLWAELLNLNPNAIGRQSHFFEAGGHSLLAVALMARIQQAFSVSLLLSAIVEHLDLASQAELIETEIEKGNAARENGERAHLTEPIEPTPVEQIRALPTQKAIYKAVKLNPQDLSNNSFLALSFDDDVEPDLKQLRNLLQSVLSRHESLRAQFVLTGDELYLRPAKRFLFRLEKRQTLGALEEDLRDFIRPFSLEDGMNVRGRWVVDGRHPLLLLDFSHACIDGSGLMQILSELATENDPAPSGTRLATYSELFYSREFTTLRQEHADFWRTQLQEWSPLVHAQDTESVTHTCLITLDTGLKGQIETLTSRLKISVPEFFMAAFLLFKARLDYQPAQRNPHDQLTSMIFHGRDRLDQQTVIVPLMSVLPVRVRLRGETMEPEMLHEVSIAVRAACRHYLFDAEELTVRYPALAKQVLSPTSFFGYFQKEGFDGRIAGRLCRQLETPNVAGGQSHWNLTCEIAEHTTGFDVHLEALSFSTGSDAGNWEALFKSIVQSALSVG

SEQ ID NO: 6041 - protein, 2180 aa, Xenorhabdus bovienii
  Peptide sequence Name=Xb4151_4152.C418.gene31.pep
  Gene classification: Gene name=EntF; Function=Non-ribosomal peptide synthetase modules and related proteins; Function class=Q Secondary metabolites biosynthesis, transport and catabolism
  Homolog annotation: Query=653..1933bp; Hit=17..1316bp; Blast score =266; Percent Identity=25.0; E value=2e-70; Homolog= PA2400 COG1020
MHTNDPIVMNARKQALKDYVRQQLDAGYQGCPFFVSRLAASGMNTEVVTTSFTLAEPLNSRIFTMAASPLHRLSLFSACIKYLAFLHSREPEGSLIWAIGAQDRSGNGTPAVLSNDPPAGVYLVPAKWHLTETELTQPVKRLFGEELAQWKRIAALTSGMPLQSASSVMSQSPQVLVGYSETQTPFEGTDTAHYSLSIWIEACPQKTCLHMRFDSQRVDAELTSLLMDRLTLLLNSMVFEPNSPLASMPWMPVQERERIAALSAPVPAQPLRYKNVEQAMTASMRDRAETQFLEVGDQTVNFKQLEQYTAILLTDPNLPQWESLGDCVLIVGAKGVEITLAAMACMRIGKPFCLQSHSAPESQLLDIIELHNTKVVLLQESCGEMAELFRAQGCQVVMLPYYVPDAPVRLTHRTEMSVLAALLRKGEAVNPDDPLCVVMTSGSEGKPKGCINTHKALLNLSAEKQALYHTAGSRVASVANHTFDYFVLECVQCLTQDIVLVMPPEEARSDAGKCVRFLRESRIDLLFTTTVLAEYIMEQGDIPNLRQLYFGGESLRTFQKNNYELFNVYGPSETGVLTTYLSIVRNDQKVTIGKPFGGCQCVVVFPDTLEPCPIGVSGELLIGGAGVGAGYINRPDLTEKAFIDLDTEWLKGKYYRSGDLCCWNVQGEIEIEGRRDRQLKVNGFRIELDAIEKNILDLPTVAQTAVIGIEDQRGHTHVGAFIVTTDSGVTEQNVREALLSRMPAYMVPSQVILVAELPLTRNGKLNRQGLKQAFGKAMNGKVVRPDGATQEWLAACWARYLELDVDTLSVDKSFFSLGGHSLRAARVLAEIQHEFGQAVSLLEFFQNDTIEALAKTIDARRTGGDSMVTESFSNLLETAPQFAVDGRGPLSAQEVRLYAEYRLHPESQAYILALEIPLSHDLFPDAVKQALQALIDRHDILRTRYRIDSEGIPYAEILPSLPVDRVLIDDRNQWLQMRTQAFELGEAPLLRGCLQEINTEHACLQLQIHHILVDKPSLEILQREFQQLLAHESLSCVALSYRHYAMALADARQRPVWTQAEAFWVDYLEGLEFDPFGHGAVDAGGKVKTLSWHLSAADMAAVKHLCGAVNVTPAMFFLSVWGLTVAREGGSHAFSISVANAFRPKNALETVGMFVSLSPCAFRFDKPTATFDRFIKKLADEQWRMVDQLFFPVEEAFALLSRDPRMFGSNPLLNVAYSYLDAADHEAPDADDLSLEAHGPLNLTVSHRTQGIQKTQSCRLTLEYQIEAFPDSQIEAIATGYQEILRQILSHAPSILQIDELMVSADAVKKAFRPVQRRASYRQIDAMLINGFLTLTDRPAVIDEEGIMTWEEFAALTAAYMQVLNQGTIRRALILGRQGRQLQAFLAACFLTHTTYLALETGTPEERINEVIRHAEPDLVIMHGAEIDAAAVSEMGVQLQDNNLLAPVSINWQGFHSLKSCDDNPIAWILYSSGTTGKPKGICVAAHTAAQYVDSLVNKLGLKQELQTTPQGLRIVQQFSPSFDGYLEEVLLAWALQGTSVVADRYSLLDERKVRAFLLRYCPDVISAAPALFSAWNRMPELAPLPKICISGGDFLAAGDISQLLERTQIWNSYGPTETCIAVSMVNCTQLASGAALSIGEPFEHAAFAVIDQDGGRLRIGQWGELVIYGDFERHGYLNDPALTASKFGRDVQGTFFRTGDLAMADKNGLFYLRGRMDDSCKVRGNFIGLGELENRAGQYPDVIAAGAAVAFAGTPEACLVLAIEGKENIQSDLQQYLARHYPRSHLPSAIFPLASLPRTEIGKLDRQRIVARFLEWRENTHQTQEEQVATMSEGVQKLIACWRTCLGYKGELTQDSDFFLVSGSSLSAVRLANQLETLFNVTFSPVDVFRNATIGGQWSLINARQGADDTMPVKLLQERFLNADDPNIAKLILLPPALGGLIELQALADKLAGRVTVSVLTTEPRDVENLSVQEFKQALLDALTSHIKAQGIHPSRSLWLGGYSLGAEMLVALLAQQAELSQPSQHFSQYIDKLVFLDPNLRTDIFAGDELYAEFVEFFRDVNRLAFDCAGFDADMDVETLRRQFPSLYQEWRYYQLQHQILENKTFYERILALPSENLPVAMFFSDDADEAGIDGLTQKMKGCCTVRRKSGDHAEFVKQLTSDDFIDLEQGKTLCVQK

SEQ ID NO: 6042 - protein, 1669 aa, Xenorhabdus bovienii
  Peptide sequence Name=Xb4151_4152.C418.gene32.pep
  Gene classification: Function=Polyketide synthase modules and related proteins; Function class=Q Secondary metabolites biosynthesis, transport and catabolism
  Homolog annotation: Query=11..502bp; Hit=8..497bp; Blast score=374; Percent Identity=42.0; E value=1e-103; Homolog= Rv2935_1 COG3321
MRTEIREDLDIAVIGLSGRFPGAGNYSEFWRNLLMGVDGISRFTAEELLKAGHDAGKIRHKDFVPVNGVLEGAQYFDAEFFGYSQAEAALLDPQTRLMMECVWHALENAGVDPDKRSRNIGLFLGARSSVQWTMQAMLSEQVENTGGFLASQLSNKDAMSTLISWKLGLEGPSFTLQTACSTSLVSVHQAVQSLLSGECDFAVAGGVSLLLPQQNGHTYQDGMLFSKDGKTRAFDAEATGSVFGSGLGAVVLRRAGDAIADNDPIWAILKGSAINNDGARKVGYTAPSVKGQAEVIRSALQMAEVDAADLDFIECHGTATSLGDSIEFMALREVFNERGSSASAEETLNQCALGTVKTNIGHLDSAAGIAGFIKMVLALRHGMIPPTLHFQRPNPQLEFEHSPFYVNTRAELWPSNQGKLRTGGVSSFGIGGTNAHMVLQQYVLPPQTMKTSGGDKVPGVCFFPFSAKNSTSLARQLESVSQWLVSQPDPDLSALSHTLGKRHSFPYRAVFAADSKFALMQQIERYLAPDEQTESLALVRQVLETTSPDSLSENFAAISDWVSGQTKELEKCLFSPGNGQPLMDVPGYAFIREEHGIGHITDKIWSQIADIVAAPDGKDLSKNTAGLLTPFWKPLRLPAQPMSEVKPDTVLLVDQTLASLASGLADNSQIEVVSLDMLCPVRMRNVLAKLSSGSQITGSQKNPSLVLSLAFPTEGFSFAPASLQILSELGRALAETDFSVFTSVHIYLIAPAFSMTGDNGYLAESVLTVAALKALALVIPQEIPGVSCAFLSIQNPSTDWTPAALTRLLQTPLHGPLKLNDEGLFVEDFRCPDAEENDVLDAAYFSGKTYVITGAGGRMAKAMARVIARRFQGRLALISRQPADSPAMRSLQEELKDAGAEAVEIFPYALESEADALALFESIRRRFGEINVVLHAAGVTDGDSFSPLVQLNADHYCTQLAPKAQVAAVLANVFESIPVEYCFVTSSMSAFFGGIAHAPYAAANLFLDGWGQMQNRRLTGTRWVVVNWETVHFDEDRRADALVWGANEVALSGAEFPALFERSLREYDHENQKIFSAGQFMDRLYAWGGRRAAKIDHRPQAGGNVKLKPRPKTLTSVYQSPANEMQKEIAAIWSSILGIDGIGIDDRFMELGGDSLKTIVMAEKVYKKLGKRVSIQDFFSQPTLREIERQLVNDQNASHPILPAIDPSEPIIASADQELLYIHQTTFTDASYNMPMAFQCPAAISAIAIATAIEQVADRHPVLKCLFKRQGTNLMMLPQLDAKVSLAIFEAEPAQEENQARLEQFAKAPFDLHTELPMRAMMIKGTDAGQFHQVLIVVHHIVCDAVSLGILAHDFQNRLEERPLPEPEYSFAAYRRYRLEFENEDQVRKNKAYWLANLLPLPASLVLPTVDDYDGHIDADSHRGVTRVKSLSAQTSEEIRCFCRDLGLPVFTFFLGTFGVLMTKIARAESFLLGVPVTGRTQPEELALVGYLVNMLALKIEPDTDFAMTDYLLELNAQWSESIPYQTYPMSALLDDLSTEHDFQNRQGKHPLFDVVFGYLPLSLSGADESAWRPGFSRLELTSDTAKFDLVMEISETQETFDCTIQFRERMFSEAIIMAVFEYFFALIEEVLTDPDTEIQELLKNLSGEPTPEMSAQTSGQNVDSEFNF

SEQ ID NO: 6043 - protein, 365 aa, Xenorhabdus bovienii
  Peptide sequence Name=Xb4151_4152.C418.gene33.pep
  Homolog annotation: Query=216..362bp; Hit=7..149bp; Blast score=241; Percent Identity=79.0; E value=1e-62; Homolog= Pa|Phot2-44g08.q1ka _g200| 144676 - 145164 843 162 aa, chain - [Photorhabdus asymbiotica]
MSLFGNTWNALGDVAMWAFEEMSIYRRRQGTQREVGNNDALAHFEAAEYRKVEKVSDISVAEFSERYLMKKEPVIVTDGLRGWRAKQIWSFDYFCQEFGDMSVRLQDAGFKPKDHVELRTYLREIASLPAVELGEMGDNLSYLRYTYDSFFKHLLFTWGFGHRVKTNSFSFLAFQRIQEHWRRPYFLPDGGYKIPWVQIGSLHPNKRMCQDWGLYFSAPGACTRLHVDGMRTNAVLCQVAGRKAGWIFSASLENVVRDAAESRIALSPVASQISGRKNQADSPHSKDCIWQFDLLPGEIMLIPKGLAHEVHTLSPSISLTYNFVTNSEYRDYFNFKRERGHGWIANAPIAAVPEFARIYQRNQRL

SEQ ID NO: 6044 - protein, 242 aa, Xenorhabdus bovienii
  Peptide sequence Name=Xb4151_4152.C418.gene34.pep
  Homolog annotation: Query=1..242bp; Hit=1..242bp; Blast score=403; Percent Identity=83.0; E value=1e-111; Homolog= Pa|Phot2-44g08.q1ka _g198| 143119 - 143847 1475 242 aa, chain - [Photorhabdus asymbiotica]
MPLFSQTITDFWQTPFLNGDVLYSDGTFTVTVNPDLNEDRRVMVLETSDGRVMAVLTPALADKAGLYQQQELSESIFRQKLTEAGVTLHGADYIFYFSEVDKNVLLQESPAGVLRQLTEQDEAVFSEFESSSSEQDLDDAYVELDHWAVFGSFEQHRLVSAASMYPWENAQIADLGVLTLTSFRGKGHASKVVRSISQYACHQGYEPQYRCQLDNYASTSLAKAAGLTLFGKWEVISPDSTE

SEQ ID NO: 6045 - protein, 283 aa, Xenorhabdus bovienii
  Peptide sequence Name=Xb4151_4152.C418.gene35.pep
  Gene classification: Gene name=FadB; Function=3-Hydroxyacyl-CoA dehydrogenase; Function class=I Lipid metabolism
  Homolog annotation: Query=4..283bp; Hit=1..278bp; Blast score=213; Percent Identity=42.0; E value=2e-55; Homolog= DR1068 COG1250
MSKLKIAVVGGGNIGSSLAFDCALHGHDVVVIEKDVLACEQSRERVTETAGYAPLFSPLAKGKTTEEILLNIVWSQDLQAVSDCGFVVENITENIELKQALYARMSEFIAPHAVLAANTSCIPITKLGSFHKTPSQVIGVHFMNPVYLKHTVEVIVGLNTSEQTKARCLEILGMLGKNAVVVKDGPGFVSNRISHLFMNEAAFTIQDGVAQPADVDAIFKQCFGHKMGPLETADLIGIDTVVNSLDVLYQMFQDSKYRVCPLMRTMVDAGRLGRKSGRGFYTY

SEQ ID NO: 6046 - protein, 62 aa, Xenorhabdus bovienii
  Peptide sequence Name=Xb4151_4152.C418.gene36.pep
MTTLCKKLCNLTWDRFKPLLEVLFSRYLRDSVMAFLASNNRQSNRQCRVNGGKLAKVVLPVI

SEQ ID NO: 6047 - protein, 231 aa, Xenorhabdus bovienii
  Peptide sequence Name=Xb4151_4152.C418.gene37.pep
  Gene classification: Function=Putative transposase; Function class=L DNA replication, recombination and repair
  Homolog annotation: Query=3..165bp; Hit=23..185bp; Blast score=231; Percent Identity=70.0; E value=4e-61; Homolog= XF2303 COG3316
MSLIRNAFKRLHYPVDIMAQCVRWYLAYALSLRNLEEMMAERGIEVDHATIHRWVLRLVPLLGKAFRPRKKPVGSRWRMDETYIKVKGQWKYLYRAVDTDGQTVDFLLTARRDAMAAQRFFRKAIRLHGRPAVVTIDKSGANTAALTLLNAEGSPQQGIEIRQNKYLNNLVEQDHRNIKRRIRQMLGFKSFRRAQTLLAGIELIHMIRKGQYQHPQSDGLSPAEQFYLLAA

SEQ ID NO: 6048 - protein, 91 aa, Xenorhabdus bovienii
  Peptide sequence Name=Xb4151_4152.C418.gene38.pep
  Gene classification: Function=Transposase; Function class=L DNA replication, recombination and repair
  Homolog annotation: Query=1..87bp; Hit=1..87bp; Blast score=77; Percent Identity=44.0; E value=3e-15; Homolog= insA_g5 COG3677
MAKVEVDCRYCHKSEDVKGHGKGHRGYPRYRCYACSKVFQLAYTYQACKPGVKEQIIDMAMNNSGIRDTARVLKVATATVMKTLKNSTPGT

SEQ ID NO: 6049 - protein, 101 aa, Xenorhabdus bovienii
  Peptide sequence Name=Xb4151_4152.C418.gene39.pep
  Gene classification: Gene name=InsB; Function=Insertion element IS1 protein InsB, putative transposase; Function class=L DNA replication, recombination and repair
  Homolog annotation: Query=1..101bp; Hit=27..128bp; Blast score=76; Percent Identity=38.0; E value=4e-15; Homolog= insB_g3 COG1662
VTTLPLDGDDIHLICEVDEQGSFVGSQKNQRWLWYAWEPRMKRIVAHTFGDRSRKTWEKLLALLSPINIRFYCTDDYAVYDCLPEEAHLTGKIFTQRMVMY

SEQ ID NO: 6050 - protein, 91 aa, Xenorhabdus bovienii
  Peptide sequence Name=Xb4151_4152.C418.gene40.pep
  Gene classification: Function=Transposase; Function class=L DNA replication, recombination and repair
  Homolog annotation: Query=1..87bp; Hit=1..87bp; Blast score=75; Percent Identity=44.0; E value=9e-15; Homolog= insA_g5 COG3677
MAKVEIDCRYCHKSEDVKGQGKGHRGYPRYRCYACSKVFQLAYTYQACKPGVKEQTIDMAMNNSGIRDTARVLKVATATVMKTLKNSTPGT

SEQ ID NO: 6051 - protein, 140 aa, Xenorhabdus bovienii
  Peptide sequence Name=Xb4151_4152.C418.gene41.pep
  Gene classification: Gene name=InsB; Function=Insertion element IS1 protein InsB, putative transposase; Function class=L DNA replication, recombination and repair
  Homolog annotation: Query=1..139bp; Hit=27..166bp; Blast score=120; Percent Identity=42.0; E value=6e-28; Homolog= insB_g4 COG1662
VTTLPLDGDDIHLICEVDEQESFVGSQKNQRWLWYAWEPRMKRIVAHTFGDRSRKTWEKLLALLSPFNIRFYCTDDYAVYDCLPEEVHLTGKIFTQRIERTNLTHRTRIKRLNRKTIGYSKSEEMHDKVIGTFIESENYI

SEQ ID NO: 6052 - protein, 63 aa, Xenorhabdus bovienii
  Peptide sequence Name=Xb4151_4152.C418.gene42.pep
LRVKTIFSEHSNYLIHDPKYGSLAVAHNRKPTPTGVVGNLFLAGKSPSVFMSERVQNTTKKIM

SEQ ID NO: 6053 - protein, 93 aa, Xenorhabdus bovienii
  Peptide sequence Name=Xb4151_4152.C418.gene43.pep
  Gene classification: Function=Predicted transposase; Function class=L DNA replication, recombination and repair
  Homolog annotation: Query=1..80bp; Hit=53..131bp; Blast score=119; Percent Identity=71.0; E value=4e-28; Homolog= VC0870 COG1943
VELNVQIDHVHLLVKIPPKLSVSQVLGHLKGRTAIRLFNKFPYLRKKKLWGNHFWSRGYCVDTVGINEEMIRKYVKYQEKHEHEDNQLSLKGM

SEQ ID NO: 6054 - protein, 219 aa, Xenorhabdus bovienii
  Peptide sequence Name=Xb4151_4152.C418.gene44.pep
  Gene classification: Gene name=CitB; Function=Response regulator containing a CheY-like receiver domain and an HTH DNA-binding domain; Function class=T Signal transduction mechanisms
  Homolog annotation: Query=1..214bp; Hit=1..214bp; Blast score=308; Percent Identity=67.0; E value=4e-84; Homolog= VC1213 COG2197
LINVLLVDDHELVRIGVKGILEDVKGIKVAGEAGSGEEAVRWCRSNSTDVVIMDIGMPGIGGLEAAKKIIRYSPDTRVIMLTIHTESSLPAKVMQAGVRGYLSKAATPQDMINAIRTVYAGQRYISPDIAQQMALDQLSPPKENPLAELSERELQIMTMITQGRKVNEISTLLNLSPKTVNSYRYRMFSKLNIKGDVELTHMAIRCGLLDAQNMVNHSG

SEQ ID NO: 6055 - protein, 588 aa, Xenorhabdus bovienii
  Peptide sequence Name=Xb4151_4152.C418.gene45.pep
  Gene classification: Gene name=UvrC; Function=Nuclease subunit of the excinuclease complex; Function class=L DNA replication, recombination and repair
  Homolog annotation: Query=1..588bp; Hit=1..588bp; Blast score=965; Percent Identity=79.0; E value=0; Homolog= uvrC COG0322
MYDTTGSVIYVGKAKDLKKRLSSYFRTQVGSRKTESLVKNIVQIDVTVTHTETEALLLEHNYIKLYQPRYNVLLRDDKSYPYIFLSGDTHPRLTLYRGAKHAKGEYFGPFPNSHAVRDTLALLQKLFPIRQCEDSVYRNRSRPCLQYQIGRCLAPCVNGFVTNEEYQQQVDYVRLFLSGKDQQVLTELVGRMEAASKQLQFEDAARYRDQIQAVRQVTERQFVSGEGDDLDVISVAFDTGMACLHVLFIRQGKILGSRSYYPKIPADTKLDEVVQTFLGQFYLQGSQNRTLPAEILLDFSLPEKELLEASLSELSGRKVHIQPRPRGDRARYLKLARTNAAIALTTKLSQQSTVHQRLASLAEFAGIKKVHRMECFDISHTMGEQTVASCVVFDGNGPVRSEYRRYNIAGITPGDDYAAMNQVLRRRYGKAIEQTRIPDIIFIDGGKGQLAQALEVFGSLDVEWNKNHPKLIGVAKGSDRKAGLETLFFEAEGGGKALSSDSPALHVIQHIRDESHNHAITGHRQRRDKVKKTSTLESIEGIGPKRRQMLLKYMGGLQPLRNASVEEIAKVPSISYSLAEKIYNALKH

SEQ ID NO: 6056 - protein, 114 aa, Xenorhabdus bovienii
  Peptide sequence Name=Xb4151_4152.C418.gene46.pep
  Gene classification: Gene name=PgsA; Function =Phosphatidylglycerophosphate synthase; Function class=I Lipid metabolism
  Homolog annotation: Query=4..114bp; Hit=36..146bp; Blast score=151; Percent Identity=81.0; E value=1e-37; Homolog= pgsA COG0558
MLCAIIFVIAAATDWFDGFLARLWKQTTRFGAFLDPVADKVMVASALVLIAEHYHAWWITLPAATMIAREIIISSLREWMAELGKRSSVAVSWLGKIKTTAQMAALVALLWRPS

SEQ ID NO: 6057 - protein, 413 aa, Xenorhabdus bovienii
  Peptide sequence Name=Xb4151_4152.C419.gene1.pep
  Gene classification: Gene name=FabB; Function=3-oxoacyl-(acyl-carrier- protein) synthase; Function class=I Lipid metabolism
  Homolog annotation: Query=1..413bp; Hit=1..413bp; Blast score=605; Percent Identity=80.0; E value=1e-173; Homolog= fabF COG0304
VSKRRVVVTGLGMLSPVGNTVESSWNAVCAGQSGISLIEHFDTANHATKFAGVVKNFNHEDFNISRKDARKMDLFIQYGIAAGVQAIEDAGIEVTEANASRFGAAIGSGIGGLGLIEENHSTLLSAGPRKVSPFFVPSTIINMVAGHLSILYGLRGPSISIATACTSGVHNIGHAARIIAYNDADIMLAGGTEKASTTFGVAGFGAARALSTRNDDPQGASRPWDKDRDGFVLGDGAGVLVLEEYEHAKKRGAKIYAEIVGFGMSSDAYHMTSPPEDGAGAALAMENALKDADISPDQVGYINAHGTSTPVGDLAEARAVESVFGEGTKVLVSSTKSMTGHLLGAAGAIESIFTILALREQIVPPTINLENQDENCRLDLVPGEARKVEGMEYALCNSFGFGGTNGSLIFRKI

SEQ ID NO: 6058 - protein, 290 aa, Xenorhabdus bovienii
  Peptide sequence Name=Xb4151_4152.C419.gene2.pep
  Gene classification: Gene name=IlvE; Function=Branched-chain amino acid aminotransferase/4-amino-4-deoxychorismate lyase; Function class=E Amino acid transport and metabolism
  Homolog annotation: Query=17..289bp; Hit=1..267bp; Blast score=268; Percent Identity=50.0; E value=6e-72; Homolog= ZpabC COG0115
MSEVITPSYRKLENEMMYWINGKPCNQLPVNDRAVQFGDGCFTTIRVEQGQAALLPLHIKRLQKGVEKLFMPALDWLQLEDHIKQVATGCESGVLKIILSRGVGGRGYGISDAIETNQVLSLSSYPEQYAIQRKNGVSLVLSPIMMGINPHLAGIKHLNRLEQVLIKRFIEQARSDEALVLDSDGLLVECCTANIFWRKGKNVYTPDLNQCGVEGVMRQKIMQLLAESDYNLSCVMRYPEVLAHADEVIICNSLMPVIAVNQIQAHKNQPAWKYQSRELHEYLLPGCLRL

SEQ ID NO: 6059 - protein, 340 aa, Xenorhabdus bovienii
  Peptide sequence Name=Xb4151_4152.C419.gene3.pep
  Gene classification: Function=Predicted periplasmic solute-binding protein; Function class=R General function prediction only
  Homolog annotation: Query=3..338bp; Hit=1..336bp; Blast score=332; Percent Identity=50.0; E value=4e-91; Homolog= yceG COG1559
MKLKKRIFILPSLIIIVAIMFFSFVKKIESFANQKINLNQEMIFTVPAGTGRAGLGILLVQHNLIKDHQLLPWLFRLKPELAKFKAGTYRLQQGMSLRAILQLFSSGKEVQFSIRFVEGSRLSDWEKILQNAPYLKHEAEGKSPKELTDALDMKAEEPLEGWLYPDTYLYTAGTSDVELLKRAHQNMNRALEQEWKNREKNLPYKNAYEMLIMASIIEKETAIDSERTKVASVFINRLRLKMRLQTDPTVIYGLGDKYMGSIFRSNLTAFTPYNTYMIEGLPPTPIAMPSLASIKAAAHPAVTGYLYFVANGNGGHTFTVNLAEHNRAVNLYRQRLKQDK

SEQ ID NO: 6060 - protein, 213 aa, Xenorhabdus bovienii
  Peptide sequence Name=Xb4151_4152.C419.gene4.pep
  Gene classification: Gene name=Tmk; Function=Thymidylate kinase; Function class=F Nucleotide transport and metabolism
  Homolog annotation: Query=1..210bp; Hit=1..212bp; Blast score=288; Percent Identity=70.0; E value=2e-78; Homolog= tmk COG0125
MNSKFIVIEGLEGAGKTTAIRTVVETLKQYGISDLIFTREPGGTPLAEKLRQLIKQGVEGESLTNKAEVLMLYAARVQLVENVIKPALEKGTWVVGDRHDLSSQAYQGGGRGIDQKLMTSLRESALGDFYPDLTIYLDLPPEVGLQRARERGELDRIEKESLDFFHRTRERYLELVAQDDTIKKIDATQPLEKVQGAIRQTLLQWLKQQDVQA

SEQ ID NO: 6061 - protein, 332 aa, Xenorhabdus bovienii
  Peptide sequence Name=Xb4151_4152.C419.gene5.pep
  Gene classification: Gene name=HolB; Function=ATPase involved in DNA replication; Function class=L DNA replication, recombination and repair
  Homolog annotation: Query=1..325bp; Hit=1..323bp; Blast score=257; Percent Identity=48.0; E value=2e-68; Homolog= holB COG0470
MNWYPWLNHAYRLLIESHQQERGHHALLLHAHEGTGAGALLYGLSRWLMCQDKQGMKSCGKCHGCHLMLAETHSDWHALAPEKGKSTIGVDAVRQLNERLYEYSQQGGAKIVWLPSAESLTDAASNALLKTLEEPPQNTYFLLQCQRPARLLATLRSRCFYYFLPVPEQRVGLYWLQHQLPAISSLDAQTALKLSQGAPLAAEQLLQTEKWQQRNVFCQAIEQALHNCDTLSLLPLLNRDDAQQSLYWLVSLLSDAVKWQQQAQDYCVNQDQQALIHHLASTQSVGKLLSTVDDWVHCRHQLLSVVGVNRELLLTGQLLNWEKQLCSTRKLI

SEQ ID NO: 6062 - protein, 261 aa, Xenorhabdus bovienii
  Peptide sequence Name=Xb4151_4152.C419.gene6.pep
  Gene classification: Gene name=TatD; Function=Mg-dependent DNase; Function class=L DNA replication, recombination and repair
  Homolog annotation: Query=1..257bp; Hit=1..257bp; Blast score=386; Percent Identity=72.0; E value=1e-107; Homolog= ycfH COG0084
MFLVDSHCHLDCLDYETLHKSVDDVVAKAAERDVKYMLAVATTLPGFQQMKNLIGKRENIAYSCGIHPLNLDEGYDFDELARLAADDDVVAMGETGLDYYYQKDNAELQRTSFREHIRIGRKLNKPVIVHTRDAKDDTLLVLREEKVQECGGVLHCFTEDKDTARALLDLGFYISFSGIVTFRNAEQIREAARFVPLDRVLVETDSPYLAPIPHRGKQNQPAYVRDIAEYMAVLKGVTLDELAAVTTRNFCNLFHINIPEN

SEQ ID NO: 6063 - protein, 116 aa, Xenorhabdus bovienii
  Peptide sequence Name=Xb4151_4152.C419.gene7.pep
  Gene classification: Gene name=Hit (BS); Function=7 Diadenosine tetraphosphate (Ap4A) hydrolase and other HIT family hydrolases; Function class=F Nucleotide transport and metabolism
  Homolog annotation: Query=1..115bp; Hit=1..115bp; Blast score=192; Percent Identity=83.0; E value=3e-50; Homolog= VC1897 COG0537
MAEETIFSKIIRREIPSDIVYQDDLVTAFRDITPQAPTHILIVPNVLIPTVNDVTSEHELALGRLFTVAAKIAEQEGIAEDGYRLIMNCNRHSGQEVFHIHMHMVGGRPLGPLLVK

SEQ ID NO: 6064 - protein, 188 aa, Xenorhabdus bovienii
  Peptide sequence Name=Xb4151_4152.C419.gene8.pep
  Gene classification: Gene name=FlgN; Function=Predicted periplasmic lipoprotein; Function class=N Cell motility and secretion
  Homolog annotation: Query=1..188bp; Hit=4..211bp; Blast score=151; Percent Identity=46.0; E value=3e-37; Homolog= ycfM COG3417
MKRILFVILSAMFLASCNLPIQPPAPVTPVKPEKKTEPQVQPSDKVPQPPKIQSINWNGTVQPLVAQMVKANGVETGKVLLVDTVKNNTNGSLRALQVTDIITDAVSRKQLFQIVPKKQVRSAQQALGLSSEDSLGLRSKSIGLARYLSADYVLYSVVSGSNNQRSIEMQLMLVKTGEILWSGSGDVN

SEQ ID NO: 6065 - protein, 276 aa, Xenorhabdus bovienii
  Peptide sequence Name=Xb4151_4152.C419.gene9.pep
  Gene classification: Gene name=CotS (BS); Function=Predicted choline kinase involved in LPS biosynthesis; Function class=M Cell envelope biogenesis, outer membrane
  Homolog annotation: Query=20..266bp; Hit=30..264bp; Blast score=118; Percent Identity=34.0; E value=6e-27; Homolog= ycfN COG0510
MLCQQWPGIPVKNWEIRQLNGLTQGSFSITDGVRQMVGRIQTQNSETLGVDRQRENQVLRRLSSTGIAPKVIAMNGDWLLLEWFSGTTITHETLNLPLLQQLLAQILATLHNHHRLGYPLQLKKQIASQWQQIDQSRLSPRWLRLQKFFMAARTPTTLKIAPAHMDIHPDNLLMTVEGLKLIDWEYAADVDIGFSLAVLFKGNQWDEIQQQIFLDYYCNYASGYADIILLQQRIKQWGPWVRYMMLMWYEVRWQQTKDPQFLALANPLRQGFKLEH

SEQ ID NO: 6066 - protein, 339 aa, Xenorhabdus bovienii
  Peptide sequence Name=Xb4151_4152.C419.gene10.pep
  Gene classification: Gene name=BglX; Function=Beta-glucosidase -related glycosidases; Function class=G Carbohydrate transport and metabolism
  Homolog annotation: Query=1..335bp; Hit=1..334bp; Blast score=489; Percent Identity=72.0; E value=1e-138; Homolog= ycfO COG1472
MGPVMLDVVGYELDNEEREILQHPLVGGLILFTRNFQDTQQLRELIRQIRAASYHRLVIAVDQEGGRVQRFHEGFTRLPAAQSFACLNDSLMGTHLAQESGWLMASEMIAMDIDISFAPVLDLGHQCTAIGERSFHGELELAVMMAEKFIKGMHSAGMKSTGKHFPGHGAVVADSHKETPRDNRSMDAISCHDMHIFRDFIQRNLLDAIMPAHVVYSQVDDRPASGSPYWLKSILRQQLGFEGVIFSDDLSMEGAAIMGSYAERGKASLEAGCDMILVCNNRQGAISVLDNLPMIRSDRVARLYHQGSQYSLEELKKSERWQQANKELNGLCEQWLNYI

SEQ ID NO: 6067 - protein, 434 aa, Xenorhabdus bovienii
  Peptide sequence Name=Xb4151_4152.C419.gene11.pep
  Gene classification: Gene name=Ndh; Function=NADH dehydrogenase, FAD -containing subunit; Function class=C Energy production and conversion
  Homolog annotation: Query=1..434bp; Hit=1..434bp; Blast score=690; Percent Identity=79.0; E value=0; Homolog= ndh COG1252
MTTPKTRIVIIGGGAGGLELATRLGHKLGRKQKAEITLVDRNNSHLWKPLLHEVATGSLDDGVDALSYLAHASNHHFHFQLGTLTNIDRDGKKITLAEIRDESNDLLVAERELTYDILVMALGSQSNDFGTAGVRENCIFLDNPQQAHRFHNEMLNLFLKYSANQCTEEKVNIAIVGGGATGVELSAELYNAVKQFNSYGFESLNSDALNVTLVEAGERILPALPPRISSAAHQELTKLGVKVLTKTMVTSADEHGLNTKDGELIKASLMVWAAGIKAPDFMKDIGGLETNRINQLVVKPTLQTTLDAYVFAIGDCASCPKKEGGFVPPRAQSAHQMASRCYDNILALLNEKPLKEYVYKDHGSLVSLSKFSTVGSLMGNLMRGSMMVEGRIARVVYISLYRMHQVALHGYIKTGLMMLVGGINRVIRPRLKLH

SEQ ID NO: 6068 - protein, 155 aa, Xenorhabdus bovienii
  Peptide sequence Name=Xb4151_4152.C419.gene12.pep
  Gene classification: Function=Uncharacterized membrane protein; Function class=S Function unknown
  Homolog annotation: Query=10..151bp; Hit=10..175bp; Blast score=57; Percent Identity=29.0; E value=5e-09; Homolog= ycfJ COG3134
VGNLKIRQYGIGSIIAIAAIGTAATLYFESPQPKVAQVLSSEPIRITVPAPHHYCHEAVFVIPIRSEDITGGVFTGYEYRILTLFDNLKASREYLAFNHSALKNCLMVYVREHRTVGYDVVYTIGDNPGKVRVTYKPEQTIPLNEKGQLILQPYL

SEQ ID NO: 6069 - protein, 1146 aa, Xenorhabdus bovienii
  Peptide sequence Name=Xb4151_4152.C419.gene13.pep
  Gene classification: Gene name=Mfd; Function=Transcription-repair coupling factor - superfamily II helicase; Function class=L DNA replication, recombination and repair
  Homolog annotation: Query=1..1146bp; Hit=1..1147bp; Blast score=1762; Percent Identity=76.0; E value=0; Homolog= mfd COG1197
MSAKYRYQLPERRGDIRQLGHLTGAACAVECAEIIERHSGPVLLVTQDMQNALRLRDEILQFTHAPINMLSDWETLPYDSFSPHQEIISNRLSTLYHLPFMTKGALILPVNTLMQRVCPHEYLKRHALVMFKGQRLSRDKLRTELEQSGYRSVEQVLEHGEFATRGALFDMFPMGSEHPYRIDFFDDEIDSLRTFDIDSQRTLVEVETINLLPAHEFPTDQEAIELFRSQWREQFEVRRDAEHIYQQVSKKMLPAGIEYWQPLFFEQPLPAIFNYLPENTLLITQDLVSAAERFWQDTAQRFESRKIDPMRPLLSPEQIWLPVDKLFAELKNWPRIQVKNEALPQKAGNTNLAYQALPDLSVTAQHKTPLDKVRRFIEQFNGRIIFSVESEGRRETVQGLLSRIKISPIKIKQLIDANKSGCFLMVGAAEHGFIDEDNKLALICESDMLGERVSRRRQDSRRTINTDILIRNLAELRRGQPVVHLEHGVGRYQGLMMLEAGGIQAEYLILTYAGEDKLYVPVSSLHLISRYAGGAEDSAPLHKLGGEAWNKARQKAAEKVRDVAAELLDVYAQRAIKPGFACTQDPEQYQLFCQSFPFDTTPDQEQAINAVLDDMCQPVAMDRLVCGDVGFGKTEVAMRAAFMAITNNKQVAVLVPTTLLAQQHYDNFRDRFANWPVHLEVLSRFRSAKEQQQVIDMAAEGKVDIIIGTHKLLQNDLCWKDIGLLIVDEEHRFGVRHKERIKAIRADVDVLTLTATPIPRTLNMAMSGMRDLSIIATPPARRLAVKTFVREYDSLVVRESILREILRGGQVYYLYNDVENIEKAKNRLEELVPEARIVVGHGQMRERDLERVMADFHHQRFNVLVCTTIIETGIDIPSANTIIIERADHFGLAQLHQLRGRVGRSHHQAYAYLLTPNPKAMTTDAQKRLEAIASLEDLGAGFALATHDLEIRGAGELLGEDQSGQMASVGFTLYMELLESAIDALKNGREPSLEDLTSSQTEIELRMPVFLPDDYIPDVNMRLSFYKRIASAHNDAELAELKVELIDRFGLLPDPGRQLLQSASIRLTAQSLGIKRIEAHEKGGFIEFSDNNKVDPNYLIGLLQTQPNIYRLDGPSKLKFITDLTERSTRLSFIQQLLEAFVQHQI

SEQ ID NO: 6070 - protein, 387 aa, Xenorhabdus bovienii
  Peptide sequence Name=Xb4151_4152.C419.gene14.pep
  Gene classification: Function=ABC-type transport systems, involved in lipoprotein release, permease components; Function class=R General function prediction only
  Homolog annotation: Query=1..387bp; Hit=14..399bp; Blast score=491; Percent Identity=71.0; E value=1e-139; Homolog= lolC COG0577
MRGRAVDKFGRFVSWLSAIGITLGVAALITVLSVMNGFERSLESSILGFMPQAIITSEKGSINPDEHPMNQLSGLKGVNRITPIVQSDVVLQSARNVGVGVMLGITPDEYTPLAAHVADTDRTQLQPGRYFVILGEKLAIKLGVKRGDQIRVIVPSASQLTPMGRIPSQRLFTVIGTFFANSEVDDTEMLVNQQDAVRLFRYPMDNITGWRLYLNQPLTVDVLSQQTLPEGLVWKDWRERKGEFFQAVRMEKNMMGLLLSLIIAVAAFNIITSLSLLVMEKQGEIAILQTQGLTRRQVMAIFMIQGGSAGIIGALLGTGLGVLLSSQLNSLMPLVGLLTEGIQLPVAIDITQVVLIATSAMLISLLSTLYPSWRAAAIQPAEALRYE

SEQ ID NO: 6071 - protein, 233 aa, Xenorhabdus bovienii
  Peptide sequence Name=Xb4151_4152.C419.gene15.pep
  Gene classification: Gene name=PhnL; Function=ABC-type transport systems, involved in lipoprotein release, ATPase components; Function class=R General function prediction only
  Homolog annotation: Query=9..231bp; Hit=3..226bp; Blast score=315; Percent Identity=73.0; E value=2e-86; Homolog= ZycfV COG1136
MSNQPLLLCHHLCKKYQEGQVSTEVLKNVTFSIRQREMMAIVGSSGSGKSTLLHLLGGLDSPTSGEVLFKGRSLNEMSASVRAELRNSEIGFIYQFHHLLPDFSALENVAMPLLIGSKKRKASQKALEMLAAVGLEKRAHHRPAELSGGERQRVAIARALVNEPSLVLADEPTGNLDQRNADSIFEILQELNQRQGTAFLVVTHDLKLAGRLARQVEMRDGFLQDELVLVGER

SEQ ID NO: 6072 - protein, 415 aa, Xenorhabdus bovienii
  Peptide sequence Name=Xb4151_4152.C419.gene16.pep
  Gene classification: Function=ABC-type transport systems, involved in lipoprotein release, permease components; Function class=R General function prediction only
  Homolog annotation: Query=4..415bp; Hit=3..414bp; Blast score=533; Percent Identity=68.0; E value=1e-151; Homolog= ZycfW COG0577
MANLPLALFTALRFSRGRRRAGMVSLVSVISTLGIMLGVAVLIIGLSAMNGFERELKNRVLSVVPHGQIYTVEQPFQHWEQALERVKQTVGIVGASPYIEFTGLMEKGEKLHAVQIQGVEPTTEADVSALPQFVGDDAWKAFHAGKHQVILGQGVAHSLHVKQGDWLTVMIPNSDPSLKLLQPKRIRLQVAGIFQLSGMLDHRLALVPLSDAQQYLDYGHAITGIAIKADNVFAAEQRVLDAGKSTEKYVYISTWIKDYGYMYNDIQMVRGIMYLAMVLVIGVACFNIVSTLIMAVKDKSSDIAILRTLGAKDGHIRAIFLWYGLLTGMVGSVIGTIAGIFTSLNLTTIIKGLEKLLGHQFLSGDIYFIDFLPSELHAMDIFYVLLTALILSLLASWYPARRASKLDPARILSGQ

SEQ ID NO: 6073 - protein, 236 aa, Xenorhabdus bovienii
  Peptide sequence Name=Xb4151_4152.C419.gene17.pep
  Gene classification: Gene name=SIR2; Function=NAD-dependent protein deacetylases, SIR2 family; Function class=H Coenzyme metabolism
  Homolog annotation: Query=1..232bp; Hit=43..274bp; Blast score=383; Percent Identity=76.0; E value=1e-107; Homolog= ycfY COG0846
VVVLTGAGISAESGIRTFRSSDGLWEEHRVEDVATPEGFQRDAELVQAFYNARRKQLQQPEIQPNAAHYALVELEQQLGDNFLLVTQNIDNLHERAGSRRVLHMHGELLKARCCQSGQMIEWKTELTTEDRCHCCQFPSPLRPHVVWFGEMPLGMEQIYSALADADLFIAIGTSGHVYPAAGFVHEAKLSGALTIELNLEPSQVESLFDEKHYGHASKIVTQYVQSLLQQMKTDKS

SEQ ID NO: 6074 - protein, 373 aa, Xenorhabdus bovienii
  Peptide sequence Name=Xb4151_4152.C419.gene18.pep
  Gene classification: Function=Uncharacterized ACR; Function class=S Function unknown
  Homolog annotation: Query=1..371bp; Hit=4..374bp; Blast score=550; Percent Identity=70.0; E value=1e-156; Homolog= ycfD COG2850
MDYQLNLDWQSFLQNYWQKRPLLIKQGFQQFIDPLSPDELAGLAMENEIDSRLVSQKNGRWEVSHGPFEIYDHLGEKDWSLLVQAVNHWHLPSSALMKPFRMLSDWRMDDLMVSFSVSGGGVGPHLDQYDVFIIQGQGRRRWRVGEKIPMKQHCPHPDLLQVDPFEAIIDEEMLPGDILYIPPGFPHEGYAIEDSLNYSVGFRAPNARELFSGFADYILANELGSHRYSDPELALRDNPALIQSNELDTLRIMMRDLLEQPTTFQNWFGEFISQSRHELDIAPPEPPYESDEIYELLKQGESLNRLSGLRVLRVGDQCFVNGELIDTPHIHAADALCQHDRVDAGILGDAIDDVRFISLLAALVNSGYWYFND

SEQ ID NO: 6075 - protein, 469 aa, Xenorhabdus bovienii
  Peptide sequence Name=Xb4151_4152.C419.gene19.pep
  Gene classification: Gene name=BaeS; Function=Signal transduction histidine kinase; Function class=T Signal transduction mechanisms
  Homolog annotation: Query=1..467bp; Hit=19..482bp; Blast score=483; Percent Identity=53.0; E value=1e-136; Homolog= phoQ COG0642
MATSAIILALTLSYGLVAIIGYLVSFDKTIYSILRSQSNLFSTLAKWDGSKLVIKIPPNLSMTNRSLALIYDNQGRILWRQSYTPELEKKIPGEWLKKDGLHDLSISFKDKEGFLYPKTPTQSDNSTKTNWSDNNELLTYSVAVNSYAKTDKLPAMTIVIIDTIPQDMQSSVKVWAWFGYVLLANLILIIPLIWLAADWSLRPIKFVITQISSLERGEREKLDEEPPNELKGLVRNLNALLSNERRRYTRYRTTLSDLSHGLKTPLAVLQSTLLSLRSGKQMSITQAEPIMLEQINRMSQLVDYYLRRANMHSDHNLLLRQISSVSILLDRLIIALTKVYQYKGVDITLNVSSEINWLGEKNDFLEVMGNVLENACKYCLEFVEITALMGDNSVTIIVDDDGPGVPPEKRNMIFERGLRADTLRSGQGLGLSIAAEIVMQYDGSISVEDSPLGGARVNVVFRSQQSSEY

SEQ ID NO: 6076 - protein, 227 aa, Xenorhabdus bovienii
  Peptide sequence Name=Xb4151_4152.C419.gene20.pep
  Gene classification: Gene name=OmpR; Function=Response regulators consisting of a CheY-like receiver domain and a winged-helix DNA -binding domain; Function class=T Signal transduction mechanisms
  Homolog annotation: Query=1..223bp; Hit=1..223bp; Blast score=320; Percent Identity=72.0; E value=7e-88; Homolog= phoP COG0745
MRILIIEDEAILRHHLTVQLRELGHQVDAAENTKEADYYLKENHPDIAIVDLGLPGEDGLSMIRRWRSDQVNLPILILTVHDSWQEKVTVLNAGADDYVTKPFRLEEINARIQALMRRHSGLASQLVELSPFLIDLSRKEFSVNKNSIKLTAFEYTIIETLMRNNGKVVSKESLMRQLYPDAELRESHTIDVLMGRLRKKISNEWSDEVIVTVRGQGYRFDVKQHDI

SEQ ID NO: 6077 - protein, 47 aa, Xenorhabdus bovienii
  Peptide sequence Name=Xb4151_4152.C419.gene21.pep
MGVDDFASIYVLCNFAHVFFRHGQENFLSMGRYMKNFYFNSSTSEVA

SEQ ID NO: 6078 - protein, 456 aa, Xenorhabdus bovienii
  Peptide sequence Name=Xb4151_4152.C419.gene22.pep
  Gene classification: Gene name=PurB; Function=Adenylosuccinate lyase; Function class=F Nucleotide transport and metabolism
  Homolog annotation: Query=1..456bp; Hit=1..456bp; Blast score=822; Percent Identity=85.0; E value=0; Homolog= ZpurB COG0015
MELSSLTAVSPIDGRYGDKVSALRAIFSEFGLLKFRVQVEVRWLQKLAATTEIREVPAFDANANAYLDEIVANFNEQDALRIKEIERTTNHDVKAVEYFLKEKVAHIPALHQVAEFIHFACTSEDINNLSHALMLKTAREEILLPQWRQLIDTIKRMAHDYRDLPLLSRTHGQPATPSTVGKEFANVAYRMERQFRQLGQIEILGKINGAVGNYNAHLSAYPQVNWHQFSESFVTSLGIQWNPYTTQIEPHDYIAELFDCVARFNTILLDFDRDTWGYIALNHFKQKTVAGEIGSSTMPHKVNPIDFENSEGNLGLANAVLGHLASKLPVSRWQRDLTDSTVLRNLGVGLGYALIAYQATMKGLNKLEINKQHLLDELEQNWEVLAEPIQTVMRRYGIEKPYEKLKELTRGKRIDAEGMKTFIDGLELPEEEKSRLKSMTPANYIGYATSLVDELK

SEQ ID NO: 6079 - protein, 208 aa, Xenorhabdus bovienii
  Peptide sequence Name=Xb4151_4152.C419.gene23.pep
  Gene classification: Function=Uncharacterized protein involved in purine metabolism; Function class=R General function prediction only
  Homolog annotation: Query=1..207bp; Hit=1..208bp; Blast score=249; Percent Identity=62.0; E value=2e-66; Homolog= ycfC COG2915
VAKNYYDITLALAGICQSGHLVQQLAHEGQCDDDTFEVMINSVLNMNPSSTQDVFGNNACNLRIGLDAIQGMFNNTRSGISADLTRYMLSLIVLERRLSKNQAAANELAHRINQLERQQTYFEPMSEGIFNALAGIYVDVISPLGPRIQVTGSPDILRNTLIQAKVRAALLAGIRSAVLWQQVGGSRLQIMFSRQRLIRQEKDILDHC

SEQ ID NO: 6080 - protein, 367 aa, Xenorhabdus bovienii
  Peptide sequence Name=Xb4151_4152.C419.gene24.pep
  Gene classification: Gene name=TrmU; Function=Predicted tRNA(5 -methylaminomethyl-2-thiouridylate) methyltransferase, contains the PP-loop ATPase domain; Function class=J Translation, ribosomal structure and biogenesis
  Homolog annotation: Query=2..365bp; Hit=16..379bp; Blast score=634; Percent Identity=84.0; E value=0; Homolog= ZycfB COG0482
MLDNSQKKVIVGMSGGVDSSVSAYLLQQQGYKVAGLFMKNWEEDDDEEYCSAAADLADAQAVCDKLGIELHTINFAAEYWDNVFEHFLAEYKAGRTPNPDILCNKEIKFKAFLEFAAEDLGADYIATGHYVRRRDVDGISQLLRGLDGNKDQSYFLYTLSHQQIAKSLFPVGELEKPEVRRLAEEIGLVTAKKKDSTGICFIGERKFRDFLGRYLPAQPGSIITVDGQTIGQHTGLMYHTLGQRKGLGIGGTKDGSEEAWYVVDKDVENNTLIVAQGHDHPRLMSVGLIAQQLDWVDRQALKTEIRCVVKTRYRQHDIPCTVIPLSEDKIEVRFDSPVAAVTPGQSAVFYQGEICLGGGVIEQRIQE

SEQ ID NO: 6081 - protein, 150 aa, Xenorhabdus bovienii
  Peptide sequence Name=Xb4151_4152.C419.gene25.pep
  Gene classification: Gene name=MutT; Function=NTP pyrophosphohydrolases including oxidative damage repair enzymes; Function class=L DNA replication, recombination and repair
  Homolog annotation: Query=1..150bp; Hit=1..150bp; Blast score=211; Percent Identity=66.0; E value=3e-55; Homolog= ymfB COG0494
LFNPHITVACIVHAKSKFLIVEEFINDIPLWNQPAGHLEASETLLEAAERELWEETGIRAKPQALLKLHQWNAPDGTPFIRFLFLIEMEQIVDTEPQDSDIHCCHWLNAEEILSSPQLRSPLVAESIRCYLENQTYPLSILDSYGPPFTK

SEQ ID NO: 6082 - protein, 209 aa, Xenorhabdus bovienii
  Peptide sequence Name=Xb4151_4152.C419.gene26.pep
  Gene classification: Gene name=RsuA; Function=16S rRNA uridine-516 pseudouridylate synthase and related pseudouridylate synthases; Function class=J Translation, ribosomal structure and biogenesis
  Homolog annotation: Query=1..206bp; Hit=1..205bp; Blast score=281; Percent Identity=68.0; E value=5e-76; Homolog= ymfC COG1187
MTNISFKKRKLNRFSQRKNKDTLKKLTGPRRVLIFNKPYDVLPQFTDEMGRTTLKDFIPFPDVYAAGRLDRDSEGLLILTNDGKLQAKLTQPHKKTAKVYYVQVEGIPDESTLNKLRNGVTLKDGPTLSAGAELVEEPEWLWERTPPIRERKNIPVSWLKITLFEGRNRQVRRMTAHVGFPTLRLIRFSIGSLQLGQLSPGEWREIDFV

SEQ ID NO: 6083 - protein, 417 aa, Xenorhabdus bovienii
  Peptide sequence Name=Xb4151_4152.C419.gene27.pep
  Gene classification: Gene name=Icd; Function=Isocitrate dehydrogenases; Function class=C Energy production and conversion
  Homolog annotation: Query=1..417bp; Hit=1..416bp; Blast score=766; Percent Identity=89.0; E value=0; Homolog= ZicdA COG0538
MESKVVVPAEGKKITIDAKGKLNVPNNPIIPYIEGDGIGIDVTPVMLKVVDAAVQKAYSGERKISWMEIYTGEKSTQVYGKDVWLPEETLDLIRDYRVAIKGPLTTPVGGGIRSLNVALRQQLDLYVCLRPVRYYQGTPSPVKQPELTDMVIFRENAEDIYAGIEWKAGSAEADKVIKFLQDEMGVTKIRFPQECGIGVKPCSEEGTKRLVRAAIEYAIDNDRESVTLVHKGNIMKFTEGAFKDWGYELALTEFGGELLDGGPWMKIKNPKSDKDIIIKDVIADAFLQQILLRPAEYDVIACMNLNGDYISDALAAQVGGIGIAPGANIGDECALFEATHGTAPKYAGQDKVNPGSVILSAEMMLRHMGWFEAADLIVKGTEGAIAAKTVTYDFERLMEGAKLLKCSEFGDALISHM

SEQ ID NO: 6084 - protein, 103 aa, Xenorhabdus bovienii
  Peptide sequence Name=Xb4151_4152.C419.gene28.pep
  Gene classification: Gene name=XerC; Function=Integrase; Function class=L DNA replication, recombination and repair
  Homolog annotation: Query=5..103bp; Hit=277..375bp; Blast score=147; Percent Identity=69.0; E value=2e-36; Homolog= intE COG0582
MLTERDRVLSPYLIHYFHTTSQSKRGEKVTANTLTTNFKKARDKIDIDWGEGTPATFHEQRSLSERLYREQGINTKDLLGHKNQQQTDKYHDDRGKDWIKITL

SEQ ID NO: 6085 - protein, 91 aa, Xenorhabdus bovienii
  Peptide sequence Name=Xb4151_4152.C419.gene29.pep
MENITILPKGGRLSSKMSRHLERGNLMTRRRLEENIRQSEIKALENMIDQAFGLETEPRKVLTIQRKPQNDGVNVIANLIVQAKGLANEPQ

SEQ ID NO: 6086 - protein, 90 aa, Xenorhabdus bovienii
  Peptide sequence Name=Xb4151_4152.C419.gene30.pep
MDRNKWKKVVGLLGKQANKSNFAALVCGLLVAFRLEPLESWLREHVPDFQPETVTYFVTMYLISAAIVYISSMPIKYLRKKISPPRRNAA

SEQ ID NO: 6087 - protein, 69 aa, Xenorhabdus bovienii
  Peptide sequence Name=Xb4151_4152.C419.gene31.pep
MNIEFTNEIRASMKRDRQSAIRYVIECKRNYLDFRQWAMDHEPRSTNHRALNRLAWQQRKFYRKWAALS

SEQ ID NO: 6088 - protein, 308 aa, Xenorhabdus bovienii
  Peptide sequence Name=Xb4151_4152.C419.gene32.pep
  Gene classification: Gene name=XerC; Function=Integrase; Function class=L DNA replication, recombination and repair
  Homolog annotation: Query=1..308bp; Hit=68..375bp; Blast score=457; Percent Identity=72.0; E value=1e-129; Homolog= intE COG0582
MAISDRVAKIKGKEITVNTWLDKYWKIQEERLETNDIKFNTFKQKRKPVDLMRQALAMKPLPAVDARDIAGILDEYKTAGQPRMAQVVRSVLIDVFKEAQHAGEVPPGYNPALATKQPRRKITRQRLNLEEWKQIFEIANSQHRYMGNAMLLAIVTGQRLGDISEMKFSDIWDDHLHISQEKTGARLAIPLALRCNALNTSLREVVAQCRDRVLSPYLIHYFHTTSQSKRGEKVTANTLTTNFKKARDKIDIDWGEGTPATFHEQRSLSERLYREQGINTKDLLGHKNQQQTDKYHDDRGKDWIKITL

SEQ ID NO: 6089 - protein, 54 aa, Xenorhabdus bovienii
  Peptide sequence Name=Xb4151_4152.C419.gene33.pep
  Gene classification: Gene name=Icd; Function=Isocitrate dehydrogenases; Function class=C Energy production and conversion
  Homolog annotation: Query=1..54bp; Hit=363..416bp; Blast score=100; Percent Identity=87.0; E value=2e-22; Homolog= icd COG0538
LLRHMGWLEAADLIVKGTEGAIAAKTVTYDFERLMDGAKLLKCSEFGDALISHM

SEQ ID NO: 6090 - protein, 56 aa, Xenorhabdus bovienii
  Peptide sequence Name=Xb4151_4152.C419.gene34.pep
VEFSHLLIQSFRFKRNAYFGFILAGEGMGISTIPFAFIFIGLLNVTEWLTTNLTAE

SEQ ID NO: 6091 - protein, 91 aa, Xenorhabdus bovienii
  Peptide sequence Name=Xb4151_4152.C419.gene35.pep
  Gene classification: Function=Transposase; Function class=L DNA replication, recombination and repair
  Homolog annotation: Query=1..87bp; Hit=1..87bp; Blast score=73; Percent Identity=43.0; E value=3e-14; Homolog= insA_g5 COG3677
MAKVDVYCRYCHKSEQVKGHGKGNGGHPRYRCYSCCKVFQLAYTYQACKPGVKEQIVDIAMNNGGIRDTARILKVATATVMKTLKTSDSET

SEQ ID NO: 6092 - protein, 96 aa, Xenorhabdus bovienii; identical to SEQ ID NO: 5468
  Peptide sequence Name=Xb4151_4152.C419.gene36.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 6093 - protein, 248 aa, Xenorhabdus bovienii
  Peptide sequence Name=Xb4151_4152.C419.gene37.pep
  Gene classification: Gene name=WcaA; Function=Glycosyltransferases involved in cell wall biogenesis; Function class=M Cell envelope biogenesis, outer membrane
  Homolog annotation: Query=6..242bp; Hit=67..312bp; Blast score=70; Percent Identity=25.0; E value=2e-12; Homolog= YPL227c COG0463
MDEIMHHGENNIDVSIILPRYNENYLVIEKTIQRIKNIQEVLKVQVIIINDSNKNTFHDIDIIKVKKQYPDVEVVSNCGNYGKGYSIRRGVDLAKGRYIFYTDIDFPIKESDFFSAYQKIETSNVDLVIGERFSKSKSKANLYRKITSKFFLKIVNLILNCKVSDSQCPFKMLKSDVAKEVFSKQRIKGYAFDAEIIYLMNRLSKTLYQFPVIWEDTRENWSLMRTIINYSIMILGVFSIKIYWIIRN

SEQ ID NO: 6094 - protein, 349 aa, Xenorhabdus bovienii; identical to SEQ ID NO: 5796
  Peptide sequence Name=Xb4151_4152.C419.gene38.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 6095 - protein, 51 aa, Xenorhabdus bovienii
  Peptide sequence Name=Xb4151_4152.C419.gene39.pep
MKEIIAAIIFFGVIFGNANAAEFTCQLENNKYVNVSVEQGKTPVYRYTRRH

SEQ ID NO: 6096 - protein, 176 aa, Xenorhabdus bovienii
  Peptide sequence Name=Xb4151_4152.C419.gene40.pep
  Gene classification: Function=Uncharacterized phage-encoded protein; Function class=S Function unknown
  Homolog annotation: Query=24..114bp; Hit=37..125bp; Blast score=89; Percent Identity=49.0; E value=1e-18; Homolog= PM1774 COG3646
MKEVTVIPPFDFQEMVTAVQDKVVTTSLKIASYFGKRHDNVLRKIRQVRDECPDNFAALNFEEADFIDKNGDVQPMFNLTKDGYILVVMGFTGKAAMLIKVNYIQAFNWMAEQIDRWKDLGEEAQHRHALKVAKSEIKARMGSRLMNDRKKEKKLLELEYEQILSLTQPKLLFDED

SEQ ID NO: 6097 - protein, 104 aa, Xenorhabdus bovienii
  Peptide sequence Name=Xb4151_4152.C419.gene41.pep
  Homolog annotation: Query=2..87bp; Hit=14..101bp; Blast score=63; Percent Identity=36.0; E value=7e-10; Homolog= gi|9630510|ref|NP _046939.1| gp44 [Bacteriophage N15] gi|7459174|pir||T13130 protein gp44 - phage N15 gi|3192729|gb|AAC19082.1|
MRTEVDLVYFEKDRTERTQLSKYYVLHDNLETILDQTLLINKDQFGEYTAKMEFENFPRLESEKEAALRLADWMRRMSEAIEDHWQDKKQSPEAVQFIGEPQSK

SEQ ID NO: 6098 - protein, 157 aa, Xenorhabdus bovienii
  Peptide sequence Name=Xb4151_4152.C419.gene42.pep
  Homolog annotation: Query=1..152bp; Hit=26..173bp; Blast score=126; Percent Identity=45.0; E value=1e-28; Homolog= Pa|Phot5-476a02.p1k _g42| 24817 - 25341 2977 174 aa, chain -
MKLTLTHYTIIVLFVTTGITSFGSYHYSTEYEKQKEANGRQATEIQQLTDTLNYQNTHIDMLHEMDTKHTQELDNAKSEIDTLRADVAAGRRKLRIKAICPVPETTSSRSMVDATTVELSGETGSTVLDIREDIINDLAKLRYLQDYVNTECYEVKK

SEQ ID NO: 6099 - protein, 144 aa, Xenorhabdus bovienii
  Peptide sequence Name=Xb4151_4152.C419.gene43.pep
  Gene classification: Function=Phage-related lysozyme (muraminidase); Function class=R General function prediction only
  Homolog annotation: Query=3..142bp; Hit=42..181bp; Blast score=110; Percent Identity=47.0; E value=3e-25; Homolog= XF1669 COG3772
MKISNKGLEFIQQWEGLKLKAYPDPATGGIPWTIGYGHTKDVKPGQVITEQQAEAFLHDDLIPAYATLERLVKVPLTQGQFDALCSFIFNCGTGNFSGSTLLKKINAGDYAGAAAEFPRWNKAAGKVMNGLTRRRASEQQMFLS

SEQ ID NO: 6100 - protein, 110 aa, Xenorhabdus bovienii
  Peptide sequence Name=Xb4151_4152.C419.gene44.pep
  Homolog annotation: Query=1..109bp; Hit=4..111bp; Blast score=130; Percent Identity=63.0; E value=6e-30; Homolog= Pa|Phot5-476a02.p1k _g44| 25675 - 26010 1803 111 aa, chain -
MKENPDVWVHLGEWLISVREQGIWATLAGTMAFFRGRYNGGGWVKVSIDAFMCAMFAWFIRDVLNFMGLNPDLAYIGSVVIGYLGTDFIGQLLRKAAEKRAGVSSDENQQ

SEQ ID NO: 6101 - protein, 64 aa, Xenorhabdus bovienii
  Peptide sequence Name=Xb4151_4152.C419.gene45.pep
MNTNAYTLIGRAICQLLDDNTPIYKTTIGEAMSDIFNAEYRGVYDEHCEAFNDALKLLMNKNEN

SEQ ID NO: 6102 - protein, 158 aa, Xenorhabdus bovienii
  Peptide sequence Name=Xb4151_4152.C419.gene46.pep
MLMLWGADNQGDDLPDGGNINVIGRLMVRDTWDDGTTTAIKLVMINYAKLGYTGKELLEKVKEVIMPHQSTLGALRLAKEKDDAEFVEKCMTEIFTIDNPIRDVVIKRYKKCKSSQNILEALSHKTGIDIDSAKRRIRWANKAAEDMIYSIMSERNSN

SEQ ID NO: 6103 - protein, 95 aa, Xenorhabdus bovienii
  Peptide sequence Name=Xb4151_4152.C419.gene47.pep
VKQKTYRSKKWLAAVGQIECCVRCGRFGIQVAHRNEGKGMGLKVDDSLTAALCPECHHAIDNGTDMSRDERRHEMDRSIVLTVKELTRRGLIGAL

SEQ ID NO: 6104 - protein, 222 aa, Xenorhabdus bovienii
  Peptide sequence Name=Xb4151_4152.C419.gene48.pep
  Gene classification: Gene name=ApaH; Function=Diadenosine tetraphosphatase and related serine/threonine protein phosphatases; Function class=T Signal transduction mechanisms
  Homolog annotation: Query=9..222bp; Hit=4..217bp; Blast score=259; Percent Identity=61.0; E value=1e-69; Homolog= Z3933 COG0639
VNEIRNGNYLKINGDRYQSIFVVGDLHGCYQLLTDKMQQIDFNYENDLLISVGDLIDRGDRNVECLDLITQPWFRAVRGNHEQMAIDALFHNGDSDLWFQNGGHWFLYLDYEQEILAKALLAKAEQLPLIIEVNAGHKKIVIAHADYPDDEYEFGKEVDWFDVIWNRGRIYNAGVDISGEITGADLFIFGHTPAAIPAKHWNQLYIDTGAVFGHGLHMEQIK

SEQ ID NO: 6105 - protein, 147 aa, Xenorhabdus bovienii
  Peptide sequence Name=Xb4151_4152.C419.gene49.pep
  Homolog annotation: Query=1..147bp; Hit=1..147bp; Blast score=199; Percent Identity=67.0; E value=8e-51; Homolog= gi|37526804|ref|NP _930148.1| hypothetical protein [Photorhabdus luminescens subsp. laumondii TTO1] gi|36786236|emb|CAE15288.1|
MECNFLFHESTKHTAWQQLKEVLATNQPHRIIIKPWKNTRSLSQNATAHMWFGEISRFLKSNGAKFSPDEVKEMMKHTFLGYEAVERIDARTQEPERVRTLRQTSKLDTGEMFRFMEQVEQWAAGLGCFVTIPHDSEYMKLKEEQER

SEQ ID NO: 6106 - protein, 149 aa, Xenorhabdus bovienii
  Peptide sequence Name=Xb4151_4152.C419.gene50.pep
MKLKTSELTGRALDFSVAKATDMDIYIFGRPSDAEYGWIGNNNVTMESFLTSIVTIDFCGKMRIEFNGEAKSYSPSTNWSQCGELIEKYHIELYFNSVNEVWSAYIFNYEKFESVIEDGSTPQIAICRAVVAAKLGDEIEIPDELVEGV

SEQ ID NO: 6107 - protein, 91 aa, Xenorhabdus bovienii
  Peptide sequence Name=Xb4151_4152.C419.gene51.pep
MSLDLLHEREKERAADAVKINNGRKPQFGDHMRNPWAGEINPHRDGYFVRARRVTGKFNPGLWYQMTDKKGQFWEIEGKYAIFIDHLEGVK

SEQ ID NO: 6108 - protein, 456 aa, Xenorhabdus bovienii
  Peptide sequence Name=Xb4151_4152.C419.gene52.pep
  Gene classification: Gene name=DnaB; Function=Replicative DNA helicase; Function class=L DNA replication, recombination and repair
  Homolog annotation: Query=2..423bp; Hit=29..453bp; Blast score=242; Percent Identity=38.0; E value=5e-64; Homolog= dnaB COG0305
MNNYDFESSVIGGLLISGLTPDASDVLATLEPEAFATPFYRELFKTIRSQAKTRGLIDSLMVADAMGENHFANVMMTAKNCPSAANLTGYANTVSANYERRLMIELIDEAKERILSGTVENAAESMDWFISQVAEVRKPRDEIRPLHVSELLDDYTEVLEKRLKNGEQSDTLKTGIEELDEITGGINPVDLVIVAARPGMGKTEFALKVAEGVANQTITGTKQKRGVLIFSMEMDSQQIIERQLAGAANLPVSALRNPARLDDEGWDWVTVGLRRLQNLDVWIIDASKLTVEQIASISRRHKKAHPALSLIMVDYLGLIDKPKAERNDLAVAHISSSLKRLAKDLKTPVIALSQLSRDVEKRADRRPVNADLRDSGSIEQDADSIIMLYRDAVYNENSPAAPYAEIIVTKNRFGQLGTVYQRFKHGHFMPTDQDEAARICHSNDKPQKRFAKGANV

SEQ ID NO: 6109 - protein, 281 aa, Xenorhabdus bovienii
  Peptide sequence Name=Xb4151_4152.C419.gene53.pep
  Homolog annotation: Query=22..273bp; Hit=21..269bp; Blast score=326; Percent Identity=65.0; E value=3e-88; Homolog= gi|9635519|ref|NP _059610.1| DNA replication protein [Enterobacteria phage P22] gi|137953|sp|P03687|VG18_BPP22 DNA replicatio
MSNVAYADFGAKNRQERPTVTVANLEDGFTRIANDILDAVLLSGFNATQLHILIAIWRKTYGFNKKIDWIGNDQFERMTTKDSTKCSTAKNQLIKMKVLIQNGRQVGMNKNISEWETKFNGFGKSFTKSVKKSFTESVNDSLPNQSNTKDNITKDKKDNNTPLTPQEGNEDEVAKPKKRKSTPSINYDEYLSAYNEEVGEKLPHAVEANSRRQRALKKIISKLVTQNVDGWRAYVKAFVKMARPFYFGENDRGWTADIDYLLRETTLTGVREGKFVGRDHE

SEQ ID NO: 6110 - protein, 55 aa, Xenorhabdus bovienii
  Peptide sequence Name=Xb4151_4152.C419.gene54.pep
MKPKFNHSAVHKNLTREREARLVTEQGCEKLRDALEDAKLRLEHREELTGGKRHE

SEQ ID NO: 6111 - protein, 120 aa, Xenorhabdus bovienii
  Peptide sequence Name=Xb4151_4152.C419.gene55.pep
MEVAKTRNTRVTCKPQELETFWFKSAAETGNSPLARDMGIHPTGLSREKSRIVKLASRLVVELGLPEGSVAAPGCEANIVLTGIEASQLLSALDNLRYPKRKTSAVRATEASEMQLEMSI

SEQ ID NO: 6112 - protein, 75 aa, Xenorhabdus bovienii
  Peptide sequence Name=Xb4151_4152.C419.gene56.pep
  Homolog annotation: Query=1..75bp; Hit=1..75bp; Blast score=116; Percent Identity=74.0; E value=1e-25; Homolog= gi|9632492|ref|NP _049486.1| regulatory protein Cro [Bacteriophage 933W] gi|15800948|ref|NP_286964.1| regulatory protein Cro of b
MRSLEEPIKNIGITEVAHACGVSERAVYKWLKNGFLPKTEFFGKTNYAEKIQQISDGKYQANDLLDISRKKLLSA

SEQ ID NO: 6113 - protein, 148 aa, Xenorhabdus bovienii
  Peptide sequence Name=Xb4151_4152.C419.gene57.pep
  Gene classification: Function=Predicted transcriptional regulator; Function class=K Transcription
  Homolog annotation: Query=1..76bp; Hit=1..76bp; Blast score=128; Percent Identity=77.0; E value=2e-30; Homolog= Z1447 COG2932
MVQTEKTREQFSQRLAQACERAGLNEHGRGAAIVRALGVSSKAVSKWFNSESLPRQEKMNALADYLNVDIVWLQHGIDNTSDNARPEKTREVKPLVRNLTKEQEELLELFDRLPAEEAKRFLKEMQTKAAHFDAIFSEMLAKRGSKAS

SEQ ID NO: 6114 - protein, 167 aa, Xenorhabdus bovienii
  Peptide sequence Name=Xb4151_4152.C419.gene58.pep
  Homolog annotation: Query=1..166bp; Hit=1..165bp; Blast score=198; Percent Identity=58.0; E value=2e-50; Homolog= gi|26247414|ref|NP _753454.1| Hypothetical protein [Escherichia coli CFT073] gi|26107815|gb|AAN80014.1|AE016759_288 Hypothetica
VAKSTDYLPSQAEVDNVLYCKKQVDFTGVRWGEKPPPNKPFLWLQMSLLPTDSDGIPIQGLSVLIQWKPDHEPKREGDPVYPKINIVAFYNKKRVFAVDTYPFDGHTNRYRIDHPDFKEYVLGAHYHIYYEEAGHYSGVGFPIKSNIKPDDLLGYWNFFCEKLNITC

SEQ ID NO: 6115 - protein, 399 aa, Xenorhabdus bovienii
  Peptide sequence Name=Xb4151_4152.C420.gene1.pep
  Gene classification: Gene name=GlyA; Function=Glycine hydroxymethyltransferase; Function class=E Amino acid transport and metabolism
  Homolog annotation: Query=1..399bp; Hit=19..417bp; Blast score=715; Percent Identity=89.0; E value=0; Homolog= glyA COG0112
MEQEVRRQEEHIELIASENYTSPRVMQAQGSQLTNKYAEGYPGKRYYGGCEYVDVVEQLAIDRAKELFGADYANVQPHSGSQANAAVYMALLKPGDTVLGMNLAHGGHLTHGSPVNFSGKLYNVVPYGIDESGKIDYNDIRSQAQKHQPKMIIGGFSAYSGVVDWAKMREIADEIGAYLFVDMAHVAGLIAAGVYPNPVPHAHIVTTTTHKTLAGPRGGLILAKGGDEELYKKLNSSVFPGGQGGPLMHVIAGKAVALKEAMEPEFKIYQQQVAKNAKAMVDVFLERGYKVVSGGTENHLFLLDLVDKEITGKDADAALGRANITVNKNSVPNDPRSPFVTSGIRIGTPAITRRGFKEAETCELAGWMCDVLDNINDEAIIENVKQKVLAICAKYPVYA

SEQ ID NO: 6116 - protein, 417 aa, Xenorhabdus bovienii
  Peptide sequence Name=Xb4151_4152.C420.gene2.pep
  Gene classification: Gene name=ProP; Function=77 Permeases of the major facilitator superfamily; Function class=G Carbohydrate transport and metabolism
  Homolog annotation: Query=5..408bp; Hit=1..375bp; Blast score=407; Percent Identity=59.0; E value=1e-114; Homolog= hcaT COG0477
MGDLMVVPSTFWLGLSYFTYFFSFGIFLPFWAVWLKGEGIEPAIIGILLGVGLVARFLGSMFIAPTVKDPSKLITALRLLSLLALLFAIGFTFGSHWAWIFFVMIGFNLFFSPLVPLSDALAGTWQKQFTFDYGKVRVWGSIAFIISSSLTGILMSSNGINFSISNLELSLSFDRINNWVGSNLFGHHHIILAFLIFSLSVMLLGMMLKPSIMPAGKIKAVNTHMVSFKELLSEKSVWQFLLCVTLLQGAHAGYYSFGSIYWENAGYSSATIGYLWSLGVVTEVIIFTFSKQLFRRWNARNLLLLSAICGVLRWGLMGISTELPVLIIIQLLHCGTFTVCHLAAMRFIGARKENEIIRLQAIYSGLAMGGGIAVMSVIAGFLYEYMQSGIYWVMALVAFPALFLRPKVEARVHSLPK

SEQ ID NO: 6117 - protein, 267 aa, Xenorhabdus bovienii
  Peptide sequence Name=Xb4151_4152.C420.gene3.pep
  Gene classification: Gene name=SuhB; Function=Archaeal fructose-1,6 -bisphosphatase and related enzymes of inositol monophosphatase family; Function class=G Carbohydrate transport and metabolism
  Homolog annotation: Query=1..267bp; Hit=1..267bp; Blast score=454; Percent Identity=82.0; E value=1e-128; Homolog= suhB COG0483
MHPMLTIAIRAARKAGNYIAKSYETPDAVEASQKGSNDFVTNVDREAERLIIDIIRKSYPKHTIITEESGEHLGEEDDFHWVIDPLDGTTNFIKRLPHFAVSIAVRIKGRTEVAVVYDPMRNELFSSARGQGAQLNGYRLRGTNARDLDGTILATGFPFKAKQHTTPYIKILGKLFDRCADFRRTGSAALDMAYVAAGRVDGFFEIGLKPWDFMGGELLVRESGCIVTDFVGGHNYINSGNIVAGSPRIVKDMLSEMREELSEALKR

SEQ ID NO: 6118 - protein, 79 aa, Xenorhabdus bovienii
  Peptide sequence Name=Xb4151_4152.C420.gene4.pep
MALAADPMLPVWEVSTRIMRIFSNMTAFRFGIRVEYLNTALVILPNYCYSTTRFISRSLTSRWKIPHASDANHRYTRCA

SEQ ID NO: 6119 - protein, 244 aa, Xenorhabdus bovienii
  Peptide sequence Name=Xb4151_4152.C420.gene5.pep
  Gene classification: Gene name=LasT; Function=rRNA methylase; Function class=J Translation, ribosomal structure and biogenesis
  Homolog annotation: Query=1..238bp; Hit=1..236bp; Blast score=359; Percent Identity=74.0; E value=1e-99; Homolog= Z3799 COG0565
MLENIRIILVETSHTGNMGSAARAMKTMGLTNLYLVNPLVQPDSHSIALSAGASDVIGNATIVNTLDEALAGCELVIGTSARSRTLSWPMVEPRECGERCIKAAGHSPVAVVFGRERVGLTNEELQKCNYHLYIPTNPEYGSLNLAMAVQLASYEIRMAYLAVQEKSEHVESTEHEVEYPPVEDMERFYQHLEQVLNDSGFIRKAHPGQIMNKLRRLYTRARPETQELNILRGILTSMGKWSGK

SEQ ID NO: 6120 - protein, 184 aa, Xenorhabdus bovienii
  Peptide sequence Name=Xb4151_4152.C420.gene6.pep
  Gene classification: Function=Predicted transcriptional regulator; Function class=K Transcription
  Homolog annotation: Query=20..163bp; Hit=15..158bp; Blast score=220; Percent Identity=75.0; E value=8e-58; Homolog= VC0747 COG1959
LTKTLRNATISLIFHHGVFVMRLTSKGRYAVTAMLDVALHSQEGPVPLADISERQGISLSYLEQLFSRLRKNGLVSSVRGPGGGYLLGRNAGNIFVAEVISAVDESVDATRCQGREGCQGGDRCLTHTLWRDLSDRITSFLSSISLEELVKNQEVLDVADRQDSDKRRTPNGRPQETINVNLRA

SEQ ID NO: 6121 - protein, 404 aa, Xenorhabdus bovienii
  Peptide sequence Name=Xb4151_4152.C420.gene7.pep
  Gene classification: Gene name=NifS (BS); Function=Cysteine sulfinate desulfinase/cysteine desulfurase and related enzymes; Function class =E Amino acid transport and metabolism
  Homolog annotation: Query=1..404bp; Hit=9..412bp; Blast score=733; Percent Identity=87.0; E value=0; Homolog= yfhO COG1104
MKLPIYLDYSATTPVDQRVAEKMMNYLTMDGVFGNPASRSHRFGWQAEEAVDIARNQIADLVGADPREIVLTSGATESDNLAIKGAAKFYQKKGKHIITCKTEHKAVLDTCRQLEREGFEVTYLAPMSNGMLDLKELEAAMRDDTILVSIMHVNNEIGVIQDIVTIGDICRSRGIMFHVDATQSVGKLPIDLSKLKVDLMSFSAHKLYGPMGIGALYVRRKPRARIEAQQHGGGHERGMRSGTLPVHQIVGMGEAYRIAKEGLETESERLRGLRLRLWNGIKDIEEVYLNGDLELGAPHILNVSFNYVEGESLMMSLKDLAVSSGSACTSASLEPSYVLRALGMNDELAHSSIRFSLGRFTTEEEIDYAIKLIHNAIGHLRELSPLWEMFKQGVDISAIEWSHH

SEQ ID NO: 6122 - protein, 128 aa, Xenorhabdus bovienii
  Peptide sequence Name=Xb4151_4152.C420.gene8.pep
  Gene classification: Gene name=IscU; Function=NifU homologs involved in Fe-S cluster formation; Function class=C Energy production and conversion
  Homolog annotation: Query=1..128bp; Hit=1..128bp; Blast score=222; Percent Identity=89.0; E value=7e-59; Homolog= iscU COG0822
MAYSDKVIDHYENPRNVGSFDSEDPSVGSGMVGAPACGDVMRLQIKVNNEGIIEDARFKTYGCGSAIASSSLVTEWMKGKSLEQAEAIKNTAIADELELPPVKIHCSILAEDAIKAAIADYKSKREAK

SEQ ID NO: 6123 - protein, 104 aa, Xenorhabdus bovienii
  Peptide sequence Name=Xb4151_4152.C420.gene9.pep
VKTFPTTALAGNIGVIEFEAFVQTFFSKIQLSTIKVNDAFTINDDFHALVFKNLIFFVNGISEFKYICHTRAAGCSHSQTQPYPFPTIIKKSQNTLGCTFCQGN

SEQ ID NO: 6124 - protein, 34 aa, Xenorhabdus bovienii
  Peptide sequence Name=Xb4151_4152.C420.gene10.pep
MFCKYRYFVKCSVKKWVKRENFPHNRTRWKHWGY

SEQ ID NO: 6125 - protein, 173 aa, Xenorhabdus bovienii
  Peptide sequence Name=Xb4151_4152.C420.gene11.pep
  Gene classification: Gene name=DjlA; Function=DnaJ-domain-containing proteins 1; Function class=O Posttranslational modification, protein turnover, chaperones
  Homolog annotation: Query=1..171bp; Hit=1..170bp; Blast score=160; Percent Identity=60.0; E value=6e-40; Homolog= hscB COG1076
MDYFTLFGLPVRYVIDREQLSIRYRELQRQFHPDRFANQPEREKAQALQQASIINDALYTLIHPLKRAEYMLSQQGFNLSGEQHTMQDTAFLMQQLELREELDAIEHSAEPEIALADFSSRLSKMIKTRSEQMEQQLDAAQWLIAADTVRKLRFLDKLQQQVEQLEERLLDDF

SEQ ID NO: 6126 - protein, 615 aa, Xenorhabdus bovienii
  Peptide sequence Name=Xb4151_4152.C420.gene12.pep
  Gene classification: Gene name=DnaK; Function=Molecular chaperone; Function class=O Posttranslational modification, protein turnover, chaperones
  Homolog annotation: Query=1..615bp; Hit=1..616bp; Blast score=894; Percent Identity=80.0; E value=0; Homolog= hscA COG0443
MALLQISEPGLSAEPHQRRLAVGIDLGTTHSLVATVRSGQVETLADSENRHLLPSVVQYRKDETQVGWQARQQAASDPVNTIISVKRMMGRSLADIQQRYPNLPYQLQASENGLPLINTVAGLVDPIQVSSEILKSLAQRAEETLDGKLDGVVITVPAYFDDAQRQGTKDAARLAGLHVLRLLNEPTAAAIAYGLDSGQEGIIAVYDLGGGTFDVSVLRLSRGVFEVLATGGDTALGGDDFDLLLANWIREQAGISDSDHGLQRQLLDVATQAKIALSDADTAEINIAGWQGNITRTEFNELIVSLVKRTLLACRRALKDAGVTTDEVLQVVMVGGSTRVPLVRSMVGEFFDREPLTSIDPDRVVAVGAAIQADILVGNKPDSEMLLLDVIPLSLGLETMGGLIEKVIPRNTTIPVARAQEFTTFKDGQGAMSIHVVQGERELVNDCRSLARFTLRGIPPLPAGGAHIRVTFQVDADGLLSVSALEKSTGVEASIQVKPSYGLSDAEIARMLRDSMTNAQEDIQARKLAEQKVEAARVLESLTSALEKDADLLSQEEQAAIDAAVEVLIESAQGTSSDAIESAIKQLDKQTQEFAARRMDTSIRRALAGHSVDEI

SEQ ID NO: 6127 - protein, 111 aa, Xenorhabdus bovienii
  Peptide sequence Name=Xb4151_4152.C420.gene13.pep
  Gene classification: Gene name=Fdx; Function=Ferredoxin; Function class=C Energy production and conversion
  Homolog annotation: Query=1..111bp; Hit=1..111bp; Blast score=187; Percent Identity=87.0; E value=1e-48; Homolog= fdx COG0633
MPKIVFLPHNELCPEGAVLEAKEGESILDVALRNGIEIEHACEKSCACTTCHCIVREGFDSLKESSELEDDMLDKAWGLEPESRLSCQAKVTDEDLIVEIPKYSINHAREH

SEQ ID NO: 6128 - protein, 39 aa, Xenorhabdus bovienii
  Peptide sequence Name=Xb4151_4152.C420.gene14.pep
VKRTVLGSKSGNLSYSASPMSRLSAHFIFHSPISARARG

SEQ ID NO: 6129 - protein, 32 aa, Xenorhabdus bovienii
  Peptide sequence Name=Xb4151_4152.C420.gene15.pep
VNLCYFFHTSFDYSNSSSQTSKIASRIFSLDF

SEQ ID NO: 6130 - protein, 436 aa, Xenorhabdus bovienii
  Peptide sequence Name=Xb4151_4152.C420.gene16.pep
  Gene classification: Gene name=PepB; Function=Leucyl aminopeptidase; Function class=E Amino acid transport and metabolism
  Homolog annotation: Query=9..433bp; Hit=32..456bp; Blast score=628; Percent Identity=71.0; E value=1e-180; Homolog= ZpepB COG0260
MTKQAISKQIMPITLSYEPANACWGEKALVSSSEQGITIHLEGNGKSGAIQRAGRKINGQGIHNVALTGEGWDLEKSWAFWQGFRGSKGLRTIEWPQLPAVDKKELDNRIKFVDWVRDTINMPAEELGPEQLTQRAIDLLNGVAGDAISYRIIKGNDLREQGYVGVHTVGRGSSRDPVFLALDFNPTKEENAPVFACLVGKGITFDSGGYSLKPSNSMDSMKSDMGGSATLTGALALAISRGLEQRVKLFLCIADNMVSSNAFKLGDIIRYRNGKTVEVMNTDAEGRLVLADGLIDASAEKAPLIIDAATLTGAAKMAVGNDYHSVFSFDDQLAADLLAAADAENELFWRLPLAEFHRSQLPSNFADLNNIASPSHSAGASTAAAFLSHFVENYKKGWVHIDCSATYRKSAVEQWAAGATGYGVRTIANLLLAKAK

SEQ ID NO: 6131 - protein, 39 aa, Xenorhabdus bovienii
  Peptide sequence Name=Xb4151_4152.C420.gene17.pep
LKLKTIERFNHSLPFLRETMNKGNLKSIGYRCLFCFSQQ

SEQ ID NO: 6132 - protein, 143 aa, Xenorhabdus bovienii
  Peptide sequence Name=Xb4151_4152.C420.gene18.pep
  Homolog annotation: Query=1..142bp; Hit=1..140bp; Blast score=186; Percent Identity=66.0; E value=4e-47; Homolog= Pa|Phot3-198b04.q1k _g50| 34479 - 34901 1609 140 aa, chain -
MSLSNGSVATEMEVLSGSRITLSQPEEQPSQLIDALSGLFKQHKPVRRAFLIMAHDKNLDEKPNLLIGLELSDAPIDNDINVLIQEAGEVACEYLTEDESVDFCLINENERGISHYLIQHTQPFYQRKLGSWLRDTIPVVNRE

SEQ ID NO: 6133 - protein, 41 aa, Xenorhabdus bovienii
  Peptide sequence Name=Xb4151_4152.C420.gene19.pep
MILPILHNQSTEKITELSSSTKFFLHLFPINNRNGIAQPAS

SEQ ID NO: 6134 - protein, 1686 aa, Xenorhabdus bovienii
  Peptide sequence Name=Xb4151_4152.C420.gene20.pep
  Gene classification: Function=Large extracellular alpha-helical protein; Function class=R General function prediction only
  Homolog annotation: Query=12..1684bp; Hit=2..1651bp; Blast score =1858; Percent Identity=55.0; E value=0; Homolog= Z3787 COG2373
MSQRQSWQWSARKKRYLAVMLATLFTLFALSACDQSESPAKENTEERQTSLSKNSDTANGHAKSAATSPENKQATAKKQEPQSSAQRYAGKDVTILDASDLQLDGASAMVVTFSVPLDSNQDFSQKIHLVDVKSGKLEGAWELSNNQMELRLRHLPPDRELQLTVDEGVKGINERQLATAYEKKFKTAPITPTVGFASKGLLLPSKAAEGLPVLALNVDRVDVNFFRIKDEALPSFIADWQYSNNMNYWNSKELLKDTELVYTGRFDLNPTANTREKLLLPLSDIKELQREGVYLAVMQQAGKYTYSNPSTLFTLSDIGVSMHSYLNRVDVFTQSLEQGSSLKGVEIRLLDAKGQLLSKATTDSDGHATLEKNAKAKLLLAIQGRLTSMIDLTSPALDLSEFDIGGSQGYSKQFFVFGPRDLYRPGEMLIVNGLLRDADGRPLKPQPVKVDVLKADNQVVRSFVWQPENELYQYRYPIPREAETGIWSLRFDLGDNTPRYYKFHVEDFMPERMALEIKSASNNQSLLKNESVNFAITGRYLYGAPAADNRLQGQLFLRPARDAVAKLPGYEFGSSKEEGLSRTLDEFDFTLNAEGKANLSVSEDEWKQVTSPVKVIVQASLLESGGRPVTRRAEQAVWPAEKLAGIRPLFNKKSIYNYRTGHDENRYNVDENSLAEFDVVYADASGKKYATNDLRTRLIYERRDYYWRWSDSTGWDSGYDQKDLVMADDTIQIAENGTAKVSFPVEWGSYRIEVVNPQNQLVTSLNFWAGYSWQDNTGGTGAIRPDQVKMSLDKPAYKSGDKVKLHMVAPQEGKGYLLVESSDGPLWWQEIDVPEKGLDIDVPINQEWARHDLYLTAVIVRPGDKSRQATPKRAIGVLHLPLMDEGRKLNLTLNAPDKMRPNQDLTVKIKATSQQGQKLPKQIYVLLSAVDSGVLSITDFKTPDPYDAFFGRKRYSVDQYDVYGHLIEAEGRKANLRFGGDGDENVLDRGGKKPLTEVKIIAEQAKPITLDANGEGEITLPIPDFNGELRLMAQAWGGEEFGHSERKIIVAAPVITQMSLPRFMAGGDQSQLALDLTNLTEQPQAITVNLEAKGLIKLQDPISKKIILETGKRTTIQIPVKADYGFGQGEVFLTIDGLNLPDEKLKQYQNSWKIGVRPAHPAKTIQFADVIHQGQNWQLPQTATAGLVLDTLEGQLLLTSRPPLQIARYIRELYAYPYGCLEQTVSGLYPSLYSNEAELKKLGIDTQTDEKRRSAIDAGITHLLSMQRHDGAFSLWNRNGDEEFWLTAYATDFLFRATQQGYSVPADALKSANSRLLRYLQDKSVITDRYSGSRIETQFSVQAYAGLVLASQQKAPLSGLRQLYERHQQAGNGLSLVQLGIALKMMGDNTRSHEAVRLGINKARQSGYGLGDYGSTIRDNALIVSLLTENKMLQKERDEKLLDLSNELSTRHYFSTQESNSLYLAGRYLIDASEQSWKAEINQQMPPLHRDSALTETLTAKQILEGIDISNRGDSTLYSRLNVVGYPLATPEPSSNVLKIKRTYLDLEGHYFPTERMRSGEMVVVKLEVNATQSVPDALVVDLLPAGLEIENQNLASSSASLSESATGLQDIVEGMQQANIRHMEYRDDRFVAAVAVQPHQTVTLLYLARAVAPGVYQVPAPQVESMYVPHWRAVGETNEKLEVVR

SEQ ID NO: 6135 - protein, 778 aa, Xenorhabdus bovienii
  Peptide sequence Name=Xb4151_4152.C420.gene21.pep
  Gene classification: Gene name=MrcA; Function=Membrane carboxypeptidase (penicillin-binding protein); Function class=M Cell envelope biogenesis, outer membrane
  Homolog annotation: Query=17..778bp; Hit=19..770bp; Blast score=932; Percent Identity=59.0; E value=0; Homolog= pbpC COG0744
MRRLSSRIYLIALVILFALLAAVWLADKIWPLPLHNVKMARVVVGEDGSPLWRFADNEGVWRYPVTLEQVSPEYIQALLTYEDRWFYKHPGINPVSLLRAAWQDIRAGKIVSGGSTISMQVARLIDPHPRTFAGKFRQIWRTLQLEWHYSKDQILEMYLNRAPFGGTLQGVGAASWAYLGKPPSELSPGEAALLAVLPQAPSSLRPDRYPERAQAARDKVLQRLKRYNVWSAENVADIKEENVWLAPRQVPHLAPLLVRRVANGNPQEVIQTTIDTGLQRQLEDMVLNWKYQLADKTSIGVLVVDHTDMAVKAYIGSVDLQDDSRFGHVDMISAWRSPGSTLKPFLYAMALDDGLIHGESLLQDVPRRFNDYRPGNFDSGFNGPVSASEALTRSLNLPAVQLLESYGAKRFTANLRNVGMVLRFPLGSEPNLSLILGGTAARMDELVSVYSAFARQGKASPLRFTPQQKIRDRQLFSAGAAWIVRRVMAGEGRPKPDDSLSAEVPLAWKTGTSYGYRDAWAIGLNARYTIGVWVGRPDGTPVVGQFGYATAIPIMNQINGLLMENLRYSSQRIPVDPRPISVSQATICWPSGTMFTKEIIAKGGSNCRQRRLSWILDNTIPPTLPAVGQEGISGINEQIWIDKNGLRVASDCPDARPETVVLWPITLEAWLPAKERRSNRLPPINPQCPPLKIDVAPLLIVGIREGDILKRIPGKNTLDLRITTQGGSGQQWWFLNGEQVFVTKNNQSWGETLSQPGKYQLSVLDLSGQISAINFVLK

SEQ ID NO: 6136 - protein, 186 aa, Xenorhabdus bovienii
  Peptide sequence Name=Xb4151_4152.C420.gene22.pep
  Homolog annotation: Query=8..186bp; Hit=5..185bp; Blast score=84; Percent Identity=34.0; E value=9e-16; Homolog= gi|32037831|ref|ZP _00136103.1| hypothetical protein [Pseudomonas aeruginosa UCBPP-PA14]
MHSSKFTRMTACSLVISKLSLLIIIILIVINIYSWLEPKLILEKYGLGFSLTNRILLHFNENTLSPWKLTSGIFISTIPLLFLGGSLWAFHQLFSNYRKSNYFSKNTVKYLEYAGWGVIIWAMLDILFEPLLTVWLTMGAPAGQRFFSLSLSPSHLVAIFISVCLAVISRILYQACDIYDENKSII

SEQ ID NO: 6137 - protein, 47 aa, Xenorhabdus bovienii
  Peptide sequence Name=Xb4151_4152.C420.gene23.pep
MASRVENRIPLIFPVFSKERFCSVIPMACANSLDLTFRFAMSTSRVI

SEQ ID NO: 6138 - protein, 108 aa, Xenorhabdus bovienii
  Peptide sequence Name=Xb4151_4152.C420.gene24.pep
  Homolog annotation: Query=1..108bp; Hit=1..105bp; Blast score=118; Percent Identity=59.0; E value=2e-26; Homolog= Pa|Phot2-87c03.q1k _g73| 49869 - 50186 776 105 aa, chain + [Photorhabdus asymbiotica]
MKIFLYALLLGLFYIPVSFADSSAKGVDNKMENKQSGNQGALRKCTHLLPEGHKYTISIIGTSDKTTKEANKQFKGEFKLSSGSKKPLDKKRNEESKPFIQCVTETVL

SEQ ID NO: 6139 - protein, 30 aa, Xenorhabdus bovienii
  Peptide sequence Name=Xb4151_4152.C420.gene25.pep
LRQSELSCFLHQSRILEITYFLPMHTILPD

SEQ ID NO: 6140 - protein, 142 aa, Xenorhabdus bovienii
  Peptide sequence Name=Xb4151_4152.C420.gene26.pep
  Gene classification: Gene name=Ndk; Function=Nucleoside diphosphate kinase; Function class=F Nucleotide transport and metabolism
  Homolog annotation: Query=1..141bp; Hit=1..141bp; Blast score=226; Percent Identity=80.0; E value=4e-60; Homolog= ndk COG0105
MTIERTFSIIKPNAVKKDAIGSIYARFESAGFKIIAAKMLYLTREQAEGFYAEHKGRPFFDGLVEFMTSGPIVVQVLEGENAVQRHRDLMGATNPDNALAGTLRADYADSFTENAVHGSDSIESANREIAYFFSDDEIFPRH

SEQ ID NO: 6141 - protein, 45 aa, Xenorhabdus bovienii
  Peptide sequence Name=Xb4151_4152.C420.gene27.pep
LYGFVKLGHFYIASLLHFRLCADLISALSFDSVTINSITTIYSDN

SEQ ID NO: 6142 - protein, 392 aa, Xenorhabdus bovienii
  Peptide sequence Name=Xb4151_4152.C420.gene28.pep
  Gene classification: Function=Predicted Fe-S-cluster redox enzyme; Function class=R General function prediction only
  Homolog annotation: Query=17..392bp; Hit=6..384bp; Blast score=683; Percent Identity=86.0; E value=0; Homolog= yfgB COG0820
MSQLNETVQPSTAAVSVTPEKKNGKINLLDLNRKQMRQFFIDMGEKPFRADQVMKWMYHYCYDDFEQMTDINKVLRMKLQQVAEIKAPEVAEEQRSADGTIKWAITVGDQQVETVYIPEDERATLCVSSQVGCALECKFCSTAQQGFNRNLRVSEIIGQVWRAAKIIGSLKSSGRRPITNVVMMGMGEPLLNLNNVVPAMEIMMDDFGFGLSKRRVTLSTSGVVPALDKLGDMVDVALAISLHAPTDDVRDEIVPINRKYNIEEFLAGVRRYLAKSNANQGRVTVEYVMLDHVNDSVEQAHQLAECLKDTPSKINLIPWNPFPGAPYGRSSNSRIDRFSKVLMEYGFTTIVRKTRGDDIDAACGQLAGDVIDRTKRTLKKRLAGEPIQVKPV

SEQ ID NO: 6143 - protein, 136 aa, Xenorhabdus bovienii
  Peptide sequence Name=Xb4151_4152.C420.gene29.pep
  Gene classification: Gene name=NrfG; Function=TPR-repeat-containing proteins; Function class=R General function prediction only
  Homolog annotation: Query=32..120bp; Hit=36..124bp; Blast score=60; Percent Identity=39.0; E value=7e-10; Homolog= PA3805 COG0457
MIRKSIIWSIVCFGLITGCAERAPHHGHQIVAIDTRLQLGKAYLAERNLSAAKYHFQKVLLAKPRHPEAHLGMALYEYYAGQPKAADQHYRMAMQYAAGNDTVIRHYAAFLCEQKRNEEAKKLVTGNNTSHYTCDK

SEQ ID NO: 6144 - protein, 68 aa, Xenorhabdus bovienii
  Peptide sequence Name=Xb4151_4152.C420.gene30.pep
MLLFSVNKSGMKRLKNWSRETTQATTLVINDFLRSTQYEMISLHKLSWMFYQINLRKYFNLNSTSALS

SEQ ID NO: 6145 - protein, 323 aa, Xenorhabdus bovienii
  Peptide sequence Name=Xb4151_4152.C420.gene31.pep
  Gene classification: Function=Uncharacterized BCR; Function class=S Function unknown
  Homolog annotation: Query=1..319bp; Hit=1..329bp; Blast score=257; Percent Identity=48.0; E value=9e-69; Homolog= yfgA COG1426
MKTETYPEEANLTTGQILRQAREKLELSQQTVADRLCLKLSTVRDIEEDNTQSNIALTFLRGYIRAYAKLVQVPESDILSTLNKQMPAKSGKVSPMQSFSSGKKRKKRDGWLMKTTWGVLIVLLGMTGWWWWQNYTAQQKDLASMTTQSDAYNAQTQGDESDLGTSTTDLSQLPDHAKDDNSVAAAQEETSSVLANPAANSNTSSPGNQSVVNSVPATTNTAPNSAVNTLSADVNNTSAVNSNELVMNFKARCWLQITDANGKTLFMGTKDKGSSLKLSGALPYKLKIGAPTAVDIQFQGKTVDMTRFVKVNRIAQLKLPENN

SEQ ID NO: 6146 - protein, 39 aa, Xenorhabdus bovienii
  Peptide sequence Name=Xb4151_4152.C420.gene32.pep
LANIYRRILNRNSSSPVCIIHHSIVVIFINKIQGCRGVM

SEQ ID NO: 6147 - protein, 373 aa, Xenorhabdus bovienii
  Peptide sequence Name=Xb4151_4152.C420.gene33.pep
  Gene classification: Gene name=GcpE; Function=Essential bacterial protein, involved in density-dependent regulation of peptidoglycan biosynthesis; Function class=M Cell envelope biogenesis, outer membrane
  Homolog annotation: Query=1..373bp; Hit=1..372bp; Blast score=629; Percent Identity=86.0; E value=1e-180; Homolog= gcpE COG0821
MHNESPIKRRKSTRIYVGNVPIGDGAPIAVQSMTNTRTNDVEATVRQIKSLERVGVDIVRVSVPTMDAAEAFKSIKQQVNIPLVADIHFDYRIALKVAEYGVDCLRINPGNIGNEERIRQVVDCARHYNIPIRIGVNGGSLEKDIQEKYGEPTPEALVESAMRHVDILDSLNFHQFKVSVKASDVFLAVGAYRLLAQKIDQPLHLGITEAGGARAGAVKSSIGLGLLLSEGIGDTLRISLAADPVEEVKVGFDILKALRIRSRGINFIACPTCSRQEFDVIGTVNALEQRLEDLITPMDVSIIGCVVNGPGEAEVSTLGVTGAKNKSGFYEDGIRQKERFDNNNLIDQLEAKIRAKATILDASNRININQLDE

SEQ ID NO: 6148 - protein, 54 aa, Xenorhabdus bovienii
  Peptide sequence Name=Xb4151_4152.C420.gene34.pep
LPDGGFSRKAIVHATNSWDIFCHVLSLINISTIASIIKAKARGVQSAIRNNTGS

SEQ ID NO: 6149 - protein, 415 aa, Xenorhabdus bovienii
  Peptide sequence Name=Xb4151_4152.C420.gene35.pep
  Gene classification: Gene name=HisS; Function=Histidyl-tRNA synthetase; Function class=J Translation, ribosomal structure and biogenesis
  Homolog annotation: Query=1..415bp; Hit=11..424bp; Blast score=679; Percent Identity=78.0; E value=0; Homolog= hisS COG0124
MNDCLPAETAIWQRVESTVKRVLAGYGFSEIRTPIVEQTPLFKRAIGEVTDVIEKEMYTFDDRNGESLALRPENTAGCVRAGIQHGLLYNQEQRLWYIGPMFRYERPQKGRYRQFHQLGAEVFGLQGPDIDAEMILMTARWWRELGIAEHVTLELNSIGSLDARANYREALVAFLEQHKETLDEDCQRRMYTNPLRVLDSKNPEIQVLLNDAPALFDYLDTESKEHFDGVCRILDSAGIKYHLNQRLVRGLDYYNRTVFEWVTSALGAQGTVCAGGRYDGLVEQLGGKSTPAVGFAMGMERMVLLVQEVNPEFVADLAVADVYLSSFGEGSQQAALNLAEQIRDELPELRLMTNHGGGNFKKQLGRADKHGAKVALILGEDEIRAGNITVKDLRNGEQETLSQQAIAARLSELLG

SEQ ID NO: 6150 - protein, 206 aa, Xenorhabdus bovienii
  Peptide sequence Name=Xb4151_4152.C420.gene36.pep
  Gene classification: Function=Uncharacterized BCR; Function class=S Function unknown
  Homolog annotation: Query=1..205bp; Hit=1..205bp; Blast score=169; Percent Identity=42.0; E value=1e-42; Homolog= Z3776 COG2976
VEVYTTETEQIDVIKRFFANNGKYLAVGLVLGIGVLAGWHYWQSHQTNQLQDTAATFEKLNKSLESGSKESVVATEKFANETNNIYGVMADMDLAKRAVEQNDLAQAEKRLLAASGKAKDENMQALASIRLARVQFAEDKTDAALKTLEQVKGKGWLVAVENIRGDILTKKGDIAGARAAYSRGLEADGPQSLKSSIQIKLNNLSS

SEQ ID NO: 6151 - protein, 390 aa, Xenorhabdus bovienii
  Peptide sequence Name=Xb4151_4152.C420.gene37.pep
  Gene classification: Function=Uncharacterized proteins of WD40-like repeat family; Function class=S Function unknown
  Homolog annotation: Query=1..390bp; Hit=1..392bp; Blast score=490; Percent Identity=63.0; E value=1e-138; Homolog= yfgL COG1520
MQLRKTLLVGLVASILLAGCSSEQDTLAMSPLPKVENQFNPRVIWDKSVGSGVGQYYSHLSPVWQGSTVYVADRTGVVKALEVDTGKELWATDLSEKAGFLSSRLPALLSGGLTVSGERLYVGTEQAKVIALDTTNGKVEWESSVAGEALSRPVVSDGLVLIHTGNGLLQALNETNGSAVWSVNMDTPSLSVRGESAPAVAYGAAIVGGDNGRISAVLMSQGQLIWQQRIAQMTGSTEIGRLNDVDMTPVISNNIIYAIAYNGNLVAMDMRSGQLIWKRDIGSVNDMVVTDDHIFIVDQNDRILSLRKNDGVTLWTQSDLLHRNLTAPEMYNGYLVAGDSEGYLHWLNMADGKFVAQHKVDGSGLLSRPVVAGDKLMVQAKDGKVYLYTR

SEQ ID NO: 6152 - protein, 496 aa, Xenorhabdus bovienii
  Peptide sequence Name=Xb4151_4152.C420.gene38.pep
  Gene classification: Function=Predicted GTPases; Function class=R General function prediction only
  Homolog annotation: Query=1..495bp; Hit=14..501bp; Blast score=793; Percent Identity=80.0; E value=0; Homolog= yfgK COG1160
MIPVVALVGRPNVGKSTLFNRLTRTRDALVADFPGLTRDRKYGRAEVEGQEFIIIDTGGIDGTEDGVETHMAAQSLMAIEEADIVLFMVDARSGMMPADHAIAKHLRSREKATFLVANKTDGIDTDTAIPEFYSLGLGDIYSIAASHGRGVTQLIEHVLLPFSEKEKTEEVELTEEEANAAYWSEIEQAELEAAEEEEKEAVFDPTTLPLKLAIVGRPNVGKSTLTNRILGEERVVVYDMPGTTRDSIYIPMERDGREYILIDTAGVRKRGKVTETVEKFSVIKTLQAIEDANVVLLIVDAREGVSDQDLSLLGFILNSGRSLVIAVNKWDGMSQEDRDHVKDMLDLRLGFVDFARVHFISALHGSGVGNLFDSILEAYESATHRVSTSMLTRIMHMAEEDHQPPMIRGRRVKMKYAHAGGYNPPIVVIHGNQVTNLPDSYKRYLMNYFRRSLKVMGTPIRIQFKEGTNPYADKKNTLTATQLRKRKRLMSHLKKR

SEQ ID NO: 6153 - protein, 73 aa, Xenorhabdus bovienii
  Peptide sequence Name=Xb4151_4152.C420.gene39.pep
MRNSKIDKYNIIPPYLLEYIANNCDENDRECVIRTLKHVNNTMKNSAKEEEALHPEDNLSTDNKKINKPDKLQ

SEQ ID NO: 6154 - protein, 30 aa, Xenorhabdus bovienii
  Peptide sequence Name=Xb4151_4152.C420.gene40.pep
MILYLSILLLRIMLTSLCVVICICFRVLRY

SEQ ID NO: 6155 - protein, 33 aa, Xenorhabdus bovienii
  Peptide sequence Name=Xb4151_4152.C420.gene41.pep
LLEQSWDYHSNKIINTNINIIINTISIIIKQNN

SEQ ID NO: 6156 - protein, 355 aa, Xenorhabdus bovienii
  Peptide sequence Name=Xb4151_4152.C420.gene42.pep
  Gene classification: Gene name=LasB; Function=Zinc metalloprotease (elastase); Function class=E Amino acid transport and metabolism
  Homolog annotation: Query=91..350bp; Hit=287..521bp; Blast score=153; Percent Identity=38.0; E value=3e-37; Homolog= BS_nprE COG3227
MKNNEINRYSLIPPFVLEHISSDCDECSNHYVLKTLDHVHHLMNISIGEELLQQENEVEFDDELNRTIYDAEYEEIFPGDRVARREGMPESEDVAVNEAYEYLGKTHEFYKKVFGRNSLDNKGIKLVATVHYGQNYMNAFWSRKQMVFGDGDKSGKYFNRFTSAIDVIAHELTHGVIESEARLFYAYQSGALNESISDVFGIMVKQYFDKQKASESDWLIGKGLLGSKFNPDNKPDVALRTFVNPGTAFSGDKQVGHMDQYKELPFTKDNGGVHIYSGIPNRAFYLLAVELGGYSWERAGKIWYETLLDERLSSDANFDDFAELTIKNAEKLFDKEISDIVNNCWSKVGIIIPTK

SEQ ID NO: 6157 - protein, 43 aa, Xenorhabdus bovienii
  Peptide sequence Name=Xb4151_4152.C420.gene43.pep
MCSKTNGGIKLYLLISLFFMIIPFIIRCYVCVFWARLNTNYNS

SEQ ID NO: 6158 - protein, 302 aa, Xenorhabdus bovienii
  Peptide sequence Name=Xb4151_4152.C420.gene44.pep
  Gene classification: Gene name=HemF; Function=Coproporphyrinogen III oxidase; Function class=H Coenzyme metabolism
  Homolog annotation: Query=4..302bp; Hit=3..299bp; Blast score=468; Percent Identity=72.0; E value=1e-132; Homolog= hemF COG0408
MNIPNISQVKNFFLSLQDEICKQLERLDGHSNFMEECWQREEGGGGRSRVLKAGNVFEQAGVNFSHITGASLPPSASAHRPELAGRSYQALGVSLVIHPLNPYIPTSHANVRFFIAEKEGEAPVWWFGGGFDLTPYYGFKEDAIHWHTVAKTLCQPFGNNVYPEYKKWCDDYFFIKHRNEPRGIGGLFYDDLNTPDFETCFNFTQAVGNGFLAAYLPIVERRKNINWGEREREFQLYRRGRYVEFNLVWDRGTLFGLQSGGRTESILMSMPPLVRWEYNHSPEPNSPEAEFYTSFLIKKDWI

SEQ ID NO: 6159 - protein, 43 aa, Xenorhabdus bovienii
  Peptide sequence Name=Xb4151_4152.C420.gene45.pep
MTLSPVGLLSKLSRSQLLILDDRRLESLTADQRSDLLEIVDQL

SEQ ID NO: 6160 - protein, 283 aa, Xenorhabdus bovienii
  Peptide sequence Name=Xb4151_4152.C420.gene46.pep
  Homolog annotation: Query=126..283bp; Hit=9..166bp; Blast score=256; Percent Identity=75.0; E value=2e-67; Homolog= Pa|Phot5-515h10.p1k _g76| 50843 - 51343 2720 166 aa, chain -
MSIQNNKPETPCPCDCDLFVVPSRNYVKESIEEHAQSRNHPNATLQDKGFVVLSNDVGSDSETMAATPKAVKVTYNLANTANQNASNANDNANTRLAKDRNGADIPDKKEFVKNLGIEPLMEGLSLPVGVPVPWPTETPPEGWLICNGNSFDIVRYPKLALAYPSGVLPDLRGEFIRGWDNGRGVDTGRHLLSNQAADIAPHSHRINRMWSSSTAGAENLGTGNRIFNSIQENINYGADPRGLGIAIGMGSGGYGYMDNAVANSTGTETRPRNIAFNYIVRAA

SEQ ID NO: 6161 - protein, 249 aa, Xenorhabdus bovienii
  Peptide sequence Name=Xb4151_4152.C420.gene47.pep
  Gene classification: Gene name=VacJ; Function=Surface lipoprotein; Function class=M Cell envelope biogenesis, outer membrane
  Homolog annotation: Query=1..249bp; Hit=1..249bp; Blast score=367; Percent Identity=71.0; E value=1e-102; Homolog= ZvacJ COG2853
MKYRLSGVALTAVLLVGCASSNSVEQGRSDPLEGFNRAMFNFNYDVLDPYLLRPVAVVWRDYVPMPARNGIGNFVSNLEEPASMVNSILRGDLHNGAKHFNRFFLNTLLGMGGLIDVASMANPKLAKEDPMRFGSTLGYYNVGYGPYVVLPGYGNFTLRDDGGNVADMTYPVLSYLTPWMSVGKWVFGGIETRARLLDSDGLLKNSSDPYLMMREAYFQRHDFMVNGGKLLPEQNPNATVIQDELDSID

SEQ ID NO: 6162 - protein, 438 aa, Xenorhabdus bovienii
  Peptide sequence Name=Xb4151_4152.C420.gene48.pep
  Gene classification: Gene name=FadL; Function=Long-chain fatty acid transport protein; Function class=I Lipid metabolism
  Homolog annotation: Query=1..438bp; Hit=3..448bp; Blast score=510; Percent Identity=58.0; E value=1e-145; Homolog= ZfadL COG2067
MSQKNLFTRSALAVAVAVISSNASAAGFQLNEYSSSGLGRAFSGAGVVADNASEGSRNPAAMTLFDRPSFSSGLVYVNPNVDITGRSPVPQLGTGVKNSTDAKNIAPHAWIPNLHFITPINDQWFLGASATSNFGLATEFSNNYAAGLVGGKTSLKTVNLNLSSAYKLNDQFSFGLGVNAVYADATIVRHMGEVGPYNPRAPIPATYEASRLEGKDWGYGWNAGILYQYDENNRYSLTYRSKVKVKFKDGDFSNDLPEPRGTGGNTIKGTLDLNLPDMWEVSGYNRVAPQWAIHYSFLYTGWSEFKELRGKNKDNGKTLFQKDENFRNAYRVSLGTTYYYDDNWTFRTGIAFDESPVPAKNRSISIPDQDRFWLSVGSTYAFNKDASVDIGVSYMRGKKVRVSEKLPEDAQQGPFSQPYEFDSKGTAWLYGMNFNYTF

SEQ ID NO: 6163 - protein, 48 aa, Xenorhabdus bovienii
  Peptide sequence Name=Xb4151_4152.C420.gene49.pep
MTNQTSAGSIGLTLEDVARMFLRYVQNDCRNGTNLTKNSQRMLTNCDG

SEQ ID NO: 6164 - protein, 125 aa, Xenorhabdus bovienii
  Peptide sequence Name=Xb4151_4152.C420.gene50.pep
  Gene classification: Function=Uncharacterized BCR; Function class=S Function unknown
  Homolog annotation: Query=31..125bp; Hit=8..102bp; Blast score=114; Percent Identity=63.0; E value=1e-26; Homolog= Z3606 COG3691
MPNSVNAGYRGLEQRKIIDRLSSQEKKMPDTIKRCNAEETAACCCVDVGTIIDNENCTASYQSVFANNQEAEMMLNILTVKAKSGESEPCVISHKIEAVDDGVKLTIDFTFSCQAEALIFQLGLR

SEQ ID NO: 6165 - protein, 58 aa, Xenorhabdus bovienii
  Peptide sequence Name=Xb4151_4152.C420.gene51.pep
LLTSQEVRPDGALLTQCWKIANRNRRKMRAKATNRDRKTVMKIISVILIEKSEPQPDS

SEQ ID NO: 6166 - protein, 436 aa, Xenorhabdus bovienii
  Peptide sequence Name=Xb4151_4152.C420.gene52.pep
  Gene classification: Gene name=PaaJ; Function=Acetyl-CoA acetyltransferases; Function class=I Lipid metabolism
  Homolog annotation: Query=1..436bp; Hit=1..436bp; Blast score=626; Percent Identity=76.0; E value=1e-179; Homolog= yfcY COG0183
MGRSSTKVAQQKERVAIVSGLRLPFAKQATSYHGIPAVDLGKAVVSELVIRSGLSPEKIDQLVFGQVVQMPEAPNIAREIVLGAGLSVSTDAYSVSRACATSFQAIANVAESIMAGTVNVGIAGGADSSSVLPIGVTKSLARTLVDMNKAKSLSQRLKLISRLKLRDLLPVSPAVAEYSTGLRMGDTAEQMAKTYHISREEQDKLAHRSHILAAKAWQQGCLNEEVVAAHFPPYRDTLTEDNNIRKNSVLTSYSKLRPAFDRKYGTVTAANSTPLTDGAAAVMLMRESVAKELGMTPLGYLRSYAFSAIDVWQDMLLGPSYATPIALERAGITLNELSLIDMHEAFAAQTLANLKMFASEKFAREKLGRSQAVGDVDMDKFNVLGGSIAYGHPFAATGARMVTQTLNELRRRGGGFGLTTACAAGGLGVAMVLEVE

SEQ ID NO: 6167 - protein, 725 aa, Xenorhabdus bovienii
  Peptide sequence Name=Xb4151_4152.C420.gene53.pep
  Gene classification: Gene name=FadB; Function=3-Hydroxyacyl-CoA dehydrogenase; Function class=I Lipid metabolism
  Homolog annotation: Query=321..725bp; Hit=1..400bp; Blast score=505; Percent Identity=64.0; E value=1e-143; Homolog= yfcX_2 COG1250
MAQGEKETIMSETQPKQSVFNFSVRDDKVGVITIDVPGEKVNTLKAEFVEQFLTVFEKAQQASGLKGLVIVSGKPDTFIAGADITMIAGCQTEEDATELAEKGQRLFAQIANYPLPVVAAIHGACLGGGLELALACHIRVCSLDDKTRLGLPEVQLGLLPGSGGTQRLPRLIGVSAALDIILTGRQLKAKQAQRLGVVDDAVPLDILLDVAVQYVKKGTPKRKPLAWSQRILASALGRPLLFHMVHQKTRAKTHGHYPAPELIINVVRTGLEKGLKKGFQAEAKAFGELAMSPESAALRSLFFASTSLKNETGSSEQPAEIKSVGILGGGLMGGGIANVTMTRGNLPVRIKDINQNGINQALKYTWDILSKRVKQRRLKSSDRSRQMALISGTTDYSGFRQVDIVVEAVFEDLALKRKMVAEVEEHSKPETIFASNTSSLPICQIAEIASRPEKVIGLHYFSPVDKMPLVEVIPHTGTNEKTIATAVALAKKQGKTAIVVGDKAGFYVNRILSPYINEAGYCLAEGEPIDHIDKALVDFGFPIGPINLLDEVGIDVGTKIIPILVAQLGSRFTAPGFLDAVLKDNRKGKKNGRGFYSYGAKKSKFWPFGNKTKEVDVSIYSLLKIKPHAKMQPSDIAQRCMMLMLNEAVRCLDEGIIRSPRDGDIGAVFGIGFPPFLGGPFRYIDRLGSDKVVAILHRLEQQYGERFTPCEYLVQMAEQKKKFYK

SEQ ID NO: 6168 - protein, 44 aa, Xenorhabdus bovienii
  Peptide sequence Name=Xb4151_4152.C420.gene54.pep
MTKNDLYLIVSISLSPAIQWVKIIKKISIIFHKKIGSDDKSRYN

SEQ ID NO: 6169 - protein, 160 aa, Xenorhabdus bovienii
  Peptide sequence Name=Xb4151_4152.C420.gene55.pep
  Gene classification: Gene name=SixA; Function=Phosphohistidine phosphatase SixA; Function class=T Signal transduction mechanisms
  Homolog annotation: Query=1..156bp; Hit=1..155bp; Blast score=167; Percent Identity=56.0; E value=4e-42; Homolog= Z3603 COG2062
MYVFIMRHGDAAVNSISDVTRELTPRGQQESQEMACWLTQQEPDVDCILVSPYIRAKQTLKVVRENLTLPGNEEELAELTPSGDVALVASYLQVLATQKYNAVLVVSHLPLVGYLVSELCPEQTPPMFSTSSIACVELDPQTEKGRLLWQTSPAQLAAKD

SEQ ID NO: 6170 - protein, 180 aa, Xenorhabdus bovienii
  Peptide sequence Name=Xb4151_4152.C420.gene56.pep
  Gene classification: Function=Uncharacterized BCR; Function class=S Function unknown
  Homolog annotation: Query=1..176bp; Hit=1..176bp; Blast score=271; Percent Identity=73.0; E value=4e-73; Homolog= Z3594 COG2840
MKKKNLMSEEDISLFRTSVTGARRIVQDTVLHSPQRKKMSYIAPERLMQEQVDASYYFSDEFQPNLDMEGPTRYIREGANHYELKKLRRGDYSPELFLDLHGLTQLQAKQEIGALIAACRREHIYCACVMHGHGKHILKQQTPLWLAQHPDIIAFHQAPKEWGGNAALLILIEMNELMER

SEQ ID NO: 6171 - protein, 95 aa, Xenorhabdus bovienii
  Peptide sequence Name=Xb4151_4152.C420.gene57.pep
MLLQHAIMMFAINVVDCRVHCGKSGITPNNVSIFQLNRHCIVLLFFLLVSTFMLYIHLFYNQPRLSNNFMGRDEYHEFFRSYPPRCEYFTIYTVT

SEQ ID NO: 6172 - protein, 417 aa, Xenorhabdus bovienii
  Peptide sequence Name=Xb4151_4152.C420.gene58.pep
  Gene classification: Gene name=HutI (BS); Function =Imidazolonepropionase and related amidohydrolases; Function class=Q Secondary metabolites biosynthesis, transport and catabolism
  Homolog annotation: Query=15..414bp; Hit=8..400bp; Blast score=414; Percent Identity=52.0; E value=1e-116; Homolog= VC1205 COG1228
MPIELKDTDVIWRNARLATMNPTINNIDGKHHYGMLEQHDLIVRGEKILAIIPTASMPTHHCHIIDVEQRLITPGLIDCHTHLVFGGNRASEWEQRLNGASYEEISAKGGGINSTVNATRNNSAQQLEVAAQKRLNALIAEGVTTIEMKSGYGLDLVNEEKQLNVVQALAQKNAIEISPTLLSAHAVPPEYKHNSDAYIDLICDSILPTLWQKQLFESVDVFCETVGFNLDQTKRVFDAAQRLNIPVKGHVEQLSNMGGSELVADYQGWSVDHIEYLDEKGIEAISRSGSVAVLLPGAFYFLKEKKLPPISLLRQYRVPMAISTDFNPGTSPFASLRLIMNMACVQFGFTPEEAWQGVTIHAARALGRAESHGQLAEGYMADFIVWDAENPVDILYELGRNPLIHRIYRGEITHNVQ

SEQ ID NO: 6173 - protein, 328 aa, Xenorhabdus bovienii
  Peptide sequence Name=Xb4151_4152.C420.gene59.pep
  Gene classification: Gene name=SpeB; Function =Arginase/agmatinase/formimionoglutamate hydrolase, arginase family; Function class=E Amino acid transport and metabolism
  Homolog annotation: Query=16..324bp; Hit=6..324bp; Blast score=210; Percent Identity=39.0; E value=1e-54; Homolog= VC1204 COG0010
MFNNGERNNMKLWHPTSENIWQGRNDLAEADNALRVFQTIKQPANFSPEEFPHHIALLGFECDEGVKLNHGRPGAKLGPEYLRQSLANMASYDGHERLVDLGNIRADPEKLAEAQNVLSEAVYECQHQNMRTLIFGGGHETAFAHGMGIYRAFPTQRVGIINFDAHLDLRNSAQPTSGTPFRQLADYCQQHQRPFNYTCIGASLASNTQALLDEANHLDVTIIWDTQCIESMLDKVKEQIQNVINQVDIIYMTIDLDVLPIWQMPSVSAPAALGVPLERLLPLIQLICQSKKLQAVDLVELNPLYDIQGMGGKAAARLTWQLVHWWNG

SEQ ID NO: 6174 - protein, 243 aa, Xenorhabdus bovienii
  Peptide sequence Name=Xb4151_4152.C420.gene60.pep
  Gene classification: Gene name=PhnF; Function=Transcriptional regulators; Function class=K Transcription
  Homolog annotation: Query=12..243bp; Hit=19..250bp; Blast score=291; Percent Identity=60.0; E value=5e-79; Homolog= PA5105 COG2188
VTVDLSDTFVKPVPLYAKVKQAIIEKIYTGEWKPHDRVPSESELVKQFSCSRMTANRALRELMAEGFLFRLQGVGSFVSEPKGQSALFEIHSIADEIAERSNQHSCKVLKLAEVNANITQAAELGIVAGTAIYHSIIVHYENDVPVQIENRYVNAQAVPAYLRQDFNQQTTHDYLSMVAPLTEGEHIVEAVAGDVRSCRLLQIEADTPCLLISRRTWSKEHIVSSAKLLFPGHRYKLKGHFSS

SEQ ID NO: 6175 - protein, 613 aa, Xenorhabdus bovienii
  Peptide sequence Name=Xb4151_4152.C420.gene61.pep
  Gene classification: Gene name=HutU (BS); Function=Urocanate hydratase; Function class=E Amino acid transport and metabolism
  Homolog annotation: Query=50..600bp; Hit=5..555bp; Blast score=1032; Percent Identity=88.0; E value=0; Homolog= PA5100 COG2987
LISSIKDTILQIIDFICVTFFSIESTCIYNYTINKLYNDEKEKTVTMQNNKFSNEVIRAPRGTQLTAKSWLTEAPLRMLMNNLDPDVAENPHELVVYGGIGRAARNWECYEKIVETLKNLENNETLLVQSGKPVGVFKTHENAPRVLIANSNLVPHWATWEHFNELDAKGLAMYGQMTAGSWIYIGSQGIVQGTYETFVEAGRQHYNGDLTGRWVLTAGLGGMGGAQPLAATLAGVSSLNIECQQSRIDFRLRTQYVDEQATDLDDALARIKRYTQEGKAVSVALCGNAAEIVPELVRRGVRPDMVTDQTSAHDPLHGYLPAGWTWEEYCRRAETEPEVVIQAAKASMAVHVEAMLAFQKQGVPTFDYGNNIRQMAKEMGVEHAFDFPGFVPAYIRPLFCRGIGPFRWVALSGDPEDIYKTDAKVKELLSDDEHLHRWLDMARERISFQGLPARICWVGLGDRAKLGLAFNEMVRSGELSAPLVIGRDHLDSGSVASPNRETESMKDGSDAVSDWPLLNALLNTASGATWVSLHHGGGVGMGFSQHSGMVIVCDGTDEAAERIARVLHNDPATGVMRHADAGYEQAIQCAKERDLNLPMLDTKSSDTKTVETK

SEQ ID NO: 6176 - protein, 510 aa, Xenorhabdus bovienii
  Peptide sequence Name=Xb4151_4152.C420.gene62.pep
  Gene classification: Gene name=HutH (BS); Function=Histidine ammonia -lyase; Function class=E Amino acid transport and metabolism
  Homolog annotation: Query=6..503bp; Hit=5..502bp; Blast score=686; Percent Identity=74.0; E value=0; Homolog= PA5098 COG2986
MKHITIHPGKMTLEELRHIYQYPVQITLDEQCVPAIERSVDCVNRIINENRTAYGINTGFGLLASTRIAEQDLEELQRSLVLSHAAGVGEPLPDEIVRLIMVLKINSLARGYSGIRLDVIQALITLVNAEVYPCIPSKGSVGASGDLAPLAHMSLLLLGESKARYRGEWLPAKDALEKANLKPIRLAAKEGLALLNGTQTSTAFALKGLFAAEDLLASAVICGAMSVEAALGSRKPFDARIHEARGQQGQIDVAALYRLVLEEQSGLSESHKNCPKVQDPYSLRCQPQVMGACLTQIRHAADVIMTEANAVSDNPLVFTDQDEVISGGNFHAEPVAMASDNLAIALAEIGALSERRISLLMDSNMSQLPPFLVNNSGVNSGFMIAQVTAAALASENKALAHPSSVDSLPTSANQEDHVSMAPAAGRRLWEMADNVRGILAIEWLTACQGMDFRDGLKSSPILEKARHILRNKVAYYDKDRFFAPDIDAAIQLLIEQQLSALLPTGKLLIN

SEQ ID NO: 6177 - protein, 457 aa, Xenorhabdus bovienii
  Peptide sequence Name=Xb4151_4152.C420.gene63.pep
  Gene classification: Gene name=AnsP; Function=Gamma-aminobutyrate permease and related permeases; Function class=E Amino acid transport and metabolism
  Homolog annotation: Query=1..449bp; Hit=1..451bp; Blast score=558; Percent Identity=70.0; E value=1e-159; Homolog= PA5097 COG1113
MQNTSQLKRGLSVRHIRFMALGSAIGTGLFYGSAEAIKAAGPAVLLAYAIGGAAVFMVMRALGEMAVHHPVAGSFSHYASHYLGPLAGFLTGWTYVFEMLVVCLADITAFGLYMKLWFPHVDQWIWVLSIVFFIGAINLCNVKVFGEMEFWLSIIKVTAIVAMIVGGFVIMMYGFGQEAGHVTGLSNLWEHGGFMPNGIAGVIASFTVVMFAFGGIEVIGITASEAKNPEKSIPQAINAVPFRILLFYVLTLFVLMCIYPWNQIGQNGSPFVQIFSSLGIDSAANILNVVVITAAISAINSDIFGSGRMMYGMAQEKQAPSAFTKLTKNGVPWITVLVMSCVLLIGVVLNYLLPEKVFGIIASIATFATVWVWLMILLSQFIMRRKIPAEEVKKLKFPVPLWPAAPILTISFMAFIIVVLGYFPSTRIALYVGIAWIALLTLSYFLWVKKLWVKKTR

SEQ ID NO: 6178 - protein, 46 aa, Xenorhabdus bovienii
  Peptide sequence Name=Xb4151_4152.C420.gene64.pep
MAYWESSIKRNYFLERVRKPPCIHRVVYLGVISFFSPTTFSPTRNN

SEQ ID NO: 6179 - protein, 30 aa, Xenorhabdus bovienii
  Peptide sequence Name=Xb4151_4152.C420.gene65.pep
MGIMSVNNEPISVSTYVTASLYRKSTQISK

SEQ ID NO: 6180 - protein, 39 aa, Xenorhabdus bovienii
  Peptide sequence Name=Xb4151_4152.C420.gene66.pep
MVCSSATASSTKILSTSISKPQKCISALFCHDPSHKSAI

SEQ ID NO: 6181 - protein, 312 aa, Xenorhabdus bovienii
  Peptide sequence Name=Xb4151_4152.C420.gene67.pep
  Gene classification: Gene name=HemK; Function=Predicted rRNA or tRNA methylase; Function class=J Translation, ribosomal structure and biogenesis
  Homolog annotation: Query=3..312bp; Hit=112..421bp; Blast score=508; Percent Identity=76.0; E value=1e-144; Homolog= yfcB COG2890
MLVDKIFVDEAVAELHTILDMLRWSASRFNAANIYYGHGTDNSWDEALQLVLPTLHLPLDVPESMMAARLTSTERHCIVERVLRRINERIPVAYLTNRAWFCGHEFYVDERVLVPRSPIGELVNNQFAGLLPQEPSTILDLCTGSGCIAIACAHEFPEAEVDAVDISGDALAVTEQNIENHGLLNRVIPILSDLFRDMPPMKYDLIVTNPPYVDEEDMNDLPDEFLREPELGLAAGVDGLILACRILANAPDFLTEEGVLICEVGNSMVHLIDQYPDVPFTWLEFENGGDGVFMLTREQLVEHHEYFRLFKD

SEQ ID NO: 6182 - protein, 36 aa, Xenorhabdus bovienii
  Peptide sequence Name=Xb4151_4152.C420.gene68.pep
VVTRKNCPILFPAIPTLPSINYALKIRLINNNSLND

SEQ ID NO: 6183 - protein, 361 aa, Xenorhabdus bovienii
  Peptide sequence Name=Xb4151_4152.C420.gene69.pep
  Gene classification: Gene name=AroC; Function=Chorismate synthase; Function class=E Amino acid transport and metabolism
  Homolog annotation: Query=1..361bp; Hit=1..361bp; Blast score=602; Percent Identity=86.0; E value=1e-172; Homolog= ZaroC COG0082
MAGNSIGQFFRVTTFGESHGIALGCIVDGVPPGIAITEADLQIDLDRRRPGTSRYTTQRREPDQVRILSGVFEGVTTGTSIGLMIENTDQRSQDYSAIKDVFRPGHADYTYEQKYGLRDYRGGGRSSARETAMRVAAGAIAKKYLLEKHGIRIRACLTQMGDIHCELKDWDLVEQNPFFCPDESKLTQLDELLRTLKKEGDSIGAKVTLVAENVPVGLGEPVFDRLDADIAHALMSINAVKGVEIGDGFGVVNLRGSENRDEITSQGFTSNHAGGILGGISSSQPIIAHIALKPTSSIMVSGKTINRQGEEVDMVTRGRHDPCVGIRAVPIAEAMMAIVLMDHLLRQRAQCADVIFPLPRW

SEQ ID NO: 6184 - protein, 38 aa, Xenorhabdus bovienii
  Peptide sequence Name=Xb4151_4152.C420.gene70.pep
MIMMPAASPRCLYFRRSLTDLPAWQWKDDVSTLRPLTQ

SEQ ID NO: 6185 - protein, 266 aa, Xenorhabdus bovienii
  Peptide sequence Name=Xb4151_4152.C420.gene71.pep
  Gene classification: Function=Predicted permeases; Function class=R General function prediction only
  Homolog annotation: Query=5..262bp; Hit=9..266bp; Blast score=267; Percent Identity=63.0; E value=7e-72; Homolog= yfcA COG0730
MEWSLLSPEIYGFLFLVAIVAGFIDSIAGGGGLLTIPALLSVGVSPVQALATNKLQAVGGSFSASLYFIRRGAVDWRSQRFAIAMTLLGAMLGALLVQFVSPDFLRYLLPVLVIIIGLYFLLVPNIGAEDRPRRLEPLAFGCLAGGGIGFYDGVFGPGTGSFLALSYVMLYGYNLAKATAHAKVLNFASNIGSLGFFILGGQVLWLLGLVMLIGQAIGARLGAGLVLSRGQKMIRPMLVTISFLMSIKLLHDHHGDTIRSWLAFYF

SEQ ID NO: 6186 - protein, 183 aa, Xenorhabdus bovienii
  Peptide sequence Name=Xb4151_4152.C420.gene72.pep
  Gene classification: Function=Uncharacterized BCR; Function class=S Function unknown
  Homolog annotation: Query=2..178bp; Hit=3..179bp; Blast score=291; Percent Identity=76.0; E value=2e-79; Homolog= Z3589 COG3101
MTAHHYQQLIEIFDNCFSDDCNTRLIKGDDEPIYLPVDDQVGYNRVVFAHGFYASGLHEISHWCIAGKERRKRVDFGYWYCPDGRDAQTQSEFEQVEIKPQALEWLFCMAAGFPFNVSCDNLEGDCEPDRFAFQRKVHTQVIAYLENGIPTRAARFIQGLHSFYNTPSLTAEHFPCPENPFAN

SEQ ID NO: 6187 - protein, 97 aa, Xenorhabdus bovienii
  Peptide sequence Name=Xb4151_4152.C420.gene73.pep
  Homolog annotation: Query=1..92bp; Hit=1..92bp; Blast score=139; Percent Identity=85.0; E value=9e-33; Homolog= gi|37527071|ref|NP _930415.1| hypothetical protein [Photorhabdus luminescens subsp. laumondii TTO1] gi|36786504|emb|CAE15560.1| u
MLAEFETRILAHIDNMVEHASDDELFAGGYLRGHLTLAVAELEQEGANTIEQLHQRVEESIHRAIRAGELAPPDQVLVLSTWQNLLDSAKDQLIDYK

SEQ ID NO: 6188 - protein, 177 aa, Xenorhabdus bovienii
  Peptide sequence Name=Xb4151_4152.C420.gene74.pep
  Gene classification: Gene name=WecD; Function=Histone acetyltransferase HPA2 and related acetyltransferases; Function class=K Transcription
  Homolog annotation: Query=4..167bp; Hit=5..168bp; Blast score=129; Percent Identity=44.0; E value=2e-30; Homolog= PA2271 COG0454
MFFIRPTQILDAGVLPAIERSASQLFLSTPELAWIADGHTQTEQQHLDYILQQNSWVALNGDNQPVGFILAKPLDDGLHIMELSVHRDWQKKGIGKALIDTVIQVAEQRGFQAVTLTTFRHINWNAPFYRRLGFFILEPRQIAGALCQILQREIEYGFAENQRCAMKRLVVTTDYHD

SEQ ID NO: 6189 - protein, 683 aa, Xenorhabdus bovienii
  Peptide sequence Name=Xb4151_4152.C420.gene75.pep
  Gene classification: Gene name=DadA; Function=Glycine/D-amino acid oxidases (deaminating); Function class=E Amino acid transport and metabolism
  Homolog annotation: Query=259..681bp; Hit=1..413bp; Blast score=451; Percent Identity=53.0; E value=1e-126; Homolog= yfcK_2 COG0665
VKKSAISSATLNWNEQGTPVSEQFDDVYFSNQDGLEETLYVFLKGNHFPQRFNTHSRPDCIIAETGFGTGLNFLTLWRAFSTFRQQYPDTPLKRLHYISFEKYPLTTADLKTAHQRWPELQVFSEELCQQWPLPLAGCHRLMLNNGTVTLDLWFGDVNDLLPRINSNLTGKIDAWFLDGFAPSKNPQMWSEQLFTAMARFSRPEGTFATFTSAGIVRRGLQGAGFDVKKIKGFGHKREMLTGVLAPSAHFLFSSSDTPWFARQAATDTDDIAIIGGGIASVLTALALLRRGAKVTLYCQDNQPAQNASGNQQGAIYPLLNGRDDLLERFFISAFTFARRQYDQLIDENVSFDYQWCGVSQLAYDEKSDKKIAKMLQTSWLEEIAIGMDRQKLSQASGLDVNYHGIHYPQGGWLSPAQLTQEAINLAERRGMLTYFNHKMTQLVQDEYGWQLHIEHQGQSLHKNHRVVIIANGHCLTQFAQTEKLPVTAVRGQVSHIPTTTRLSQLKNVLCYDGYLTPANPQNQHHCIGASYQRGNVDTQYSPAEQQENRDRLLKSLPDVDWVKQVNISEAKSRQGIRCVIRDHMPMVGNVPIFSQIMVKYAGLSQRINTDETIEESPYYPDLFVIGALGSRGLCSAPLSAELLAGQIFGEALPLDDETLAALHPNRFWVRKLLRGREVKAGKP

SEQ ID NO: 6190 - protein, 31 aa, Xenorhabdus bovienii
  Peptide sequence Name=Xb4151_4152.C420.gene76.pep
MNTVKISYYFYQPYRHYCEKECYQQRNPKLE

SEQ ID NO: 6191 - protein, 39 aa, Xenorhabdus bovienii
  Peptide sequence Name=Xb4151_4152.C420.gene77.pep
LFGVQVYAKVQGRNPAGKNDEVMNETCSNHWSGDCFQYW

SEQ ID NO: 6192 - protein, 404 aa, Xenorhabdus bovienii
  Peptide sequence Name=Xb4151_4152.C420.gene78.pep
  Gene classification: Gene name=FabB; Function=3-oxoacyl-(acyl-carrier- protein) synthase; Function class=I Lipid metabolism
  Homolog annotation: Query=1..401bp; Hit=1..403bp; Blast score=621; Percent Identity=79.0; E value=1e-178; Homolog= fabB COG0304
MKRAVITGLGIVSSIGNNQKEVLESLREGRSGITFSEEFKEMGLRSHVWGNIKLDISGLIDRKTQRFMSDSSVYAYLAMDEAIKDSGLSDEQVSNLRTGLVVGSGGGSPRNQVSGSDGMRAKGLRGVGPYMVTRAMASGVSACLATPFKIKGVNYSISSACSTSAHCIGHAVELIQLGKQDVIFAGGGEELSWEMACEFDAMGALSTKYNETPELASRTYDQGRDGFVIAGGGGIVVVEELEHALARGAHIYAEIIGYGANSDGADMVAPSGEGAVRCMKLALDGIEGGVDYINTHGTSTPIGDLKELGAIREVFGDNTPAISATKAMTGHSLGAAGAHEAIYSLLMLEHGVIAPSINIDNLDEKALGMNIITEPTERELRTVMSNSFGFGGTNASLVMRKYSN

SEQ ID NO: 6193 - protein, 55 aa, Xenorhabdus bovienii
  Peptide sequence Name=Xb4151_4152.C420.gene79.pep
MEQLLSIKWCLEIHRNIHCECFGTPHTALAIQSHRYYRLWLLLHYLIKPKDLANP

SEQ ID NO: 6194 - protein, 325 aa, Xenorhabdus bovienii
  Peptide sequence Name=Xb4151_4152.C420.gene80.pep
  Gene classification: Function=Uncharacterized BCR; Function class=S Function unknown
  Homolog annotation: Query=9..325bp; Hit=12..327bp; Blast score=365; Percent Identity=58.0; E value=1e-101; Homolog= PA0754 COG3181
METILIKVLAVATLLACTNTFADNAPDKTECIAPAKPSGGFDLTCKLAQITLLDTKAINSPMSVAFMPGGIGAVAYNTIIAQRPAEPGTIVAFSGGSLLNLSQGKFGRYHVNDVRWLASMGTDYGMIAVRGDSPYKTLKDLMGAFQKDPNKIVFGASASIGSQDWMKTALLAKEVGVDPQKIRYVAFEGGGEPITALLSNHIQAVSWELSETVPYLTDDKIRVLAVYAEQRLKGKLANIPTAKEQGYNIVWPVVRGFYMGPKVTDEQYQWWIKTFKKLQQTEEFKKERDLRGLFEFNMVGKELDDYVKKQVVQYHGLAKSFGLIK

SEQ ID NO: 6195 - protein, 84 aa, Xenorhabdus bovienii
  Peptide sequence Name=Xb4151_4152.C420.gene81.pep
LGYTIYRYKTFHLPFINQKNLFGCDVSHSIYITPRITVLINDYQLSFAYDLVVVWENEKNSRFLIYLANLYEVNIFSALNMLRY

SEQ ID NO: 6196 - protein, 221 aa, Xenorhabdus bovienii
  Peptide sequence Name=Xb4151_4152.C420.gene82.pep
  Gene classification: Gene name=OmpR; Function=Response regulators consisting of a CheY-like receiver domain and a winged-helix DNA -binding domain; Function class=T Signal transduction mechanisms
  Homolog annotation: Query=1..220bp; Hit=1..221bp; Blast score=217; Percent Identity=55.0; E value=9e-57; Homolog= PA0756 COG0745
MRLLLVEDHPDLSHWLQKALSSSGFAVDIAEDGIAADQLLLTEDYTLLILDVALPRLDGISLLSRLRKRGQNLPVLLLTAKVDVADRVKGLNSGADDYVTKPFDFEELEARIRALLRRGMGLPLGIQQFGSLVYEDAGYFLLDNQPLALTPREFSVLTTLFHRRGRPVSKQQLFEQVFSLSDEANPQSIELYVHRLRKKLFNSDVGICTLRGLGYRLELQK

SEQ ID NO: 6197 - protein, 492 aa, Xenorhabdus bovienii
  Peptide sequence Name=Xb4151_4152.C420.gene83.pep
  Gene classification: Gene name=BaeS; Function=Signal transduction histidine kinase; Function class=T Signal transduction mechanisms
  Homolog annotation: Query=24..483bp; Hit=6..457bp; Blast score=257; Percent Identity=38.0; E value=2e-68; Homolog= PA0757 COG0642
MYIARIGISIGIAKIMKLFKAPRSLFHQLLLFFGAPLLLLGGASVYTHYFSAENAATLAYDRTLLASARTVAERLTVKNKQLNVDVPYIVLDSFERNTNDRLYYQVISPAGRTISGYDNLPPIPQYTQRSQLYTALVYFYNAEYQGYPIRVAALYQPINEGGVMGMALILVAETVDSRQYLARQLLISSLISQGTVVVLTLILAYFLLKQLLKPLRRLSGMMVLRSANDLTPLPDILPWSELSPLLRAFNRYIERLKLMVGRQARFSADASHQLRTPLSVLKTQIAVALNDKDPYPSRKIINSINKTVDNMISLTDRLLYLSQLKVHEKEAIQNYQPVNIVELLQQACFSRLQQAESKNIDLGYEGENTFWIKGEPVLLTEMCANLLDNAIKYTPAAGMVTARVSMTADKKYCCLEVDDSGPGIAQENITQSLMAFNRLDNAAGLEGAGLGLTIVKDISLYHGATLQLLPSIVLGGLLVRILFRLPAGERNT

SEQ ID NO: 6198 - protein, 295 aa, Xenorhabdus bovienii
  Peptide sequence Name=Xb4151_4152.C420.gene84.pep
  Gene classification: Gene name=RhaT; Function=7 Permeases of the drug/metabolite transporter (DMT) superfamily; Function class=G Carbohydrate transport and metabolism
  Homolog annotation: Query=2..283bp; Hit=1..282bp; Blast score=190; Percent Identity=43.0; E value=2e-48; Homolog= PA4287 COG0697
MINFLFPFIAVLIWSINAVVSKAAATAIEPAAIAFYRWFIAFLALTPFVLWPVLKQRKMVIQYWWKLLILGTLGMVLNQSMAYYAAHTVSATLIGIFTSLIPLLTVIISIFALRIAPTVGITLGTVFSLFGLVWLVSKGEPASLLEHGLGIGEVMLFIASASYALYGVLTKRWAIPLPNWQSLYIQIGFSLLLLLPNFMMTKDVQLTSDNISLVLFAGIPASILAPYLWIQGVTRLGANMTSVFMNLAPVFTAIIAIVFLREKMQSYHLIGGGIVLAGVILAQRLRIPLTRRKAE

SEQ ID NO: 6199 - protein, 91 aa, Xenorhabdus bovienii; identical to SEQ ID NO: 5467
  Peptide sequence Name=Xb4151_4152.C420.gene85.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 6200 - protein, 32 aa, Xenorhabdus bovienii
  Peptide sequence Name=Xb4151_4152.C420.gene86.pep
VASRLSVKSTSNGRLSAIRKTNAGFGMLGNPA

SEQ ID NO: 6201 - protein, 96 aa, Xenorhabdus bovienii; identical to SEQ ID NO: 5468
  Peptide sequence Name=Xb4151_4152.C420.gene87.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 6202 - protein, 120 aa, Xenorhabdus bovienii
  Peptide sequence Name=Xb4151_4152.C421.gene1.pep
IQFELGTPSSFLIPIRPLLHEPLFGTHVRKHRFWCRIPCHGSCIKWLVAVICFRLFKDEVWPKLMSIAVIATNQNRSKDMGKEMADILVIAVIAAVRSFSWRIPIRPANPALKNRLSISR

SEQ ID NO: 6203 - protein, 92 aa, Xenorhabdus bovienii
  Peptide sequence Name=Xb4151_4152.C421.gene2.pep
MSHYSLQAGFPSIPKPALVFLIADKRPLLVDFTDNLDATFRKGKCRYVSGSEVFNVFMTVAVATFRIRAVSRIPPLFIAISTICSLTPGLQA

SEQ ID NO: 6204 - protein, 96 aa, Xenorhabdus bovienii; identical to SEQ ID NO: 5468
  Peptide sequence Name=Xb4151_4152.C421.gene3.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 6205 - protein, 92 aa, Xenorhabdus bovienii; identical to SEQ ID NO: 6203
  Peptide sequence Name=Xb4151_4152.C421.gene4.pep

SEQ ID NO: 6206 - protein, 96 aa, Xenorhabdus bovienii; identical to SEQ ID NO: 5468
  Peptide sequence Name=Xb4151_4152.C421.gene5.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 6207 - protein, 45 aa, Xenorhabdus bovienii
  Peptide sequence Name=Xb4151_4152.C421.gene6.pep
MPGDSTSDGDWPEYRASSFKKLKPKSVKPPRWLFYADDRIRSCIK

SEQ ID NO: 6208 - protein, 38 aa, Xenorhabdus bovienii
  Peptide sequence Name=Xb4151_4152.C421.gene7.pep
MTKHGIQANPHHSCCRPASIPFIAISTICLWVPGRQAA

SEQ ID NO: 6209 - protein, 92 aa, Xenorhabdus bovienii
  Peptide sequence Name=Xb4151_4152.C421.gene8.pep
MTVKAITELNHKTTHRHSPVLKWHRPLKVILPQYAAANSPHVQGYWRFLNAAPANIAGSRFRQRLILPISQRALTFWSSTLSLPILPSFLAT

SEQ ID NO: 6210 - protein, 268 aa, Xenorhabdus bovienii
  Peptide sequence Name=Xb4151_4152.C421.gene9.pep
  Gene classification: Function=TPR repeat proteins; Function class=R General function prediction only
  Homolog annotation: Query=13..238bp; Hit=84..305bp; Blast score=105; Percent Identity=33.0; E value=6e-23; Homolog= ybeQ COG0790
MMALFTNGFLYASEVSLETLRFAAIGGDAKSQTDLGVMYFHGQGVKQDYQLAKSWFEKAAQQNSAEAENYLGVMYMTGKGTPENIQTAIEWFEKSANQNFAKAQNNLGLIYFYNNENDNQNLNKARDWFEKAAQQNIAISQYQLGMIYLHGRGVEQSIKIAREWFEKAAAQDLPEAQYKLGVIYYGGNSGVLRDYQIAWQLFENASRQNHGESQFHLAMMYLLGQGVTKDFKRGRDMFGLACKNGDIEACLWFKELTENNEAIKEFSK

SEQ ID NO: 6211 - protein, 46 aa, Xenorhabdus bovienii
  Peptide sequence Name=Xb4151_4152.C421.gene10.pep
MIEDKYFFTLPFILPLAAVQFISDLAQFDWAKSVDNNMATYCKTAF

SEQ ID NO: 6212 - protein, 77 aa, Xenorhabdus bovienii
  Peptide sequence Name=Xb4151_4152.C421.gene11.pep
LIGLNLLIIIWLPTVKLHSDTNPTGFRKYPQIPPPHHIPPDGVLHRNERRFLSFCGNHAKSRQFAGKGILVHHTDYQ

SEQ ID NO: 6213 - protein, 117 aa, Xenorhabdus bovienii
  Peptide sequence Name=Xb4151_4152.C421.gene12.pep
  Gene classification: Gene name=ARC1; Function=EMAP domain; Function class=R General function prediction only
  Homolog annotation: Query=9..116bp; Hit=2..109bp; Blast score=124; Percent Identity=61.0; E value=2e-29; Homolog= BH1785 COG0073
MENIHLEPATFDAFMSLDIRVGKIIKAEKNEKAIKPAYKLYIDFGSDIGEKQSSAQICQNYTEEQLIGKQVLAVVNFPPRRVAGFKSEVLVLAAVCDDQGTVLLQPERDVTLGTRIL

SEQ ID NO: 6214 - protein, 52 aa, Xenorhabdus bovienii
  Peptide sequence Name=Xb4151_4152.C421.gene13.pep
MRNNIQGKMTFDLWNVDRNESSSGKLFLLTHSTRNHFDRVYLWVVVRNGFLT

SEQ ID NO: 6215 - protein, 286 aa, Xenorhabdus bovienii
  Peptide sequence Name=Xb4151_4152.C421.gene14.pep
  Homolog annotation: Query=1..286bp; Hit=16..301bp; Blast score=343; Percent Identity=60.0; E value=2e-93; Homolog= gi|37526856|ref|NP _930200.1| hypothetical protein [Photorhabdus luminescens subsp. laumondii TTO1] gi|36786289|emb|CAE15340.1
MAEACCPASCGELLQGWLFGGEKLISCPINWFSCVAVSEGHASADERPRMRQMVELLLEHWNEPAELSACLRIEYQSTIPVAKGMASSTADIAATAHATAKLLGKSLNSTTLAQLCVKLEPTDSTVFESLTLFDHLTAQTQIPFAWQPDIDILLLESRQTILTEEHHRRDRRQLLLESAPLLQQAWQQFRIANKHHDNSRLGEACTLSAIANQPILPKPRFYQLLDLVEQSGIYGLNVAHSGSIVGLLCNSHQHDMDDLFWQLGQKPISDYYPQIHPVKMIAGGVR

SEQ ID NO: 6216 - protein, 357 aa, Xenorhabdus bovienii
  Peptide sequence Name=Xb4151_4152.C421.gene15.pep
  Gene classification: Gene name=HisC; Function=Histidinol-phosphate aminotransferase/Tyrosine aminotransferase; Function class=E Amino acid transport and metabolism
  Homolog annotation: Query=16..355bp; Hit=3..347bp; Blast score=165; Percent Identity=33.0; E value=8e-41; Homolog= sll1713 COG0079
MSEHGGNIIEVAQQFGIPANELIDLSANINPLGAPERVKTLIKDNLACIEKYPDVEYRHLHQVLADAHQCDTASVIAGNGATELIYAVVRYLNPKRALLLTPGFAEYRRALQHVGAEIIAYPLTEDAGFQPDLRLLDTLTILQPDCVFIATPNNPTGLMPDSRFLQSLGQHCEEHRIALIVDEAFIDFLPDNRGLIPHIAATRHLYVLRSLTKFFAIPGLRLGYLVSGDCAGVAWMKNRREPWSINALAAQVGEVLLDDQAYITATHQWLKSQQHYLWTYLSSCPELTVWPPSANFLFFRCHQPNLDLWHTLLEHRLLIRHCKNYVGLDESYYRIAVRSEWENRRLTAAIQHVFAHG

SEQ ID NO: 6217 - protein, 266 aa, Xenorhabdus bovienii
  Peptide sequence Name=Xb4151_4152.C421.gene16.pep
  Gene classification: Gene name=CysG; Function=Uroporphyrinogen-III methylase; Function class=H Coenzyme metabolism
  Homolog annotation: Query=1..236bp; Hit=3..240bp; Blast score=226; Percent Identity=48.0; E value=1e-59; Homolog= BS_nasF_1 COG0007
MNKGKVWLIGAGPGEAALITVKGLHYIQSADVIVHDRLVNPELIAQAPEHCDIINVGKERNHHPIPQEEINQILVKHALDGKQIVRLKGGDPYVFGRGGEEAETLAQQGIEFEIIPGISSAIGGLAYAGIPVTHRDYASGFHVVTGHLSLGKEPQNWRALAQLDGTLIILMGMSRLAEICQQLIQFGKPPATPAAVIMYASQPRQEMTIATLATLTTEVEHHQLHAPALIVIGNVVRLTEILAFTSTPIALSSTAVMMNPLTRLVT

SEQ ID NO: 6218 - protein, 35 aa, Xenorhabdus bovienii
  Peptide sequence Name=Xb4151_4152.C421.gene17.pep
MLNNEKNTIRLLSIIHTTRVPYTLLYKKENIKGVL

SEQ ID NO: 6219 - protein, 464 aa, Xenorhabdus bovienii
  Peptide sequence Name=Xb4151_4152.C421.gene18.pep
  Gene classification: Gene name=CobB; Function=Cobyrinic acid a,c -diamide synthase; Function class=H Coenzyme metabolism
  Homolog annotation: Query=8..463bp; Hit=6..462bp; Blast score=315; Percent Identity=39.0; E value=7e-86; Homolog= BH1898 COG1797
MRQKYAFVIAGTGSGCGKTTVTLGIMRALMCRQLRVQPFKAGPDYLDGGWHRAVTGVASRNLDAFMLPVPILNGLFNQAVADKDVAVIEGVMGLYDGYGADPDYCSSAALAKQLGCPVILVVDGKAVSTSIAATVMGFQHFDPSVNIAAVLINRVNHDSHFQLLKQAIEDYCGLPVLGHIPVMPDIALPSRHLGLIPAQERNSQYDEQWQHLAHQIETTVDLDTLLALTPLPALPQGDITSLVDPAIGQGLTLALAEDEAFHFYYSDNLLLLEHAGVVIKRFSPLHDSQLPECQMIYLGGGYPEMYAQSLAANHAMHEALRQAQRQGIAIYAECGGLMYLGDALTDVQGVRHSMVGLIAGESRMGNSLKRFGYCEATAVCDTLLVAKGETLRGHEFHYSDFTSAQPPVFHCTKQRSGMVQKSWFGGYQNGNTLAGYLHVHFAQRPDLLHRWLTIARKQMARGQS

SEQ ID NO: 6220 - protein, 324 aa, Xenorhabdus bovienii
  Peptide sequence Name=Xb4151_4152.C421.gene19.pep
  Gene classification: Gene name=CbiB; Function=Cobalamin biosynthesis protein CobD/CbiB; Function class=H Coenzyme metabolism
  Homolog annotation: Query=3..297bp; Hit=6..297bp; Blast score=206; Percent Identity=44.0; E value=2e-53; Homolog= BH1588 COG1270
MTVLLWFAAFVLDMKLGDPPHWPHPVRWMGRLINQAERVIRGRCKTDADLKWGGVALWLVVVGSVWLMSYLVLWLAYGVAFWFGMLVEVWLIYTVLAGRSLSDAANAVYQPLKQGDPVASRQQLAQIVGRDTSQLQPPQISRAAIETVAENSVDGVIAPLFFLMIGGAPLAMAYKAVNTLDSMVGYKTPRYRALGMFSARMDDVANGIPARLGWLLLALAAKWLGLNFRQALRIGWRDRYQHRSPNSGWPEATVAGALGIRLGGPSVYFNQRVEKPWIGDARREVTPEDIPQSVQMMRVASVMALLLFALLHSLVSVTPFNAVL

SEQ ID NO: 6221 - protein, 217 aa, Xenorhabdus bovienii
  Peptide sequence Name=Xb4151_4152.C421.gene20.pep
  Gene classification: Gene name=CobH; Function=Precorrin isomerase; Function class=H Coenzyme metabolism
  Homolog annotation: Query=8..207bp; Hit=6..205bp; Blast score=108; Percent Identity=37.0; E value=3e-24; Homolog= mlr1379 COG2082
MNYPQRSYIQQPQQIEQHSFDIITGIIRESRPDYHFVDAGQEAVIKRVIHTTADFDWLDILHFSPDVLHRIRDGILRGCTLYTDTTMVLSGINKTRLAQYGSECRCYVSDPRVVQMAKVQQITRSMAAVDIALQESGEKIFVFGNAPTALFRLLEHQSTPIAVVGVPVGFVGAEESKNALIHSDLSCIAARGRKGGSNIAAAIINAVLYRMPEVRHE

SEQ ID NO: 6222 - protein, 415 aa, Xenorhabdus bovienii
  Peptide sequence Name=Xb4151_4152.C421.gene21.pep
  Gene classification: Gene name=CbiD; Function=Cobalamin biosynthesis protein CbiD; Function class=H Coenzyme metabolism
  Homolog annotation: Query=52..402bp; Hit=7..355bp; Blast score=214; Percent Identity=36.0; E value=1e-55; Homolog= MJ0022 COG1903
LRREGAKVAAILRRRLSTLFCTGCRRCGMNETLNETPHTQAESLGTVWHRGKQYRKGYTTGSCATAAARVAALMILRQQIIHQVSIVTPSGVTLALNVEQPLIEGQQAVAAIRKDGGDDVDATHGMLIFARVSLNDSGIITLDGGAGVGRVTRVGIGLPIGWAAINKTPRHTIEEAVREVIGLQRGADIVIFAPEGEERAKKTYNDRLGIKGGISIIGTTGIVMPMSEESWKRSLALELEAKRASGLDRIIFVPGNHGERFVSQQLGIDGNYVVTMSNFVGYMLQEAVRLQFSHVVLVGHVGKLVKIAAGIFHTHSHIADGRMETLIANLALMGAPFELIQAVDHCDTTEAAIELIAERGWQAVHQQIARKICGRVDQMLRFSSGRPQCDAILFSFDNQVLGCNRPVDEIVEGFR

SEQ ID NO: 6223 - protein, 206 aa, Xenorhabdus bovienii
  Peptide sequence Name=Xb4151_4152.C421.gene22.pep
  Gene classification: Gene name=CobL; Function=Precorrin-6B methylase 1; Function class=H Coenzyme metabolism
  Homolog annotation: Query=1..206bp; Hit=1..214bp; Blast score=100; Percent Identity=32.0; E value=1e-21; Homolog= sll0099_1 COG2241
MITVVGIGPGAIANQTLAALDAIKQAEILVGGARHLAEFPHFRGETRRLNADMDGLMQWLELRQHQQVVVLASGDPLFYGIGKRIAEHFVGEPQNIRIISGISAIQYLCARILLDMNDIYLTSSHGRKPDFDWLLRHEKIAMVTDEVIGPRQIAEEILARGQHRRMVIGENLSQENERIVCLSAQQVAGYGDINYGLNVVVILNER

SEQ ID NO: 6224 - protein, 198 aa, Xenorhabdus bovienii
  Peptide sequence Name=Xb4151_4152.C421.gene23.pep
  Gene classification: Gene name=CobL; Function=Precorrin-6B methylase 2; Function class=H Coenzyme metabolism
  Homolog annotation: Query=3..184bp; Hit=42..225bp; Blast score=88; Percent Identity=32.0; E value=5e-18; Homolog= slr1368 COG2242
MKDELFLRGHRIPMTKETVRALALERLELTKARRLIDVGAGTGSVSIEAALRYPTLDVLAIERKEEALALIYENVRHFGCHTVRIQAGVAPLPLEEAVDAIFIGGTGGHLTELIDWSLTHLNPGGRLVMTFILLENFMQALAHLQSCQVVSLDGREIQIGELTPLGQGHYFKPNNPTYLISCQKFFEHLSEPEENAYA

SEQ ID NO: 6225 - protein, 264 aa, Xenorhabdus bovienii
  Peptide sequence Name=Xb4151_4152.C421.gene24.pep
  Gene classification: Gene name=CobM; Function=Precorrin-4 methylase; Function class=H Coenzyme metabolism
  Homolog annotation: Query=16..264bp; Hit=6..255bp; Blast score=278; Percent Identity=56.0; E value=4e-75; Homolog= MJ1578 COG2875
MPEYVDPESACFDAEKVWFVGAGPGDKTLITLKGYQLLQQAQVVIYAGSLINRELLEYCRADAECYDSAGMTLQEITDLMANSVKAGKLVVRLQTGDLSLFGSIREQAEMLAGQGIGFVSVPGVSSFLGAAAQLGVEYTVPEVAQSLIITRMVGRTPMPPRETLEAFAAHQTSMAIFLSVQDIAGVTVRLIQGGYPQETPVAVVYKATWPDCRIVRGTLDTIVEQVRTAGIQKTALILVGAFLGEEYHYSKLYDAGFSHEYRQA

SEQ ID NO: 6226 - protein, 360 aa, Xenorhabdus bovienii
  Peptide sequence Name=Xb4151_4152.C421.gene25.pep
  Gene classification: Gene name=CbiG; Function=Cobalamin biosynthesis protein CbiG; Function class=H Coenzyme metabolism
  Homolog annotation: Query=29..356bp; Hit=12..322bp; Blast score=132; Percent Identity=33.0; E value=8e-31; Homolog= MTH1408 COG2073
MMRGSAMNIVKHDERIALFCLTFGGMALARRLQSHLAVDCFTSPELVETGFRAFDSGFANTVRNAFIQYGSLVMVGATGIAIRVIAPLLKDKLIDPAVVVLDEKGQFAISLLSGHMGGANDLARQVADLLGGQAVITTATDVNQLAAIDMLSRQIDGEMADFRASVKTVNQMLVNGKRVGIWWHPALIDEKGQCDTRGFIPVESLDDLPELDALVYVSHRRATPVLAIPTFKLVPRRIIAGIGCRRGIAAERVAQLLDRHLAEHDFDPLALKAIGSVELKQEEPALVQLAEKRRIPFQIFSVNQLAQCEQAFPASEFVRKTVGVGCVSQPVAWLMSQGRLVGHTLREQGVTITLGVLQPC

SEQ ID NO: 6227 - protein, 241 aa, Xenorhabdus bovienii
  Peptide sequence Name=Xb4151_4152.C421.gene26.pep
  Gene classification: Gene name=CobJ; Function=Precorrin-3B methylase; Function class=H Coenzyme metabolism
  Homolog annotation: Query=2..239bp; Hit=5..243bp; Blast score=195; Percent Identity=43.0; E value=3e-50; Homolog= TVN0921 COG1010
MLTVIGIGPGSEAMMTQEAIAALKAADIVVGYKTYTHLVKPLVGDKEIIKTGMCKEIERCQVAIDLAEEGKNVALVCSGDAGIYGMAGLVLELVSQHQRHVEVRLVAGVTASTACASLLGAPLMHDFCHISLSDLLTPWAVIEKRVRAAAEADFVVCFYNPRSRGREDHLAHAFALMAPWTPAETPVGVVKAAGRKKEEKWLTTFGGMDFSRVDMRSLVIVGNQSTYVRDGLMITPRGYRL

SEQ ID NO: 6228 - protein, 264 aa, Xenorhabdus bovienii
  Peptide sequence Name=Xb4151_4152.C421.gene27.pep
  Gene classification: Gene name=CobK; Function=Precorrin-6x reductase; Function class=H Coenzyme metabolism
  Homolog annotation: Query=8..243bp; Hit=43..279bp; Blast score=118; Percent Identity=32.0; E value=6e-27; Homolog= MTH1002 COG2099
VKQPQIHIFGGTSDARQICMMMDSAGIDYRLSVATATGAQQAADIRGDIVIGRMEAEGMVDYLQKQKTQRVIDASHPYAEQLSQNIAQACQKLDIPLIRYIRPSDIDDVEHALIHKVATLDQACEVAARLGERILLTTGSKQLADYVTRLAGKTVLARVLPTAEVLALCESCGLSVDQIFALKGPFSADFNRAFYQFCQADVVITKESGEQGGFKEKVEPCLALGLPCIVICRPVHPFNGEGITQANGLEEMAQLLANFPAIAN

SEQ ID NO: 6229 - protein, 264 aa, Xenorhabdus bovienii
  Peptide sequence Name=Xb4151_4152.C421.gene28.pep
  Homolog annotation: Query=1..262bp; Hit=1..262bp; Blast score=353; Percent Identity=66.0; E value=2e-96; Homolog= Pa|Phot5-515h10.p1k _g141| 87154 - 87948 1743 264 aa, chain -
MKKALLVISFGTRYPETRKNNIEACEQQLASVFPDRELFRAFTSGMIIRKLRERDGIHIDTPHDALTRLYHAGYHDIAVQCLHIIKGDEYEKVLHEVERFRPQFQRLVLGAPLLNHFEDYLQLMRALHHQLPRLGDKECVVFMGHGTTHPAFSAYACLDHLMTHYHFPARVGAVESYPEIALIIKGLKAEGIRKVHLMPLMLVAGDHAINDMASDESDSWKSQLEKAGMTAIPWLQGLGENPMIRQMFVAHLTDAMNENSREDA

SEQ ID NO: 6230 - protein, 237 aa, Xenorhabdus bovienii
  Peptide sequence Name=Xb4151_4152.C421.gene29.pep
  Gene classification: Gene name=CobF; Function=Precorrin-2 methylase; Function class=H Coenzyme metabolism
  Homolog annotation: Query=1..206bp; Hit=1..208bp; Blast score=118; Percent Identity=35.0; E value=5e-27; Homolog= MTH1348 COG2243
MSGKLYVMGVGPGASDLITVRAARILARLDVIYAPSGKKGVQSLAHSIVEEYLSPETEVCTYHFLMKSDRGEKEVVWNNVAQALQEEVAKGRKVGFITLGDPMLFSTWLFLLERIGNPSWLEIVPGITSFAAIAARSAMPLAMENQTLSVIAGTASDAVLEQALLNHDCIVLMKVYSNFERIRELLQRHHLLQHALMMADATLPTEQYWRHLDALESGQELSYFSTILVNKNWQLPR

SEQ ID NO: 6231 - protein, 243 aa, Xenorhabdus bovienii
  Peptide sequence Name=Xb4151_4152.C421.gene30.pep
  Gene classification: Gene name=CbiM; Function=Cobalamin biosynthesis protein CbiM; Function class=H Coenzyme metabolism
  Homolog annotation: Query=29..234bp; Hit=1..204bp; Blast score=191; Percent Identity=51.0; E value=5e-49; Homolog= MJ1091 COG0310
MQQKLTKFSLSGAAIALLLALAPQEAFAMHIMEGFLPPMWAVAWWLAFLPFLAAGIMRLRQIVQEDSNQKVLLALCGAFIFVLSALKIPSVTGSCSHPTGVALAVILFGPSVVAVLGAIVLLFQALLLAHGGVTTLGANGMSMAVIGPLVGYLVWRFSCKMGVRKDIGVFFCAFIADIVTYSVTSIQLGVAFPDPQLGMGAAIIKFMGIFCITQLPIAVAEGLLTVLIYDQLVKRQLIQARSF

SEQ ID NO: 6232 - protein, 93 aa, Xenorhabdus bovienii
  Peptide sequence Name=Xb4151_4152.C421.gene31.pep
  Gene classification: Gene name=CbiN; Function=ABC-type cobalt transport system, periplasmic component; Function class=P Inorganic ion transport and metabolism
  Homolog annotation: Query=1..91bp; Hit=1..90bp; Blast score=70; Percent Identity=42.0; E value=4e-13; Homolog= VNG1634G COG1930
MKKTLILLSLLIALCVIPFFIDHGGEFGGADGQAEAQIMEIAPNYTPWFESLYEPASGEIESLLFTLQGSLGTAVIFYILGYYRRSRKDHDRH

SEQ ID NO: 6233 - protein, 225 aa, Xenorhabdus bovienii
  Peptide sequence Name=Xb4151_4152.C421.gene32.pep
  Gene classification: Gene name=CbiQ; Function=ABC-type cobalt transport system, permease component CbiQ and related transporters; Function class=P Inorganic ion transport and metabolism
  Homolog annotation: Query=2..221bp; Hit=6..219bp; Blast score=73; Percent Identity=26.0; E value=1e-13; Homolog= MTH132 COG0619
MIGIDKLSDQSRWRNKDPKAKFALYLLFMVLAMGLSPVWQAVLLFGLALFTCYLLRISLLRYLKWLLIPLGFLGIGLIAIVLSASLQPDSLLWGFKVGQYWLGIDSQGVNMANQTLWRSLATLAATFWFMLNMPFEQMIKLLKFCRVPHLLIEQILLTWRFIFIFVEEAAAIHRAQSLRFGYRSLRTDYRSLAMLVGMLFTRVMSRYQQMSVALTLKLYQGDFHL

SEQ ID NO: 6234 - protein, 270 aa, Xenorhabdus bovienii
  Peptide sequence Name=Xb4151_4152.C421.gene33.pep
  Gene classification: Gene name=CbiO; Function=ABC-type cobalt transport system, ATPase component; Function class=P Inorganic ion transport and metabolism
  Homolog annotation: Query=1..238bp; Hit=3..241bp; Blast score=195; Percent Identity=40.0; E value=3e-50; Homolog= MJ1088 COG1122
MLATQALYFSYQDEPILQNLTLDFSHHQVTGIIGANGCGKSTLLMNLSGILRPQQGAVWWDNAPLDYSKKRLMALRQRVVTVFQDPDQQIFYTDIDSDLAFSLRNLGVEEAEIQRRIERALTLVDAHAFRNKPIQYLSFGQKKRVAIAGALVMEFDYLLLDEPTAGLDPSGRQQMLEIIAMIAAGGKRIIISSHDIDLIYQICDGLYVLAKGRVISSGKPETVFLQKDLLEQAGLVQPWLVKVHSEAGLPLCKTEQALFAILHATKEKRQ

SEQ ID NO: 6235 - protein, 513 aa, Xenorhabdus bovienii
  Peptide sequence Name=Xb4151_4152.C421.gene34.pep
  Gene classification: Gene name=CobQ; Function=Cobyric acid synthase; Function class=H Coenzyme metabolism
  Homolog annotation: Query=5..507bp; Hit=16..513bp; Blast score=397; Percent Identity=44.0; E value=1e-110; Homolog= MTH787 COG1492
MTLSLMIQGTASDVGKSVLVAGFCRIFLQDGYHCIPFKSQNMALNSGITADGKEMGRAQIFQAEAAGIEPDVRMNPVLLKPTSDRKAQVIFMGKVVCSMNAVEYHEYKPRLQQQILAAYDSLAAETDIMVLEGAGSPAEINLRDRDIVNMGMAELADVPVILVADIDRGGVFAAIYGTLALLRPEERARVKGVIINKFRGDPALLQSGIDQIEELTQVPILGVLPWLDLDLEDEDSVALQVGKYAHSGKHTENWLDIAVIQFPHIANFTDFNALAAQPDVHLRYVSDPSALHGSDLIVLPGSKNTLGDLLWLKIQGLDQAIIAAHQSGIPIIGICGGFQMLGKQIIDEVESGLNRMAGLGLLDADTQFANEKHTAQVKGVVMPELTGMLNSCSEQPIAGYEIHMGMTQLGEQAWPFAKMHLRNGEETVWFDGAVNQSGSVMGSYLHGLFDQNTFTRPLLNQLRRQKGLAPLENVMFNYVQHKEKQFNILAASMREHLDIDRIYQLMKEHEEHH

SEQ ID NO: 6236 - protein, 37 aa, Xenorhabdus bovienii
  Peptide sequence Name=Xb4151_4152.C421.gene35.pep
VHLPSPKSFCDPKLRKVTMLTRYALFLQSVMLFMLFH

SEQ ID NO: 6237 - protein, 181 aa, Xenorhabdus bovienii
  Peptide sequence Name=Xb4151_4152.C421.gene36.pep
  Gene classification: Gene name=CobU; Function=Adenosyl cobinamide kinase/adenosyl cobinamide phosphate guanylyltransferase; Function class=H Coenzyme metabolism
  Homolog annotation: Query=1..181bp; Hit=2..181bp; Blast score=226; Percent Identity=65.0; E value=9e-60; Homolog= cobU COG2087
MILVTGGARSGKSAYTERRIAGQCEQVLYIATAQVTDEEMAARIERHRQERPSHWRTWEGYQDLASVIRQHRQPEEGVILECVTTLTANLLFDESAGASPDEWDFPSLEGFIQRQIDDLIAACLHCPAPVYLVTNEVGMGIMPENRLARHFVDIAGRVNQKLAQAAKEVWLMVSGVGVKIK

SEQ ID NO: 6238 - protein, 252 aa, Xenorhabdus bovienii
  Peptide sequence Name=Xb4151_4152.C421.gene37.pep
  Gene classification: Gene name=CobS; Function=Cobalamin-5-phosphate synthase; Function class=H Coenzyme metabolism
  Homolog annotation: Query=5..250bp; Hit=4..247bp; Blast score=197; Percent Identity=49.0; E value=1e-50; Homolog= cobS COG0368
MKLNLFWATLQFMTRLPVPVKWTEGVDFSQYWRGVPNFPVIGLIIGGLAALISLSISQSGGGMYIGAIGYVLALALLTGGLHLDGLADTCDGLFSARRRETMLAIMRDSRLGTYGGLGLIFCLFLKVFAVAELSYHPPLELFALLTCAPIVGRTAVVLLMYEQRYAREGEGMGSSYIGRMTPRSTALTLLGGAVLVIALGDWQGLIAMMVTLIVIYGLAFYFNYRLGGQTGDTLGASIEAGEVIFLLVMIWE

SEQ ID NO: 6239 - protein, 92 aa, Xenorhabdus bovienii
  Peptide sequence Name=Xb4151_4152.C421.gene38.pep
LHQVKIEESCVSSWLFFRPIFCPSIEDTQCDYRRRYKHLAEREKTTWLLSAFCQSDNQRAPVPVSDRSVLPQKTLLILASVCPCRTRKSRIG

SEQ ID NO: 6240 - protein, 354 aa, Xenorhabdus bovienii
  Peptide sequence Name=Xb4151_4152.C421.gene39.pep
  Gene classification: Gene name=CobT; Function=NaMN; Function class=H Coenzyme metabolism
  Homolog annotation: Query=3..354bp; Hit=4..357bp; Blast score=376; Percent Identity=58.0; E value=1e-104; Homolog= cobT COG2038
MTLQSLLDAIQPLNQAKIETATQHIDSLVKPLGSLGRLEALAIQLSGMPGILDLRNLQKEIIVMCADHGVYDEGVAISPKNVTAIQARNMLQGITGVCVLAKNSGTHVLPVDIGIDGDPIDNLLSLKLARGCGNIAQGAAMQYTQAETLLLASAQLVQQRIAAGVSVFGVGELGIANTTPAAAVISVLTGSDPHDVVGQGANLPIEWLMHKGSVVHQSIIVNQPNKNDALDVLAKVGGFDLVGMTGVILGAAASGVPVVLDGFLSYASALAACQMAPIARNYCIPSHLSAEKGSGLALQHLRLQPYLHLGLRLGEGSGAAIAMSLIDAACAIYCNMGQLASSGISLPEQSSKGI

SEQ ID NO: 6241 - protein, 149 aa, Xenorhabdus bovienii
  Peptide sequence Name=Xb4151_4152.C421.gene40.pep
  Homolog annotation: Query=20..69bp; Hit=94..143bp; Blast score=67; Percent Identity=58.0; E value=5e-11; Homolog= gi|25169175|emb|CAD48011.1| putative DNA recombinase [Arthrobacter nicotinovorans]
LCDLLQYGATGEQWDQFAGAEFERDLIWLRTREGMAITRAKGKLRGKQPKFLDKQQKELCRMHGMAEYSTIWLNCFQYRYQLSIRLLYVQIIFKSRLCSVIINPTMISFSGVFMLKFYSLVSLLWLSISAFAHSSSAVGFKEIDLVLQS

SEQ ID NO: 6242 - protein, 87 aa, Xenorhabdus bovienii
  Peptide sequence Name=Xb4151_4152.C421.gene41.pep
MRSPPCIFSRSALVTILRIREKKTAKGLIALSVSELRKLLSELMEKTGETVEQILHWSYWRRRHQYYAQQCHYRHRDNPLITNKLRL

SEQ ID NO: 6243 - protein, 47 aa, Xenorhabdus bovienii
  Peptide sequence Name=Xb4151_4152.C421.gene42.pep
MQGGDRITVSGQQEVNRLTVGIDRPVKVFPLTFYFDIGFTHPPSQPL

SEQ ID NO: 6244 - protein, 60 aa, Xenorhabdus bovienii
  Peptide sequence Name=Xb4151_4152.C421.gene43.pep
VLIFLRLRTEFLLEWQFSKVTSTLLADGKDPCVNRKGFGGSWSGWFHSGCDGGWVKPISK

SEQ ID NO: 6245 - protein, 79 aa, Xenorhabdus bovienii
  Peptide sequence Name=Xb4151_4152.C421.gene44.pep
  Homolog annotation: Query=7..74bp; Hit=343..411bp; Blast score=69; Percent Identity=44.0; E value=1e-11; Homolog= gi|18539288|gb|AAL74315.1|AF311911_1 aspartate transcarbamoylase [Toxoplasma gondii]
MAGYRETADHLPNSNLMLTPDLLSHLHPRAIIMHPLPRGYELPYELDNSVHCAYFSQAENGVFVRMAILQGYFNVIGGR

SEQ ID NO: 6246 - protein, 219 aa, Xenorhabdus bovienii
  Peptide sequence Name=Xb4151_4152.C421.gene45.pep
  Gene classification: Gene name=PyrB; Function=Aspartate carbamoyltransferase, catalytic chain; Function class=F Nucleotide transport and metabolism
  Homolog annotation: Query=12..217bp; Hit=7..207bp; Blast score=107; Percent Identity=34.0; E value=1e-23; Homolog= PH0720 COG0540
MISVQNFFLKDNLLSIKSLNLDTIMNIIDLAQNFKVSKPDKKIKKRNEDILVASLFFQASTRTRLSFESAANRLGARVIGFADGESSRSGSSWNEKFTDTAQMINAYADIAVIRHAEVEPVHNYCIKSRLPVINAGNGEGLNAEHPTQALLDIFTIHQSFPLHKSLTLLLCCHPSSRSARSLLFCIALFHNIKLLLCTEENCKLFQEDEAYLRQAGVTY

SEQ ID NO: 6247 - protein, 349 aa, Xenorhabdus bovienii; identical to SEQ ID NO: 5796
  Peptide sequence Name=Xb4151_4152.C421.gene46.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 6248 - protein, 720 aa, Xenorhabdus bovienii
  Peptide sequence Name=Xb4151_4152.C421.gene47.pep
  Gene classification: Function=Uncharacterized membrane protein; Function class=S Function unknown
  Homolog annotation: Query=9..717bp; Hit=10..711bp; Blast score=868; Percent Identity=63.0; E value=0; Homolog= yccS COG1289
VLTVLSSSRHFLYNSHVLYYIRIFIALTGTTLVPWLLGEEPKMTIPLTLGVVAAALTDLDDRLVGRLRNLMITLVSFFAASTSITLLFPYPWLFMVGLAVSTCSFILLGALGQRYATIAFGALLIAIYTMLGTSIFPLWYQQPLLLLTGAIWYNLLTLTGHLLFPIRPLQENLARCYQQLSAYLYAKTSLFDPDSEAEECKQSMFDVAMANSALVTTLNQAKISLLSRLKGDRGQRGTRHTLHYYFVAQDIHERASSSHVQYQKLRETFRHSDILFRCQRLLSMQARACEQVSQSIILRKPYQHNSRFENAFNYLESSLERLKNQQGADTQIMAFYNLLRNLRAIDAQLSGLNSEQSPLFQNTSQSGKQEDTQLSDEALTGWRDVWFRISSNLTPKSALFRHAIRMSVLLCTGYAIIQLFDLQRGYWILLTSLFVCQPNYNATRRRLALRVIGTLAGILIGLPILYFVPSIEGQLVLIIISGVLFFAFRNIQYAHATLFITLLVLLSFNLLGEGFEVALPRITDTLIGCGIALLAVSFIWPDWKFRQLPRVINRTMIANCRYLDAIVGQYYQGKSNSLNYRISRRDAHNCDAELASVISNMASEPKNYRVSQEEAFRLLCLNHTMLSYISALGAHRDRLNNQVILDILNDAIFQVESALQQGRVDDERLQHISERLAESINLISSDSSGKIQLVLQQIGLLVELLPEFVSLIKQLTQSDI

SEQ ID NO: 6249 - protein, 687 aa, Xenorhabdus bovienii
  Peptide sequence Name=Xb4151_4152.C421.gene48.pep
  Gene classification: Gene name=UvrD; Function=Superfamily I DNA and RNA helicases; Function class=L DNA replication, recombination and repair
  Homolog annotation: Query=1..686bp; Hit=1..683bp; Blast score=870; Percent Identity=63.0; E value=0; Homolog= helD COG0210
MELKSTQMGQRLAQHPYNRVRLLNAGIEVSGDKHQYLIPFNQLMSIQCKRGIVWGELEFELYDGKVVRLHGTKWQQTQHFYHYLLKEWQQWSLDMSDVSADVLAAQLNEINKITQQDRWFKTADLLSLQQQIQEAFQALPLPLARIEQFENCRDDYRMCLDWLNEGGKTIKTLNQQWIERILQQYAEFFQTIETTPLNRSQCQAVVNGEKSILVLAGAGSGKTSVLIARAGWLLLRQQALPEQVLLLAFGRQAADEMNKRIQERLGAKEIQAKTFHALALHIIQQGSHTAPKMSELETDAQKRRDFLINEWQKQCSEKKAQAKGWREWLNQELDWQLPEGEYWHDKQLTIRLSDRLERWLELMRMHGGSQKEMIEQASPAYADTFQKRIRLMAPLLKAWKSALKSEGAVDFSGLIHQAVNILEKGRFISPWKHILVDEFQDLSPLRAKLLAALRVQNKQSHLFAVGDDWQAIYRFSGAELMLTTAFSTYFGEGAESAECTLDTTYRFNDRIGEIANRFIRQNPNQLNKPLHSLTKGTKKSVVILSQEQLEALLNKMSGYVTKQETILLLGRYHHFKPEFLKKASTRWPNLNIEFMTIHASKGQQSDYVIILGLQQGQDGFPAPARESVLEQVLLPQPENFPDAEERRLLYVALTRAKKQVWLMQEPDNPSVFIHQLTQLGVAIQSKL

SEQ ID NO: 6250 - protein, 92 aa, Xenorhabdus bovienii
  Peptide sequence Name=Xb4151_4152.C421.gene49.pep
MVDAGAGQSVGIHSSINTIGCGNPKQAIRSWNIFLIRVTTSFLSALDWRILHSRLIWLACNEEAKSLAENTGLNVVMDCCPKIEIPRLAMEK

SEQ ID NO: 6251 - protein, 106 aa, Xenorhabdus bovienii
  Peptide sequence Name=Xb4151_4152.C421.gene50.pep
  Gene classification: Function=Uncharacterized ACR; Function class=S Function unknown
  Homolog annotation: Query=2..106bp; Hit=18..122bp; Blast score=158; Percent Identity=74.0; E value=1e-39; Homolog= yccV COG3785
MMIASKFGIGQQVRHKLLGYLGVIVDIDAEYSLEQPQENDIASNATLRSAPWYHVVMEDDDGQPVHTYLAEAQLAYETSDDHPEQSSLDELAESIRSQLQAPRLRN

SEQ ID NO: 6252 - protein, 42 aa, Xenorhabdus bovienii
  Peptide sequence Name=Xb4151_4152.C421.gene51.pep
MRWQSHAILFGYKKFRLPGMHLKFTLLPLYKNLCKVSLEVTI

SEQ ID NO: 6253 - protein, 109 aa, Xenorhabdus bovienii
  Peptide sequence Name=Xb4151_4152.C421.gene52.pep
  Gene classification: Gene name=AcyP; Function=Acylphosphatases; Function class=C Energy production and conversion
  Homolog annotation: Query=25..108bp; Hit=9..92bp; Blast score=88; Percent Identity=52.0; E value=1e-18; Homolog= yccX COG1254
LTCQRSYYLVRREDEIMAIKGMTIYVYGRVQGVGFRYQTYCWAKKNKLVGYVRNMNDGSVKIVACSSDEQLKKLAHWLEQGGPPGAKVEHFKSQLCGVEEEMTDFSIRH

SEQ ID NO: 6254 - protein, 109 aa, Xenorhabdus bovienii
  Peptide sequence Name=Xb4151_4152.C421.gene53.pep
  Gene classification: Gene name=DsrC; Function=Sulfite reductase, gamma subunit; Function class=P Inorganic ion transport and metabolism
  Homolog annotation: Query=1..109bp; Hit=20..128bp; Blast score=175; Percent Identity=74.0; E value=6e-45; Homolog= ZyccK COG2920
MLVFKDRAIETDAQGYLKNSSDWQEDMASLLAEQEDITLTEQHWEVIRFVRKFYEEFNTSPAIRMLVKAISQKYGEEKGNSRYLYRLFPKGPAKQATKIAGLPKPVKCI

SEQ ID NO: 6255 - protein, 42 aa, Xenorhabdus bovienii
  Peptide sequence Name=Xb4151_4152.C421.gene54.pep
MSSTINITVLNVKYLSVQLPSNYSHYYPLAYFFSRFGDLSWE

SEQ ID NO: 6256 - protein, 404 aa, Xenorhabdus bovienii
  Peptide sequence Name=Xb4151_4152.C421.gene55.pep
  Gene classification: Gene name=XerC; Function=Integrase; Function class=L DNA replication, recombination and repair
  Homolog annotation: Query=1..389bp; Hit=1..389bp; Blast score=505; Percent Identity=62.0; E value=1e-143; Homolog= ZintL COG0582
MKLTDMAIKRAKPKEKSYMLADGNGLSLLVETNGSKGWRYRYQFTGKTKMISLGIYPVVTLTEARAKRDEARKQVANGINPSEARKAEKVASISQSENTFKNIALEWYEGRKDRWSVGYRDDMMDAFEKDVFPYIGDRPIADIKPMELLEVLSVMEKRGTTEKLKKVRQRCGEVWKYAIITGRAEYNPAPDLASAFVPHKREHYAHLSVSELPEFLSSIDKYMGSQIVRVALRILILTGVRPGELRKAEWSEINFDIGIWEIPAEKMKMRRPHIVPLSEQVIELLKQIHPISGSYQYIFPSRTDYRKHISDMALNTMIRRMGYSGRATGHGFRHTMSTILHEQGYNTAWIEAQLAHVDKNSIRGTYNHAQYLDGRREMLQWYADYMETLERGENVIHGKFGKSI

SEQ ID NO: 6257 - protein, 108 aa, Xenorhabdus bovienii
  Peptide sequence Name=Xb4151_4152.C421.gene56.pep
MDVTSIDFDLINYHAGETLQFYWDIRLCMLASRTVSSDSIEDKMESAKKCEKILEKFAFDMKINESHKIINDFISTISINRALELLGIYAINLKMRVLKSGSYQSTEW

SEQ ID NO: 6258 - protein, 349 aa, Xenorhabdus bovienii; identical to SEQ ID NO: 5796
  Peptide sequence Name=Xb4151_4152.C421.gene57.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 6259 - protein, 36 aa, Xenorhabdus bovienii
  Peptide sequence Name=Xb4151_4152.C421.gene58.pep
MFNCLYLLRINIEIYPSSLKMLDFSFVSDHDCAHEN

SEQ ID NO: 6260 - protein, 502 aa, Xenorhabdus bovienii
  Peptide sequence Name=Xb4151_4152.C421.gene59.pep
MAGKIDILPATLSNIIKGQPFRVTVTVSGETNISANTEIDIVSSQGVHLIKKFPGTVVKTNFIQQMIFLADDTDADYKISFTAKSASSPKGSVDYKPVENPELIPDSCVLRGSSSYLYDPSPVGLSGTPPTSSNPFILASINPMGVSGGSISKYDIQIRATGPVRIFTVDDVEILPYEVDDQKQYYDYLVQKSTKSAVNLKIYATTGIAQFIGFETIFSRRVYNQKQVMFITSSPIAVSDDFDPPIIEETYQSSTLTRPDQPDYFHFMIPQNNHLHPGDFIIGFVTDDDKHIYKKNLIFGEVAVAEDGYFRFKVAYSDMYNGTNFISYAALDQGGNLVGSEPNYISYDSGGNNNPSPNDQSRTLDAPEVHDQFGLFIGIYQSINIHSIGNKGIEVWLPVAATANDLNKIAEGDSITIKAYISYCVDTETPARPLPIVVTENHIVQQKEIDSGYYKHTIAADKLLGYDTIQGDFEGSISIDYSRLAQNQKSQLFTRGFDTVAP

SEQ ID NO: 6261 - protein, 315 aa, Xenorhabdus bovienii
  Peptide sequence Name=Xb4151_4152.C421.gene60.pep
  Homolog annotation: Query=7..118bp; Hit=11..125bp; Blast score=70; Percent Identity=40.0; E value=4e-11; Homolog= gi|37525980|ref|NP _929324.1| hypothetical protein [Photorhabdus luminescens subsp. laumondii TTO1] gi|36785410|emb|CAE14356.1|
MPIKKNSLVAPFLPQSYDGAIDLSKLDQSILVIKINHYEAVHIGDVIIVHLNQYLSSILYYITNANKDYPAYEITIPFSTIPLGSYNIFYTVTDCAGNTSDSVTSSVTIIKSDPSPFPVIASLKTEVLTNGMPANDYTPNVVLITALDEKKKSVSGVPIHIVSNDNMSIAPSSCITDQDGKVVFCSTSRADGFFSIQVSSGSTLNTTELYFSPTNEAILEITGKEQISEEYEIITIQVHDKQTLKQIKNATVYYKIDLAHNINAVLDIGYNPDTIQSMSTDEYGQFKINLKGKIGGYCIISATANNYIGSIKYTK

SEQ ID NO: 6262 - protein, 132 aa, Xenorhabdus bovienii
  Peptide sequence Name=Xb4151_4152.C421.gene61.pep
MATKTLSFVAIKSGWYVSYYFMTEAGYDYTITLTDKSTGTIYGTWTKNEDGDASIYKYSSSFEYTGSDGELICVVDCPESQKLDNSFSANLITPSAGSPTLGYTYCAAFEDFGGSIDYNDFFVCLVGWTHEG

SEQ ID NO: 6263 - protein, 1507 aa, Xenorhabdus bovienii
  Peptide sequence Name=Xb4151_4152.C421.gene62.pep
  Gene classification: Function=Predicted outer membrane protein; Function class=M Cell envelope biogenesis, outer membrane
  Homolog annotation: Query=1039..1422bp; Hit=4..402bp; Blast score =116; Percent Identity=30.0; E value=2e-25; Homolog= Z0402_2 COG3468
MKICKQALMPIAIKLALFFPGVSVNAIAASSCGSSNTTTIISDNEAEPCNLSNGENLTINQSASIDIPQGQTDNSDRYGLKKSAVNVGGNNDVAPVTSIDHIENHGILKGDSGITVTYSGSVGKLLNHGVISGASGGVWVSGHMNTLDNYGVIKAENIDTALYSVMLSQALNQKNGSQGSIDTIFNREGGSIDGISVRMAKLNTLDNHGTLTSQVNFAGSTGGTLIVDSGGHVGTFNNYGSVTGPNHGIVITGGGYLENVNNQAGSKGIMTGQDAIQVTGQDTSDSQKKSSNIKQITNASFIRGKHNGISIDDKGTVDTITNLDGGVIQGDKFSINNKGTLINGIDNAGTIDGDVELGSASLYMSGPNAILKGNVSGTKDSVVTIGSKDAMTKNLNLSFTHNMNAGAVRILSENALTLGDGHTTGSIFSDINNEGRLNFNHSDKTTYSHIISGTGSVHQVGSGTTLLTGENTYTGETKIDSGTLQLGDNGTTGSIDKTSRVAIGQSGVLAFDHNNNITFSNNISGTGGVEHVGKGMTILSGQNTYVGKTNIKSGTLQFNTRNNGPDTRLVAIGSEGTLALNLNGTNRFDGVISGNGHLGKIGAGTTTLSSNSSDFTGSTGVEEGTLIVDGKLGTAASTFNVKNGSTVNGSGTIGGTATIENGGHLVGKQGDTLTFGHDLILGHGANVGISLGAAETSTSALFNVRGNLTLAGTLNVTNLGGFSAGEYDIFHYGGTLTNNRMTLTGGEPGTLSLDTSRDKKVYLTNTGGMLLNYWDGGDAGKHSNGVVDGGSGVWQVGGRNNWTSKTGWPNASWSNADQFAIFSGTAGKVQVDNGGGQVTVNGMQFGTEGYTLTGAPLLLKNDNTGSAKIRVGTGNQSAAGSTATIESNLTGSATLETTDYGTLVLKGKNDYTGGTKVTQGILQLGDGGTTGSISGDVVTGDKGTLAFNRSNTVTFGGHITGKGNLVQNGGGTTLLTGGNNYTGTTEIQKGTLRQGAKAAFSTVSSYTIGQNGTLDMGGFNTTISALSNNGRVLVGGDNQTVGRMLTVAGDYSGNNGTVSLSTALAADNSKTDKLVVNGSTSGTTQLAIKNVGGTGAKTQEGIKVIDVQGSSDGTFNLVADYHYQGDPAIVAGAYAYRLYKNGTDNSDGNWYLRSSLTRAKPNPEPAQHYQAGVSVYETYGRILQTLNAPESLRDRIGGRQYPLPDIDEFRSAEGKDSTDESTNPTPNGVWGRLTASHGKLSPRVTTSGADATTYNLFRAQIGMDKRFYENNQGSLDGGVFLQYSNIDAKVGSVHGEGDIRAKGYTVGATSTWYSKNQFYLDGLAQVTYFNNDLNSKTASQPLGNNKSALGYALSLEAGQAFDLSPRWSLTPQAQLMFSSVNMNGFHDPFGARIHFNQSKSMKLRVGTTIDYRQKWHDSLSKEEKSTHLYGFININQEVLGRSDLTDVANVGFISGNDRTWGGMGTGGSYSWGNGKYLIHGEISANSSLNNFADSYDMKAKIGIKRAW

SEQ ID NO: 6264 - protein, 52 aa, Xenorhabdus bovienii
  Peptide sequence Name=Xb4151_4152.C421.gene63.pep
MGPYHYLAFLKLYRPVKNRCCHAMLAGADDHFHFAINIASTCLHRRLPLLGF

SEQ ID NO: 6265 - protein, 33 aa, Xenorhabdus bovienii
  Peptide sequence Name=Xb4151_4152.C421.gene64.pep
LNTRPKKEGNHRFLCSRTILFTGCLNNRQHHFC

SEQ ID NO: 6266 - protein, 121 aa, Xenorhabdus bovienii
  Peptide sequence Name=Xb4151_4152.C421.gene65.pep
  Gene classification: Gene name=InsB; Function=Insertion element IS1 protein InsB, putative transposase; Function class=L DNA replication, recombination and repair
  Homolog annotation: Query=4..120bp; Hit=49..166bp; Blast score=112; Percent Identity=50.0; E value=4e-26; Homolog= insB_g4 COG1662
MGSFISNKKRQRWLWYAWEPRLKRIVAHAFGARSKQTLRTLLEKLSTFDVAFWCTDNFGAYDILADEKHVTGKLYTQRIERENLNLRNRLKRLNRKTLGYSKSVEMHDKIIGTFIEREFYY

SEQ ID NO: 6267 - protein, 91 aa, Xenorhabdus bovienii
  Peptide sequence Name=Xb4151_4152.C421.gene66.pep
  Gene classification: Function=Transposase; Function class=L DNA replication, recombination and repair
  Homolog annotation: Query=1..89bp; Hit=1..89bp; Blast score=80; Percent Identity=46.0; E value=2e-16; Homolog= insA_g5 COG3677
MALVEVKCRFCDQTTSVKKHGKGEGGHQRYYCQSCRRTFQLEYTYRACHSGMKEQIVKLAMNNAGIRDTARALHVSINAVVRTLKNSRRDV

SEQ ID NO: 6268 - protein, 125 aa, Xenorhabdus bovienii
  Peptide sequence Name=Xb4151_4152.C421.gene67.pep
MLNTFPNRGNMRFLANFISPLAARIVLGRMLSEGINAELIDENVVWNNYMYSQALGGVKLLVHNSDIERAKNIIIQIEQGCYQLDDSNENSLVSKNNVTNNILNTFFSIALFLITGIAIPFKPSL

SEQ ID NO: 6269 - protein, 186 aa, Xenorhabdus bovienii
  Peptide sequence Name=Xb4151_4152.C421.gene68.pep
  Gene classification: Gene name=RimL; Function=Acetyltransferases, including N-acetylases of ribosomal proteins; Function class=J Translation, ribosomal structure and biogenesis
  Homolog annotation: Query=2..168bp; Hit=5..171bp; Blast score=58; Percent Identity=31.0; E value=5e-09; Homolog= BH0699 COG1670
MIMRFDNLETERLLLRKLAYDDAPQIQQKFPHWEVVKYLDSNAVPWPYPDNGAGYFVNHIAMPEIQTEKAWIWSIRMKSNPDELIGVIGLYDKPDNNRGFWLSPEYHGRGLMREASKRVTDYWFNELDRTVLRTLKASINENSRKISLAQGMRLISTSKKQYVSGTYDSELWEITKDEWCNKPPFP

SEQ ID NO: 6270 - protein, 271 aa, Xenorhabdus bovienii
  Peptide sequence Name=Xb4151_4152.C421.gene69.pep
  Gene classification: Gene name=SmtA; Function=SAM-dependent methyltransferases; Function class=Q Secondary metabolites biosynthesis, transport and catabolism
  Homolog annotation: Query=1..270bp; Hit=1..267bp; Blast score=315; Percent Identity=57.0; E value=3e-86; Homolog= rrmA COG0500
MSYQCPLCHSPLLFTHHQWRCENNHQFDCAKEGYVNLLPVQHKRSKEPGDSVEMMQARRAFLHSGYYRALQQKTIQLLDKYLPEGAGTLLDIGCGEGYYTAAVQAQLNLHRDMTVYGLDVAKIAVRYGAKCYPKVNFCVASSHRLPFADGSLDGILRIYAPCKATELARVVKPHGIVLTVTPGPRHLYQLKELIYQEVNLHPENKEQWEGFELISTEMLAYAMPLGGEQAHNLLQMTPFAWRASEQVKTNLMTEKLFNCEADFTLKVYRRI

SEQ ID NO: 6271 - protein, 206 aa, Xenorhabdus bovienii
  Peptide sequence Name=Xb4151_4152.C421.gene70.pep
  Gene classification: Function=Predicted membrane protein; Function class=S Function unknown
  Homolog annotation: Query=4..198bp; Hit=10..203bp; Blast score=201; Percent Identity=57.0; E value=3e-52; Homolog= Z2864 COG1971
MCIWNHPAEAMLMNLYATLILAFALSMDAFAAAVGKGAVLHRPRFREAIRTGIIFGLVEACTPLIGWFLGLYASQYIMEWDHWIAFSLLFMLGCRMIIESLKIDAQTTVESTPRRHSSMTLIITAIATSLDAMVIGVGLAFLQVDIFHTAMTIGIITMIMATLGMLIGRYIGPLLGKRAELIGGLILIIIGFNILFEHLKLFMYAA

SEQ ID NO: 6272 - protein, 62 aa, Xenorhabdus bovienii
  Peptide sequence Name=Xb4151_4152.C421.gene71.pep
MVLPTDSELIFVRLFRHSYHVLLKTSMLIRIFQKCFGTGYSPMTESDNTRFKIKGKKYLVIY

SEQ ID NO: 6273 - protein, 152 aa, Xenorhabdus bovienii
  Peptide sequence Name=Xb4151_4152.C421.gene72.pep
  Homolog annotation: Query=1..152bp; Hit=1..152bp; Blast score=150; Percent Identity=67.0; E value=5e-36; Homolog= gi|37526591|ref|NP _929935.1| hypothetical protein [Photorhabdus luminescens subsp. laumondii TTO1] gi|36786023|emb|CAE15074.1|
MNFNDIILIILILLMFAFAIYDEFIINQLKGKTLLNIKLKRKHRIDALIFIVLISIVIYNNVIVQGNQLTTYLLLFIILFTIYLGYIRSPKLIFKNKGFYYANRFLQYEKINAMNLSEDGILMISFEKNNIYITVSKLDDLEKIYQFLINNK

SEQ ID NO: 6274 - protein, 54 aa, Xenorhabdus bovienii
  Peptide sequence Name=Xb4151_4152.C421.gene73.pep
VDHHGLFHSGNRGLSFWFPWLSLISLRYFRIWGGYPPPFLYCKNKHILKKPLAI

SEQ ID NO: 6275 - protein, 285 aa, Xenorhabdus bovienii
  Peptide sequence Name=Xb4151_4152.C421.gene74.pep
  Gene classification: Function=Phosphotransferase system, mannose/fructose/N-acetylgalactosamine-specific component IID; Function class=G Carbohydrate transport and metabolism
  Homolog annotation: Query=1..285bp; Hit=1..285bp; Blast score=461; Percent Identity=84.0; E value=1e-130; Homolog= manZ COG3716
MNNMSDTTNIGQKKLTQSDIRGVFLRSNLFQGSWNFERMQALGFCFSMVPAIRRLYPENTEERKQAIKRHLEFFNTHPYVAAPILGVTMAMEEQRANGANIDDGAINGIKVGLMGPLAGVGDPIFWGTVRPVFAALGAGIAMSGSMMGPILFFFLYNLVRLLTRYLGVAYGYKKGLDIVKDMGGGFLQKMTEGASILGLFVMGALVNKWTKVNIPLVVSEVPDPTTGVIKVTTVQTILDQLMPGLMPLLLTFGCMWLLRKKVNPLWIIMGFFILGIVGFRFGFLG

SEQ ID NO: 6276 - protein, 221 aa, Xenorhabdus bovienii
  Peptide sequence Name=Xb4151_4152.C421.gene75.pep
  Gene classification: Function=Phosphotransferase system, mannose/fructose/N-acetylgalactosamine-specific component IIC; Function class=G Carbohydrate transport and metabolism
  Homolog annotation: Query=1..221bp; Hit=46..266bp; Blast score=261; Percent Identity=84.0; E value=4e-70; Homolog= ZmanY COG3715
MKTGIIIGGTLEMIALGWMNIGAAIAPDAALASIISTILVIAGGQDVGAGIALAIPLAAAGQVLTIIVRTLTVGFQHAADKAAENGNLRAISALHIFALALQAMRIALPALVVALSVGTSEVQSMLNAIPQVVTSGLNIAGGMIVVVGYAMVINMMRAGYLMPFFYLGFVTAAFTDFNLVALGVIGVVMAILYIQLSPKYNQSQAAASAGNTSNDLDNELD

SEQ ID NO: 6277 - protein, 98 aa, Xenorhabdus bovienii
  Peptide sequence Name=Xb4151_4152.C421.gene76.pep
LSAACWKPTVRVRTIMVNTCPAAARGIASAIPAPTSCPPAITRMVEMMEANAASGAIAAPIFIQPRAIISSVPPMMMPVFISPSTKPTNVQATSGRWN

SEQ ID NO: 6278 - protein, 49 aa, Xenorhabdus bovienii
  Peptide sequence Name=Xb4151_4152.C421.gene77.pep
VELKFIKNGIHACNTGNDEYQQKLNNGNFHCFSPVTKWNLVRISLLSNG

SEQ ID NO: 6279 - protein, 318 aa, Xenorhabdus bovienii
  Peptide sequence Name=Xb4151_4152.C421.gene78.pep
  Gene classification: Function=Phosphotransferase system, mannose/fructose/N-acetylgalactosamine-specific component IIB; Function class=G Carbohydrate transport and metabolism
  Homolog annotation: Query=159..317bp; Hit=1..159bp; Blast score=255; Percent Identity=79.0; E value=4e-68; Homolog= manX_2 COG3444
MIGTHGAAAEQLLHTAEMLIGEQENVSYIDFVPGENADTLFDKYNQKLESLNTEQGVLFFVDTWGGSPFNAANRIVVDKNNYEIITGVNVPMLVEAFMCRDDNPSMEELVSVALETGREGIRALKTEQAEETQKPEPVKPAAPTIAPASSPTVSGGGHMKIALARIDDRLIHGQVATRWTKETNVKRIIVVSDDVAQDTIRSTLLKQVAPPGVSAHVIDVAKCVRVYNNPKYAGERVMLLFTNPTDVLRIVEGGVSLESINIGGMAFRQGKTQINNAISVDSADIEAFEKLNSRGIELEARKVSSDTRLNMIDLLKKA

SEQ ID NO: 6280 - protein, 66 aa, Xenorhabdus bovienii
  Peptide sequence Name=Xb4151_4152.C421.gene79.pep
VVFLSIISAHTLPRKISLLHSRDIFLAETDHLSTLFSLFSTKHHIFFIQTLMKCYRKQFNEPFKQK

SEQ ID NO: 6281 - protein, 454 aa, Xenorhabdus bovienii
  Peptide sequence Name=Xb4151_4152.C421.gene80.pep
  Gene classification: Gene name=SdaA; Function=L-serine deaminase; Function class=E Amino acid transport and metabolism
  Homolog annotation: Query=1..454bp; Hit=1..454bp; Blast score=781; Percent Identity=83.0; E value=0; Homolog= sdaA COG1760
VISVFDMFKVGIGPSSSHTVGPMKAGKQFVDDLVNQGVMSSITRVAVDVYGSLSLTGKGHHTDIAIIMGLAGNMPATVDIDSIPGFIRDVEQTQRLPLANGLHEVDFPRDGGMNFRSDNLSLHENGMQVHAFAGDEKIYSKTYYSIGGGFIVDEEHFGKPSQDTKPVSYPFSSAADLLMNCSKTGLSVSGLMMKNELDLHSKEEIGEYFADVWNTMQACIDRGLNTEGLLPGPLRVPRRAAALHRMLTSSNNFSNDPMNVVDLINMFALAVNEENAAGGRVVTAPTNGACGIVPAVLAYYNHCIEPVTPDLYIRYFLASGAIGILYKMNASISGAEVGCQGEVGVACSMAAAGLAELLGASPEQVCIAAEIGMEHNLGLTCDPVAGQVQVPCIERNAIASVKAINASRMALRRTSEPRVSLDKVIETMYETGKDMNAKYRETSRGGLAIKVQCD

SEQ ID NO: 6282 - protein, 47 aa, Xenorhabdus bovienii
  Peptide sequence Name=Xb4151_4152.C421.gene81.pep
LGINCGYYLSAGTTSSKIGLTIIAKHHQNVRFLATFISIAIIIKKKL

SEQ ID NO: 6283 - protein, 189 aa, Xenorhabdus bovienii
  Peptide sequence Name=Xb4151_4152.C421.gene82.pep
  Gene classification: Gene name=MutT; Function=NTP pyrophosphohydrolases including oxidative damage repair enzymes; Function class=L DNA replication, recombination and repair
  Homolog annotation: Query=3..185bp; Hit=7..188bp; Blast score=162; Percent Identity=54.0; E value=2e-40; Homolog= ZyeaB COG0494
MTSLSDFIHRFQLQLPAQPANLASNQRNAAVLLPIICKPEPTLLLTQRAKNLRSHAGQIAFPGGATDPEDHSLIATALREAEEEVSIPHHKVQVLGQLAPLDSSGGYRVTPVVGLVSPSLSFRTNPTEVARIFEIPLFDALTLPHYQHLDIKIRNRQHRVYFYWYREQMIWGLTAAIIYRLAQQVQRSV

SEQ ID NO: 6284 - protein, 512 aa, Xenorhabdus bovienii
  Peptide sequence Name=Xb4151_4152.C421.gene83.pep
  Gene classification: Gene name=TrpE; Function=Anthranilate/para -aminobenzoate synthases component I; Function class=E Amino acid transport and metabolism
  Homolog annotation: Query=66..506bp; Hit=11..451bp; Blast score=598; Percent Identity=64.0; E value=1e-171; Homolog= pabB COG0147
MTITSNIRSQLTTSGIIYPIGFNRRFYLKSGVRFCDNLHQLISYLFELPNANTGYIMKIALQKRLLPYSPDLATRYFAPLSVSPWAMLLHSGTAEHPHNRFDILVAEPVTTLITRDESTEINCNGDVSLSQEDPFLLLKKHLHIRNIAPQFDPDYPFQGGALGLWGYDLGRKIEKLPAIAANELDFPDMAVGIYDWALIIDHHQQKATLLGYHNLDNRLAWLESQKKNRETNFSLSSQWQSNMTAQQYHEKIAQIHRYLRDGDCYQVNLSQRFHASYQGDEWQAFTQLNDSNRAPFSAFIRLPENCIISVSPERFLLLEDKKIQTRPIKGTLPRLQDPEEDHLQAKKLANSRKDRAENLMIVDLLRNDIGRVATPGSVKVPELFVVEPFPAVHHLVSTITATLPDEYHATDLLRACFPGGSITGAPKIRAMEIIEELEPHRRHGYCGAIGYISFCGTMDSNITIRTLLTEKGKIYCWAGGGIVADSIAEKEYQETFDKLGRILPQLGELHIP

SEQ ID NO: 6285 - protein, 62 aa, Xenorhabdus bovienii
  Peptide sequence Name=Xb4151_4152.C421.gene84.pep
  Homolog annotation: Query=3..59bp; Hit=1..57bp; Blast score=69; Percent Identity=73.0; E value=2e-11; Homolog= Pa|phot2b01.q1k_g46| 41916 - 42089 230 57 aa, chain -
MVMFSGMPALSHEEQQVAVERIHQLISEGMSSGEAIAIVAQELREKHQGKEQIHILFEDDEK

SEQ ID NO: 6286 - protein, 124 aa, Xenorhabdus bovienii
  Peptide sequence Name=Xb4151_4152.C421.gene85.pep
  Homolog annotation: Query=1..124bp; Hit=1..124bp; Blast score=159; Percent Identity=59.0; E value=1e-38; Homolog= gi|37526583|ref|NP _929927.1| hypothetical protein [Photorhabdus luminescens subsp. laumondii TTO1] gi|36786015|emb|CAE15066.1|
MKSNQFIHRIGLLGTGILLSVSLTIASAAENDHMAKFVSCKNLTKDQIAAQVKQDFLQNRIHHWDKDRKQLGTSKPIAWVNVNDMTGDRNALQVPLIVRGSQRDKSYNVTIDCQKDTINYSEVK

SEQ ID NO: 6287 - protein, 317 aa, Xenorhabdus bovienii
  Peptide sequence Name=Xb4151_4152.C421.gene86.pep
  Gene classification: Gene name=MhpC; Function=Predicted hydrolases or acyltransferases (alpha/beta hydrolase superfamily); Function class=R General function prediction only
  Homolog annotation: Query=2..317bp; Hit=3..318bp; Blast score=407; Percent Identity=61.0; E value=1e-114; Homolog= mlr7803 COG0596
MAELRKLYPAYDAYQTGYLDTGDGHQVYWELCGNPKGKPAVFIHGGPGGGSANYHRQLFDPECYHVMLFDQRGCGRSKPHASLENNTTWHLIDDIERLRNLMGVDSWLVFGGSWGTTLSLAYAQKHPSCVSELVLRGIFLLRTQELHWYYQDGASRFFPDKWERMISILSEEEREDVMDAYRKRLMSDDPEVQLEAARLWSLWEGETVTLLPSENVDSFSEDKFALAFARIENHYFVNNGFMDNTQQLLDHIDLIRHVPAAIIHGRYDMVCQLQNAWDLAKAWPEAELHIVEGAGHSFDEAGILHQLIKATDKFAGK

SEQ ID NO: 6288 - protein, 76 aa, Xenorhabdus bovienii
  Peptide sequence Name=Xb4151_4152.C421.gene87.pep
  Homolog annotation: Query=1..76bp; Hit=1..76bp; Blast score=107; Percent Identity=77.0; E value=5e-23; Homolog= Pa|phot2b01.q1k_g43| 40122 - 40352 199 76 aa, chain +
MVHNLAKLSKDEMDKVNVDLVASGVAFKERYNMPVIPDTVEQSQPQHLREYFRQRLSHYREQSRYFSRLPYEPRSR

SEQ ID NO: 6289 - protein, 167 aa, Xenorhabdus bovienii
  Peptide sequence Name=Xb4151_4152.C421.gene88.pep
  Gene classification: Gene name=Ftn; Function=Ferritin-like protein; Function class=P Inorganic ion transport and metabolism
  Homolog annotation: Query=1..162bp; Hit=7..168bp; Blast score=228; Percent Identity=70.0; E value=2e-60; Homolog= VC0078 COG1528
MLKQEMVKKLNEQLNLEFYSANLYLQMSAWCSDKGYEGAAAFLRAHSQEEMQHMQRLFDYLGDTGAMPVLGAIQAPPVEFNSISDVFNQTYKHEKLITEEINKLAHVAMMTQDYSTFNFLQWYVAEQHEEEKLFKSILDKLGMVGESGNSLFLLDKDLKGLSVPAHA

SEQ ID NO: 6290 - protein, 51 aa, Xenorhabdus bovienii
  Peptide sequence Name=Xb4151_4152.C421.gene89.pep
LFLWQELRFFSFLSSFLRSGSQVMTLAADYRRLNLFFDIESLFRYENSPVY

SEQ ID NO: 6291 - protein, 140 aa, Xenorhabdus bovienii
  Peptide sequence Name=Xb4151_4152.C421.gene90.pep
  Gene classification: Gene name=CopC; Function=Uncharacterized protein, homolog of Cu resistance protein CopC; Function class=R General function prediction only
  Homolog annotation: Query=27..140bp; Hit=11..124bp; Blast score=109; Percent Identity=48.0; E value=9e-25; Homolog= Z2889 COG2372
MKIHLYIKGLSIMSILSLRSFWAKLSALVVLFVGMSCQQALAHAYLKDQTPAENTTVEAIPQAITLSFSERIELGFSKVKLIGPEKKTVKTGKLELDPDTKTKLILPVEDKLVAGEYSVDWSVLSVDGHKTKGAYNFTVK

SEQ ID NO: 6292 - protein, 314 aa, Xenorhabdus bovienii
  Peptide sequence Name=Xb4151_4152.C421.gene91.pep
  Gene classification: Gene name=PcoD; Function=Putative copper export protein; Function class=P Inorganic ion transport and metabolism
  Homolog annotation: Query=8..313bp; Hit=6..289bp; Blast score=132; Percent Identity=35.0; E value=5e-31; Homolog= Z2888 COG1276
MISLEALYILCRFFHFVVVMLMFGLSLFTVMLASGRFSVLMRERLRVGVSISTVLALITSIAWFIIQTGLMGDGWHDVYQFDIWLAVLGTAFGKVWKWQLLVAALAVVCLFFFHTKTRNFLLLACSVILLSSHAFIGHAAMHEGNIGLLLQANQIVHLLSAGYWFGGLWPFLLCLQFLRLKNTLYFNLYRDGTYSGYIADKLSGESVAAMRKFSNYGHLAVFMVITTGIVSSIILIPDWPVFCTTISEYQSMLWLKIALVAGMVLLALINRYILVPRLNQKRRYEWLTLNSWLEIILGTSVLLCIAIFATEPPV

SEQ ID NO: 6293 - protein, 124 aa, Xenorhabdus bovienii
  Peptide sequence Name=Xb4151_4152.C421.gene92.pep
  Homolog annotation: Query=8..118bp; Hit=1..111bp; Blast score=135; Percent Identity=66.0; E value=1e-31; Homolog= Pa|phot2b01.q1k_g39| 37308 - 37655 170 115 aa, chain -
MSIRGMIMKRVYWVLAFLFFSFQGIAASIQTVSKLQFGKQWAFNREEVMLDCRSDGALFVINPSTLMQYPLNDRATQLMVSNKVIATSLNKILLDDPEHSNQKMSIEPFQKAALALCDNTRDKK

SEQ ID NO: 6294 - protein, 76 aa, Xenorhabdus bovienii
  Peptide sequence Name=Xb4151_4152.C421.gene93.pep
LQSDPCPCSYYYDKTPYQYTEGCLISILLIYIRRKNNLLKKFPALYGKKIKKGRVYSSTRPMENGSIKKPCAKNYH

SEQ ID NO: 6295 - protein, 165 aa, Xenorhabdus bovienii
  Peptide sequence Name=Xb4151_4152.C421.gene94.pep
  Gene classification: Function=GAF domain-containing protein; Function class=T Signal transduction mechanisms
  Homolog annotation: Query=1..159bp; Hit=19..177bp; Blast score=209; Percent Identity=63.0; E value=1e-54; Homolog= yebR COG1956
MDKHKFYQELSDSLMALLSGEYDLIASLANTSALLSDYLDDVNWVGFYLVDGNTLVLGPFQGKIACVRIPIGKGVCGTAVAKNSIQRISDVHAFPGHIACDTASNAEIVLPLEINGQIIGVLDIDSTVFERFDENDEQGLKALVIRLCKHLGQCVVPKYLQQNVT

SEQ ID NO: 6296 - protein, 33 aa, Xenorhabdus bovienii
  Peptide sequence Name=Xb4151_4152.C421.gene95.pep
MTSLLLFNLGSVSMKFPDYNGFANQRRHEQATL

SEQ ID NO: 6297 - protein, 240 aa, Xenorhabdus bovienii
  Peptide sequence Name=Xb4151_4152.C421.gene96.pep
  Gene classification: Gene name=ProQ; Function=Activator of osmoprotectant transporter ProP; Function class=T Signal transduction mechanisms
  Homolog annotation: Query=1..240bp; Hit=1..232bp; Blast score=248; Percent Identity=61.0; E value=5e-66; Homolog= proQm COG3109
METEPKLNSSKEVIAFLAERFPLCFAAEGEARPLKIGIFQDIVERIQSEECLSKTQLRSALRLYTSSWRYLYGVKEGAQRVDLDGNACGELEVEHIEHARQQLAEAKARVQAQRAEQRAKKRETENASDKKSEHPVNKKTAPRRQASGDGEKRSSRSQNRLQQSRKPADNVTRKIAQPRISQPELTSVTDVSSLKVGQTIKVNVGKSLMDASVLEIAKDGVRVQLPTGLAMIVRAEHLKF

SEQ ID NO: 6298 - protein, 690 aa, Xenorhabdus bovienii
  Peptide sequence Name=Xb4151_4152.C421.gene97.pep
  Gene classification: Gene name=Prc; Function=Periplasmic protease; Function class=M Cell envelope biogenesis, outer membrane
  Homolog annotation: Query=44..685bp; Hit=31..676bp; Blast score=899; Percent Identity=68.0; E value=0; Homolog= prc COG0793
MNKLINLAFVLGLSFSGIGYANTANVIGSSTVNGNNAPVIALSQLPDLKPEQQHSTVSKRIVSRFLRSHYRHFYLDVAFSGKVFDRYLNALDYGHNVFLASDIAQFAEQKGLLGKELENGDLRLPYALFNLMQKRRFERYQYVLSRLEQPVNLDGNDTFETERTKAPWPTSVVELNKLWDAKIKSDWINLKLSGKDDKEIKEILTKRYRTHLKRLNQSKSEDVFQIIMMAFAREIDPHTSYLSPSNTEQFNSEMSLSLEGIGAVLQYDDEYIAIRSLVGGGPAAKSNLLKDGDKIIGVGQAGKPIVDVVGWRLEDVVTLIKGPKGSKVRLEIIPSTKGAKNHIVTLTRENIRLEDNAVKMSVKTVGKEKIGVLDIPSFYVGLTNDVKIQLQKLTKQGVSSIVIDLRTNGGGALTEAVSLSGLFISTGPIVQIRDNTGRIKQDSDTDEAIYYKGPLVVLVDGRSASASEIFAAVMQDYGRGLIVGDPTFGKGTVQNHRSLNRIYDQMLKPDWPEIGSVQYTVQKFYRVNGGSTQLKGVTPDILMPTAEEPADIGESQEDNALPWDSIQPASYPFSKVISAWVPLLTQLHNQRIANAPEFKYIKQDIAYYKLIKARNGVYSLNYAQREKENKEYESIKLNRINERFKREDKKPLKSLDDLPKDYKGPDPYLDESVQIALDLAHQPAEITLTK

SEQ ID NO: 6299 - protein, 40 aa, Xenorhabdus bovienii
  Peptide sequence Name=Xb4151_4152.C421.gene98.pep
MEIHSILFNFFKMLSDRINITLQCHKKGRLPSRPFICNEL

SEQ ID NO: 6300 - protein, 294 aa, Xenorhabdus bovienii
  Peptide sequence Name=Xb4151_4152.C421.gene99.pep
  Gene classification: Gene name=HtpX; Function=Zn-dependent protease with chaperone function; Function class=O Posttranslational modification, protein turnover, chaperones
  Homolog annotation: Query=1..294bp; Hit=1..293bp; Blast score=442; Percent Identity=80.0; E value=1e-124; Homolog= ZhtpX COG0501
MMRIALFLLTNLAVMVVFGIILSLTGVQQSSVAGLMIMAGLFGFGGAFISLLMSKWMALRAVGGQVIEKPSNEMELWLMETVRRQSDQVSITMPQVAIYNAPDINAFATGARRNASLVAVSTGLLNNMSRDEAEAVIAHEISHIANGDMVTMTLLQGIVNTFVIFISRIIAQAASSFLSSNDNENESSSNGNPIVYMVLSMVLEIVFGILASIITMWFSRYREFHADAGSAKLVGREKMIAALQRLKTSYEPQEEGRMMAFCINGKSKSFSELFLSHPPLDKRIEALRSGEYIK

SEQ ID NO: 6301 - protein, 35 aa, Xenorhabdus bovienii
  Peptide sequence Name=Xb4151_4152.C421.gene100.pep
LHNILKKLNFAHKSNKKAGIHDEYRLFSLNIYFRP

SEQ ID NO: 6302 - protein, 463 aa, Xenorhabdus bovienii
  Peptide sequence Name=Xb4151_4152.C421.gene101.pep
  Gene classification: Function=Predicted Na+/dicarboxylate symporter; Function class=R General function prediction only
  Homolog annotation: Query=1..461bp; Hit=1..461bp; Blast score=570; Percent Identity=74.0; E value=1e-162; Homolog= ydjN COG1823
MNLPLVINVLVFVALLIVLAKASSNKWSLSKKVVVALIMGVVFGLALNVIYGAHNIIVKESIKWFNIVGNGYVQLLQMVIMPLVFASILSAVARLHKASALGKISFLTIGTLLFTTAISALIGIIIANVFGLTAAGLIQGTQETARLSAIETSYIGKVSDLGVPQLILSFIPKNPFADLTGASPTSIIGVVIFAVFLGIAALQMLKDDHERGERALIAIDTLQAWAMKLVRLVMRLTPYGVMALMTKVVASSNIHDIAQLGNFVVASYIALGLMFVVHGGLLALTGINPIKFFKKAGPALTFAFTSRSSAASIPLNVETQTRRLGIPESIASFSASFGATIGQNGCAGIYPAMLAVMIAPTVGIDPFDPLWIATLVGIVTISSAGVAGVGGGATFAALIVLPAMGLPVTLVALLISVEPIIDMGRTALNVNGAMTAGTITSQLMGTTNKEILEQDETVGLSQS

SEQ ID NO: 6303 - protein, 53 aa, Xenorhabdus bovienii
  Peptide sequence Name=Xb4151_4152.C421.gene102.pep
MTPFPQWGHPQKHKQCLFFSLLSLCVNPQIISIISKYQTKIKYNNISIYNQFY

SEQ ID NO: 6304 - protein, 42 aa, Xenorhabdus bovienii
  Peptide sequence Name=Xb4151_4152.C421.gene103.pep
MFLRVTPLRKWGHELIRLYLIRYLYRLCNLSICNLSICNLSK

SEQ ID NO: 6305 - protein, 193 aa, Xenorhabdus bovienii
  Peptide sequence Name=Xb4151_4152.C421.gene104.pep
  Gene classification: Function=Predicted membrane-bound metal -dependent hydrolases; Function class=R General function prediction only
  Homolog annotation: Query=1..166bp; Hit=5..170bp; Blast score=176; Percent Identity=53.0; E value=1e-44; Homolog= ydjM COG1988
MTAEGHLLFSVASLILAHQLEITPEIAQGDWLHMLPGVLLASLLPDIDHPSSTLGRLFRFISIPIARLCGHRGFTHSLLALGVGIILFQAEIPSGWPIPTDFFHAMIVGYISHLIADMLTPAGIPLLWPLRIRFCIPILRGKERKKAERFIAVLVLVIAILLPHQIDFSFIHHYFDKLQIDKLQIDKLQSLYK

SEQ ID NO: 6306 - protein, 38 aa, Xenorhabdus bovienii
  Peptide sequence Name=Xb4151_4152.C421.gene105.pep
VLPFFDLYFPYRAAQIFIIMYFILAALGKNQLNLSVLY

SEQ ID NO: 6307 - protein, 94 aa, Xenorhabdus bovienii
  Peptide sequence Name=Xb4151_4152.C421.gene106.pep
MAAQSNYQVMFSMVNSSSEFNLISASDQRGSSKWWKAGITIERILAALVATIPLKKSSSIRQLIGLTSSWIVIVASFPTVPQSPTFLSGSREGG

SEQ ID NO: 6308 - protein, 108 aa, Xenorhabdus bovienii
  Peptide sequence Name=Xb4151_4152.C421.gene107.pep
MLELTLTTVRKSNYRHLKSLSTVVTHTKDHLHEIKFVYFQFVISNLLLHSVSYVHNSSNYLCTLLKLKIHINTQSYYLTMLINYQSSLHPTHPFADYIDEISTPFATT

SEQ ID NO: 6309 - protein, 555 aa, Xenorhabdus bovienii
  Peptide sequence Name=Xb4151_4152.C421.gene108.pep
  Gene classification: Gene name=ThrS; Function=Threonyl-tRNA synthetase; Function class=J Translation, ribosomal structure and biogenesis
  Homolog annotation: Query=1..554bp; Hit=1..554bp; Blast score=1020; Percent Identity=85.0; E value=0; Homolog= thrS COG0441
MPVITLPDGSQRQFEHAVSVMDVARDIGVGLAKACIAGRVNGELVDACELIETDANLAIITSKDENGLEIIRHSCAHLLGHAVKQLWPDTKMAIGPVIDNGFYYDVDLDRSLTQEDIELLEKRMLELAKTDYDVIKKKVSWQEAREAFAARGEEYKIQILDENISRDDYPGLYHHEEYMDMCRGPHVPNMRFCHHFKLQKIAGAYWRGNSDNKMLQRIYGTAWADKKQLNAYLQRLEEASKRDHRKIGKQLDLYHMQEEAPGMAFWHNDGWTIFRELETFARVKLKEYHYQEVKGPFMMDRILWEKTGHWENYKEHMFTTSSENREYCVKPMNCPGHVQIFNQGLKSYRDLPLRMAEFGSCHRNEPSGALHGLMRVRGFTQDDAHIFCTEDQIHQEVSNCIKMIYDVYNTFGFEKVVVKLSTRPEKRIGTEKQWDEAEADLAEALKQSGIEFEYQPGEGAFYGPKIEFTLYDCLDRAWQCGTVQLDFSLPARLNASYVGENNERKVPVMIHRAVLGSLERFIGILTEEYAGFFPTWLAPQQVVVMNITDGQAGYY

SEQ ID NO: 6310 - protein, 548 aa, Xenorhabdus bovienii
  Peptide sequence Name=Xb4151_4152.C422.gene1.pep
  Gene classification: Gene name=PutP; Function=1 Na+/proline, Na+/panthothenate symporters and related permeases; Function class=E Amino acid transport and metabolism
  Homolog annotation: Query=22..546bp; Hit=20..544bp; Blast score=764; Percent Identity=83.0; E value=0; Homolog= PA3234 COG0591
MKKIVLSAMLLFSTLFHNLAQADAISGKVEEQPLNIQAIVMFLLFVGFTLCITYWASKRTQSRSDYYTAGGRITGFQNGMAIAGDYMSAASFLGISALVYTSGYDGLIYSIGFLVGWPIILFLIAERLRNLGRYTFADVASYRLKQRPIRTLSAIGSLVVVALYLIAQMVGAGKLIELLFGLNYHIAVILVGILMVLYVLFGGMLATTWVQIIKAILLLAGATFMALMVMKAVNFNFNTLFKEAIAVHSRGQAIMSPGGLVSDPISALSLGLALMFGTAGLPHIIMRFFTVSDAKEARKSVFYATGFIGYFYILTFIIGFGAILLVSPNPAFKDATGALIGGTNMSAVHLADAVGGNFFLGFISAVAFATILAVVAGLTLAGASAVSHDLYANVIKQGQANERDELKVSKITVIILGFVAIGLGILFEKQNIAFMVGLAFSIAASCNFPIILLSMYWNKLTTRGALIGGWLGLISAVVLMILGPTIWVNILGHEKPIYPYEYPALFSMFVAFICTWLFSITDGSQQGQQERKMFRNQFIRSQTGIGIE

SEQ ID NO: 6311 - protein, 103 aa, Xenorhabdus bovienii
  Peptide sequence Name=Xb4151_4152.C422.gene2.pep
  Gene classification: Function=Uncharacterized membrane protein; Function class=S Function unknown
  Homolog annotation: Query=1..102bp; Hit=1..102bp; Blast score=133; Percent Identity=66.0; E value=3e-32; Homolog= ZyjcH COG3162
MNPDIYQEIENNPRFKELVQKRGRFAWLLSAIMLVLYVGFIFLIAFSPEWLGTPLYEGSSMTRGIPVGVGIIFISFILTGIYVVRANGEFDRLTSTILNEVKK

SEQ ID NO: 6312 - protein, 651 aa, Xenorhabdus bovienii
  Peptide sequence Name=Xb4151_4152.C422.gene3.pep
  Gene classification: Gene name=Acs; Function=Acyl-coenzyme A synthetases/AMP-(fatty) acid ligases; Function class=I Lipid metabolism
  Homolog annotation: Query=1..650bp; Hit=1..650bp; Blast score=1132; Percent Identity=80.0; E value=0; Homolog= acs COG0365
MTQIIKHLIPADIAETALISKQQYLQDYQWSLQDPEAFWSEKGKIVDWIKPYTQVKNTSFDPGHVSIRWFEDGTLNLSANCLDRHLQERGEQTAIIWEGDNPAESKHVTYRELYHDVCQFANVLKKLDVKKGDVVAIYMPMVPEAAVAMLACTRVGAIHSVIFGGFSPDAIAGRVIDSNAKLIITADEGIRAGRVIPLKKNVDEALSNPAVTDVVNVVVFKRTGNTKSWQEGRDLWWHELIENVSTDCPAEEMNAEDPLFILYTSGSTGKPKGVLHTTGGYLVYASLTFKYTFDYRPGEIYWCTADIGWVTGHSYLLYGPLSCGATSLMFEGVPNYPDVNRLCQIVDKHQVNIIYTAPTAIRALMAEGDKAIEGTKRTSLRIMGSVGEPINPEAWEWYYRKIGNSKCPIVDTWWQTETGGFMITPLPGAVDLKPGSATLPFFGISPALVGNSGEPLTGECEGNLVITDSWPGQARTLFGDHERFEQTYFSTFKGMYFSGDGARRDEDGYYWITGRVDDVLNISGHRLGTAEIESALVSHPKIAEAAVVGIPHHIKGQAIYAYVTLNHGEEPSPDLYTEVRNWVRKEIGPIATPDILHWTDSLPKTRSGKIMRRILRKIASGDTSNLGDTSTLADPGVVEKLLEEKQSMNMT

SEQ ID NO: 6313 - protein, 59 aa, Xenorhabdus bovienii
  Peptide sequence Name=Xb4151_4152.C422.gene4.pep
VNSSCHISSSLECIRLTACEQHSYYNDLNSNENDYQFHIITRVSFPFLSFISSLDRITK

SEQ ID NO: 6314 - protein, 208 aa, Xenorhabdus bovienii
  Peptide sequence Name=Xb4151_4152.C422.gene5.pep
  Gene classification: Gene name=SodA; Function=Superoxide dismutase; Function class=P Inorganic ion transport and metabolism
  Homolog annotation: Query=1..206bp; Hit=1..205bp; Blast score=326; Percent Identity=75.0; E value=1e-89; Homolog= ZsodA COG0605
MSYSLPALPYSYDALEPHFDKPTMEIHYTKHHQTYVTNTNTALEAFPELAKLHIDDLIQQLDKIPADKRTFIRNNAGGHSNHSLFWKGLKLGTVLGGALKTAIERDLGSIEIFKEKFEQAAATRFGSGWAWLVLKADGKLAVVSTANQDSPLMGEEIAGASGYPILGLDVWEHAYYLKYQNRRPDYIKAFWHVVDWDEAAKRYEEKIK

SEQ ID NO: 6315 - protein, 344 aa, Xenorhabdus bovienii
  Peptide sequence Name=Xb4151_4152.C422.gene6.pep
  Gene classification: Gene name=TrpS; Function=Tryptophanyl-tRNA synthetase; Function class=J Translation, ribosomal structure and biogenesis
  Homolog annotation: Query=13..342bp; Hit=3..332bp; Blast score=563; Percent Identity=79.0; E value=1e-161; Homolog= PM1621 COG0180
MNEPTVMKPNSQKPIVFSGAQPSGELTIGNYMGALRQWVKMQDEYDCIYCIVNQHAITVRQDPNELKKRTLDTLALYLACGIDPKKSTIFVQSHVPQHSQLSWVLNCYTYFGELGRMTQFKDKSARHAENINAGLFSYPVLMAADILLYQANQIPVGIDQKQHLELSRDLAQRFNAIYGDIFTVPEPFIPTGGAKVMSLQDPAKKMSKSDDNCNNVIALLEDPKSVAKKIKRAVTDSEDPPRVRYDLENKPGVSNLLDILSGVTGKTIAELEAEFEGKMYGHLKGAVADAVSEMLTDLQERYHHFRNDEALLNQIMAEGAAKAQARAQATLDKIYDAVGLLAHP

SEQ ID NO: 6316 - protein, 234 aa, Xenorhabdus bovienii
  Peptide sequence Name=Xb4151_4152.C422.gene7.pep
  Gene classification: Gene name=Gph; Function=Predicted phosphatases; Function class=R General function prediction only
  Homolog annotation: Query=7..234bp; Hit=5..249bp; Blast score=260; Percent Identity=56.0; E value=7e-70; Homolog= gph COG0546
MVTSIKKNLRAIAFDLDGTLVDSASGLAEALDQALIAKGLPPAGKERVAIWIGNGADVMVERALKWAGVESTPELHRETRKLFDGFYETTVTTGSQLFPYVKETLATLAQHNLPMAIVTNKPTPFIAPLLESLGISEYFSLVLGGDDVKEKKPHPAPLYLTMGMFGIHKEELLFVGDSRNDILAAQAAGCPCVGLTYGYNYGESIALSHPDYILDHFPDLLPAIGLSTLKLQEA

SEQ ID NO: 6317 - protein, 224 aa, Xenorhabdus bovienii
  Peptide sequence Name=Xb4151_4152.C422.gene8.pep
  Gene classification: Gene name=Rpe; Function=Pentose-5-phosphate-3 -epimerase; Function class=G Carbohydrate transport and metabolism
  Homolog annotation: Query=3..224bp; Hit=2..223bp; Blast score=380; Percent Identity=86.0; E value=1e-106; Homolog= rpe COG0036
MKKDFLIAPSILSADFARLGEDTAKVLAAGADVVHFDVMDNHYVPNLTIGPMVCQALCDYGITAPIDVHLMVKPVDRIIPDFAKAGATYITFHPEASEHVDRTLQLIKEHGCKAGLVFNPATPLSYLDYVLDKLDVILLMSVNPGFSGQSFIPETLNKLRQVRKIIDESGYDIRLEVDGGIKANNIREAAQAGADMFVAGSAIFSQPDYKTVIDEMRRELSKVA

SEQ ID NO: 6318 - protein, 272 aa, Xenorhabdus bovienii
  Peptide sequence Name=Xb4151_4152.C422.gene9.pep
  Gene classification: Gene name=Dam; Function=Site-specific DNA methylase; Function class=L DNA replication, recombination and repair
  Homolog annotation: Query=1..269bp; Hit=1..268bp; Blast score=374; Percent Identity=69.0; E value=1e-104; Homolog= dam COG0338
MKKKRAFLKWAGGKYPLVDDIRRHLPEGERLIEPFVGAGSVFLNTDYDSYILSDINSDLINLYDTVKSRPEEFINHARPLFSQEFNTAEDFYRLREEFNKSQEPLYRSLLFLYLNRHCYNGLCRYNSRGEFNVPFGRYKKPYFPEDELYWFAEKAQKASFVCQHYQITLDNAPQGSVIYCDPPYAPLSATANFTAYHTNSFNLLDQENLARMAYHLSSQQGIPVLISNHDTLMTREWYHQATLHIVKARRTISRNILARSKVDELLALYCRK

SEQ ID NO: 6319 - protein, 321 aa, Xenorhabdus bovienii
  Peptide sequence Name=Xb4151_4152.C422.gene10.pep
  Gene classification: Gene name=DamX; Function=Uncharacterized BCR; Function class=S Function unknown
  Homolog annotation: Query=3..320bp; Hit=66..428bp; Blast score=117; Percent Identity=34.0; E value=1e-26; Homolog= ZdamX COG3266
MDELKSENKQKTENEFKPDTSDRHPPRSRSQSNQPKLAVSRQQLMIGVGILVLLLLIIAISSALKSPTEHEKQQSQNTAEKNIDLSGSSSLSTNNQNSSPENPLASAINGSQEISMPPISNTPSKDLSPAPEASNHNQRIELPGDISDALNQQQGNINNTVQKNLTPSQSNPMQQTVIPPVEQNKTEKVAPPKIEKTEKVAKSEKHAKSTDKPAIFHHQASKKSVTDTRGDLLKASANRFTLQLSSASRSDTLIAFAKNNNLSNYTVYEAKREGKAWFILIHGSYGSVSDAKSAISSLPAEVQAKKPWVRKLQQVQQDLKK

SEQ ID NO: 6320 - protein, 365 aa, Xenorhabdus bovienii
  Peptide sequence Name=Xb4151_4152.C422.gene11.pep
  Gene classification: Gene name=AroB; Function=3-dehydroquinate synthetase; Function class=E Amino acid transport and metabolism
  Homolog annotation: Query=1..360bp; Hit=1..359bp; Blast score=517; Percent Identity=72.0; E value=1e-147; Homolog= aroB COG0337
MEQVTVTLGERSYPIAIAQGLFSSDEAFKSLQAGQQVMIVTNETLAPLYLEQVKSTLQGMGLRVDEVILPDGEQYKSLFVVNDIFSALLENNHGRDTTLIALGGGVIGDMTGFAAACYQRGIRFIQIPTTLLSQVDSSVGGKTGVNHPLGKNMIGAFYQPASVIIDINCLKTLPAQELHAGLAEVIKYGIILDGEFFNWLESNIEQLLALDNQVIAYCIRRCCELKAWVVAADEQERNGMRALLNLGHTFGHAIEAEMGYGVWLHGQAVAAGMVMAARTSELMGTFSKQDTQRIISLLERAKLPVNGPVEMSPEIYLPHMMRDKKVSAGKLHLVLPTAIGKAELRSDIGSDVILDAIHLCLPSTS

SEQ ID NO: 6321 - protein, 173 aa, Xenorhabdus bovienii
  Peptide sequence Name=Xb4151_4152.C422.gene12.pep
  Gene classification: Gene name=AroK; Function=Shikimate kinase; Function class=E Amino acid transport and metabolism
  Homolog annotation: Query=1..173bp; Hit=68..240bp; Blast score=297; Percent Identity=91.0; E value=3e-81; Homolog= ZaroK COG0703
MAEKRNIFLVGPMGAGKSTIGRQLAQQLNMEFYDSDQEIERRTGADVGWVFDVEGEEGFRDREEKIINELTEKQGIVLATGGGSVKSKETRNRLSARGVVVYLETTIEKQLARTQRDKKRPLLQVDAPAREVLENLADERNPLYEEIADLTIRTDEQSAKVVANQIIELLEKN

SEQ ID NO: 6322 - protein, 83 aa, Xenorhabdus bovienii
  Peptide sequence Name=Xb4151_4152.C422.gene13.pep
MGKLSQYINLYCNYIYLARTVVVWFMLCWLTVSLLYVYWGRLLLVMLDPLTQLDNPCMLNYSQRQIHKQVRPRKIVENLVKKT

SEQ ID NO: 6323 - protein, 361 aa, Xenorhabdus bovienii
  Peptide sequence Name=Xb4151_4152.C422.gene14.pep
  Gene classification: Gene name=GspD; Function=General secretory pathway protein D; Function class=N Cell motility and secretion
  Homolog annotation: Query=59..358bp; Hit=110..408bp; Blast score=258; Percent Identity=49.0; E value=7e-69; Homolog= hofQ COG1450
MNSHFFILLACLFLLLPILASAEEINTWKETESEKAVRNPFQPPKNELDEQLEFFPAERDEQEQEIEYQSITLQYADAGQIAEQLQKNTPALLTKWGKVEHDTMTNSLILEDKFDAITRIKGWLKEVDTPQQQVQITAHIVTSSREALHELGIHWGMAADPLNRSIGLNRLNLHQSAGNQSHRLVLNTARIHASLLEMELSALEQENQLDIIASPRLTASHQQPASIKQGSDIPYLVQDKDKTTIQFKEAVLGMEVTPHILRKGKIRLALKISQNAPGLPISQGGNENLAIDKQEIVTQVTVRNGETLILGGIFQQKKGASLQKVPYLSDLPLLGALFNQKGEQHSRRELVIFITPQLTDI

SEQ ID NO: 6324 - protein, 183 aa, Xenorhabdus bovienii
  Peptide sequence Name=Xb4151_4152.C422.gene15.pep
  Homolog annotation: Query=1..182bp; Hit=2..177bp; Blast score=110; Percent Identity=38.0; E value=8e-24; Homolog= Pa|Phot5-395f12.p1k _g168| 105960 - 106505 1076 181 aa, chain +
MKSNYLVWFHRPAWQLFLLQQLPVIPLILGFYFWVWQENEYAIHDLQLNLTEQKHNSALSEKRIAELPNLPDIRQQIQQLTAELSQGNNILPNNIPQKNATVLKRLHQPLTSSGSQLMEWKSHREGNQIFWHIMLSLSYDQLLHFLNEIQQVQPVLLIKHLTIIPVDNDLTVRMVLSDVLHEG

SEQ ID NO: 6325 - protein, 121 aa, Xenorhabdus bovienii
  Peptide sequence Name=Xb4151_4152.C422.gene16.pep
  Homolog annotation: Query=1..121bp; Hit=63..183bp; Blast score=96; Percent Identity=48.0; E value=1e-19; Homolog= gi|37524119|ref|NP _927463.1| hypothetical protein [Photorhabdus luminescens subsp. laumondii TTO1] gi|36783542|emb|CAE12388.1|
MQLQQNIQESEHAIQHHQQLTQQLRKKQTFMEQNQRYLQLFRQLPHLLPEKSWLTAFSDDTGQLVFAASSQNYDDVSDLLDNLTDNASLNNVQLKKMSTTEEHLKIFTIDANWLMGAPDEK

SEQ ID NO: 6326 - protein, 275 aa, Xenorhabdus bovienii
  Peptide sequence Name=Xb4151_4152.C422.gene17.pep
  Homolog annotation: Query=1..275bp; Hit=1..276bp; Blast score=303; Percent Identity=58.0; E value=2e-81; Homolog= gi|37524120|ref|NP _927464.1| hypothetical protein [Photorhabdus luminescens subsp. laumondii TTO1] gi|36783543|emb|CAE12389.1|
MYLSKWYIGLDVHEHYINAFAAIKRRDGWQLRHCWQYRLSSDIISGGRLQHPEKLGHILMQWRRKLPKKISLRLTLPVQQTLQKQIALPTHTLLQEPELGWFVHANAEKQFPVSDLALDYRVRGQQICISATRQKDLNLWLKLLADIDLSPDAIDISPCALRYIAKLAGVPDDGWLIHKRITDWLWVTPASSPFGYGLISIQTHPHLAQIISQLPVLSDMASPEIYYSDEQHAIPAEPVHVWHMQTAFRHYQLPLPEKTDAFIIAAGLALRPDDQ

SEQ ID NO: 6327 - protein, 835 aa, Xenorhabdus bovienii
  Peptide sequence Name=Xb4151_4152.C422.gene18.pep
  Gene classification: Gene name=MrcA; Function=Membrane carboxypeptidase (penicillin-binding protein); Function class=M Cell envelope biogenesis, outer membrane
  Homolog annotation: Query=1..835bp; Hit=16..858bp; Blast score=1253; Percent Identity=71.0; E value=0; Homolog= ZmrcA COG0744
LILVVVCILLGTASIFGLYKYIEPQLPDVATLKDVRLQTPMQVYSADGELMAQYGEKRRLPLTLSEMPPLMVKAFIATEDSRFYEHHGVDPIGVIRAVSVMMTSGHASQGASTITQQLARNFFLSREKTLIRKAKEAFLAIKIEQLLTKDEILELYLNKIYLGNRAYGVGAAANVYFGKNANELTLSEMAMIAGLPKAPSTLNPLYSYDRAVSRRNVVLVRMLEEGYITQQQYNEARSEKLVARYHSPQIVFSAPYLTEMVRQEMINRYGENAYTDGYKVYTTITRKVQLAAVDAVRANVIDYDMRHGYRGAQEVLWTVSQSAWSQSQIVDKLKTLSKYGSLLPAVVTKSSATQAEAMLVDGNKVELTMAGVRWARQFKSDSLQGAAPRSVNEVIRAGEQVWVRKVNDIWWLAQLPQVNAALVSLNPMNGEVEALVGGFDFELSKFNRVTQSLRQVGSNIKPFLYTAAMDKGLTLASMFNDVPISRWDAGAGTDWRPKNSPPSYDGPIRLRQGLGQSKNVVMVRAMRAMGVDYAADYLRRFGLPGENVVRTESMALGSPSFTPMQMVRGYAVMANGGYLVDPYFITKIENDEGKVLFEAKPKLACPQCENIPVIYGDTAHSIELSEDSIENVTHSNVTQNSTQPQSELERAPVNVNNDDQQYAPHVISTPLAFLIHDALNTNVFGEPGWMATGWRSARDLKRRDIGGKTGTTNSSKDAWFSGYGPDMVATVWIGFDEHSRSLGRTPALKGEGGAKSAQPIWNDFMKVALEGVPVKVMEPPAGIVSVTIDRATGKLSNGGGNTRKEYFIEGTQPTEYAVPEAGTTVTENGESQELF

SEQ ID NO: 6328 - protein, 349 aa, Xenorhabdus bovienii; identical to SEQ ID NO: 5796
  Peptide sequence Name=Xb4151_4152.C422.gene19.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 6329 - protein, 558 aa, Xenorhabdus bovienii
  Peptide sequence Name=Xb4151_4152.C422.gene20.pep
  Gene classification: Gene name=FabB; Function=3-oxoacyl-(acyl-carrier- protein) synthase; Function class=I Lipid metabolism
  Homolog annotation: Query=79..558bp; Hit=155..633bp; Blast score=444; Percent Identity=45.0; E value=1e-124; Homolog= PA5174 COG0304
MSNLPVIVGLGGINAAGRSSGFHSYKRIVSDSLSDEIMQDTWLDLCHRMGIVKNTVSVTDAHIESAKNGTLIRKITHFDTQKVSSVTSAGQLPEGFEVGDLYNANHHPRGLRLTVYGASDLLSSIGISWPDIAKLVEPDQISVYASSALGQIDRFSLAGLIGNPQNGTRISSKMLALSLADMPANFINSYIINSIGNTSANLGACASFLYNLKQGVNDIKQGKAKISLVGCSEAAIVPEIIEGFRVMGALAEDHQLCKLDGTDIVNNRRATRPFSTNVGFTIAESAQFVLLMSDDLALQCGANILGAVPDVFVNADANKKSISSPGIGNYITMMKAASLADHLLDGKLQYSYVQAHGTGTPQNRVTESHIINEVAKVFGLKCWDVTAIKSYVGHSIAASAGDQLACTLGVWQYGWIPGIKTIDHIAEDVHATNLNILMQNKFAGEHGEEMRATIINTKGFGGNNASAVILSPQQTMQMLNKKHGSSAVYTYHQRNQIVKRISEDQDRAICRGEESVVYNFGNAVMQSSDIKLSRQEVKLSGYNHTIKLPNAEEFSAFL

SEQ ID NO: 6330 - protein, 54 aa, Xenorhabdus bovienii
  Peptide sequence Name=Xb4151_4152.C422.gene21.pep
VLQQIAAIRGAVNGLMAGVLESHLREELTNTEQTPEAQKASIEDAVSLIRTYLR

SEQ ID NO: 6331 - protein, 369 aa, Xenorhabdus bovienii
  Peptide sequence Name=Xb4151_4152.C422.gene22.pep
  Gene classification: Gene name=AdhC; Function=Zn-dependent alcohol dehydrogenases, class III; Function class=C Energy production and conversion
  Homolog annotation: Query=1..369bp; Hit=1..369bp; Blast score=654; Percent Identity=86.0; E value=0; Homolog= sll0990 COG1062
MKSRAAVAFGPGQPLEIVEIDVAPPQAGEVLVKISHTGVCHTDAFTLSGDDPEGVFPVILGHEGAGVVVEVGAGVTSVKPGDHVIPLYTAECGECLFCKSGKTNLCVAVRATQGKGVMPDGTTRFSYNGQPIYHYMGCSTFSEYTVVAEVSLAKINPEANHEEICLLGCGVTTGIGAVHNTAKVQSGDSVAVFGLGGIGLAVIQGARQAKAGRIFAIDTNPAKFELAKQFGATDCLNPNDYDKPIQQVIIEMTEWGVDHTFECIGNVNVMRAALESAHRGWGQSVIIGVAGAGQEISTRPFQLVTGRSWRGTAFGGVKGRSQLPKMVEEAMKGEIELKPFVTHTLPLERINEAFNLMHEGKSIRTVIHY

SEQ ID NO: 6332 - protein, 288 aa, Xenorhabdus bovienii
  Peptide sequence Name=Xb4151_4152.C422.gene23.pep
  Gene classification: Function=Predicted esterase; Function class=R General function prediction only
  Homolog annotation: Query=8..281bp; Hit=1..274bp; Blast score=372; Percent Identity=63.0; E value=1e-103; Homolog= sll0992 COG0627
MFYREEKMERIERRACFGGWQDVYQHDSTELGCTMSFAVYLPPQAEHQKLPVLYWLSGLTCNEQNFITKAGAQRYAAEQGIILVAPDTSPRGENVADDDAYDLGQGAAFYLNATQEPWAPHYRMYDYVVSELPALIEAHFPVTEDRAISGHSMGGHGALTIALRNPDRYHSVSAFSPIVAPSQVPWGEKAFRAYLGDDRDTWKAYDTIRLIANSAKPLHLLIDIGNDDPFLAEQLRPELLKEACEKAGQPYTLNLRTGYDHSYYFVASFIGEHIAYHAEVLKGCCADN

SEQ ID NO: 6333 - protein, 326 aa, Xenorhabdus bovienii
  Peptide sequence Name=Xb4151_4152.C422.gene24.pep
  Gene classification: Gene name=FabH; Function=3-oxoacyl-[acyl-carrier- protein] synthase III; Function class=I Lipid metabolism
  Homolog annotation: Query=50..316bp; Hit=87..355bp; Blast score=94; Percent Identity=31.0; E value=1e-19; Homolog= VCA0751 COG0332
MTRVAIASLGIWHPPTSVNNNWFIEHYAAQGIDMSGLLNALGHKNRYLIRDSSDTTLTMSVAASNNAIQRLGCQAKDLDFIVFASQTPEYLIPSTALKIHHAIGGGERALAFDMNANCAGLLVAVEMVSRAMMASPSCQLALVVGSDYLGAHSSNAPVYHSCFAESAVAVILHKTEQGNGFIDSEFRIQTSVIDNSLFPACGLSNIHRHDVSAQVKFTPFDDDICITAAFESIQLLLSRHNLVPADIKGFMFSQFSVSNIRRLCEELGVDQDKALFIGDEYGYTATNSPFVALYETLERKKIVRGDFLIFWTIGAGWQSIAVLMQY

SEQ ID NO: 6334 - protein, 343 aa, Xenorhabdus bovienii
  Peptide sequence Name=Xb4151_4152.C422.gene25.pep
  Gene classification: Gene name=FabH; Function=3-oxoacyl-[acyl-carrier- protein] synthase III; Function class=I Lipid metabolism
  Homolog annotation: Query=56..314bp; Hit=95..365bp; Blast score=60; Percent Identity=22.0; E value=2e-09; Homolog= VCA0751 COG0332
MENNISIISAAGILPPGNIIIHPEDNIRNEFSAPGEVQLSRSRTLWRLEHKKDLIELMKVSLLAAVKQVQMDISDIDYLILSQVWSDNILGDEAGRLARELKLSCPVVSINVGTSGGATGLEIATAMFANSEFHNIAVIAGCNYSHWFSMSDPARTLLSDGAACLVLSRKQGMTVTGCHTLSTAHYDVLKFNEGPERYVYYKPKGGEYIFNNMKETIYQCCNKVCQSNGMSLNEVSAFYVYDPSDWVASAAAEALGVGKDKIISIFHKYGSLGPAQSFFGFMEMQDNKNLTDSDWVIVMGLGPSTTATAVLFRWQNIPCNVYYYDHKTQLSNPMLPSGVTQNI

SEQ ID NO: 6335 - protein, 565 aa, Xenorhabdus bovienii
  Peptide sequence Name=Xb4151_4152.C422.gene26.pep
  Gene classification: Gene name=IlvB; Function=Thiamine pyrophosphate -requiring enzymes [acetolactate synthase, pyruvate dehydrogenase (cytochrome), glyoxylate carboligase, phosphonopyruvate decarboxylase]; Function class=E Amino acid transp
  Homolog annotation: Query=6..541bp; Hit=4..530bp; Blast score=140; Percent Identity=26.0; E value=3e-33; Homolog= AF1720 COG0028
MSVNIAKALVKLLEDCEVKAAFGVSGGFIAPIWQELTESEKIKLFHCRHESGGAFSASEFSLCHQVPAVAFATAGPGISNALTGLRAAKLDGAKVIFISSITSVASSGKWSLQETTVQDIDGLCIPDGHGYFDEIIIINQKDDYAHVESKLRKGLNKKDGYVVGIFLTTKVQQEIIDYENDEALSLSHDDLDENAKRHSREIADLLVNENAVFWAGFGARHASALLTQIAIKTNSRVISTPRGKGIFDEKHSLYAGTSGLGSDSESINKTLHCPLLSAVIIMGSRLGELSSSYAQNNLKKVKVYYIGLNAQEIKGNLPSHTVLIDSDIETFLTSIDTCLAEKVIPSSHIKAISAPHDSHKCYSDAAKDVIHPLDVMSVVQEIAIDMFDCYVASEAGNSFVWTNRYLKFSNPLRYRVSTAYGAMGHYACGLVGMAASKERCAVGIIGDGAMLMSNEVSTAVRFGLPAIWLVMNDSGYNMCRQGQELLGYPPLDCSIPQVDFAVFGQSIGATGYNVRNKKELREALIHAIEEKKPAVINAFIDKYEIPPLGDRVETFRKLKEELDGK

SEQ ID NO: 6336 - protein, 175 aa, Xenorhabdus bovienii
  Peptide sequence Name=Xb4151_4152.C422.gene27.pep
  Gene classification: Gene name=Ssb; Function=Single-stranded DNA -binding protein; Function class=L DNA replication, recombination and repair
  Homolog annotation: Query=1..175bp; Hit=1..178bp; Blast score=224; Percent Identity=78.0; E value=2e-59; Homolog= ssb COG0629
MASRGVNKVILVGNLGQDPEVRYMPNGGAVANITLATSESWRDKQTGEMREKTEWHRVVIFGKLAEVAGEYLRKGSQVYIEGSLQTRKWQDQGGQERYTTEVVVNIGGSMQMLGGRGGASQDAPAQGGNWGQPQQPQASQQFSGGGQQPSPSRPAQSPAPQSNEPPMDFDDDIPF

SEQ ID NO: 6337 - protein, 943 aa, Xenorhabdus bovienii
  Peptide sequence Name=Xb4151_4152.C422.gene28.pep
  Gene classification: Gene name=UvrA; Function=Excinuclease ATPase subunit; Function class=L DNA replication, recombination and repair
  Homolog annotation: Query=1..940bp; Hit=1..940bp; Blast score=1696; Percent Identity=87.0; E value=0; Homolog= uvrA COG0178
MDNIEVRGARTHNLKNINLIIPRNKLIVITGLSGSGKSSLAFDTLYAEGQRRYVESLSAYARQFLSLMEKPDVDHIEGLSPAISIEQKSTSHNPRSTVGTITEIHDYLRLLFARVGEPRCPDHDIPLAAQTISQMVDNVLVLPEGQRLMLLAPVVKERKGEHTKLLDNLSAQGYIRARIDGEVCDLSDPPKLELQKKHTIEVVVDRFKVRADLAQRLAESFETALELSGGTAVIANMDDEQAEELIFSANFACSVCGYSMSELEPRLFSFNNPAGACPTCDGLGVQQFFDPERVIQNGDISLAGGAIRGWDRRNFYYFQMLKSLSDHYKFDIEIPFNDLDPAIRKTVLYGSDKESIEFKYTNDRGDTTVRHHPFEGVLHNMERRYKETESSAVREELAKYISNRSCISCDGTRLRKEARYVFIESTTLPQISEFSIGHAMAFFQNIKLSGQRAQIAEKILKEIRDRLKFLVNVGLNYLTLSRSAETLSGGEAQRIRLASQIGAGLVGVMYVLDEPSIGLHQRDNERLLETLLHLRNLGNTVIVVEHDEDAIRAADHVIDIGPGAGVHGGKIVAEGTIEDIMTNKESLTGKFLSGKCKIAIPEQRVPANPDKVLELIGAKGNNLKKVTLKLPVGLFTCVTGVSGSGKSTLINDTLFPIAQRQLNGATNINPAPYLDVQGLEHFDKVIDIDQSPIGRTPRSNPATYTGVFTPVRELFSGVPESRARGYTPGRFSFNVKGGRCEACQGDGVIKVEMHFLPDVYVPCDHCKSKRYNRETLEIKYKGKNINEVLNMTIEEARKFFDAVPALARKLQTLMDVGLSYIRLGQSATTLSGGEAQRVKLSRELSKRGTGQTLYILDEPTTGLHFADIQQLLSVLHQLRDQGNTIVVIEHNLDVIKTADWIVDLGPEGGNGGGEILVSGTPEEVAQCEESHTARFLKPILERQ

SEQ ID NO: 6338 - protein, 52 aa, Xenorhabdus bovienii
  Peptide sequence Name=Xb4151_4152.C422.gene29.pep
MYMFLPFLIALVIIPTVIIGKKKLTYTLWFALLIITVFWFKYHATDALNLSF

SEQ ID NO: 6339 - protein, 184 aa, Xenorhabdus bovienii
  Peptide sequence Name=Xb4151_4152.C422.gene30.pep
  Homolog annotation: Query=1..184bp; Hit=5..189bp; Blast score=205; Percent Identity=59.0; E value=3e-52; Homolog= gi|37524258|ref|NP _927602.1| hypothetical protein [Photorhabdus luminescens subsp. laumondii TTO1] gi|36783681|emb|CAE12534.1|
MSASRSLNPAMVLNILGLFGISVVLIIAFYYQLARFELPCPLCLLQRAGIIMIGLGFLFNIYFGIKNAHYSLSLLGCLVTGFIAMRQVSLHILPGDTGYGSTFLGLHFYTWAAVLSILTIIAIAVIMPLKAGNSDSSRYTPPTLGKIAMGLFAFLIAANLVSTVLECGSGQCDDNPTFYQLLKK

SEQ ID NO: 6340 - protein, 91 aa, Xenorhabdus bovienii; identical to SEQ ID NO: 5467
  Peptide sequence Name=Xb4151_4152.C422.gene31.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 6341 - protein, 96 aa, Xenorhabdus bovienii; identical to SEQ ID NO: 5468
  Peptide sequence Name=Xb4151_4152.C422.gene32.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 6342 - protein, 389 aa, Xenorhabdus bovienii
  Peptide sequence Name=Xb4151_4152.C422.gene33.pep
  Homolog annotation: Query=Organism:..Escherichiabp; Hit=coli..O157bp; Blast score=; Percent Identity=; E value=; Homolog= Pa|Phot5 -451c10.q1k_g195| 149072 - 151501 2582 809 aa, chain -
MAETQHTQTRPEFTVQKKSGSQKPLDLIQTVKTSAMYSWANLLSACGIDVPAKGKHGACPICGGTDRFHFLDDHHHGNWHCRQCDAPNYGDGLDLVARTQKISITEAAKIIAGSLALPLPEPKPAKENLYPTQPIADRVAALMAQTVVGQSPYLTAKGLHCPNQRLLPDNSTVLRLATLDNIVTGAQIIKPNGEKKLLTGSQKKGAFIPLSTLEENPDTVIITEGYATALTVNQLYEGVVLAALDEGNLFPTAKTIRERWPDAKIIIAADNDWHTPGELDKDGKPKKNVGKISAEKAAYAVNGWVTLPPDNIKADWDDCRQQHGIEAAKQAFSNGLYQAGEPMNHHTIESRRYDNVESIYPKRKTKLPLSVGSAGFDAQLDYVVKGVMY

SEQ ID NO: 6343 - protein, 68 aa, Xenorhabdus bovienii
  Peptide sequence Name=Xb4151_4152.C422.gene34.pep
  Gene classification: Gene name=AlpA; Function=Predicted transcriptional regulator; Function class=K Transcription
  Homolog annotation: Query=10..66bp; Hit=8..64bp; Blast score=77; Percent Identity=66.0; E value=3e-15; Homolog= Z3946 COG3311
MAVTALKVNLIRLPEVQRRTGYSKAWIYKLISDGEFPKQVKIGPRSIAFIESEIDNWIAQRIAESRAA

SEQ ID NO: 6344 - protein, 423 aa, Xenorhabdus bovienii
  Peptide sequence Name=Xb4151_4152.C422.gene35.pep
  Gene classification: Gene name=XerC; Function=Integrase; Function class=L DNA replication, recombination and repair
  Homolog annotation: Query=1..415bp; Hit=1..414bp; Blast score=469; Percent Identity=56.0; E value=1e-132; Homolog= Z4313 COG0582
MKLNARQIETAKPKEKTYKLADGGGLYLEVSSRGSKYWRMKYYRPTDKKEDRLAFGVYPTVSLADARAKRDEAKKLMAQGIDPKAEKKGTPTPAKVNSFEQVARAWHASNKRWSDSHRQKILRSLEQYIFPHIGARDITTLRTSQLLAPVKAIDEQDKHDIAQRLRQRITAIMRYAVQNDILESNPANDMTGALTTAKSRHHPALPHECLPDFLNRLSAYRGRLLTKIAVELALLTFVRSSELRFARWQEIDLENSVWKIPATRQPIKGVRFSERGMKMKTDHIVPLSRQAVGLINALHELSGNCDVMFPSDHNSAKVMSENTVNKALRAMGYDTQTEVCGHGFRTMARGAMGESGLWSDDAIERQLSHIERNNVRAAYIHTSKHLDERRLMVQWWADYLDANREKPITPYDFAKPLRDRANR

SEQ ID NO: 6345 - protein, 295 aa, Xenorhabdus bovienii
  Peptide sequence Name=Xb4151_4152.C422.gene36.pep
  Gene classification: Gene name=Soj (BS); Function=ATPases involved in chromosome partitioning; Function class=D Cell division and chromosome partitioning
  Homolog annotation: Query=1..285bp; Hit=1..273bp; Blast score=161; Percent Identity=38.0; E value=7e-40; Homolog= XF1785 COG1192
MIILPIISPKGGEGKSTHAANLAGFFADAGLCVLLIDADYSQPTSSSIFPLSYEAPAGLYELLMQTVDLNQSEQIISRSVIKNLDILISNDPDELLPTAMLHAPDGRLRLRNVLQHPLFSQYDIIFIDSKGATGVMSELVVLAATQGVLGVIKPILPDVREFLRGTLRMLTRLRPFEHYGIRLPAIQILVNGIEGTNLDRDTLSELADIINNQRYDASALGGRQVYQLLETRIDLLDIYKLGHVRAQPVHRLEYKTTRKSPAAAQTMHRLACELVPLWAEKFDAVLTVQPTGEAQ

SEQ ID NO: 6346 - protein, 125 aa, Xenorhabdus bovienii
  Peptide sequence Name=Xb4151_4152.C422.gene37.pep
MNVIWRAVCFRYERVELLFSDDERFVFVDAPDRETAQTKLQILLPAVPDVSPEGVEHYYPRMRRQAMRPDASLDLALLECGWENDQPQYLTHNEVLFWVSSPHLQQRLIAALNAISREAADGHSA

SEQ ID NO: 6347 - protein, 458 aa, Xenorhabdus bovienii
  Peptide sequence Name=Xb4151_4152.C422.gene38.pep
  Gene classification: Gene name=DnaB; Function=Replicative DNA helicase; Function class=L DNA replication, recombination and repair
  Homolog annotation: Query=16..448bp; Hit=25..459bp; Blast score=399; Percent Identity=49.0; E value=1e-111; Homolog= VC0371 COG0305
MDIAHEHLQIISEEAPSYAYAEVGVLGGLVLENERWDSVVQLLVADDFYFPAHRIIFQAIAELSEKNCPFDLITLTDRLTQRGQIDRACGFAYVAEVCKNTPSAANIEEYARIVAEKSRLRQLLALGKSLSADVFQPNIQSDTLIEQAESQLFNLAEKGSTRQHQEMTLLQGADSLIAHLERIQGSQGITGTPTGFQDLDEKTGGLQAGDLILLAARPSMGKTALGLACCLGVLRHRDDAVVQIFSLEMPAAQLMLRLTAMEGGVSLSTLRSGMLDDEQWGRISQSLDQFARWDQRLVIDDCSHQTPALLRARARRYTRKYGQPALIMVDYLQLMCAPGQENRTQEIADISRNLKALGKELGCPVLALSQLNRQVENRSDKRPNNGDLRDSGSLEQDADLILHLYRDEVYHPDTPDTGTAEIIIGKQRQGPTGVVRVGFDGQYTRFSDLSADSDGYGE

SEQ ID NO: 6348 - protein, 525 aa, Xenorhabdus bovienii
  Peptide sequence Name=Xb4151_4152.C422.gene39.pep
  Homolog annotation: Query=1..502bp; Hit=1..549bp; Blast score=434; Percent Identity=48.0; E value=1e-120; Homolog= gi|37525017|ref|NP _928361.1| hypothetical protein [Photorhabdus luminescens subsp. laumondii TTO1] gi|36784443|emb|CAE13327.1
MARQPLNMGNALLQQGRQAAATLSEQPPVSEMPMVLTLDQLRPNPDNPRTSRNPRYEDIKASIKVRGLDTVPKVTRDPEGEDVYIFSDGGNTRYQVLSELWQETGDERFYRVHCLFKPWPGRLQCVIGHLAENELRGELSFIEKALGVCKARTLFEVQNQQKITQSELSALLGEAGFPVSRSYISRMEDTVQYLYPWMPDLLNSGLKVPQIRLLLALRQDAEAVWLQHVVSAISEPACSFDAIFGACCRKFDSPESWSPEMFRDELIGDLLQVLPHPQLNYDRWVLELDPKESNRRQLFGEQATPVDLVPEKPDTPKADRVRAPDREPNRRIMSQPVTDAEQASETTCAPVDKTPVPAPSSRNNPVLPPYQPDSPSEPALSEPEADDLHFARTGLEPVSSVWHISPMQDDIEHLQNMAFRLAFELAEVMGCDRDLLPVSDERSAGFCLIDGPDVHPFSCLLHSLTGEISTDRHELTLTAVLLGTAGRKAVPLLDDSQTVKFLRLLRIIRRLRELQREMVPEMLAM

SEQ ID NO: 6349 - protein, 193 aa, Xenorhabdus bovienii
  Peptide sequence Name=Xb4151_4152.C422.gene40.pep
  Homolog annotation: Query=1..178bp; Hit=1..177bp; Blast score=201; Percent Identity=59.0; E value=4e-51; Homolog= gi|37525019|ref|NP _928363.1| hypothetical protein [Photorhabdus luminescens subsp. laumondii TTO1] gi|36784445|emb|CAE13329.1|
MNHLSQATNSLLLQLVMDLKNGYIRRCEALGLAPSEMLMLQSLTIEDLHYLGNSPVSVLSVQIHHANLARILHQARIEQQRIQRIDRALALSGSIDLMHYFFGLSSLEVAARRRIAGIAVKSGRVSVLTEAENRDLWQRWQAAKMRDADSADGLDIMMDVAEHHDISLTSVWNAVKEWQQQGASGSVSVKKQG

SEQ ID NO: 6350 - protein, 85 aa, Xenorhabdus bovienii
  Peptide sequence Name=Xb4151_4152.C422.gene41.pep
MSGKLTEIMPGLHVPVTAPLSFRRKAQYQVKCYRRGQRNYVRLKEKGTGYLKINVGLFWRLLSRDSGQSWELMHHERYNNEIRKS

SEQ ID NO: 6351 - protein, 407 aa, Xenorhabdus bovienii
  Peptide sequence Name=Xb4151_4152.C422.gene42.pep
  Homolog annotation: Query=4..396bp; Hit=17..424bp; Blast score=389; Percent Identity=56.0; E value=1e-107; Homolog= gi|37525020|ref|NP _928364.1| hypothetical protein [Photorhabdus luminescens subsp. laumondii TTO1] gi|36784446|emb|CAE13330.
MINLSADSLIAHTMAKMKSRLEQRPDDDVSQLRSGLLFMGNIQDAYPRRLLLDDRLSPLDKTGWMMIRLYAQQNEGAVFPSYDELQLLLASPYKGKASRETVSRVLLMLRITGWLSLCKRIRDEHGRVRGNIYAQHDEPLTCRDAEILDPHWLDTVAEACRSKNRTISQTAREVLTDIQEDPLMRHRHSHIRLLEARLNAVQTPQQRVMRQALQQGKQQTELREMKPGSETESGQLKGQNKPNSETELSMKSMTCRQTTKPNCYVRSFTQSVNKKTYVDTPSAIFLPEKLCRQLEPEDGGMLNSQLQALPAEQAQAVLTCLDKALQAGKIGNPVGWLLAMMKRAREGKLYVQAEPAVTTTAAAKKPVEFTRETARSVPPSSQAHVSSVVKDIRQRLAQAKYHRDDMG

SEQ ID NO: 6352 - protein, 180 aa, Xenorhabdus bovienii
  Peptide sequence Name=Xb4151_4152.C422.gene43.pep
  Homolog annotation: Query=15..180bp; Hit=11..174bp; Blast score=172; Percent Identity=54.0; E value=2e-42; Homolog= gi|37525021|ref|NP _928365.1| hypothetical protein [Photorhabdus luminescens subsp. laumondii TTO1] gi|36784447|emb|CAE13331.
MSEPDEKTAPSPPRRAGALKSTLTIELHTHYAIRLWAGRKKEDVTGRRQYPDIIGMPQVIKRAGTISEDAAADNPYADSWLMKLEQALVAASASLQQRIATLQETLNALPAQVTLSAVSSVEPLNIGVYSHSPLGYRCVWLLVGFDQLAMKTFQAFHYGFISRSERDALLHNGSRVIRQI

SEQ ID NO: 6353 - protein, 926 aa, Xenorhabdus bovienii
  Peptide sequence Name=Xb4151_4152.C423.gene1.pep
  Homolog annotation: Query=6..915bp; Hit=6..915bp; Blast score=1116; Percent Identity=58.0; E value=0; Homolog= gi|16122366|ref|NP _405679.1| putative phage host specificity protein [Yersinia pestis] gi|22126075|ref|NP_669498.1| putative phag
MTLHIIEGAKGGGGGGHTPYEMPDNIQSTATAKILVALGEGEFVNDLTAKDIYLDGTPLQNDNGTMNFAGVKWEFRPGTQHQNYIKGMSAAENEIRLGTEIKTAVPWTKYISNTKLSAVRVRLGWPTLRMQKENGDTVGFRVDYAIELSTDGGSYQAVFDTHIDAKTTTLYERSYRINLPDTKTGWTVRVVRKTPDSTSERINDKMNIMAFTEIIDAKLRYPNTALLYVEFDARLFNGNTPLISCKPKGRIIRVPANYDPVNRTYSGIWNLTFKWAHSNNPAWVLYDILLNDLCGLGDKIDRTQIDEIELYRVAQYCDQLVPDGKGGGGMEPRFTCDVYIQSREEAHKVLTDIGAIFRGSVHWGANQFVAAADMPDDIKYIFTQASVINGDFVYSGGGERNRSTVAMVSWSNPNNHYNDEVEVVSDDNLIRRYGINQIDISAIGCTRQSEAQRRGKWAILTNSRDGMISFRVGLDGQIPMPGHIIGVAHKNRAGRTIGGRIQSVNDRNITLDRKPDVKAGDRLLVNLPTGKSEGRTVQAVNGHIVTVTTTYSESPVSGAGWAVDAHDLFIQQYRVVGIKDNNDGTFEINGLYHDPDKYDRIDTGARIDERPISIIPASVQQPPNSIRIESFSFVQQGISTTTVRIAWEKAEGAAAYVGEWRRDSGNWISIPRTASLGFEIPNAYSGRYQARIKAINSFDIPSLFISSEEVNIVGKQGNPPAPLGFRTTPIIFGIQIDWGFAPQTDDTLKTEIQYSRTNDGEGLLLLADIPYPQRMHTMQGLAAGVAFYFRARLVDKSGNQSPWTAFIRGESSSDTNWIIDAAGKEFLSNKAGQRLQSQMDFNSEAIMENAALTGAVVQRQLQVNGNMRAEILEVKTTQVTDREAFAEKMEKVQADVGENAAAVKTKATVVFDIDGNGYALKEIEAG

SEQ ID NO: 6354 - protein, 68 aa, Xenorhabdus bovienii
  Peptide sequence Name=Xb4151_4152.C423.gene2.pep
MLACLNLSGVTMGRDARASMSSAPDKPKKPHGFREPFFMSGFHQVDKPFMSSIISLRKTRLGTALIND

SEQ ID NO: 6355 - protein, 346 aa, Xenorhabdus bovienii
  Peptide sequence Name=Xb4151_4152.C423.gene3.pep
  Gene classification: Function=Transposase; Function class=L DNA replication, recombination and repair
  Homolog annotation: Query=15..344bp; Hit=2..335bp; Blast score=241; Percent Identity=43.0; E value=7e-64; Homolog= PA2319 COG3547
MLAGCFFQEKTIMQNVTLIGIDLGKHSFHVHCQDKSGKALLRKKFTRARLMEFLAGSPSATVVMEACAGAHFMARRIAAFGHEAKLISPQFVRPFVKSNKNDFVDAEAICEAASRPSMRFVQPRTEAQQAMRALHRVRESLVRDRVKTTNQMHAFLLEFGISMPIGTAVIKRLSTVLAENELPPYLAQLLMRLHAHYLYLVEQLTELETALEQELRRDETGQRLQTIPGVGPITASVLSSQLGDGKQYGCSRDFAASTGLVPRQYSTGGKNTLLGISKRGDKNLRRLLVQCARVFIQRIDYQSGRLAEWVKAQLERKHSNVVACALANKLARIAWAITTRQTVFER

SEQ ID NO: 6356 - protein, 52 aa, Xenorhabdus bovienii
  Peptide sequence Name=Xb4151_4152.C423.gene4.pep
MFAEINTNKRNVLHDGLLLKETPCQHTAHRVVGTISLTALLKIVFFVIGRIK

SEQ ID NO: 6357 - protein, 90 aa, Xenorhabdus bovienii
  Peptide sequence Name=Xb4151_4152.C423.gene5.pep
VVRYTNHIRYLRILFFNRNHFNFLRCYCRIPFFISLDLTWPLLLLYLLLPSFYLSRISRYIRTTESLQIIGKQPIASLINQFVGDNVSEI

SEQ ID NO: 6358 - protein, 42 aa, Xenorhabdus bovienii
  Peptide sequence Name=Xb4151_4152.C423.gene6.pep
MVCLPKMMECYEIGIPPDNNTGHNIRVQDLNLTHIVSDKLVN

SEQ ID NO: 6359 - protein, 728 aa, Xenorhabdus bovienii
  Peptide sequence Name=Xb4151_4152.C423.gene7.pep
  Gene classification: Gene name=VgrG; Function=Uncharacterized BCR; Function class=S Function unknown
  Homolog annotation: Query=109..683bp; Hit=15..582bp; Blast score=539; Percent Identity=48.0; E value=1e-153; Homolog= ZvgrE COG3501
MSIKKNLDKLKKGQALVQQGQEAVQKAKQVAGKLGSGMSGTAGLIPGGGFAGGIGGRSGSGMTSTAGLIPGGGFTGGQGLAERSAGGQNAATKALEKVGQMLMGGRDPSGLQFTLTAGSLPPQTFVVTDFTLNESFSQPFSLSVGLASADPVIDFPAVLDRTATLTILQNGIEQRSITGIVSRFEQGNTGLHQTTYQMTIRPDLWRTTLRQNSRIFQQQDIATIITALLKEHSIRDVIFSLRHPHPAREFCVQYQESDFAFLQRLTAEEGIFYFFECSNGRNTLVFADDCGSVPPGIVIPYQPGEVNTVGEPAISSLTCSAQVRPAQVQLKDYTFKNPAWPAEFHQQMRDENLQQLYYEHYDYPGRFKDEAHGKDFTRYRLEALRSDAVTGQGSGNAIALQPGKLFILNNHPRIDLNQSWQTISTSHSGSQPGALETATDGAGTTLHSHFYFIRQNQNWRPAPLSKPVVDGPQIAKVVGPAGEEIFCDQYGRVRLQFPWDRYGKSNDQSSCWIRVSQPWAGQGWGILAIPRIGQEVVVDFLHGDPDQPIVTGRTYHASNIPPGALPGSKTQMAFRSKTHKGQGYNELLFEDAKGSELLSLHAQKDMYTKVLNNRDTHVLANHSETVEKNQTITVNENKEETVTLNSTETVKEVRKLITGKDYIIEVGTHKIETINNTLSITTGDVIELRCGASVLRMDSAGRITLQGSEFKFEASGPVQITGKDIDLN

SEQ ID NO: 6360 - protein, 405 aa, Xenorhabdus bovienii
  Peptide sequence Name=Xb4151_4152.C423.gene8.pep
  Homolog annotation: Query=1..373bp; Hit=96..414bp; Blast score=134; Percent Identity=31.0; E value=3e-30; Homolog= gi|22957521|ref|ZP _00005220.1| COG5351: Uncharacterized protein conserved in bacteria [Rhodobacter sphaeroides]
MEFRNLTPFAVMNYSMLDVEDVEHHVAVIKIGYQLLPVGQGEYSAELLPAPRLCLQDEYREQMNASQVLQESDLAPFKPRCDVIVNGTAYAPDNRPCTEFPVRLRVKSKQGQTLLDKTLTITGEREFIRDAGGQWQLTDPKPFSTLPLDYRYAFGGECKIQADDKASEHLKERDRLTPEQRRQHPDGENAPVAHAVCESNPLGMGFITPWYAQAKPLTRSPALRITRPDAPFTAQHFTTQLDGTLAPDTPACQPQGMGFIGRPWLPRRQLAGTYDADWLTHRHPYLPKDFDFGYWNGAPTDQQIDWPDTDIAITLSGLTPDGELHVNLPGHRPFILLRMHNGILLPVPMRMDTLIINSEARTLHMTCRLSFKASLPVRVAETRFEINPDAPLLNLAPLEEEKTDG

SEQ ID NO: 6361 - protein, 133 aa, Xenorhabdus bovienii
  Peptide sequence Name=Xb4151_4152.C423.gene9.pep
  Homolog annotation: Query=16..132bp; Hit=1..117bp; Blast score=103; Percent Identity=47.0; E value=5e-22; Homolog= gi|22986048|ref|ZP _00031153.1| hypothetical protein [Burkholderia fungorum]
MPPCSIWHHWKRRKRMADNYIARTAGEWLIIGMLPDVCKTPMGASTPPIPYPVIAKLAGSDTPVKSVRANGQPVVVFAQSFVPTTLGDQPGVANGIKSGTVGAKCHPKAHTNTVRAGNKLVLRHGDEFWMNGA

SEQ ID NO: 6362 - protein, 1518 aa, Xenorhabdus bovienii
  Peptide sequence Name=Xb4151_4152.C423.gene10.pep
  Gene classification: Gene name=RhsA; Function=Rhs family protein; Function class=M Cell envelope biogenesis, outer membrane
  Homolog annotation: Query=307..1380bp; Hit=393..1491bp; Blast score =357; Percent Identity=29.0; E value=6e-98; Homolog= Z0705 COG3209
MSEDKANREDVSSETGEHIPPQPNTALPSKPRSDSPTGEGNTLGKIIGQAPQGASSPHEANPVVIPESKPEMSAWETLKTMGKALGNAAVDKAKETKQDLSTVSGWDPIEQQKGIAKTVSNTAVGLGEMAIKGGMLNSAREADESARSLAFWGKVFGNPDTEKQAKVIGEVADAGRTNAKQFNLDEYKMTLDTPGQRIGGTAADIFMLIGPTKGAGTAGSVTKAPEIAKVAEAGALATKSREAAQVVEASTQAAKNANPAAGAIIKEKPATSPKTEVKPTTEKPVDNATSSGKKKGNDNELSSTKGDPVDMATGDFLQVWPVLAIPGVLPINLSRTYRSTADLHGLFGAKWADDWSLKLAISQGEVHYTHTDGVIYDYATPDNRVLSRNRNLPHCLLTGELTGELCLTDRRTQLTYHFSPMSGNTRKLSAITDRRQNRIDFIYDKQSQLTAVTRNDGLRLSLHYLDGRLNTITMQENREGQPAEQCLLTCQYDSQGYLNECDAFQHNHLWHEYDVQGRMIRWHDTDQTDLTITYDERGRVLSTTSPSGYWHDRFRYDDNARITTYLDGEGGETHYHYDPNGLVIREVDPLGRITRRQWRHSLLMWESDPMGQMTAFDYNPDGALTEVKLPTGDTFAYGYNEHGQLIESVLPTGERWQLHYDEQGNLTALTHPLGHQEEYQYGTQGELRQRLLPDGRQWHYAYDEKQRLAAVMTPDGETTGLQLDALGRLRQFTDALKQQTHYRYSDDHASLNGSLTEVELPDGVTQQLRYDSERRVVAATDGEGRTTRYQYGAFDLLNQVTRPDGTILRFGYDRLTRLNSVTASTGETYRYERDAAGQIIRETDFTGRTLEYQYDKLGRRTLTQYPDGQQLRWHYSAAGLLVKQESWQPEENQQVLKDTTTYEYNQRYQLVKATNADATVEYEYDKTTGLPTCERINGREITRKWDNLTGRPVSESVEGNTLHFGYNLSGSLNHFQLNEHSPLAFRHDALGRETVRESANGFILASRYTATGLLAHQSAGQATPFFRETLAQNDPHFPPQASAVNRSWQYDRAHNVRVIDDSRWGQTRYRYNTNDQILHTLFEGVRPHEEQFSYDANGNLNQHLPPDAQGALEQITQRQKAGRVVQQGDIRYRYDDNGRLVEKTEQRDGFRPQIWRYRWDTQNQLTHVETPDGSRWHYRYDAFGRRVRKLKVHDGKLTATNLQLWLAGKADLAPRSDAIIGQEYLWSGDQLIEEVPIYADGTPVEDQRVRWLYEPGSLTPSARFEKGKLHYIVSDHQGTPREMLSEEGVLVWAQRLTTWGKAEKSQVIASNNPDYHVNCNLRFCGQYEDEESGLYYNRFRYYSPDTAQYISADPIGLLGGVNPYGYVHNPSKWIDPYGLAGGIGNKGDYIITYRGDTRSFTEIFDKGFETLGPSKDLYKHALDNRAPPSDFVSTTIDPTKTISFATKYGQKSGYMYTMKTNHGIDVNKALGARSPFAAEAEIAMPGGVRAEDILGARAVNADGEMWDYTILNPKRYGK

SEQ ID NO: 6363 - protein, 134 aa, Xenorhabdus bovienii
  Peptide sequence Name=Xb4151_4152.C423.gene11.pep
  Homolog annotation: Query=33..133bp; Hit=31..133bp; Blast score=63; Percent Identity=37.0; E value=5e-10; Homolog= gi|30575708|gb|AAP32758.1| unknown [uncultured bacterium]
MTDVDKRKIKIILNGEMEEAELHMITSPNRHCCLKIFHNNNQLAESNDTDYFSCFADLRNQLKNIIFLCKGAKINVYPSAMSRDMSDGIVAYETTLGQPGLPENQVHIFDFEDKYVDITPEEQRKFHSQWFESL

SEQ ID NO: 6364 - protein, 106 aa, Xenorhabdus bovienii
  Peptide sequence Name=Xb4151_4152.C423.gene12.pep
  Homolog annotation: Query=1..106bp; Hit=1..107bp; Blast score=130; Percent Identity=66.0; E value=3e-30; Homolog= Pa|Phot4-264g05.p1k _g42| 54392 - 54715 326 107 aa, chain +
MAKAHSKQNRAVNKATKIERYYTVGYVPQNDKANAPPAIHLKGQWLKAAGFEIGGSVTVKIMEGCLVLIPDSDETHRLKQQYQRQREQISEIKLRMRELIGDYKSG

SEQ ID NO: 6365 - protein, 134 aa, Xenorhabdus bovienii
  Peptide sequence Name=Xb4151_4152.C423.gene13.pep
  Homolog annotation: Query=21..129bp; Hit=2..105bp; Blast score=63; Percent Identity=34.0; E value=6e-10; Homolog= gi|37527570|ref|NP _930914.1| hypothetical protein [Photorhabdus luminescens subsp. laumondii TTO1] gi|37527578|ref|NP_930922.1
MCAVLVFFFVPQWMAAATEKKFAQRLRELRRQKGLSQSELGKLAELHYTHIGRFERGTSRPGSDTLKRLADVLDVTSDYLLEGAETDAAKARFEDRELLRQFQAVEQLPEEDKEVIKKLLDAFLTKKQLQALAR

SEQ ID NO: 6366 - protein, 685 aa, Xenorhabdus bovienii
  Peptide sequence Name=Xb4151_4152.C423.gene14.pep
  Gene classification: Gene name=VgrG; Function=Uncharacterized BCR; Function class=S Function unknown
  Homolog annotation: Query=110..640bp; Hit=60..582bp; Blast score=528; Percent Identity=48.0; E value=1e-150; Homolog= ZvgrE COG3501
LSAQFPQALCKFLLCCCCHPLGHKEKYQYGTHGNLRLCQLTDALKQQTHYRYSNDHASLNGGSLTDVELPDGTTQQLAYDSERRVVAVTDGEGRTTRYTYGAFDLLNQVIDFPAVLDRTATLTILQNGIEQRSITGIVSRFEQGNTGLHQTTYQMTIRPDLWRTTLRQNSRIFQQQDIATIITALLKEHSIRDVIFSLRHPHPAREFCVQYQESDFAFLQRLTAEEGIFYFFECSNGRNTLVFADDCGSVPPGIVIPYQPGEVNTVGEPAISSLTCSAQVRPAQVQLKDYTFKNPAWPAEFHQQMRDENLQQLYYEHYDYPGRFKDEAHGKDFTRYRLEALRSDAVTGQGSGNAIALQPGKLFILNNHPRIDLNQSWQTISTSHSGSQPGALETATDGAGTTLHSHFYFIRQNQNWRPAPLSKPVVDGPQIAKVVGPAGEEIFCDQYGRVRLQFPWDRYGKSNDQSSCWIRVTQPWAGQGWGMLAIPRIGQEVVVDFLHGDPDQPIVTGRTYHASNIPPGALPGSKTQMAFRSKTHKGQGYNELLFEDAKGSELLSLHAQKDMYTKVLNNRDTHVLANHSETVEKNQTITVNENKEETVTLNSTETVKEVRKLITGKDYIIEVGTHKIETINNTLSITTGDVIELRCGASVLRMDSAGRITLQGSEFKFEASGPVQITGKDIDLN

SEQ ID NO: 6367 - protein, 405 aa, Xenorhabdus bovienii
  Peptide sequence Name=Xb4151_4152.C423.gene15.pep
  Homolog annotation: Query=1..373bp; Hit=96..414bp; Blast score=137; Percent Identity=32.0; E value=3e-31; Homolog= gi|22957521|ref|ZP _00005220.1| COG5351: Uncharacterized protein conserved in bacteria [Rhodobacter sphaeroides]
MEFRNLTPFAVMNYSMLDVEDVEHHVAVIKIGYQLLPVGQGEYSAELLPAPRLCLQDEYREQMNASQVLQESDLAPFKPRCDVIVNGTAYAPDNRPCTEFPVRLRVKSKQGQTLLDKTLTVTGEREFIRDAGGQWQLTDPKPFSTLPLDYRYAFGGECKIQADDKASEHLKERDRLTPEQRRQHPDGENAPVAHAVCESNPLGMGFITPWYAQAKQLTRYPALRITRPDAPFTAQHFTTQLDGALAPDTPACQPQGMGFIGRPWLPRRQLAGTYDADWLAHRHPYLPKDFDFGYWNGAPTDQQIDWPDTDIAITLSGLTPDGELHVNLPGHRPFILLRMHNGILLPVPMRMDTLIINSEARTLHMTCRLSFKASLPVRVAETRFEINPDAPLLNLAPLEEEKTDG

SEQ ID NO: 6368 - protein, 133 aa, Xenorhabdus bovienii
  Peptide sequence Name=Xb4151_4152.C423.gene16.pep
  Homolog annotation: Query=16..132bp; Hit=1..117bp; Blast score=101; Percent Identity=46.0; E value=2e-21; Homolog= gi|22986048|ref|ZP _00031153.1| hypothetical protein [Burkholderia fungorum]
MPPCSIWHHWKRKKRMADNYIARTAGEWLIIGMLPDVCKTPMGASTPPIPYPVIAKLAGSDAPVKSVRANGQPVVVFAQSFVPTTLGDQPGVANGIKSGTVGAKCHPKAHTKTVRAGNKLVLRHGDEFWMNGA

SEQ ID NO: 6369 - protein, 1532 aa, Xenorhabdus bovienii
  Peptide sequence Name=Xb4151_4152.C423.gene17.pep
  Gene classification: Gene name=RhsA; Function=Rhs family protein; Function class=M Cell envelope biogenesis, outer membrane
  Homolog annotation: Query=307..1382bp; Hit=393..1491bp; Blast score =356; Percent Identity=28.0; E value=1e-97; Homolog= Z0705 COG3209
MSEDKANREDVSSETGEYVPPQPNAALPSKPRSDSPTGEGNTLGKIIGQAPQGASPPHEANPVVIPESKPEMSAWETLKTMGKALGNAAVDKAKETKQDLSTVSGWDPIEQQKGIAKTVSNTAVGLGEMAIKGGMLNSAREADESARSLAFWGKVFGNPDTEKQAKVIGEVADAGRTNAKQFNLDEYKMTLDTPGQRTGGTTADIVMLIGPTKGAGTAGSVTKATEIAKVAEAGALATKSREAAQVVEASTQAAKNANPAAGAIIKEKPATSPKTEVKPTTEKPVDNATSSGKKKGNDNELSSTEGDPVDMATGDFLQVWPVLAIPGLLPINLSRTYRSTADLHGLFGAKWADDWSLKLVISQGEVHYTHTDGVIYDYATPDNRVLSRNRNLPHCLLTGELTGELCLTDRRAQLTYHFSPISGNTRKLSAITDRRQNRIDFIYDKQSQLTAVTRNDGLRLSLHYLDGRLNTITMQENREGQPAEQCLLTCQYDSQGYLNECDAFQHNHLWHEYDVQGRMIRWHDTDQTDLTITYDERGRVLSTTSPSGYWHDRFRYDDNARITTYLDGEGGETHYHYDPNGLVIREVDPLGRITRRQWRHSLLMWESDPLGQMTAFDYNPDGALTEVKLPTGDTFAYGYNEHGQLIESVLPTGERWQLHYDEQGNLTALTHPLGHQEAYQYGTQGELRQRLLPDGRQWHYAYDEKQRLAAVMTPDGETTGLQLDALGRLRQFTDALKQQTHYRYSDDHASLNGSLTEVELPDGVTQQLRYDSERRVVAATDGEGRTTRYQYGAFDLLNQVTRPDGTILHFGYDRLTRLNSVTTSTGETYRYERDAAGQIIRETDFTGRTLEYQYDKLGRRTLTQYPDGQQLRWHYSAAGLLVKQESWQPEENQRVLKNTTTYEYNKRYQLVKATNADAIVEYEYEYDKTTGLPTCERINGREITRKWDELTGRPVSESVEGNTLHFGYNQMGALNHFQLNQHAPLTFQHDVLGRETVRESAHGFILASRYTATGLLSHQSAGQATQFFRETLAQSDPHFPPQASAVNRSWQYDRAHNVRVIDDSRWGQTRYRYNTNDQILHTLFEGARPHEEQFNYDANGNLSQHLPVDAYGAMEQITQHQKAGRVVQQGNIHYRYDDNGRLVEKTEHRDGFRPQIWRYRWDTQNQLTHCETPDGSRWHYRYDAFGRRTRKLKVHDGELTAANLQLWLAGKPDLAPRSDAIMGQEYLWSGDQLIEEVPIYADGTPVEDQRIRWLYEPGSLTPSARFEKGKLHYIISDHQGTPREMLSEEGVLVWAQRLTTWGKADKSQVIASNNPDYHVNCNLRFCGQYEDEESGLYYNFHRYYSPETAQYISPDPIGLLGGVNPYGYVHNPSKLVDPYGLSGTSQVASKPDFYVGPDGPSATMPSTAYRYMNSEGPYAAMTIEKKSAPLSYFGYTKYKSGHEARDAYQIFYEKGNPDSWSDARLLGKFDTLQLYKNGVPQVKVPLANGDKGPGLELFTSAYPQYGKGGAVQLLPIEKNLPVTFDKVTIIPE

SEQ ID NO: 6370 - protein, 69 aa, Xenorhabdus bovienii
  Peptide sequence Name=Xb4151_4152.C423.gene18.pep
MTETELRKNLTYLVDKYMPDNEKKEELYTYIQRENVPVKGILADFNEYKTRTVEQVDGNLIREIYFYYC

SEQ ID NO: 6371 - protein, 229 aa, Xenorhabdus bovienii
  Peptide sequence Name=Xb4151_4152.C423.gene19.pep
  Gene classification: Gene name=RhsA; Function=Rhs family protein; Function class=M Cell envelope biogenesis, outer membrane
  Homolog annotation: Query=3..99bp; Hit=200..302bp; Blast score=81; Percent Identity=41.0; E value=7e-16; Homolog= Z0702 COG3209
MQVWTQWLTTWGKADKSQVIASNNPDFHVNCNLRFCGQYEDEESGLYYNRFRYYSPDTAQYILPDPLNLAGGVNPYGYVHNPSKFVDPYGLSSTSEVKAASIQSPSEFARSWQGQGEYPGVDRFKDITVKKDTILMAGAPGQGNFYTTVSAIERSGFSQEGVFKGLQVMPHPQFGYRPGMTAYRVLEDTPAAFGIVRANPQHGAGGLPQIVIKNYEGILEPLYSVKLIK

SEQ ID NO: 6372 - protein, 140 aa, Xenorhabdus bovienii
  Peptide sequence Name=Xb4151_4152.C423.gene20.pep
MIYFNGDISLNGIIINPLITLDDFLTLTLDLNPKKMYDFEGRVSYSIDDILFLDKNYIINVVFQDGIIDFIKLLPFNKEKENKINVFTNENQMRNKLINDDLLKSLFGSSEKLFFLWGNIESVDDNKSGMSYIIISYKQQ

SEQ ID NO: 6373 - protein, 104 aa, Xenorhabdus bovienii
  Peptide sequence Name=Xb4151_4152.C423.gene21.pep
MDSIEQSKKLRVLFLSLWEIMRVNGGGNWIKGIENVITLLTPPTYGGTNDAQSAIEDARRAYGSMFGGYGGFSEYFIWRDDFNERLKANKALDKIKNDINDTFN

SEQ ID NO: 6374 - protein, 64 aa, Xenorhabdus bovienii
  Peptide sequence Name=Xb4151_4152.C423.gene22.pep
LRLFVSSLPGMSTKQPSMILTVTESPMVKEQFTKSGTRLDGRADQIVLPLGYPISWVKDVRFLK

SEQ ID NO: 6375 - protein, 41 aa, Xenorhabdus bovienii
  Peptide sequence Name=Xb4151_4152.C423.gene23.pep
MNKEQLLIKIVKAIDLLEEEKRNNKNQLQSIINLFIKTKEK

SEQ ID NO: 6376 - protein, 127 aa, Xenorhabdus bovienii
  Peptide sequence Name=Xb4151_4152.C423.gene24.pep
MITVYQYIYDKMIKKREEMRSYLLGPLSDDLPEEYKPIRELYYTGSAKGKSYVEKMIIKTADDLLLLQLEKMDKLRFLENGQDMFSMELKLNEYNSIVHVPQNLSFCSIMKELIEEENNNHISRFVY

SEQ ID NO: 6377 - protein, 94 aa, Xenorhabdus bovienii
  Peptide sequence Name=Xb4151_4152.C423.gene25.pep
  Gene classification: Function=Predicted transcriptional regulator; Function class=K Transcription
  Homolog annotation: Query=1..88bp; Hit=1..88bp; Blast score=96; Percent Identity=52.0; E value=4e-21; Homolog= HI1420 COG3636
MKTEPKKFDVVEFLETEEDIQAYLNAAIEENDTKYLFKALGNIARRKNISQLSKESGISREGIYKALSGEGNPSFNTVYKISKVLGLKLHFTGA

SEQ ID NO: 6378 - protein, 106 aa, Xenorhabdus bovienii
  Peptide sequence Name=Xb4151_4152.C423.gene26.pep
  Gene classification: Function=Uncharacterized BCR; Function class=S Function unknown
  Homolog annotation: Query=9..104bp; Hit=3..98bp; Blast score=108; Percent Identity=53.0; E value=9e-25; Homolog= XF1703 COG3657
MILALEVSMITIERTQDFEKWLKSLKDRIAKAKILIRIERMEEGNFGDVEPVGAGVLELRIHYGQGYRVYFANKNNEIILLLCGGDKSSQQADIKKAKQLAKEWGF

SEQ ID NO: 6379 - protein, 112 aa, Xenorhabdus bovienii
  Peptide sequence Name=Xb4151_4152.C423.gene27.pep
MKLHFSTDNAELPECVLSGDDMQQMGFMPNTLFHIQQYNNGLMLTLAEPDVIPLSHTAENDPYQGIDWVRDNGELYLAGDWLTETGLLDNPVQVAFGYGKIMLMTESDLIPV

SEQ ID NO: 6380 - protein, 39 aa, Xenorhabdus bovienii
  Peptide sequence Name=Xb4151_4152.C423.gene28.pep
MKNHIEHACVSGALRLKGKIFLLRSHSHFILPIKQGRNR

SEQ ID NO: 6381 - protein, 109 aa, Xenorhabdus bovienii
  Peptide sequence Name=Xb4151_4152.C423.gene29.pep
  Homolog annotation: Query=12..103bp; Hit=9..91bp; Blast score=81; Percent Identity=45.0; E value=3e-15; Homolog= gi|37527254|ref|NP _930598.1| hypothetical protein [Photorhabdus luminescens subsp. laumondii TTO1] gi|36786688|emb|CAE15754.1|
MADAHSTAGICIYKISQPERYQKVVYRPKGVNRTIPAINLSGKWLLEAGFSINDPLKIRVMPGCLIITSQNFYELWHCLKSLNEGEWDDIAVAHWLRQFPGKLTKKLPK

SEQ ID NO: 6382 - protein, 71 aa, Xenorhabdus bovienii
  Peptide sequence Name=Xb4151_4152.C423.gene30.pep
MQMPAVECASAIITTPIVVAVSGFIVLLHGKAASNFHRHSISRPNNIPLTKIAFAKRLARSRAKFALLFVL

SEQ ID NO: 6383 - protein, 84 aa, Xenorhabdus bovienii
  Peptide sequence Name=Xb4151_4152.C423.gene31.pep
  Homolog annotation: Query=4..84bp; Hit=3..83bp; Blast score=95; Percent Identity=65.0; E value=1e-19; Homolog= gi|28869204|ref|NP _791823.1| prevent-host-death family protein [Pseudomonas syringae pv. tomato str. DC3000] gi|28852444|gb|AAO55
MTITTLSSRELNQDVTRAKKATKNGPVFITDRGKPAYVLLSIEEYRLLTKQHRNIADSLAMPGVADIEFEPQRVTIETRPADFS

SEQ ID NO: 6384 - protein, 141 aa, Xenorhabdus bovienii
  Peptide sequence Name=Xb4151_4152.C423.gene32.pep
  Gene classification: Gene name=VapC; Function=Predicted nucleic acid -binding protein, contains PIN domain; Function class=R General function prediction only
  Homolog annotation: Query=1..138bp; Hit=1..137bp; Blast score=70; Percent Identity=36.0; E value=4e-13; Homolog= XF1589 COG1487
MYVLDTNVVSELRKIRAGKADPNVAKWAESVDAADLFVSAITIMELELGILLIERKDATQGTLLRAWLEQHVLPEFTERTLPVDTAVAQRCARLHVPDRASERDALIAATALVHGMAVVTRNVADFQPTGVTILNPWEPNS

SEQ ID NO: 6385 - protein, 56 aa, Xenorhabdus bovienii
  Peptide sequence Name=Xb4151_4152.C423.gene33.pep
LLVILLVSYSATWTLMATGNFRSLLLTDSQMYLCSAIGHHQVKSQLIHIKSSAPTD

SEQ ID NO: 6386 - protein, 456 aa, Xenorhabdus bovienii
  Peptide sequence Name=Xb4151_4152.C423.gene34.pep
  Gene classification: Function=Retron-type reverse transcriptase; Function class=L DNA replication, recombination and repair
  Homolog annotation: Query=6..385bp; Hit=1..364bp; Blast score=74; Percent Identity=22.0; E value=3e-13; Homolog= BH0099 COG3344
MTAGRIFKKSFSERNLLKVYKEKIKESGAIGIDRVRPSKLDSTIKNEIKFISEKVNSGSYKFTAYKEKLISKGANSNPRQISIPTARDRITLRALCECLTEIYPDSRLRLPHKVIDSLKVALNSGLYTEYAKIDLRTFYPSIKHTLIADAIKNKVRKSEIRKLIMSSLVVPTVSEFKGSKGASANPRGVPQGLAISNILAEISLSIFDKEINEIPDIWFMRYVDDILILTPNSQAETMASHVIKKLQLLNLNPHPLNEENSKSKVGNLDESFDFLGYHISQGELLIKHESILRFESSLAKIFTAYKHAVLQAKNKCDKERAIAYCQWKLNLRITGCVFEGKRLGWVSYFSQISTTAQLRSVNHTVSHLIRRFSLSSEIKQKSLIKTFYELRRGTADTFKYIPNFDNLDISQKRELVSMWIGKDKAKMLSNSEIERKFKFKIANSAKELEEDISGIS

SEQ ID NO: 6387 - protein, 181 aa, Xenorhabdus bovienii
  Peptide sequence Name=Xb4151_4152.C423.gene35.pep
MRDNIWFTYKARINAHHRLEWLEKHSQFILVWYAILSAVLSIVTLRFPKVLGNNTDILATILSVALLGISLVVSNLDFRGRAISMRRNYLALQRLYSDTTIGQPLTLEQRKKYHELLDEVENHLDIDDQIARVAQVGLTTRIPTKKEKRTVLGWKIKRFIFTYSFYLLPLVWIAYDCWSNL

SEQ ID NO: 6388 - protein, 97 aa, Xenorhabdus bovienii
  Peptide sequence Name=Xb4151_4152.C423.gene36.pep
MKLSYFKRMGQVLPLAFVRAALIMNSDFLLLGLGSLILLSRVFNGSNLSCPFHIPKNKREFSCGTISGLHIKHVLMHIIAWSGLKNTLSSSSFGMLY

SEQ ID NO: 6389 - protein, 879 aa, Xenorhabdus bovienii
  Peptide sequence Name=Xb4151_4152.C423.gene37.pep
  Homolog annotation: Query=1..863bp; Hit=1..852bp; Blast score=956; Percent Identity=54.0; E value=0; Homolog= gi|16122366|ref|NP _405679.1| putative phage host specificity protein [Yersinia pestis] gi|22126075|ref|NP_669498.1| putative phage
MEKQPIQGNKGGRQQPRTPVEAPDSLQSTSYTKIILALGEGEFAGDLDGQRIFLDNTPLIGSDGRPNFEGIKWEFRPGTPYQAYIPGMPAVENARTVSAELVSSWVTTVTNTQLSAVRLRLSWPQLQRQKENGDTVGYRIEYAIDLATDGGAFKEILKTAVDGKSTTKYERSHRVDLPQAHSGWQLRLRRLTPKQNSNRIADAMVVEAITEVIDAKLSYPETALLFVQFDAKQFRNIPQITCEPKMRIIRVPSNYYLEPRRRYYHGSWDGTFKWSWSDNPAWVLYDLMINDRFSIGTRVKTENLNLAKWDLYRIAQYCDQMVSDGEGGEEPRFTCNVYIQSQEDAWAVLRDIAGIFRGMTFWSNNNMNVLADMPRDMDYLFTCANVRDGKFTYSSASEKTHYSTAMVSWSDPQNGYQDAIEPVFEHRLIRRYGIRQADITAIGCISQSEAIRRGKWVLHTNEHDRTANFTVGLEGYIPLPGYLIGVSDNLLSGVGRSGRIQAVPRRYIITLDRVPSAKVGDWLVINLPSGKAERDLISAINGQEVSVWDRGYAYSEQPEVGSIWVIESRYEPEQPFRVIGIKAGEDGVSFDITAVEHNPDKYALIDKDIRIDERTVTIIPPSVQPAPKDVLIDSYYSLNQGIISNTLQITWDAADSAVAYEVEWRKDNGNWITAPQTTVRGLEVPNVDDGRYQARVRATNAAAISSIWMNTQDTLLGSRKEIPSAPQSLQTTSLLFGIRLDWDFANPTDVLLKTEICYNKNGEDDDTLQFADISYPQRTHTLQGLAAGEKLYFRARLVDKSGNASEWTSWVSGVASNDTGWIVEASRDHFLDTEIGRRLQNQLNEQARVDAHHSQSIAENAQAIERLNDILEDIQRRMR

SEQ ID NO: 6390 - protein, 191 aa, Xenorhabdus bovienii
  Peptide sequence Name=Xb4151_4152.C423.gene38.pep
  Homolog annotation: Query=4..190bp; Hit=9..199bp; Blast score=196; Percent Identity=56.0; E value=2e-49; Homolog= gi|32043835|ref|ZP _00141097.1| COG4723: Phage-related protein, tail component [Pseudomonas aeruginosa UCBPP-PA14]
MNTLRTVRLYGVLGTQFGRVHKLAVSTPQEAIRALSVLIKGFEHFLLTAKEQGLTFAVFNGKHNISREELVFVGQDDIRIAPMIIGSKNAGVFQTILGAVMVVAGAFLWATPFGAPMVMSGVGMMLGGVVQMLSPMPGGLARREDPDNKPSYAFGGPVNTVAQGNPVPIGYGRRRIGGAIISAGIYSEDQQ

SEQ ID NO: 6391 - protein, 248 aa, Xenorhabdus bovienii
  Peptide sequence Name=Xb4151_4152.C423.gene39.pep
  Gene classification: Function=Uncharacterized ACR, PAD1/JAB1-related; Function class=S Function unknown
  Homolog annotation: Query=4..127bp; Hit=3..126bp; Blast score=135; Percent Identity=51.0; E value=3e-32; Homolog= PA0639_1 COG1310
MTILRKSTTRAIMAHAQSTYPDECCGLIIQQHRRQHYLPCRNTALSPTEQFSIHPEDYAAAEDKGSIIAIVHSHPDATTQPSQLDIAQCDLSQIPWVIVSWPEGDIRTLMPIEGIKPLIGRPFVHGIWDCYAIVRDWFRLERTIELPDFERTDSWWVRGENLYMKQYAAAGFVACRGELQTGDVIIMQVQANEPNHAAIYLGDSLMLHHLYGQLSKREPYHGYWQERTIITLRYSSASADFLFREVTS

SEQ ID NO: 6392 - protein, 245 aa, Xenorhabdus bovienii
  Peptide sequence Name=Xb4151_4152.C423.gene40.pep
  Homolog annotation: Query=1..245bp; Hit=1..250bp; Blast score=327; Percent Identity=60.0; E value=1e-88; Homolog= gi|16122357|ref|NP _405670.1| putative phage protein [Yersinia pestis] gi|22126082|ref|NP_669505.1| putative phage tail protein
MTINATLQQLEPGSKVLLFAVDGSAFGGPELYFHNHPIVYTGAELESADNLPAKSLWWQGVEYKPWPVSIEGLEVTGDGRAVTPTLNVANLDGSLSALCLAYQNMVQARVTIRMTFAHYLDARNFPGGNPQADPTQEKIEVFYIDSKTQEDNENIQFSLSSPADLQGIKIPTRQIHSLCTWCMRGQYRQSPCGYTGTQYFTERGKPTDEPAADACGGLMSDCKKRFGDTEQLPFGGFPGSALLRR

SEQ ID NO: 6393 - protein, 111 aa, Xenorhabdus bovienii
  Peptide sequence Name=Xb4151_4152.C423.gene41.pep
  Homolog annotation: Query=1..111bp; Hit=1..112bp; Blast score=89; Percent Identity=41.0; E value=1e-17; Homolog= gi|23471668|ref|ZP _00126997.1| COG4718: Phage-related protein [Pseudomonas syringae pv. syringae B728a]
MMIKTFDFPARVGTSGEFEPIVRTVQFGDGYKQTSGDGINTQRESWPLSFVGAQSDIQPIMDFLREHQGWRSFKWRNPLSELGLYQAGKFTIQANGTYFTLSVTFTRIYHP

SEQ ID NO: 6394 - protein, 1111 aa, Xenorhabdus bovienii
  Peptide sequence Name=Xb4151_4152.C423.gene42.pep
  Homolog annotation: Query=1..946bp; Hit=1..941bp; Blast score=699; Percent Identity=47.0; E value=0; Homolog= gi|33770523|ref|NP _892060.1| tape measure protein [Bacteriophage PY54] gi|33636106|emb|CAD91775.1| tape measure protein [Bacteriop
MANLSTLTVGLLVNATAFKSQMMDAYRYAGRESERFNDKSVADANKVKKSYSSLASHIKSVSGQLALLAGMGFSLSSMISHTRQYGQALSDLSAITGATGAQLKKLDETAQQLGRTTEFGATGIANALKLMASAKPELLKNTAALTQATEKAVILAQASGIELPEATKALALSLNQFGASAAQADRYINVLAAGAKYGSSEINETAQAIKNGGTVAAQAAISFEALNAVIQILAAGGIKGAEAGTAIRNIILALEKSNDKKLKPSVVGLGSALDHLKSKNLSTAEAAKLFGRANISAASQLVVGRGKLDALTQSLTDTRVAYDQASERANNLSADLDVLASAFEGMAIKIGQNADGPLRSGVQNATSAINALSENFNLVASVALHTLIPVMATKLTAGLRENITAWRATEKAARDVAKQQAETAKRTIEQANATLRSTEAQGRHIKYLESTNRLHGLSVNYAKEKRILIRQETEALKLQTQATGQLEAANRRLSYSYRALSAAGGVARGALAMIGGPFGAAMLVGSALYGLYHHSVQAREGLRHLKDETVETVAGLQRLSRIKVEVELDKTDDDINHLKEELKQIDSQLERYSQTRIKRLQNRRKGFLSFLYEDPKEVEKQGRVLLSRREDILKGIENKTARKKNLQATSVAGIFDQPPPEPPKPEGNGTGNPWTGQDLIKEEKQGKQSLNLYQQLRKEIEQTHATSLDRIRFSEKEMLGKIHEVGKSGMASESELQRLKTLNAENHQKQRLELAEKYSPAAALIRQEKEASAELKALYRERLLTEQEYLFASKTLYQTSVKDKLAEQAKQISAPHLDMTGEVDPVVQLQNQLIEQTALYDTYYRNGLLSKERHEQLITAAANRSKDAQFAAAKDLYASQGDFQKMQMDLLDMVEQRTGNSLTGMLTGTKSFSESMRELSASLAQSIIQDLIRIAMQALITKAISGFFGGAMGGMGASALSSAGGGLSSVGSGTTITPDVWKSPIMNAKGGVYQSADLSQYSGQIVSSPTLFKFAKGGGVMGEAGPEAILPLKRGTDGKLGVQATGSTDNQTFNTVHIVIHSDGTHDTKTSRGAESAGQDIAKFVDQRFKFLLHKSLSQGGELSAAIKGGR

SEQ ID NO: 6395 - protein, 30 aa, Xenorhabdus bovienii
  Peptide sequence Name=Xb4151_4152.C423.gene43.pep
MAIHDNATLIEAIQTVKRHAIGTLEEAEKN

SEQ ID NO: 6396 - protein, 117 aa, Xenorhabdus bovienii
  Peptide sequence Name=Xb4151_4152.C423.gene44.pep
MASIRVALSWIAINSSVVGKSALSMGFPLSSTRQSSTIWIFRREASRPFPASLNVSAFSSSSSNSSAVIRRRLIWVPNSATALICGRGVSKAAFSVFIGSLLFWCQRYPRRGCFVCP

SEQ ID NO: 6397 - protein, 153 aa, Xenorhabdus bovienii
  Peptide sequence Name=Xb4151_4152.C423.gene45.pep
  Homolog annotation: Query=3..143bp; Hit=5..145bp; Blast score=205; Percent Identity=71.0; E value=2e-52; Homolog= gi|33770520|ref|NP _892057.1| hypothetical protein PY54p12 [Bacteriophage PY54] gi|33636103|emb|CAD91772.1| hypothetical protei
MATSPEYAVLPAGTLVKFGKPGDSVEQMKPLINCKALGATGLTGSFVDCTTLMDTNKQFISDMPEGPEKSLGFIDDPENSDFVSFLNAAEKRDTVQFYIALPNKRTATMVLALSGWEMNDINAPASEVIQITVKGKQNNLVWGIADTKTGVTQ

SEQ ID NO: 6398 - protein, 185 aa, Xenorhabdus bovienii
  Peptide sequence Name=Xb4151_4152.C423.gene46.pep
  Homolog annotation: Query=58..185bp; Hit=8..135bp; Blast score=135; Percent Identity=53.0; E value=2e-31; Homolog= gi|33770519|ref|NP _892056.1| hypothetical protein PY54p11 [Bacteriophage PY54] gi|33636102|emb|CAD91771.1| hypothetical prote
MGVGATRVYRSLSGTGRDARCTVPKCRRTDGKSQALPYHTGLYHHLHGASDMITAKTTGWTELGHKLQALDSDLQTQILRKTGKVAMEIVKEDMEAHAGYDRKSEGPHMRDAIQIRSTKSKKYKGGVIIKVGPTKSHRIKALAQEMGTIKQVPKPFIRPALDYNKTTVIKVLAQEIRDALSGYSQ

SEQ ID NO: 6399 - protein, 131 aa, Xenorhabdus bovienii
  Peptide sequence Name=Xb4151_4152.C423.gene47.pep
  Homolog annotation: Query=4..128bp; Hit=15..140bp; Blast score=118; Percent Identity=46.0; E value=1e-26; Homolog= gi|33770518|ref|NP _892055.1| hypothetical protein PY54p10 [Bacteriophage PY54] gi|33636101|emb|CAD91770.1| hypothetical prote
MCVMIEPELQSDLTRLTELPVYPLILPSSVLEGVTYQRISDAKFNSGLAATQLIEARFQISLILHDYKKALKLEGKICSAWESVQHGFIGHYPVQVVTRGALYQNAEELTENRKRYRITRDFIITYTEHLT

SEQ ID NO: 6400 - protein, 137 aa, Xenorhabdus bovienii
  Peptide sequence Name=Xb4151_4152.C423.gene48.pep
  Homolog annotation: Query=29..137bp; Hit=5..115bp; Blast score=80; Percent Identity=42.0; E value=5e-15; Homolog= gi|33770517|ref|NP _892054.1| hypothetical protein PY54p09 [Bacteriophage PY54] gi|33636100|emb|CAD91769.1| hypothetical protei
MKIGRHRPYPLDLKRCWNPTVLFRYRRMPMKAGSLRYRIKLFRPVKNRDDLGAEIIGREYVTETWARAEAMSNHKIRTADQQHVIEVQQFTVRPRKDVEPNWLVEHQGRLFTVRAVDRNRTDRAIITTEADVRHDRT

SEQ ID NO: 6401 - protein, 51 aa, Xenorhabdus bovienii
  Peptide sequence Name=Xb4151_4152.C423.gene49.pep
VPEGDPDGLLATDDVTLAIMLAVGYWYENREAQTLPTGFKALLEPYRFIPL

SEQ ID NO: 6402 - protein, 65 aa, Xenorhabdus bovienii
  Peptide sequence Name=Xb4151_4152.C423.gene50.pep
LSNKSSSVWLSLSIRHCCRSSSSVGKGMSSPDNTVTTPYLLLLSAVSRRCCPPAGNQPAWWCRSE

SEQ ID NO: 6403 - protein, 403 aa, Xenorhabdus bovienii
  Peptide sequence Name=Xb4151_4152.C423.gene51.pep
  Homolog annotation: Query=1..399bp; Hit=1..399bp; Blast score=525; Percent Identity=67.0; E value=1e-148; Homolog= gi|23505451|ref|NP _700379.1| Major capsid protein precursor [Salmonella typhimurium phage ST64B] gi|23379198|gb|AAL25885.1| S
MAIEVKDVQQVAQEIQQRFDEFRQKNDQRIEAIEAEKGKLAGQVETLNGRLSELDALKTALEEELAGLKRPAGGSNNKAVNEHKTAFAQFIRKGREDGLAELEQKAMQTTADPEGGYAVPEELDRSIISALKDEVVMRAECHVVSVGNPNFKRLINQGGTNSGWVGETDERPETKTPKLTPIEPTWGEIYGNPAATQTMLDDAFFDVEAFISSELTQEFAEQEENAFTHGDGKNKPKGLLAYGSDAQEDKDRKWGTLQHRLLKKPTTVTADDIMQLIYTLRKPYRTGAKFMMNNNMLFQVRTLKDSQGNYLWQPGLQLGQPSALLGYGIAENEQFADLGAGAVPVAFGNFKRCYTILDRMGVRMLRDPYTHKPFIHFYTTRRVGSLLVDSNAVKLLKVAEDKA

SEQ ID NO: 6404 - protein, 218 aa, Xenorhabdus bovienii
  Peptide sequence Name=Xb4151_4152.C423.gene52.pep
  Gene classification: Function=Phage head maturation protease; Function class=R General function prediction only
  Homolog annotation: Query=23..158bp; Hit=6..134bp; Blast score=87; Percent Identity=40.0; E value=1e-17; Homolog= CC2786 COG3740
MPMMTKQRLDMPLKIKSVSDSGEFEGYGSVFGLKDSTDDIVLPGAFANTLKQWGEKGSLPALLWQHRMDEPIGIYTEMKEDETGLYLKGRLLIEDDPLARRAHAHMKAGSLSGLSIGYVLKDGEYDRTKAAFLLKDLDLWEVSLVTFPANDDARVSNVKSALARGDIPTSDCIERVLRDIGLSRTQAKSFMSAGYSALSLQDAEAANALTALKSLHFN

SEQ ID NO: 6405 - protein, 410 aa, Xenorhabdus bovienii
  Peptide sequence Name=Xb4151_4152.C423.gene53.pep
  Homolog annotation: Query=1..410bp; Hit=1..412bp; Blast score=635; Percent Identity=73.0; E value=0; Homolog= gi|18249902|ref|NP _543090.1| putative portal protein [Bacteriophage P27] gi|18152369|emb|CAC83556.1| putative portal protein [Bact
MFFPGLFRKSADPLTSRELSELIGLSYDTYSGRRVSPQLAMQLTAVFSCVRVLAESVGMLPCLLYEQLERGNRRAVNERLHKLLSVNPNHYMTPQEFWELLIACLCLRGNFYAYKVKALGEVVELLPLDPGSVTAKLNHDWQPEYQITFPNGESRTLMQDELWHVRIFTLDGLTGLSPITYARQAIGLGLATEEHGSRLFGNGAVTSGVLQTDQALKDEAYQRLKMDFEARHQGLVNAHKPMILEMGLKWHQISLSAEDAQFLETRKFQLEEICRIFRVPLHMVQNTDRATFNNIENLGIGFINYSLVPYLTRIEQRINAGLVNSNKQGRFYAKFNTGALLRGDMKSRFEAYATGINWGIYAPNECRELEELNPREGGDIYLTPMNMTTKPEQVPKKEEERHADDDQTTA

SEQ ID NO: 6406 - protein, 58 aa, Xenorhabdus bovienii
  Peptide sequence Name=Xb4151_4152.C423.gene54.pep
MKGLMIAALLIGLAGGVLLSYGAWLLLPAAGFMVSGVLCLGWSYLVSRMLSQTLDKEA

SEQ ID NO: 6407 - protein, 576 aa, Xenorhabdus bovienii
  Peptide sequence Name=Xb4151_4152.C423.gene55.pep
  Homolog annotation: Query=1..576bp; Hit=1..577bp; Blast score=1021; Percent Identity=81.0; E value=0; Homolog= gi|23505447|ref|NP _700375.1| Terminase large subunit [Salmonella typhimurium phage ST64B] gi|23379194|gb|AAL25881.1| Sb2 [Salmone
MSRKSYLNVNTANQYARDVVRGKIDVGRYVREACQRHLDNLHQEKSRQFNYRFDKDLAERAAKFIQLLPHTKGEWAFKRMPITLEPWQLFIVCSVFGWVHKGSRLRRFREVYTEIPRKNGKSAISAGVALYCFTCDNEFGAEVYSGATTEKQAWEVFRPARLMCKRTPLLLEAFGIEVNAANMNRPADGARFEPLIGNPGDGQSPSCAIVDEYHEHDTDDLYTTMLTGMGARRQPLMWAITTAGYNIEGPCYDKRREVIEMLSGNVPNEELFGVIYTVDEGDDWTSPDVLRKANPNMGVSVYADFLLSQQQRALNNPRLASVFKTKHLNIWVSAREAYFNMVNWKQCEDTSLTLEQFAGQPCFLAFDLARKLDMNSMARLFSRETDGKRHFYSIAPRFWVPYDTVYSVEQSENRRSAERFQKWVEMDLLTVTEGAEVDYRYILEEAKLACHLNPVNEAPIDPFGATGLSHALADEGINPIIITQNFTHMSDPMKELEAAIQSGRFHHDGHPIMSWCLGNVVGKTLAGNDDIVRPIKEHKDSKIDGAVALIMAMGRAILHEAPSLSDHLISHGVRSL

SEQ ID NO: 6408 - protein, 164 aa, Xenorhabdus bovienii
  Peptide sequence Name=Xb4151_4152.C423.gene56.pep
  Gene classification: Function=Uncharacterized phage protein; Function class=S Function unknown
  Homolog annotation: Query=55..144bp; Hit=14..103bp; Blast score=63; Percent Identity=35.0; E value=6e-11; Homolog= Z1853 COG3747
MAGTMGKSGRRPKPTARKELAGNPGKRKLNRDEPSFTPLTGVSPPDWFAENEMLLAVVMWELTSKELCAQGLLCVTDLAVLERWCVAYQFWRNAVINIARQGNTVTGATGGPIKNPELTAKKEQQSEMDTTGAMLGLDPSSRQRLIGAAGQAKTDNPFMRMISS

SEQ ID NO: 6409 - protein, 51 aa, Xenorhabdus bovienii
  Peptide sequence Name=Xb4151_4152.C423.gene57.pep
LPGLPASSLRAVGLGRRPDLPIVPAIRSPSRLKNGERSVKSTRFKFHFSRA

SEQ ID NO: 6410 - protein, 44 aa, Xenorhabdus bovienii
  Peptide sequence Name=Xb4151_4152.C423.gene58.pep
VNINFKSNHFEFHSHKRRAGKIPTPLAPKDRPLGAFFMPAKNEI

SEQ ID NO: 6411 - protein, 116 aa, Xenorhabdus bovienii
  Peptide sequence Name=Xb4151_4152.C423.gene59.pep
  Homolog annotation: Query=1..115bp; Hit=1..115bp; Blast score=165; Percent Identity=80.0; E value=2e-40; Homolog= gi|6066821|emb|CAB58450.1| hypothetical protein [Xenorhabdus nematophila]
MPPRIPRACRKSGCPKTTTDRSGYCIDHQHTGWQRYQQGKSRHQRGYGSQWDKLKVRVKQQNNHLCQYCLRQGRVVTGTTVDHIQPKAHGGTDALSNLQLLCEACHRQKTATERLR

SEQ ID NO: 6412 - protein, 103 aa, Xenorhabdus bovienii
  Peptide sequence Name=Xb4151_4152.C423.gene60.pep
  Gene classification: Gene name=CpsB; Function=Mannose-6-phosphate isomerase; Function class=G Carbohydrate transport and metabolism
  Homolog annotation: Query=4..103bp; Hit=7..106bp; Blast score=149; Percent Identity=69.0; E value=4e-37; Homolog= NMA0001 COG0662
MEHIKSKDFKSERAWDSRLISNLDGVTVKLHWTNQPYIWHINEGEEVFAVMDGNVDMHYKEKGQEKIAKLKTGDIFYASIGTEHVAYPIGEARILVIEKEGSI

SEQ ID NO: 6413 - protein, 157 aa, Xenorhabdus bovienii
  Peptide sequence Name=Xb4151_4152.C423.gene61.pep
  Homolog annotation: Query=1..146bp; Hit=26..171bp; Blast score=128; Percent Identity=49.0; E value=4e-29; Homolog= Pa|Phot5-476a02.p1k _g42| 24817 - 25341 2977 174 aa, chain -
MKLNFTKGTVIALMIASAATFLYRSEYKKQLGINNEQITEIQQLTDTIDYQNTHIEMLHGLDSKHTQELANAKIEIDTLRADVAAGRRKLRIQAACPVPETTPSSSVVDATTVELTGETGSAVLDIREGIINDRAKLRYLQEYVSTGYRGNHGKPTP

SEQ ID NO: 6414 - protein, 144 aa, Xenorhabdus bovienii
  Peptide sequence Name=Xb4151_4152.C423.gene62.pep
  Gene classification: Function=Phage-related lysozyme (muraminidase); Function class=R General function prediction only
  Homolog annotation: Query=3..142bp; Hit=42..181bp; Blast score=104; Percent Identity=44.0; E value=3e-23; Homolog= XF1669 COG3772
MEISNKGLECIKQYEGLKLKVYPDPATGGIPWTIGYGHTKGVKKGDVITEQQAEAFLQDDLQPVYTTLRQWVNVPLNQGQFDALCSFIFNCGSGNFSGSTLLKKLNQGDYKGAAAEFSRWNKAAGKAMRGLDNRRASERQMFLS

SEQ ID NO: 6415 - protein, 164 aa, Xenorhabdus bovienii
  Peptide sequence Name=Xb4151_4152.C423.gene63.pep
  Homolog annotation: Query=55..163bp; Hit=4..111bp; Blast score=136; Percent Identity=60.0; E value=1e-31; Homolog= Pa|Phot5-476a02.p1k _g44| 25675 - 26010 1803 111 aa, chain -
LCATVYCIASVYVKCVQCQPTLPPQSLSSHPYTRTGANITHPTDTHCFNRGNMKMKENPDIWVHLGNWFVSIKEQGVRSVLAGTMAFLRGRYNGGGWLKVSIDAFMCAMFAWFIRDVLNLFGLNPDLAYIGSVMIGYLGTDFIGQLLRKAAEKKTGASSDGNQQ

SEQ ID NO: 6416 - protein, 93 aa, Xenorhabdus bovienii
  Peptide sequence Name=Xb4151_4152.C423.gene64.pep
  Gene classification: Gene name=HigB; Function=Plasmid maintenance system killer protein; Function class=N Cell motility and secretion
  Homolog annotation: Query=1..93bp; Hit=13..105bp; Blast score=146; Percent Identity=75.0; E value=3e-36; Homolog= XF0721 COG3549
MIKSFKHKGLEKFFKTGSTAGIQANHAVKLNIQLTALNTAKKPDDMNAPGWKLPPLKGADLKGHWAVSVNGNWRLTFRFEGEDAILVNYQDYH

SEQ ID NO: 6417 - protein, 93 aa, Xenorhabdus bovienii
  Peptide sequence Name=Xb4151_4152.C423.gene65.pep
  Gene classification: Gene name=VapI; Function=Plasmid maintenance system antidote protein; Function class=N Cell motility and secretion
  Homolog annotation: Query=1..86bp; Hit=1..86bp; Blast score=129; Percent Identity=77.0; E value=5e-31; Homolog= XF0720 COG3093
MSRMHNPAHPGIVLREYLGDISVTEAAKALGVTRVALSRILNGSAGISADMALRLEAALGTSAEMWTSMQSQYELWQASQQQRPEIRPIFAHL

SEQ ID NO: 6418 - protein, 43 aa, Xenorhabdus bovienii
  Peptide sequence Name=Xb4151_4152.C423.gene66.pep
MAGFSTTTPRNQADICTSIMMKWFGIAELLQLSSHTDELSRKR

SEQ ID NO: 6419 - protein, 345 aa, Xenorhabdus bovienii
  Peptide sequence Name=Xb4151_4152.C423.gene67.pep
  Gene classification: Function=DNA modification methylase; Function class=L DNA replication, recombination and repair
  Homolog annotation: Query=8..339bp; Hit=12..344bp; Blast score=459; Percent Identity=64.0; E value=1e-129; Homolog= Z2060 COG0863
MDLRPVTLVNDDSLKFIKTLPDNCIDLIATDPPYFRVKACSWDNQWEDVTAYLAWLDELLAEFWRVLKPNGSLYMFCGSRLAADTELLVRERFNVLNQIIWAKPSGPWRRQNKESLRMYFPATERIIFAEHYQGPYHPKGDGYYKQCQDLKQSVFKPLVDYFRGSRKALGVTAKAIHAATGKQMASHWFSDSQWQLPSETDYQKLQGLFDRIAKEKHQRGELNIPYAELVGSHFTLSRQYDELRQEYGLMRRPFSVTAAVPYTDVWQFAPVQYYPGKHPCEKPADLMTHIIQSSSREGDLVADFFMGSGATLKTALKLNRRVLGVELEEERFKQTIQEINGQLST

SEQ ID NO: 6420 - protein, 55 aa, Xenorhabdus bovienii
  Peptide sequence Name=Xb4151_4152.C423.gene68.pep
MQLSGRVLINFRESSLTKVTGRRSIRFFPLDTGDFQENHNTKSRHSPAALSRPGK

SEQ ID NO: 6421 - protein, 80 aa, Xenorhabdus bovienii
  Peptide sequence Name=Xb4151_4152.C423.gene69.pep
  Homolog annotation: Query=15..78bp; Hit=1..64bp; Blast score=87; Percent Identity=71.0; E value=4e-17; Homolog= gi|37527337|ref|NP _930681.1| hypothetical protein [Photorhabdus luminescens subsp. laumondii TTO1] gi|36786771|emb|CAE15837.1| u
MCLCTKTDHEVKFIMLKHEDMTMTAACVLDAVPLHTWFSVSEVSKLMGLPEPRCQLLLTQFRLAGLMESREDDTFFKRSP

SEQ ID NO: 6422 - protein, 31 aa, Xenorhabdus bovienii
  Peptide sequence Name=Xb4151_4152.C423.gene70.pep
MINLTSWSVFVHRHIGNSDPSQQQVLCLFQA

SEQ ID NO: 6423 - protein, 45 aa, Xenorhabdus bovienii
  Peptide sequence Name=Xb4151_4152.C423.gene71.pep
VLTGYLYPCPVGYPASLTSLQSRLRPFVTVFRYAYQNSGDHGPIA

SEQ ID NO: 6424 - protein, 102 aa, Xenorhabdus bovienii
  Peptide sequence Name=Xb4151_4152.C423.gene72.pep
  Homolog annotation: Query=1..102bp; Hit=1..102bp; Blast score=164; Percent Identity=72.0; E value=3e-40; Homolog= gi|16122330|ref|NP _405643.1| putative phage antitermination protein [Yersinia pestis] gi|22126106|ref|NP_669529.1| hypothetica
MRDIQLVMERWGAWVADNRDGVYWSSIAAGFKGLIPNRVKSRVQCCDDDAMVISSCMAKLNQQSSDAHDLLFDYYVFGKTFMQLAHDHHCSDTHIGKRLQKA

SEQ ID NO: 6425 - protein, 453 aa, Xenorhabdus bovienii
  Peptide sequence Name=Xb4151_4152.C423.gene73.pep
  Gene classification: Gene name=DnaB; Function=Replicative DNA helicase; Function class=L DNA replication, recombination and repair
  Homolog annotation: Query=5..423bp; Hit=29..454bp; Blast score=209; Percent Identity=36.0; E value=5e-54; Homolog= VC0371 COG0305
MNVYDLEMAVISGLLSGGATPDAYDVLAILPDEAFSSVHLRRVYGEIKKQALSSTIIDPFFIADAMGEERGILANLLELAKTPVWQANLKGYAEKVMRYWRVRQVTDLINRYQKEIQVCGNHTQAEALIEAFASQFNGLSRSDSSLQPVVIGTLLDRYVETLEARNQGKTGMILTGIEPLDELTGGFNPTDLILLGGRPGMGKTELALCMIDGMTRDGGGALLFSMEMAAQQIAERMVANSAAMPVSKLRNCELYDEDWGRIGNALGSLIERDIHVLDASDLSIEQICAISETHKRRHPNLKGIFVDYLGLIRKPRADRHDLAVAEISKALKGLAKRLHTPVTALSQLSREVDKRPLYQRRPIAADLRDSGSLEQDADRILFTYRDGVYNPLSPASQYAEIILEKNRHGQTGTVYQAFRHGHYLPTDQISAAEVCRMQRQTKQKERRYADRAL

SEQ ID NO: 6426 - protein, 194 aa, Xenorhabdus bovienii
  Peptide sequence Name=Xb4151_4152.C423.gene74.pep
  Gene classification: Gene name=DnaC; Function=DNA replication protein; Function class=L DNA replication, recombination and repair
  Homolog annotation: Query=11..193bp; Hit=62..240bp; Blast score=94; Percent Identity=32.0; E value=5e-20; Homolog= dnaC COG1484
METIDLGILKIVPRFAQASFATYQPQSLRAETNLKTCQGYVQTWEERKRAGEGMILCGRQGTGKTHLAVALCREIATGGDEAVFITTASRIIRAFRRSWNSEGEMSEFDTLKFYSELDLLVIDEIGVQYGTESERNILFEVLNNRYEDLLPTMLISNLPVTELAQFLGDRTLDRVLQGGTVLAFDWESYRREIA

SEQ ID NO: 6427 - protein, 252 aa, Xenorhabdus bovienii
  Peptide sequence Name=Xb4151_4152.C423.gene75.pep
  Homolog annotation: Query=1..252bp; Hit=1..249bp; Blast score=247; Percent Identity=55.0; E value=1e-64; Homolog= gi|37527346|ref|NP _930690.1| hypothetical protein [Photorhabdus luminescens subsp. laumondii TTO1] gi|36786780|emb|CAE15846.1|
MSMSLMAKAMSIRVGNPLRKLVLIKLADNANDKGECWPSYQHIADHCECSKSAVRSHIDALIKMGLLIKENRLGNHNGKGNASNVYYLNLSADPVSPKSIPPVPPAGSSVSSAGTPMPPDDIPPMPSDGTRTSHSFEPVKEPVKEPIKPKGAGQFDPLTAKPENVSAETWADWVTFRQEIRKPLTETSCRQQAKQLAGCTNPDEVICTSIANSWQGLFPDKPRSGRPPQTNTHTGFKHKRYESHGANWTKNL

SEQ ID NO: 6428 - protein, 84 aa, Xenorhabdus bovienii
  Peptide sequence Name=Xb4151_4152.C423.gene76.pep
MKNSVIKKVIDIAGSQAKLAQVLGCAQSLISAWLYGKKRVSVSLVPDIVVLSNGAVQAHELRPDLPTVFPPPEAKAHESIPVGG

SEQ ID NO: 6429 - protein, 59 aa, Xenorhabdus bovienii
  Peptide sequence Name=Xb4151_4152.C423.gene77.pep
VHIPEPEPAWPGCLRYLSLFLSHCFSLVPFSNTTAITISLTVNINHYWSVCKDITLEIE

SEQ ID NO: 6430 - protein, 221 aa, Xenorhabdus bovienii
  Peptide sequence Name=Xb4151_4152.C423.gene78.pep
  Gene classification: Function=Predicted transcriptional regulator; Function class=K Transcription
  Homolog annotation: Query=20..83bp; Hit=11..74bp; Blast score=60; Percent Identity=48.0; E value=1e-09; Homolog= PA0611 COG2932
LGLSPVFHVNAGTTHEALMTLADRLKEAMADKGLTQSALAKKAGMAQSMIWKLLSGNAVKTGRLVDLAKALDVRPEWLSDGSGHKSQSGDTDFAVRHNNRYVPVKIYEAEQETPEFFMVPAFFEQQAPVESCRAYRITQNTGCTEAPEGTVIVVDTQENIANDDLVYARIGEHYSVYRYKQGGAVSYLSVDDTRIPLIPLSSDMEIVGVIVYLFRNMKRKR

SEQ ID NO: 6431 - protein, 30 aa, Xenorhabdus bovienii
  Peptide sequence Name=Xb4151_4152.C423.gene79.pep
MMAEIKVRINPLADYCSDYSYHFDAANIIT

SEQ ID NO: 6432 - protein, 126 aa, Xenorhabdus bovienii
  Peptide sequence Name=Xb4151_4152.C423.gene80.pep
MRTFISAIINKPATKQKKAININGIVANIAQKNSLHTGTTPITFLADQYHQGKNQNHGMGIKNKDEFKHHILTTYRVSPKHTEPVPCYNLEPIVDYGYALYKRRGRYMHLIDIIPLIKADKKHCQL

SEQ ID NO: 6433 - protein, 76 aa, Xenorhabdus bovienii
  Peptide sequence Name=Xb4151_4152.C423.gene81.pep
MFHSKFRTVTHRKRTRKKSVIWKLQIKWLKWSQKKYHLTSLYWEQTKYGAMPISNQNNKRYALLVLPIARSQAREF

SEQ ID NO: 6434 - protein, 59 aa, Xenorhabdus bovienii
  Peptide sequence Name=Xb4151_4152.C423.gene82.pep
  Homolog annotation: Query=1..59bp; Hit=1..59bp; Blast score=68; Percent Identity=64.0; E value=3e-11; Homolog= gi|16123020|ref|NP _406333.1| putative regulatory protein [Yersinia pestis] gi|25510918|pir||AI0343 probable regulatory protein YP
MAIRYIKREEMQRLTGKSKTTLWRMYAKRNEFPKPDKTAGGTFLGWTEEVYEAWVREKK

SEQ ID NO: 6435 - protein, 31 aa, Xenorhabdus bovienii
  Peptide sequence Name=Xb4151_4152.C423.gene83.pep
LTHYLTRYFDGFFIFHCNFLILWYALQDSNL

SEQ ID NO: 6436 - protein, 49 aa, Xenorhabdus bovienii
  Peptide sequence Name=Xb4151_4152.C423.gene84.pep
MPVPDLSQPIHPDNPTHQFTAHNFPNPPNYPLISPIGYLLTADVTPYSC

SEQ ID NO: 6437 - protein, 236 aa, Xenorhabdus bovienii
  Peptide sequence Name=Xb4151_4152.C423.gene85.pep
  Homolog annotation: Query=54..228bp; Hit=249..418bp; Blast score=201; Percent Identity=54.0; E value=7e-51; Homolog= Pa|Phot3-163e06.p1k _g25| 30856 - 32115 701 419 aa, chain -
YQFELGTRFFNSNANSSVSWTDSYTQIAVSLFSDDEFNIIIGGDLGSVPLYYRRRRYGKWDDKIEFITTKNTTFDGSGYLKKASPIIQIYPDGTFTTNDESEGATVTRLGLGHYKLSGILGYNSDGAWGVHGGISVPRDVNGNELVYVDDKVLPDGAIEIKVTHRQNAHMPARLQNRRMKSVDEPAYYTDDEPCDLPAGTRLDVRVQMPEDSIWNQKQVLASDPQQEYGVTSAVNK

SEQ ID NO: 6438 - protein, 161 aa, Xenorhabdus bovienii
  Peptide sequence Name=Xb4151_4152.C424.gene1.pep
MDWGAFLTTGNGVPWWTPKTTPLSFVRKESVWTDRYVKRIETGISTKQPCMAFMCAHTSNVWYAPYGVMFGGGSEWGIEITRGESGTETSILCEIYLFTLVYPQPVPDWGIAVWDEAGKCVITSDTRPLSIEGELSSHSSKETVVQGKKGILMQKTGWILS

SEQ ID NO: 6439 - protein, 111 aa, Xenorhabdus bovienii
  Peptide sequence Name=Xb4151_4152.C424.gene2.pep
MHPNPYITSRSVVSNQPSLNGVVVAIRNDDLIILYQKLTFFIYPVSTKKDIRKPQSFIHRLPGDSERTCRLPALQLHKASIKKGANAGITLPPLFIPDPKPVITHRRNCPI

SEQ ID NO: 6440 - protein, 1045 aa, Xenorhabdus bovienii
  Peptide sequence Name=Xb4151_4152.C424.gene3.pep
  Homolog annotation: Query=1..971bp; Hit=1..958bp; Blast score=755; Percent Identity=41.0; E value=0; Homolog= gi|26248996|ref|NP _755036.1| Putative tail component of prophage [Escherichia coli CFT073] gi|26109403|gb|AAN81606.1|AE016765_8 Pu
MGKGGGGGSTPTLVDDNLKNKQFLRVVDLIGEGQIEGPVGGLHGFRVNGTPVVDKNGNPNINGVTVQWRAGTQSQEPLSDYPFVESEIPVSVEVKKDTPILRMVSNKDVDRVRFTLGVSQLVQTDSKGNQSNSSVQLAIDVNDGSGWQHVKTVQIGPGKISGQYLESHTINAPQKKPFQIRVSRLTDDSKTDQLRNGTVWASYTEITDTLMSYPNSAVVGMRIDRSLFADTPKRTYHIKGMIVQVPDNYDPESRHYSGVWTGRFKPAYTNNPAWIFYDLVTNTRYGIGKLMGSFGCDKFALYAIAQYCDQPVPDGFGGTEPRFTCNAYIATQRKARDVLDDLASVFRGMQVWNGLQLTCFQDRPSDPVWTFTNANVAEGKFNYSAAAKKARHTAIEVTWTNPDNGWKDEREMIQDDELAARLGINIKKVTAFGCTSRGQAHRVGKWIIETEKLETDSVTFSTGREGINCIPGDIVEIADNSFAAARIGGRVLSFSGKEVRLDAPAEFSKGESGYFSYMGSEGKFVRVDIESVSGDMITLKEEPVGLRQWGVFSISKKSLVTRLFRVMSIAEDNKTGNYNYTCIQHEPQKEAIVDNGVDFQGSPATQNVIRIPNIERLSVAYIQDSSQVQARAMWATTTINRNITFDVAVYRDNKVVSRGNTKELEYYFNGLDAGIYMVGVRARDDNGMLGDESKVQMVIGTPAAPSTVNIESGFFELKAIPHISAPKTLDTQFEFWFSENRISNINEIEAKADFLGIAKFWIKGQLKAGTPYWFYVRSINEFGKSHFVEAEGQPNDNAKDILEVVGEQFLSNKAGQHLQSQMDFNSEAIMENAALTGAVVQRQLQVNGNMRAEILEVKTTQVTDREAFAEKMEKVQADVGENAAAVKTKATVVFDIDGNGYALKEIEAGVKYKGQLYKAGMVIGAEVKNGEVHTNIGFNANNFVWFNPASGKMEPFMAAKNGQLFIRQAFIDQALMREAILSDAIRSKNYVQYQAGFLINAATGAFEFNDMRVRAGLRWANGAIACYDPSGRVRAAMGYIGQFRR

SEQ ID NO: 6441 - protein, 197 aa, Xenorhabdus bovienii
  Peptide sequence Name=Xb4151_4152.C424.gene4.pep
  Homolog annotation: Query=1..196bp; Hit=14..211bp; Blast score=148; Percent Identity=42.0; E value=6e-35; Homolog= gi|16764285|ref|NP _459900.1| Fels-1 prophage; putative tail assembly protein [Salmonella typhimurium LT2] gi|16419434|gb|AAL1
MVKLQLGGHLRRFGRRYELEVRDAAEAVRCLCYQLKGFQQAISDGLIRVRIAGRDMTEKSIPAGMNHPLNDGDTITIVPVVGGAGGNGVGMAILGVVAVAAAFYTGGGSLAAWASASGAAATAATGLAIAGVALISAGLASMLTKMPKGPEMGSSKTDGNQYFNSLENRIGQGYPIPIAYGEMVVGSNVISQGLETE

SEQ ID NO: 6442 - protein, 239 aa, Xenorhabdus bovienii
  Peptide sequence Name=Xb4151_4152.C424.gene5.pep
  Gene classification: Gene name=Spr; Function=Cell wall-associated hydrolases (invasion-associated proteins); Function class=M Cell envelope biogenesis, outer membrane
  Homolog annotation: Query=116..238bp; Hit=2..126bp; Blast score=140; Percent Identity=51.0; E value=1e-33; Homolog= Z2143_2 COG0791
MIERDIIAHANAKAEGVRESCGLISGGRYFPCRNISPDPENYFEINPDDWITAECFADIDAIVHSHPNGKTRLSAGDREQQIKTGLPWWLACGDRVHKFRPVPRLLGREFIHGTQDCYSLIRDAYHLAGIELADIPRDDEWWNKGQNLYLDNSLSQGFEQVDDIQSGDIILICLGSQTPCHGAIYLGNQQILHHRPDRISKRDIYDGYWLKYTHSIWRHKQWSSYSLEAILEDLAVATN

SEQ ID NO: 6443 - protein, 227 aa, Xenorhabdus bovienii
  Peptide sequence Name=Xb4151_4152.C424.gene6.pep
  Homolog annotation: Query=6..226bp; Hit=13..230bp; Blast score=225; Percent Identity=49.0; E value=3e-58; Homolog= gi|15830093|ref|NP _308866.1| putative minor tail protein [Escherichia coli O157:H7] gi|25301976|pir||G90733 probable minor ta
MRIAVTELSQNATLNLYEIDLTAFGGDIYRFHDGMNGKLEPVIWQGVRYEAYPVEASGFEMNGKGPSARPKMIFANVDGFITAINQDFNDALGAVVTRHQVPEIYLDAVNFPNGNPQADPTREAVSKYLIEQKQDSNADFVTYVLALPSETDGALIPARVIQADICCWQYRSADCGYDGPPVADEKDQPTTDPLKDRCSKKYSGCICRFPRPLSLPFGGFLGANKLG

SEQ ID NO: 6444 - protein, 111 aa, Xenorhabdus bovienii
  Peptide sequence Name=Xb4151_4152.C424.gene7.pep
  Homolog annotation: Query=1..111bp; Hit=1..110bp; Blast score=78; Percent Identity=37.0; E value=2e-14; Homolog= gi|16764402|ref|NP _460017.1| Gifsy-2 prophage; probable minor tail protein [Salmonella typhimurium LT2] gi|2232363|gb|AAB62387.
MTKTEFKWRPQDNYEVTHEPRVRVVKFGDGYEQRVKDGINNQLKRYQLSFIEKVDTGRAIDGFLRARGAVESFTWLTSDDNQLRTFVCRSWTVNRQQVIWSISCTFEEVVA

SEQ ID NO: 6445 - protein, 112 aa, Xenorhabdus bovienii
  Peptide sequence Name=Xb4151_4152.C424.gene8.pep
  Homolog annotation: Query=16..112bp; Hit=5..99bp; Blast score=89; Percent Identity=55.0; E value=9e-18; Homolog= Pa|Phot5-476a02.p1k _g64| 32563 - 32862 1431 99 aa, chain +
MVASRVRKVRMAKHLENVIPIFKDTPLPENETSHSGGNGGGGEMETRVKKLEEYVHSIKVDLAVIKSNYATKEDIASVRVEVQKAIANQTKWIAATLIATASIAIAVSKLIF

SEQ ID NO: 6446 - protein, 49 aa, Xenorhabdus bovienii
  Peptide sequence Name=Xb4151_4152.C424.gene9.pep
MIGIEIHFMTTILTNAPIFIFGYIIFTFNGYLVNFYRNEIELFICPVSH

SEQ ID NO: 6447 - protein, 73 aa, Xenorhabdus bovienii
  Peptide sequence Name=Xb4151_4152.C424.gene10.pep
LTIITDIEIIDLINNYTTTTTFPHIPITNHLPPVTRYHVLMTVIRFEYFRLIVFTNAISTVRTDWPTIFTSAH

SEQ ID NO: 6448 - protein, 193 aa, Xenorhabdus bovienii
  Peptide sequence Name=Xb4151_4152.C424.gene11.pep
LIHLILAFPLFPLGVSKVFLILLFDSGSGCLGLFFQLGMPLLEICDSCYFSIMFINEVLYWVEFPKGFHGRRYGFIDFALSFLFFGLVLNCFHLLLERFFVDEVLIVHPREVIFFFLPKLCGMGCNIEFRGFNFVIFCLVSQPNSCSKIFRCFYLEFTRTLRHRLSSIIFSHLKAVFFVASVEAFKFFALIFK

SEQ ID NO: 6449 - protein, 96 aa, Xenorhabdus bovienii
  Peptide sequence Name=Xb4151_4152.C424.gene12.pep
MRVQTQEILKSTLIWLLKNKKLMKQPRNEKRPLRRLNQQLRKLKMRLKVVLNRLQTHLKINAKNLNASTLATKKTALRWLNMMLERRCRRVLVNSR

SEQ ID NO: 6450 - protein, 75 aa, Xenorhabdus bovienii
  Peptide sequence Name=Xb4151_4152.C424.gene13.pep
LPFSSGIDAISKSLSAFLIMPSIFLLTSFVSSPTDLIAIPRLLSLTFIKSTTSPYVFPAFSHSLTLLGISFLPCS

SEQ ID NO: 6451 - protein, 60 aa, Xenorhabdus bovienii
  Peptide sequence Name=Xb4151_4152.C424.gene14.pep
LRLFLIISNSLLGKIAIKPVTRVIGYFYRSFFRVFEFIEFLLQFINFLLCVFGVYSHLLD

SEQ ID NO: 6452 - protein, 70 aa, Xenorhabdus bovienii
  Peptide sequence Name=Xb4151_4152.C424.gene15.pep
LNLSSSFCNSSIFCSAFLASIPICLIDLFILSISAATSSTLKSLSFSLTSPKFFAYSLAPSDACLVFSYI

SEQ ID NO: 6453 - protein, 81 aa, Xenorhabdus bovienii
  Peptide sequence Name=Xb4151_4152.C424.gene16.pep
MVIRPNHPPTKANADPSNLKPTDASLAATPTAAVATAATLPVVATSRLTIANLDLAMTRLSVAILSALVPAAALSSASATI

SEQ ID NO: 6454 - protein, 122 aa, Xenorhabdus bovienii
  Peptide sequence Name=Xb4151_4152.C424.gene17.pep
LACDALASAREACVDVCIALTLPASAPLNLATAASATMPIAVANTSRFPLKFTNDLLNMFAAVLTLLDSPTNLVTLLLATTNACSIVEVVLANSLAILSALAFIAATTILEVNLPCAAIAFN

SEQ ID NO: 6455 - protein, 39 aa, Xenorhabdus bovienii
  Peptide sequence Name=Xb4151_4152.C424.gene18.pep
LQRQLFWRLIYLALPLPLIDRYLYQDSQQWLALSLCRSR

SEQ ID NO: 6456 - protein, 180 aa, Xenorhabdus bovienii
  Peptide sequence Name=Xb4151_4152.C424.gene19.pep
MSDISIQGEPRDYYKILIKSDDSECYQANRRTIREIMKVINGATEKYQENGDSDTVIQMHQDYYDAFDVFILNEPDDAKIAMRSVLAEEMKAKECELNIGGGSIPKVIGFLLTFIGLFVCFYACTMNISVGYYDKVINAGLVADRQLYMTAGVGITIIGSLAILFSLLLGKMGKRFIARQ

SEQ ID NO: 6457 - protein, 191 aa, Xenorhabdus bovienii
  Peptide sequence Name=Xb4151_4152.C424.gene20.pep
  Homolog annotation: Query=37..167bp; Hit=30..172bp; Blast score=131; Percent Identity=59.0; E value=7e-30; Homolog= gi|37526068|ref|NP _929412.1| hypothetical protein [Photorhabdus luminescens subsp. laumondii TTO1] gi|36785498|emb|CAE14445.
MNKITVDARLESRNRFKVVKPHENSDDYESQQSKIGGSGGGGGMESRVARLESDVEHIKTTMNDMKSDLKTVTGDVGTMKTDVAVIKQKLDAIDSALSKKPSEDQLDARLTKTENRFDSKLTEVENRFNSKFKEMDNKLDNAISRIESSLEKNALSFDGKLKDARLSLILWILGLPGLLFVIYRLYISFLG

SEQ ID NO: 6458 - protein, 138 aa, Xenorhabdus bovienii
  Peptide sequence Name=Xb4151_4152.C424.gene21.pep
MKGKTMNNERIAFIHPYNPDSDEQPLLVFECEELPFIVDFHFKVFMINLKHDEPYYIQSQLFRVTDSNQTEVCDKKGFWMKTEDTQGKPDDIAASIRLSFLKSMFSYEGTYFVRTGILVNNEEIDGNEAYFKVSLVNE

SEQ ID NO: 6459 - protein, 86 aa, Xenorhabdus bovienii
  Peptide sequence Name=Xb4151_4152.C424.gene22.pep
LSFPSYIRLIVFINNSLNFSDSNCTSSSMFFGFDSSSTAVCKIMTISELRERPFFLALSVSFSFNSSGILMLYGLISLTFFIELSH

SEQ ID NO: 6460 - protein, 89 aa, Xenorhabdus bovienii
  Peptide sequence Name=Xb4151_4152.C424.gene23.pep
MKKYNKEVFEQISKLQWVLDIAQEYEGICLFTEDTLTIDYYDEFCQCSVHLGFDDQFAIRDSFGNWRQTSAEECIELREGKLKGSMKLM

SEQ ID NO: 6461 - protein, 82 aa, Xenorhabdus bovienii
  Peptide sequence Name=Xb4151_4152.C424.gene24.pep
MVNVSSVNKQIPSYSWAISNTHCSFEICSNTSLLYFFIIALLLLFDYLQCYSVKMQVKAKQIYYMMLHALNAILVDRVQVYL

SEQ ID NO: 6462 - protein, 70 aa, Xenorhabdus bovienii
  Peptide sequence Name=Xb4151_4152.C424.gene25.pep
LLYFDIELPLTKSGVRRFETVQKRPRTYSPFGCCIRRPPDFESEIWLINQPLKFRHKKSNTDGVGSDRFC

SEQ ID NO: 6463 - protein, 256 aa, Xenorhabdus bovienii
  Peptide sequence Name=Xb4151_4152.C424.gene26.pep
  Gene classification: Function=Prophage antirepressor; Function class =K Transcription
  Homolog annotation: Query=64..184bp; Hit=73..192bp; Blast score=103; Percent Identity=39.0; E value=2e-22; Homolog= Z1818 COG3617
MITNQLTISSTSIHQDKDGRYSLNDLHQASGGEQKNKPVHWLSTQQAKDLIEEISKVENPTFKSVFIKKGRYGGTYVCKELVYSYAMWISAAFALKVIRAYDDLVNGRISTVESKTTVQQRNPLKNAVNLLVSKKGIMYPEAYSLVHQRFNVEHIDELTADQLPQAIEYVHKMAMEGEYLGKEELPVLRGYSGFSGKLLMELENGEVVYSSALTPNHHVATINDFMEIAQRAGYLLIRKEDMQPMMKALESYKFNA

SEQ ID NO: 6464 - protein, 66 aa, Xenorhabdus bovienii
  Peptide sequence Name=Xb4151_4152.C424.gene27.pep
MMDNTDLKNNQGDQKPKRHPQSLGSEMLRKISRRFPHISQEVSTPRQVQTERIRWPTEGFPPPVRL

SEQ ID NO: 6465 - protein, 213 aa, Xenorhabdus bovienii
  Peptide sequence Name=Xb4151_4152.C424.gene28.pep
  Homolog annotation: Query=1..210bp; Hit=1..210bp; Blast score=379; Percent Identity=87.0; E value=1e-104; Homolog= gi|37527101|ref|NP _930445.1| hypothetical protein [Photorhabdus luminescens subsp. laumondii TTO1] gi|36786534|emb|CAE15592.1
MPQRLVSPEKINEVFAHLNESSDNHTLYASLMGGADITGQIKGLPLSPGYRMVRIDNRLTNKISQSHFELALINDISKEVAYYNRVVIQPDVELNCRPVTQILVWRIRTPQHRAALRDLAGKVFFDYLLERYNVIVSDMNQTNDGMAFWQDRMYDALMYNLHVYAYDMITCELRKILTQDDVSRQEMWLWGDPEHHQNRLAIISKSELPMPKE

SEQ ID NO: 6466 - protein, 66 aa, Xenorhabdus bovienii
  Peptide sequence Name=Xb4151_4152.C424.gene29.pep
VILVYLNLRFNSIGYIAIVSLMIKMCQFLAIRNPKLSMNPCHFIAAYSPVCVCRSSAHWCAYHQHR

SEQ ID NO: 6467 - protein, 228 aa, Xenorhabdus bovienii
  Peptide sequence Name=Xb4151_4152.C424.gene30.pep
  Homolog annotation: Query=3..212bp; Hit=4..221bp; Blast score=147; Percent Identity=39.0; E value=2e-34; Homolog= gi|32034624|ref|ZP _00134771.1| hypothetical protein [Actinobacillus pleuropneumoniae serovar 1 str. 4074]
MTPIFEIGEIVISTDKRDFLLYPSFSSMTRIGTPQQIVGAYTLLNGAETQELINRAVIAYGTLPDWLIKLMRKPIGRKILSTAIMVIQACCDEDADELIGEWRPGRRGLVYRPGRMPVNDIIVVATELITHGVIGKVEIRRLQRHEGTEAYSDQFKAIEYISAARTHFNMTREEAERLTMTEFQMMLKAKFPDEKGFTREEYDAVIDADDKRTNELMSGKRRLVSMQR

SEQ ID NO: 6468 - protein, 250 aa, Xenorhabdus bovienii
  Peptide sequence Name=Xb4151_4152.C424.gene31.pep
  Homolog annotation: Query=29..157bp; Hit=16..141bp; Blast score=79; Percent Identity=33.0; E value=4e-14; Homolog= gi|32034623|ref|ZP _00134770.1| hypothetical protein [Actinobacillus pleuropneumoniae serovar 1 str. 4074]
MANCPVETNKLIGRNAIIRIAHGCPDAVPDQSAFFRIGALTTKSFDLSPNTLTSEADDSKGLVESVVTSMNLTISFDGEYRKRDKKDDFGPLRLLQEIPREVQAGRQPSYWVQMDFTGENAFVLQGYMVFTSWSSKFGANEVATYSGELKISDADTVEWLIEEVAVQSITANPSSLTVAVGKTGSFVVNFNPADATNKNYTVTSDKTSVATVSKIGSVVTVKGVAEGSANVTVTSEDGSKAAKCAVTVTA

SEQ ID NO: 6469 - protein, 59 aa, Xenorhabdus bovienii
  Peptide sequence Name=Xb4151_4152.C424.gene32.pep
LPECCFQSGRYANPHPDTREPIHHPVTIPLYIIIRSRNAAFFISINRGYSHGKLPGRNQ

SEQ ID NO: 6470 - protein, 128 aa, Xenorhabdus bovienii
  Peptide sequence Name=Xb4151_4152.C424.gene33.pep
MSSHIVEYFLRSLDNGLWVVLSTDQYHLHIVIRTEIIQSSCSTRWLKDHVLRFPAIAFLFNPSDHLYRETINQPCRCQIMPELFKYTHSDFNSSMTALSICARTSLNPRFKNSFFAVALRKFCLTLGS

SEQ ID NO: 6471 - protein, 123 aa, Xenorhabdus bovienii
  Peptide sequence Name=Xb4151_4152.C424.gene34.pep
  Homolog annotation: Query=1..119bp; Hit=20..138bp; Blast score=109; Percent Identity=49.0; E value=9e-24; Homolog= gi|32034621|ref|ZP _00134768.1| hypothetical protein [Actinobacillus pleuropneumoniae serovar 1 str. 4074]
MGVKVTGIREAQTRLNALIGDIRGRKVVRAMHKALYIGSAQAALYTPIDTATLINSQFRDVRFQGTRLTGRVGYSANYAVYVHDPKVKQNFRRATAKKEFLKRGFNEVRAQIDKAVMEELKSL

SEQ ID NO: 6472 - protein, 115 aa, Xenorhabdus bovienii
  Peptide sequence Name=Xb4151_4152.C424.gene35.pep
  Homolog annotation: Query=1..114bp; Hit=1..113bp; Blast score=102; Percent Identity=47.0; E value=1e-21; Homolog= gi|32034620|ref|ZP _00134767.1| hypothetical protein [Actinobacillus pleuropneumoniae serovar 1 str. 4074]
MSSVANWAYTAPCTFWKRLENDEYGKPLGYAEPQIILCDYQGGLSSKISGVGAELVAKNTFWTEFADASIGDYILIGESSNLNPIAAGADELKHIVRYADTFERMADDYALVTGV

SEQ ID NO: 6473 - protein, 137 aa, Xenorhabdus bovienii
  Peptide sequence Name=Xb4151_4152.C424.gene36.pep
  Homolog annotation: Query=19..137bp; Hit=4..121bp; Blast score=89; Percent Identity=40.0; E value=8e-18; Homolog= gi|32034619|ref|ZP _00134766.1| hypothetical protein [Actinobacillus pleuropneumoniae serovar 1 str. 4074]
MMQRKLLRKRPERRKKMVITLSDIKPMIAELGFTLPDSVLELLLEQVNVTSECMTAQGYEDNLQKLLLIYAAVRLASLSGARKIASQGSPSGGSRSFNYDSAGTDYLLKQIRIWDKQGCLSGLPLESKSVGFFDVVG

SEQ ID NO: 6474 - protein, 129 aa, Xenorhabdus bovienii
  Peptide sequence Name=Xb4151_4152.C424.gene37.pep
MALVKILVTNLFAGANLQKLEVGHTYEINDSIAVKWIDAGKAEASKDKKGEKLVFEVATPATMNFSEDSELQAELDDANAKMLAMIEAAKAKETELTEVLAAEKKRADDAEKALAEAARKAKKDGDNTE

SEQ ID NO: 6475 - protein, 358 aa, Xenorhabdus bovienii
  Peptide sequence Name=Xb4151_4152.C424.gene38.pep
  Homolog annotation: Query=66..357bp; Hit=58..350bp; Blast score=71; Percent Identity=26.0; E value=2e-11; Homolog= gi|32034617|ref|ZP _00134764.1| hypothetical protein [Actinobacillus pleuropneumoniae serovar 1 str. 4074]
MFYFSTKRATETGNLEANQAQFGELTLARNSSAQAVAAFISRARFRGEDAPRLDAVNAIDDIKRLYRAYDQTVLAEFEPNTEFTLLNDLVGLSRSVRLEESVYEYARTGGTGWAHTSMSGQIGAALDARSYSFDGTMVPIHDTGFKFNWRDPVFNKGSALASLSDAQADSVKVVRRKYLDFIWNGFRDSEGNFIKFDDKTWKGLRADERIAQVTLNVDHTTSTDGQAMRSEVMKVRDVLKLQNYQYGAQTWYVSGDVLSNWEKLYYDVNQTRTVLEEIKKITGIAGIKEDFELKGNEMMIIPLGAGVIAPIVGQAFGTVADPRQFYNSDYVWRTWGAAGLMVKQDINGHFSVIHAKGK

SEQ ID NO: 6476 - protein, 144 aa, Xenorhabdus bovienii
  Peptide sequence Name=Xb4151_4152.C424.gene39.pep
MEMAKDGKHVIHAGGVFTNPMLNREGAAAVDTKPGTIGYFEAGKFKASVDGKESAILYVANIDYLRCQTVDDAITAGSVVICIHPMAGVFLNVRATEGTYKKGQPVTAANGQIAAAGDGVAAFAYVEEDSITAKAGDLVRVVFK

SEQ ID NO: 6477 - protein, 462 aa, Xenorhabdus bovienii
  Peptide sequence Name=Xb4151_4152.C424.gene40.pep
  Homolog annotation: Query=1..456bp; Hit=1..442bp; Blast score=397; Percent Identity=49.0; E value=1e-109; Homolog= gi|32034615|ref|ZP _00134762.1| hypothetical protein [Actinobacillus pleuropneumoniae serovar 1 str. 4074]
MKLSSVHVKSLALNSSNISTETIDGDAHIVIRGVVPVVDDVVMNGGLYPAGEINKSYKSIEGKQMPLGHPSIDGQYVSADVPRAVNQFHVGAWAENVRKDGDRVVMDMKINRRYAESTEKGQVLLQRLDDMIANKGAEPIHISTGLLLQREQNGGKSRGKKYTWIARNMQFDHVAILPPEEPGAATPKEGVGIFVNSDGEKLNVEQVNLSDASNCTKEGVVDKTKFFFTNASNFSFDDIYSALRAKLKVAYPNDDWPYPETVWPDKFIYYRSGKTYQQKYLMNDDGTAELVGESVEVVRKPTEYEIKTNGANNPMKDMIVNALKAKGKSTDGKTEAELLDAYNQMNADEAKDKETLEEKAARAKKEKEAVTNTDAITAAINAAMKPVTDKITTLESQLTANADKEKSDKRAAVKAKFGLDDIAVNALDGAALDGFYAQCQTSAGLNSSFTNNNSESFTSMPE

SEQ ID NO: 6478 - protein, 330 aa, Xenorhabdus bovienii
  Peptide sequence Name=Xb4151_4152.C424.gene41.pep
  Homolog annotation: Query=166..321bp; Hit=3..157bp; Blast score=142; Percent Identity=46.0; E value=1e-32; Homolog= gi|32034614|ref|ZP _00134761.1| COG2369: Uncharacterized protein, homolog of phage Mu protein gp30 [Actinobacillus pleuropneu
MTQTKIGTPIIPRNKRDPTQSYRPVNKMFRDIEQRYYGIKVALKQLFNERLVGRERSVNSLYGYILTQNAVKPDTLYRVNAGTYIYDMTAQQLADLLEIVQIILDDFLLAGGKDQLWAFSYVADEYQRGTLNAYTNLSAQSEIYAQKTTLSALLSTPAYQNQVAAAFISTYSDWKGVSDAARADLSHVIAEAIARGVNPREIAAIISKRLNVSIGTAKNIAQTEQVGALREANWNESEWAKERLGLNTKLLWLSALKPTTRQWHAVRHGKLYTKQEAEEFYSKNGNRYRCYCAQQPVVLDDSGKLYNTGLTKRLTEERQAWQKPEPEQIE

SEQ ID NO: 6479 - protein, 455 aa, Xenorhabdus bovienii
  Peptide sequence Name=Xb4151_4152.C424.gene42.pep
  Homolog annotation: Query=7..432bp; Hit=16..437bp; Blast score=386; Percent Identity=44.0; E value=1e-106; Homolog= gi|32034613|ref|ZP _00134760.1| COG3567: Uncharacterized protein conserved in bacteria [Actinobacillus pleuropneumoniae serov
MLYASGGISGNTKRTNIYSEFGYPEQLRFKEYYNVYERNAVAHAAVHRLLDGCWQDNPTIIDGEEKKESDVTSAWETKVTKLLKPFWAKIKDADRRNMIGNYSALLIQVRDSKNWSEPVDVTVVSRLKVDAVVNLIPVWEPQLTVAEWDQDIHSDTYGQPKMFNFDERPVGQVEMQGPAKQLLIHPSRVITLCEGAESGDIFSGTPLLRAGYNKLLDIEKVSGGSSEGFLKNASRQIGVEFEKETDMNSITTAAIQAGYKDLGAALEDKISKLNRGTDSAAVMQAGRLNVLSVAPGDPTPTWEVTAREFCASVQVPFTVLFGTQTGKLAGDKDDATWKVRLNGRRWGFLTQYVTQLITRLWEIGIIEPPSSGEVTIAWSDMLAASEQEKIDNMIKMAEAALKTQQAFGTPAFTPNEVRTVGEMEPLEEEPEPQGATGDPLTDDPDQNWNPDNTKE

SEQ ID NO: 6480 - protein, 489 aa, Xenorhabdus bovienii
  Peptide sequence Name=Xb4151_4152.C424.gene43.pep
  Homolog annotation: Query=7..472bp; Hit=15..482bp; Blast score=313; Percent Identity=39.0; E value=3e-84; Homolog= gi|18071222|ref|NP _542306.1| unknown [Sinorhizobium meliloti phage PBC5] gi|17940328|gb|AAL49572.1|AF448724_9 unknown [Sinorh
MKPEHLALLRDKLWRLNHLYWITDKEGRPVRFKMTPEQLEYFEGIHTRNIILKARQLGFTTEVCIIQLDAALFESAKCALIAHTLNDAKRLFREKVKYAYDQLPDEIKAANPASNDAAGELVFRKGGSLYVSTSFRGGTLRYLHVSEFGKICAKFPHKAREIVTGAFEAVSTDCFTTIESTAEGRAGYFFDYCQTAEKAQLQGKQLSNLDWKFFFFSWWKNPQYAIDPVEAWPQRLVDYFAELSGKHGIQLNERQKAWYLAKEKTLGDDMKREYPSIPSEAFQQSVEGAYYAKQFRWLYENKRIGKLPDNSHLPVHTFWDIGVGDSTAIWFVREVGEEFHVIDYYENSGEGLRHYMKVLKDKGYIYGDHWGPHDIDNREFGADAKSRRELAREGYEIDGQKYSMIFKVVPKVGVDTGIESVREILSSCVFDEECSEGISHLESYRKEWDDKRGCWKDKPLHDFTSHGADGFRYFAVAKNNRKAVGAFFF

SEQ ID NO: 6481 - protein, 73 aa, Xenorhabdus bovienii
  Peptide sequence Name=Xb4151_4152.C424.gene44.pep
MCLPNSSRFFTLSGHLIFLSNAVVSCEPISTTSIPDRVVRQTLGQSFTGFSSPPSVRMSSTSIWSISTNRFNT

SEQ ID NO: 6482 - protein, 80 aa, Xenorhabdus bovienii
  Peptide sequence Name=Xb4151_4152.C424.gene45.pep
VRLAVLSLYPARMAACVAFKSTRYSRQNISCLSVSAISFSSIKQKTLRRGLNYRALNINLELNYTFQSLGLLEYDIHLYL

SEQ ID NO: 6483 - protein, 76 aa, Xenorhabdus bovienii
  Peptide sequence Name=Xb4151_4152.C424.gene46.pep
MGGSSTYVRFKNGDYSYVVYAGGSKYWDFSGLVVYKGDKIINKKSCKDSESLGLIDIGEYHIQEDPMIEKYSSAPN

SEQ ID NO: 6484 - protein, 349 aa, Xenorhabdus bovienii
  Peptide sequence Name=Xb4151_4152.C424.gene47.pep
  Gene classification: Function=Predicted transposase; Function class=L DNA replication, recombination and repair
  Homolog annotation: Query=183..336bp; Hit=34..184bp; Blast score=70; Percent Identity=29.0; E value=2e-12; Homolog= BH2520 COG3335
MIAPMKINLTDAQKDALELMHDTTRDGRVRDRIKAVLLASEGWTAQMIAQALRIHESTVSRHLKDYFSEEKLAPENGGSESRLSAEQTTELVEYLMANLMHTTAQIVAYVRARWQVTFTVAGMTKWLPRQGFSHKNPMGAPHKFDADTPPQFIETYNALKEECGQNAPILFIDAVHPTLSTKLSYGWMKSGRKHVKVVETTGSRTRLNIMGALNLQRIEETIVREYPTINAKNVVLFFGSIRETYPLSQKIHIILDGAGYHRSGVVQFFAEVLNIELHYLPPYSPNLNPIERLWKYVNEQVRNNVYFPDTKTFRETLRHFFHVTLPEKAKELTTRLTDNFQILKPASSS

SEQ ID NO: 6485 - protein, 76 aa, Xenorhabdus bovienii
  Peptide sequence Name=Xb4151_4152.C424.gene48.pep
MKNQASSMTTGIGQTSPFKMMNMYSFFEGNPTLPEKNPQDILDTHFYIVVVGDFESAYDIDINHKKWWSKVLQYFH

SEQ ID NO: 6486 - protein, 257 aa, Xenorhabdus bovienii
  Peptide sequence Name=Xb4151_4152.C424.gene49.pep
  Homolog annotation: Query=1..136bp; Hit=1060..1196bp; Blast score =115; Percent Identity=47.0; E value=7e-25; Homolog= gi|9634161|ref|NP_037717.1| tail fiber [Bacteriophage HK97] gi|6901590|gb|AAF31093.1|AF069529_6 tail fiber [Bacteriophage
MVIGAQMVNGQVRTDIGFNANNFTFVNPANNKFEPFVAAKNGQLFIRDGFIEDGSITNAKIGNYIQSRNYITGRAGWKIDKGGSAEFNHVIVRGEIHATSGTFTGTIKGADGYFSGAVYATKIVGDVVSVTLGNVSLGNRDSIFFHKRLTESMPFDRVFIYGSIMTQRYVGSLGGSGEASVSVYVNNAHVAGQNFFMESSDSVPQCISGTLFTPPITIPANTTPTIKVVLTTHGTGITYPTTGIGMLFKASSQWSNM

SEQ ID NO: 6487 - protein, 256 aa, Xenorhabdus bovienii
  Peptide sequence Name=Xb4151_4152.C424.gene50.pep
MYLPANNNMVEFCRAAFVNFPPCPTRDIISGLDVIANFGIGNTAIFYKSIPNKQLTIFSCHKGFEFVICGIDEGKIIGIKTNIRSHLTIHHLSTNNHPRSVIISAGIFDTHFNVPCCQCGDFFQVKNRLYGILYRCPALIGRCLDRINLFSQRFCLSHSEVPNLDNFRFHFPVLAHKVLTVAIRGGGINQHSFNVGINLLLQLLACCVGKELITSRINDPVRIRRRLPTSERRPRGLIRTSSSSRGFISAIGLLPI

SEQ ID NO: 6488 - protein, 140 aa, Xenorhabdus bovienii
  Peptide sequence Name=Xb4151_4152.C424.gene51.pep
  Gene classification: Gene name=XerC; Function=Integrase; Function class=L DNA replication, recombination and repair
  Homolog annotation: Query=2..133bp; Hit=18..149bp; Blast score=154; Percent Identity=56.0; E value=2e-38; Homolog= Z0324 COG0582
MMKLTDVAIKRAKPEAKSYTLSDGNGLWLLIEPNGSRGWRFRYRFEGKQKMLSLGTYPEVPLAEARKRTAGCRSMIADGINPSENRKQKKRESVIMSENTFEKITREWYEKRKDRWSAGYRADMMSALKMTSFLILVIGQ

SEQ ID NO: 6489 - protein, 349 aa, Xenorhabdus bovienii; identical to SEQ ID NO: 5796
  Peptide sequence Name=Xb4151_4152.C424.gene52.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 6490 - protein, 153 aa, Xenorhabdus bovienii
  Peptide sequence Name=Xb4151_4152.C424.gene53.pep
  Gene classification: Gene name=UraA; Function=Xanthine/uracil permeases; Function class=F Nucleotide transport and metabolism
  Homolog annotation: Query=1..151bp; Hit=81..231bp; Blast score=182; Percent Identity=74.0; E value=8e-47; Homolog= uraA COG2233
LLLPLGYELALGGFIVCGLLFCLVSLIVKIAGRGWINVIFPPAAMGAIVAVIGLELAGVAADMAGLRVAIGAEVNTANLTISMVTLAVTILGSVMFRGFMAIIPILIGVLAGYALAFFMGAVDFTPVLEAPWFALPTFYTPRFEWFAIMTIRN

SEQ ID NO: 6491 - protein, 231 aa, Xenorhabdus bovienii; identical to SEQ ID NO: 6047
  Peptide sequence Name=Xb4151_4152.C424.gene54.pep
  Gene classification: Function=Putative transposase; Function class=L DNA replication, recombination and repair
  Homolog annotation: Query=3..165bp; Hit=23..185bp; Blast score=231; Percent Identity=70.0; E value=4e-61; Homolog= XF2303 COG3316

SEQ ID NO: 6492 - protein, 56 aa, Xenorhabdus bovienii
  Peptide sequence Name=Xb4151_4152.C424.gene55.pep
MEAFKRVSDQGHHSGLAQKQGSLPDDRLMRQNLIYILYVTLLETKKSRLFSRLNVI

SEQ ID NO: 6493 - protein, 208 aa, Xenorhabdus bovienii
  Peptide sequence Name=Xb4151_4152.C424.gene56.pep
  Gene classification: Gene name=Upp; Function=Uracil phosphoribosyltransferase; Function class=F Nucleotide transport and metabolism
  Homolog annotation: Query=1..208bp; Hit=10..217bp; Blast score=358; Percent Identity=89.0; E value=2e-99; Homolog= upp COG0035
MKIVEVQHPLVKHKLGLMRAHDISTKRFRELASEVGSLLTYEATADLEVEKVTIEGWCGPVEIDQIKGKKITVVPILRAGLGMMDGVLENIPSARISVVGVYRDEETFEPVPYFQKLVSDISERMALVVDPMLATGGSMIATIDLLKKAGCPVIKVLVLVAAPEGVAALAKVHPDVELFTASIDECLNEHGYIVPGLGDAGDKIFGTK

SEQ ID NO: 6494 - protein, 47 aa, Xenorhabdus bovienii
  Peptide sequence Name=Xb4151_4152.C424.gene57.pep
  Homolog annotation: Query=1..34bp; Hit=189..222bp; Blast score=64; Percent Identity=85.0; E value=4e-10; Homolog= gi|1805764|emb|CAA60622.1| IS1327 containing a transposase [Pantoea agglomerans]
MLGFKSFRRAQTLLAGIELIHMIRKGQYQHPQSDGLSPAEQFYLLAA

SEQ ID NO: 6495 - protein, 231 aa, Xenorhabdus bovienii; identical to SEQ ID NO: 6047
  Peptide sequence Name=Xb4151_4152.C424.gene58.pep
  Gene classification: Function=Putative transposase; Function class=L DNA replication, recombination and repair
  Homolog annotation: Query=3..165bp; Hit=23..185bp; Blast score=231; Percent Identity=70.0; E value=4e-61; Homolog= XF2303 COG3316

SEQ ID NO: 6496 - protein, 41 aa, Xenorhabdus bovienii
  Peptide sequence Name=Xb4151_4152.C424.gene59.pep
MLIFRNSLSLQYPLHVAPAYFLQSQPCDHEIYGSVALTAAS

SEQ ID NO: 6497 - protein, 112 aa, Xenorhabdus bovienii
  Peptide sequence Name=Xb4151_4152.C424.gene60.pep
  Gene classification: Gene name=CpsB; Function=Mannose-6-phosphate isomerase; Function class=G Carbohydrate transport and metabolism
  Homolog annotation: Query=5..111bp; Hit=3..110bp; Blast score=99; Percent Identity=41.0; E value=7e-22; Homolog= PA2490 COG0662
MSQMTALRKVKNLKQEFDLIKEVWSPKVITQTNEYKIIILLADGDFIWHTHKDEDKVFMVIEGELRIDFKDDHVIIKQGEFFVVPKGEESKPSSKELTKLLLIEPIVTNSGQ

SEQ ID NO: 6498 - protein, 247 aa, Xenorhabdus bovienii
  Peptide sequence Name=Xb4151_4152.C424.gene61.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=4..247bp; Hit=3..248bp; Blast score=286; Percent Identity=60.0; E value=2e-77; Homolog= ZentA COG1028
MNSFKGKTVWVTGAGSGIGYRTALRFHEAGAKVFGFDLKFPDSMPFETLILDVSDDCAVQKICPPLLKENGLDILVNGAGILRLGSAETLSREDWESSINVNAGAAFNLFKILIPHFQRQRSGNIVSIASNAAHVPRVNMAVYCASKAAMRSLCLSVGLELAPFGIRCNIVSPGSTLTPMLEGMFDDDIAHQRLIHGVTEQFKLGIPLGKIAHPDEIASVILFLASEQASHMTLQDIVIDGGATLGA

SEQ ID NO: 6499 - protein, 294 aa, Xenorhabdus bovienii
  Peptide sequence Name=Xb4151_4152.C424.gene62.pep
  Gene classification: Gene name=EntB; Function=Isochorismate hydrolase; Function class=Q Secondary metabolites biosynthesis, transport and catabolism
  Homolog annotation: Query=1..209bp; Hit=1..209bp; Blast score=286; Percent Identity=64.0; E value=2e-77; Homolog= entB_1 COG1535
MSIPKLQDYTLPDEATLPANKVEWTLEPQRAALLIHDMQEYFLNFWGKESKMVQQVIDNIVILRARCHALGIPVFYTAQPTQQSDVERALLNDMWGPGLNNYPEQQKIVAALSPEQQDNVLVKWRYSAFQRSDLETQLKEHKRDQLMICGVYAHIGCLTTATDAFMRDIQAFMISNALADFSREEHMMALRYTAGCSGQVLSTDMVLSALDSSTAESQWDRERLLTLLQSTLDEDVHDIGDDENLLDYGLDSLRMMSFVSKRRQEGYDLDFTSLMKQPTLRNWLTLLNGDLEAK

SEQ ID NO: 6500 - protein, 115 aa, Xenorhabdus bovienii
  Peptide sequence Name=Xb4151_4152.C424.gene63.pep
LFAQPATEYGWLYSFVFACYHICASFLTHQTVRNSDQCGVYHRWVAQQKMFNLFSRNFFAATIYLIFFTSDDFEVSAGKLNDDVTRAIKPIAVEHGLVMFWAAVIAPKSVWTSGH

SEQ ID NO: 6501 - protein, 53 aa, Xenorhabdus bovienii
  Peptide sequence Name=Xb4151_4152.C424.gene64.pep
VCRHHLVGCSSPDLPPYQIPVGAGTLALLGCVWPVLLPEEHRRPASPPDWRVR

SEQ ID NO: 6502 - protein, 55 aa, Xenorhabdus bovienii
  Peptide sequence Name=Xb4151_4152.C424.gene65.pep
VTDEIGILQPDADSRWHQGNKIDLMMCDSRKTSIWTRIGNEDNLTTRIEYAQSSR

SEQ ID NO: 6503 - protein, 75 aa, Xenorhabdus bovienii
  Peptide sequence Name=Xb4151_4152.C424.gene66.pep
MCSRQCTEISGLTAYVADRITGADAVIVVVVGTWNQLGCASAAAGKLEKCDLICRRWCWREVSRFFRYQACKRMV

SEQ ID NO: 6504 - protein, 94 aa, Xenorhabdus bovienii
  Peptide sequence Name=Xb4151_4152.C424.gene67.pep
VRHLGAVRQKRRYKTQPRCQAEPVQFVPDARRVGAERRLIGLLPHSAPDSSSSAHRKIVLWYRSRGEYQESRSMDDQSSTLSGDRVQPDPEANG

SEQ ID NO: 6505 - protein, 362 aa, Xenorhabdus bovienii
  Peptide sequence Name=Xb4151_4152.C424.gene68.pep
  Gene classification: Gene name=MenF; Function=Isochorismate synthase; Function class=H Coenzyme metabolism
  Homolog annotation: Query=88..353bp; Hit=123..389bp; Blast score=280; Percent Identity=54.0; E value=2e-75; Homolog= entC COG1169
MRVITAKLKNVIVLMQGIVAKRSAPGTKTAIPLFKIRQTIFVVTRNQMALASATSVSDALIDTSSTFTNYLGLSNRNAEVVVHLFHYIPDHDAFCAMVESALSPLRIGELDKVVLSRLLQIESIPPLSALNLWLQLNRQNPESYNFHLPLADGTLIGASPELLLRKEGNVLRSCPLAGSVRRGDNTASDRNAKEKLLVSGKDRHEHRVVTEAIRRQLTDLCQSLTIPEPSLFSTPTLWHLATEIQGILANDRDSALSLACLLHPTPALCGAPYTSSRNLIGALEPFDRGWFGGIVGWCDARGNGEWVVAIRCGKVRPHQIELFAGAGIVPDSVPENEWMETHTKFNTMLNALGFAMQQEQTL

SEQ ID NO: 6506 - protein, 44 aa, Xenorhabdus bovienii
  Peptide sequence Name=Xb4151_4152.C424.gene69.pep
MFKIRKKLVVKIISRCTGFGFQVVLFSIPTLSDEAYAASTGLAS

SEQ ID NO: 6507 - protein, 45 aa, Xenorhabdus bovienii
  Peptide sequence Name=Xb4151_4152.C424.gene70.pep
LPYKNNLITINEFVLLTGGAGNKMFVIKRYELLRKKTLLQYFRCK

SEQ ID NO: 6508 - protein, 73 aa, Xenorhabdus bovienii
  Peptide sequence Name=Xb4151_4152.C424.gene71.pep
  Homolog annotation: Query=16..73bp; Hit=69..126bp; Blast score=101; Percent Identity=82.0; E value=3e-21; Homolog= gi|37526341|ref|NP _929685.1| hypothetical protein [Photorhabdus luminescens subsp. laumondii TTO1] gi|36785772|emb|CAE14822.1
MADFLSINSVYGCSTKRMVKKQQMQWSQQGAHYLLQTRTAVLNNDLKTRFEHWYPGIKLSKETDHYLAEIIAA

SEQ ID NO: 6509 - protein, 111 aa, Xenorhabdus bovienii
  Peptide sequence Name=Xb4151_4152.C424.gene72.pep
LYYSRNPYCAMIGLFFLKSKAVLHVILCQNLGTGATGMTCPSDSLISLYRPTTTQPRLSSGDCSVMLNVRIAGNWLNGWGKVLPMAFNWAMNRGFSSKAIASKFDALCPVL

SEQ ID NO: 6510 - protein, 373 aa, Xenorhabdus bovienii
  Peptide sequence Name=Xb4151_4152.C424.gene73.pep
  Homolog annotation: Query=7..367bp; Hit=6..372bp; Blast score=257; Percent Identity=39.0; E value=2e-67; Homolog= gi|16129419|ref|NP _415977.1| putative receptor [Escherichia coli K12] gi|140581|sp|P28917|YDCC_ECOLI H repeat-associated prote
MSSVSPLLQHFASLEDPRVQRTQLHSLENILTIAICAVICGAEGWVEIEEFGESKQDFFTQLLDLTNGIPSHDTFGRVFAALDAQAFADCFTSWISTLAQGVDQGIIAIDGKTMRRSLDKANGKAAIHLVSAFACTNRLVLGQVKVESKSNEITAIPELLRRLVLSGSLVTIDAMGCQKAIAHQLHEAGADYVLSLKENHPGPYNDVSHYFDYVSSQPERLSEYEDVDAGHGRIERRTVQMTHVDWLPEKACWCGLHSIIRVIRERYVGNEVSRESCYFISTLRPTEAQRAATAIRSHWQIETQLHWCLDIAFNEDQQRMREGNAAANMALLNKIALNLLRLAPTKAGIKARRKRAGWDGEYLLTVLGKAHQI

SEQ ID NO: 6511 - protein, 91 aa, Xenorhabdus bovienii
  Peptide sequence Name=Xb4151_4152.C424.gene74.pep
  Gene classification: Function=Transposase; Function class=L DNA replication, recombination and repair
  Homolog annotation: Query=1..89bp; Hit=1..89bp; Blast score=81; Percent Identity=46.0; E value=1e-16; Homolog= insA_g5 COG3677
MALVEVKCRFCGQTTPVKKHGKGEGGHQRYYCQSCRRTFQLEYTYRACHSGMKEQIVELAMNNAGIRDTARALHVSINAVVRTLKNSRRDV

SEQ ID NO: 6512 - protein, 121 aa, Xenorhabdus bovienii
  Peptide sequence Name=Xb4151_4152.C424.gene75.pep
  Gene classification: Gene name=InsB; Function=Insertion element IS1 protein InsB, putative transposase; Function class=L DNA replication, recombination and repair
  Homolog annotation: Query=4..120bp; Hit=49..166bp; Blast score=109; Percent Identity=49.0; E value=4e-25; Homolog= insB_g4 COG1662
MGSFISNKKRQRWLWYAWEPRLKRIVAHAFGARSKQTLRTLLEKLSAFDVAFWCTDNFGAYDILADEKHITGKLYTQRIERENLNLRNRLKRLNRKMLGYSKSVEMNDKIIGTFIEREFYY

SEQ ID NO: 6513 - protein, 84 aa, Xenorhabdus bovienii
  Peptide sequence Name=Xb4151_4152.C424.gene76.pep
MSPLNLANGTPFLSALMMGLRKLFLIYYSNYYLRIQIQNGCSLMAVLFGLINIVQGSCIQPVDWPSIIELTFDECANDLVIHFN

SEQ ID NO: 6514 - protein, 35 aa, Xenorhabdus bovienii
  Peptide sequence Name=Xb4151_4152.C424.gene77.pep
MMVWGNGFFAKTMIPEHHAVQIPLIKRQQPLIWSI

SEQ ID NO: 6515 - protein, 35 aa, Xenorhabdus bovienii
  Peptide sequence Name=Xb4151_4152.C424.gene78.pep
MTNILNFKLLFCCVLVGVKTISQSFLQGTKIHELC

SEQ ID NO: 6516 - protein, 150 aa, Xenorhabdus bovienii
  Peptide sequence Name=Xb4151_4152.C424.gene79.pep
  Gene classification: Function=Uncharacterized membrane protein; Function class=S Function unknown
  Homolog annotation: Query=5..149bp; Hit=3..147bp; Blast score=140; Percent Identity=72.0; E value=4e-34; Homolog= yeaL COG2707
MSYVDPTLLILLVLAGLGIISHNMTVTLAMLFLLIVRITPLNHFFPWVEKYGLTIGILILTIGVMAPIASGKISAQDIFSSFLNWKSLLAIAVGIIVSWLGSRGVALMSSQPSTVAGLLVGTVLGVALFKGVPVGPLIAAGILSIMIGKP

SEQ ID NO: 6517 - protein, 713 aa, Xenorhabdus bovienii
  Peptide sequence Name=Xb4151_4152.C424.gene80.pep
  Gene classification: Function=Predicted P-loop ATPase fused to an acetyltransferase; Function class=R General function prediction only
  Homolog annotation: Query=11..687bp; Hit=10..655bp; Blast score=568; Percent Identity=48.0; E value=1e-162; Homolog= ypfI COG1444
MTMLDSIWKKLQEQMQQQGQRRLVVLSGDVLWSEQIVNQLKKQFQGDWVTVASGDEGVIEPVKACSLLGREFMHGVFDVTRGFNAEALAILAGTLKTGSWLVMRVPTWSQWPAQPDEDSSRWNESAGVISTPYFIQHIQQQILGFPDILLWQQGKPFQPMQLPQTASWQMPDGNPTASQQAILEQLLRASQGVWVVTAPRGRGKSALAGMLIQQWQGKCWLCAPAKITTEVIRYYSGTSDPEQGSPVDKTPFWAVDNLLKYCRLKNNREGHDIDADWLLIDEAAAIPTPQLAELIRYFPRVLLTTTVQGYEGTGRGFLLKLCATLPDCHVRELETPMRWAENDPLETWLDSTLLFDEKSLSGKPLVYSEPEKNLHFYPITQAMWLRQPELLRQFYGLLTSAHYRTSPLDLRRLLDGNGMTFLAATSRSAVNNQQLIGALWMVSEGGLPQTLAHEVWAGRRRPRGNLVAQSLAAHSGFPQAAMMRSQRVSRIAVRAQYRRRGIAQRLVAQQCQEARTQKQDFLSVSFGYTAELWSLWQTCGFRLVRIGTHLEASSGCYTAMAILPLSEKGKWLAESAQQQLCRDAYWLELLIGFSLPIDHHDDNQLSDNDWQELAGFAFAHRPLSASYFALQRLLLALDLALPALRKYLQQQIDIEQCARDLFLSGRKALLKRCREETAGALASIDEILANQWKNWTISCGVSGNNRPHHPIYH

SEQ ID NO: 6518 - protein, 64 aa, Xenorhabdus bovienii
  Peptide sequence Name=Xb4151_4152.C424.gene81.pep
  Homolog annotation: Query=1..64bp; Hit=15..78bp; Blast score=79; Percent Identity=67.0; E value=2e-14; Homolog= gi|22125323|ref|NP _668746.1| hypothetical [Yersinia pestis KIM] gi|21958201|gb|AAM84997.1|AE013745_9 hypothetical [Yersinia pest
MHWLMDYWWVILLLLIGIIVNAIKELSRVDQKRFLDNKRELPPHRDFNDKWDDEDDCSQKHRKK

SEQ ID NO: 6519 - protein, 224 aa, Xenorhabdus bovienii
  Peptide sequence Name=Xb4151_4152.C424.gene82.pep
  Gene classification: Gene name=VanY; Function=D-alanyl-D-alanine carboxypeptidase; Function class=M Cell envelope biogenesis, outer membrane
  Homolog annotation: Query=1..217bp; Hit=4..226bp; Blast score=226; Percent Identity=52.0; E value=1e-59; Homolog= PM1021 COG1876
MMTPEMLTGLSTDHLVTFAGNHRLQFNATKAFLAMQRDAAKAGFKLQPASSFRDFARQQAIWNEKFRGQRPVLDDNSQPLDITKMTEGEICEAILRWSALPGASRHHWGTELDIYDPFLLPQGQKLLLEPWEYENGGYFEPLSDWLTENMSIYDFYRPFNRHSSGVAYEPWHISFWPLSHEAENLFNEQVLLKAWQDHNIAGIDWLSANLSSLFAKYVKIAEQD

SEQ ID NO: 6520 - protein, 375 aa, Xenorhabdus bovienii
  Peptide sequence Name=Xb4151_4152.C424.gene83.pep
  Gene classification: Gene name=ArgE; Function=Acetylornithine deacetylase/Succinyl-diaminopimelate desuccinylase and related deacylases; Function class=E Amino acid transport and metabolism
  Homolog annotation: Query=1..374bp; Hit=1..374bp; Blast score=591; Percent Identity=72.0; E value=1e-169; Homolog= dapE COG0624
MICPVIELAQQLIKHPSVSPDDQGCQDILIQRLQDTGFTIERMPFGDTLNFWAYHGTGTTFAFAGHTDVVPAGDTSEWQTPPFDPVIRDGMLYGRGAADMKGSLAAMIVAAERFVKDNPDHPGRLAFLITSDEEASATNGTVKVVETLMSRHERLDYCLVGEPSSQQRLGDIIKNGRRGSLTASLTIHGIQGHVAYPQLADNPIHHSLPFLQELVNTQWDNGNEFFPATSMQIANIQAGTGSNNVIPGKLWVQFNFRFSTELTDTEIRQRVEDMLKKHNLKYDIDWWLSGQPFLTCKGELVDAVVESIEQCCGYKPEISMSGGTSDGRFIAKMGAQVVELGPINATIHKVNEGISVSDLQKLSLIYQRIMEQLIK

SEQ ID NO: 6521 - protein, 126 aa, Xenorhabdus bovienii
  Peptide sequence Name=Xb4151_4152.C424.gene84.pep
  Gene classification: Gene name=ArsC; Function=Arsenate reductase and related proteins, glutaredoxin family; Function class=P Inorganic ion transport and metabolism
  Homolog annotation: Query=11..123bp; Hit=3..115bp; Blast score=150; Percent Identity=64.0; E value=2e-37; Homolog= yffB COG1393
MSDTTYHTAFTLYGIKNCDTMKKARRWLEDQEIPYQFHDYRVDGLSSELLQLFIEQVGWEPLLNTRGTTWRKLSDDQKSAINSTDAAKKLMLEQPAIIKRPLLVSETGNYLLGFKAEQYQQFFFHD

SEQ ID NO: 6522 - protein, 36 aa, Xenorhabdus bovienii
  Peptide sequence Name=Xb4151_4152.C424.gene85.pep
MMRSLVWFYTSDIMREIWHFIQITRHLSCTPSTSFL

SEQ ID NO: 6523 - protein, 32 aa, Xenorhabdus bovienii
  Peptide sequence Name=Xb4151_4152.C424.gene86.pep
MYAIYVISLEWITICSAYDQIILSVTLVNHAK

SEQ ID NO: 6524 - protein, 211 aa, Xenorhabdus bovienii
  Peptide sequence Name=Xb4151_4152.C424.gene87.pep
  Gene classification: Gene name=CitB; Function=Response regulator containing a CheY-like receiver domain and an HTH DNA-binding domain; Function class=T Signal transduction mechanisms
  Homolog annotation: Query=6..206bp; Hit=9..212bp; Blast score=194; Percent Identity=49.0; E value=5e-50; Homolog= ZnarP COG2197
MHNHSVMIVDDHPIIRHGLKRLIELERELIVTAETDNGEDAINIACQIKPDIILIDLKIHGLSGIDTIKSLRRKGLDSYVLVLSDSDNRGDIYDAIDAGANGYLLKDIELTPLISKIKKAANGDAVYSEKVYQYLSTRHLYIDPLSKLTKRELDVLKEISEGMTNKEIADFLFISEETVKVHTRNLLKKLKSRSRLEATIIYLRHRKPELV

SEQ ID NO: 6525 - protein, 54 aa, Xenorhabdus bovienii
  Peptide sequence Name=Xb4151_4152.C424.gene88.pep
LRYFYIRIYFQNLIIYDSTYSIKITQQFNIKQSPVFYVLLNIKICISIWEKEHA

SEQ ID NO: 6526 - protein, 46 aa, Xenorhabdus bovienii
  Peptide sequence Name=Xb4151_4152.C424.gene89.pep
MRTLFRKLLAIKETHFLMAVNFISPEWINLFAIFLYQDIFSESHYL

SEQ ID NO: 6527 - protein, 760 aa, Xenorhabdus bovienii
  Peptide sequence Name=Xb4151_4152.C424.gene90.pep
  Gene classification: Gene name=SfcA; Function=Malic enzyme; Function class=C Energy production and conversion
  Homolog annotation: Query=2..435bp; Hit=1..434bp; Blast score=734; Percent Identity=85.0; E value=0; Homolog= maeB_1 COG0281
MMDEKLKQSALDFHEFPQPGKITVTPTKPLATQRDLALAYSPGVAAPCLEIAKDPLAAYKYTARGNLVAVISNGTAVLGLGNIGALAGKPVMEGKGVLFKKFSGIDVFDIEVDESNPDKLIDIIAALEPTFGGINLEDIKAPECFYIEQKLRERMKIPVFHDDQHGTAIICTAAVLNGLRIVNKDIGKVRMVVSGAGAASIACMNLLVALGLKRENITVCDSKGVIYRGREENMEKTKADYAIEDNGCRTLMDVIPDADIFLGCSGPGVLTPEMVKTMAKDPLIMALANPEPEILPPLAKAVRPDAIICTGRSDFPNQVNNVLCFPFIFRGALDVGATTINEEMKLACVHAIADLALAEQSQEVASAYGDQDLFFGSEYIIPKPFDPRLIVKIAPAVAKAAMDSGVATRPIADFGAYIEKLNEFVYKTNLFMKPIFSQAKKEKKRIVLAEGEDIRVLHATQELVSLGLAFPVLIGRPSVIEMRIKKQGMHIEIGKDFEVVNNENDPRFKEYWQEYYQLMKRRGISQEQARRTVIGNPTLIGAIMVHRGEADGLICGTVGSYSEHYQVVKDFFGFRQGVHTAGAMNALMLPMGNTFIADTYVNEDPTPEELAEITLMAAETVRRFGIEPKVALLSRSSFGSSDCVSAQKMRKVLELVQEAAPSLEIDGEMHGDAALVENIRRDIMPDSPLKGSANLLIMPNMEAARISYNLLRVTSSDGVTVGPVLMGVSKPVHILTPIASVRRIVNMVALAAVEAQTDPL

SEQ ID NO: 6528 - protein, 300 aa, Xenorhabdus bovienii
  Peptide sequence Name=Xb4151_4152.C424.gene91.pep
  Gene classification: Gene name=PhuW; Function=Uncharacterized iron -regulated protein; Function class=S Function unknown
  Homolog annotation: Query=13..292bp; Hit=7..280bp; Blast score=207; Percent Identity=40.0; E value=1e-53; Homolog= PA4705 COG3016
MKAPTCIKSTFLACAFLFGGCVTPQHDPQNGSQRALQTLSSELVQSGMLLDMKTGKAITSAELLEQLAVYPRVIVGEKHDNPYHHQIELWLVQQLGQKRPHGSVLLEMINPNQQEKVNKVKSWLQSNPIVREERIKQLLAWQQGWPWELYGELVTELMKAPYPLLAANLDRSEIDQAYKNHSPTDKAAWVSDDVKKLIEETIKNSHGADVEAKHLSAMTMIQQMRDRRMAEQLVNAPSPALLFAGGYHAVKAMGVPQHVKKIVPNEQVAVFVIAEQGVSLNKEYADFVWFTPKVTKAITQ

SEQ ID NO: 6529 - protein, 267 aa, Xenorhabdus bovienii
  Peptide sequence Name=Xb4151_4152.C424.gene92.pep
  Gene classification: Gene name=TonB; Function=Periplasmic protein TonB, links inner and outer membranes; Function class=M Cell envelope biogenesis, outer membrane
  Homolog annotation: Query=19..263bp; Hit=9..239bp; Blast score=68; Percent Identity=25.0; E value=5e-12; Homolog= Cj0181 COG0810
MLTYTTYQTTHVGHVTKSFLAAITLHALLVGWFIYTPENIDIEEFLPPPAVMVELSLQTEAIHKIQNQPIGIEQQLSVASQQQESQVDEVNMPKLDVNENAHVLVHKPKKKQKEQEIPKKTQPVKRVKAKERESEKSRSSVAPTTSSATADNIASRTAASYESNSDAIADAKAIWQAEVSGHLNRYKKYPPDAQRRNRTGRPMVKFTVNQLGTVIDSELIQRSGTNSLDREARLVLERAQPLPLPPDVILTNGRVTVELPIDFYLSQ

SEQ ID NO: 6530 - protein, 726 aa, Xenorhabdus bovienii
  Peptide sequence Name=Xb4151_4152.C424.gene93.pep
  Gene classification: Gene name=PtrB; Function=Protease II; Function class=E Amino acid transport and metabolism
  Homolog annotation: Query=45..714bp; Hit=3..675bp; Blast score=758; Percent Identity=54.0; E value=0; Homolog= ZptrB COG1770
MNGMLQHKTVFSPQTKRVVRSFLLGGSLLCNSFATIAMEKNMVPPMATKQPHKMTFHGDTRVDNYYWLRDDTRQDKDVIDYLTAENTYTEQMLKSGQELRETLYNEMAGRMSKEDQSAPYTYNGYVYRTVYEAGKDFPIYQRKPVDNSTDWQVMVDGNERAKGHKFYRVSGFAVTRDNKRIAVAEDTQGRRNYQVSFKNLDDGEWQNNVIENTSGNIVWANDGSTLFYVRRDPQTLLPYQLFRHQYGTDIQQDKKIYQEDDDRFYLGISESTSLDYILISITSSTTSEYRLIDANNPQSETQIFSARQAGREYDLDHFRGQFYIRSNHEHPLFGLYRADAINKPWKTVIAPQEETDLENFALFNHWLVVQERTKGLSTIRQIDWKTQQEKRVKFDEPAYMASLDYNPEPDTDLLHYSYSSMTTPSSVFQWNMQTGERELLKQQEVKGFDKENYESQRIWVKARDGVEVPVSLVYRKSLFKKGENPILIYGYGSYGISMDPYFSSPLLSLLERGFVYALVHVRGGGELGKNWYLQGKVENKMNSFHDFIDATQTLLADGYGDSQRVYAEGGSAGGLLMGTVINQAPELYRGVIAKVPFVDAVTTMLDPSIPLTTGEYEEWGNPNNKEDYFRIKSYSPYDNVKHQHYPHLLVTTGLHDSQVQYWEPAKWVAKLREIKQGDSLLLLETNMDTGHGGKPGRFNRLNDIAFDYSFLLMLDDTKVYFPQLKD

SEQ ID NO: 6531 - protein, 754 aa, Xenorhabdus bovienii
  Peptide sequence Name=Xb4151_4152.C424.gene94.pep
  Gene classification: Gene name=CirA; Function=Outer membrane receptor proteins, mostly Fe transport; Function class=P Inorganic ion transport and metabolism
  Homolog annotation: Query=37..754bp; Hit=23..755bp; Blast score=406; Percent Identity=35.0; E value=1e-113; Homolog= Cj0178 COG1629
MLMKIVAKIAGASAILIGLQGIAHAENASDNKKEKVMRFSSLKVSGAQDNNSPQVEAMEKPGAYSSVGEDNKLESMDSVLRSLPGTYTQMDASQGTISVNIRGLSGFGRVNMMVDGVSQSFYGTSPSEYGHGAQPYNQFGVLLDPNFIIRTDIDRGQSSDSDSVNALVGSANFRTIGVDDVIFEGSKLGVRTKWAYGNNGIGKSGMMAVAGKIQTFSPEGSLGAMFAVSGHSIDAHYKNAMGVSSNEFGTRDSFKQKPKSQLMKINIKPNDFHDLELSGRFYHNKFNKRNIDSYDYYLKYHYTPFSELIDTRILLSTGNSIQDVQGGALAGLSRSESRNKSDAIDIKNTSRFNYGDTDFAFTLGSKLIRNEYRKRTGIDFGDGKEYVSTEDNNVFSPSGKQNTTSIYSKLKVEHDIYTADLGLNYLDSSLKGIKPACDEILDCFPQGRSLLNIKSRGFNPGILLSAEIIPAFQPFISYAHSMRTPNAQEVFYSNEAGASVNPFLKGEKADTYQIGFNSYRPNLIVERDTFRLKAVYFHTKIKNYIRSESYTLCATGKICKDDGSLEFKDYHERSFNIMVYTNNLTPTNMSGYELSANYDAGIFYSSLAYSQQKTQQPTSRATSEFGASPASQLPERYITLDTGVRLLDEKIRVGAIVKYTGKSYHQDPLMEVDKNNGGHIKMVKDDKIPTIVDLYTDYQVNKNISVKLSVQNLTNRNYADALNRMNSSAFMGDDDAVTQTARGRTYVMGAEVRF

SEQ ID NO: 6532 - protein, 455 aa, Xenorhabdus bovienii
  Peptide sequence Name=Xb4151_4152.C424.gene95.pep
  Gene classification: Gene name=XseA; Function=Exonuclease VII, large subunit; Function class=L DNA replication, recombination and repair
  Homolog annotation: Query=3..453bp; Hit=2..452bp; Blast score=550; Percent Identity=65.0; E value=1e-156; Homolog= xseA COG1570
MSLPTNTGIFSVSRLNQTVRQLLELEMGRIWLSAEISNFSQPSSGHWYFTLKDERAQIRAAMFRSSNLRATFRPQNGQQVLVRAQITLYEPRGDYQLIVESIQPAGDGLLQQQFEILKQKLTSEGLFDSIHKKPLPSPAKRLGVITSASGAALHDILHILKRRDPSLPIIIYPTAVQGAEAPLQIIRAIELANDRQECDVLIVGRGGGSLEDLWCFNDEQVARAIFQSRIPIVSAIGHETDVTIADFIADLRAPTPSAAAELVSRNQIELLRQVQSLQQRLEMAMDYFFAQKLRIFNTLQHQLQQQRPDLRLARQQNKLVELRQKLVDSLLRCLKQHFLSHEKLNLRLLQTNPEQQIRHYSQQIQQYDFRLKQAIERQLGHYREKFAVSCSQLNAVSPLATLQRGYSISETADGTLLKETKQVKVGDTLNTRLQDGWVKSQVIQVKRPTKREKLQ

SEQ ID NO: 6533 - protein, 488 aa, Xenorhabdus bovienii
  Peptide sequence Name=Xb4151_4152.C424.gene96.pep
  Gene classification: Gene name=GuaB; Function=IMP dehydrogenase/GMP reductase; Function class=F Nucleotide transport and metabolism
  Homolog annotation: Query=241..487bp; Hit=1..247bp; Blast score=427; Percent Identity=88.0; E value=1e-119; Homolog= PM0295_3 COG0516
MLRIKKEALTFDDVLLVPAHSTVLPNTADLSTQLTSTIRLNVPMLSAAMDTVTESALAIALAQEGGIGFIHKNMPIERQAEEVRRVKKHESGVVTNPVTVTPQTTLREVHELTKRNGFAGYPVVTEENELVGIITGRDVRFVTDLDQPVTAVMTPKERLVIVKEGEAREVVLQKMHEKRVEKALVVDDSFHLLGMITVKDFQKAERKPNACKDEEGRLRVGAAVGAGAGNEERVDALVAAGVDILLIDSSHGHSEGVLQRIRETRAKYPDLQIIGGNVATGEGAKALFEAGVNAVKVGIGPGSICTTRIVTGVGVPQITAIADAVEALEGTGIPVIADGGIRFSGDIAKAIAAGASCVMVGSMLAGTEESPGEIELYQGRSFKSYRGMGSLGAMSKGSSDRYFQTDNAADKLVPEGIEGRVAYKGLLKSIVHQQMGGLRSCMGLTGCATIDELRTKAEFVRISGAGIQESHVHDVTITKESPNYRLGL

SEQ ID NO: 6534 - protein, 525 aa, Xenorhabdus bovienii
  Peptide sequence Name=Xb4151_4152.C424.gene97.pep
  Gene classification: Gene name=GuaA; Function=GMP synthase - PP -ATPase domain; Function class=F Nucleotide transport and metabolism
  Homolog annotation: Query=207..525bp; Hit=1..319bp; Blast score=583; Percent Identity=87.0; E value=1e-166; Homolog= ZguaA_2 COG0519
MTTNIHQHRILILDFGSQYTQLIARRIREIGVYCELWTWNVTEEQIREFNPSGIILSGGPESTTENNSPCAPEYVFHAGVPVLGICYGMQTMSMQLGGKVGNSTEREFGYAQVEIKDDCELFRGIQDVQSESGKPLLDVWMSHGDKVTAIPEGFITVASTDTCPFAIMANDEKRFYGVQFHPEVTHTHQGLNILQRFVLDICQCEVLWTPASIIDDIVERLRTQIGDDHVILALSGGVDSSVTALLLNRAIGKRLTCVFVDNGLLRLNEADQVMAMFEGKFDLNLVHVKAEERFLSALAGIDEPEAKRKTIGHVFIDVFDEEASKQTQVKWLAQGTIYPDVIESAASATGNAHVIKSHHNVGGLPDDMKLGLVEPLKELFKDEVRRIGLELGLPYDMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEINGISRVVYDISGKPPATIEWE

SEQ ID NO: 6535 - protein, 53 aa, Xenorhabdus bovienii
  Peptide sequence Name=Xb4151_4152.C424.gene98.pep
MISAVSHLRRSSGNDLESSQASPNHHNFLIKTLISGSFYPCISPNHTTSVFNF

SEQ ID NO: 6536 - protein, 54 aa, Xenorhabdus bovienii
  Peptide sequence Name=Xb4151_4152.C424.gene99.pep
LHSVSVHVKPCWNEHQAIQRLMLWKAPVIQGLKLISLLGSQLSVLSGLFMHIRP

SEQ ID NO: 6537 - protein, 46 aa, Xenorhabdus bovienii
  Peptide sequence Name=Xb4151_4152.C424.gene100.pep
MFSCRGWYFLNLKAVFFRLFFNISADLAQYCLLFAFRFSSRETVLE

SEQ ID NO: 6538 - protein, 53 aa, Xenorhabdus bovienii
  Peptide sequence Name=Xb4151_4152.C424.gene101.pep
LKNNRKKTAFKFRKYHPRHENILSEGLSMGWSPENIDYECVWSVRRYSRINIT

SEQ ID NO: 6539 - protein, 134 aa, Xenorhabdus bovienii
  Peptide sequence Name=Xb4151_4152.C424.gene102.pep
  Gene classification: Function=Predicted transposase; Function class=L DNA replication, recombination and repair
  Homolog annotation: Query=6..118bp; Hit=24..138bp; Blast score=72; Percent Identity=33.0; E value=1e-13; Homolog= slr1283 COG3335
MPRKQGYSEKGLRCFGTHDWHAKGRLNVIGAILENTFVTLSLFTGNINADVSYAWMTQDLLPKLPHGAVIVMDNAPFHKRNDTTQAIADSRCQLEWLPAYSPDLNPIEHKWGGAKAIRRQKRCSVDELFTEHIE

SEQ ID NO: 6540 - protein, 107 aa, Xenorhabdus bovienii
  Peptide sequence Name=Xb4151_4152.C424.gene103.pep
MGKSKTFRCLIIGYSLRLETAEYHPEKKRSNTLALILKLVRHLSSTSAMMNRLADPLFIWMKVVLLNRCHVNRGIRKKGYAVLVRMTGTQKAVSTSLAPFSKIPSSP

SEQ ID NO: 6541 - protein, 83 aa, Xenorhabdus bovienii
  Peptide sequence Name=Xb4151_4152.C424.gene104.pep
  Homolog annotation: Query=1..83bp; Hit=1..83bp; Blast score=71; Percent Identity=44.0; E value=3e-12; Homolog= gi|30249526|ref|NP _841596.1| putative transposase [Nitrosomonas europaea ATCC 19718] gi|30138889|emb|CAD85468.1| putative transpo
MGYSLDFRKRVLAYKDKHSLTFEQTSAHFEISMRTLFRWCNKIEPCMTRDKPATKIPDKVLIADVQNFSDDSQWERAKRLGVS

SEQ ID NO: 6542 - protein, 396 aa, Xenorhabdus bovienii
  Peptide sequence Name=Xb4151_4152.C424.gene105.pep
  Homolog annotation: Query=7..367bp; Hit=6..372bp; Blast score=259; Percent Identity=40.0; E value=8e-68; Homolog= gi|16131356|ref|NP _417941.1| putative receptor [Escherichia coli K12] gi|140772|sp|P28912|YHHI_ECOLI H repeat-associated prote
MSSVSPLLQHFASLEDPRVQRTQLHSLENILTIAICAVICGAEGWVEIEEFGESKQDFFTQLLDLTNGIPSHDTFGRVFAALDTQAFADCFTSWISTLAQGVDQDIIAIDGKTMRRSLDKANGKAAIHLVSAFACTNRLVLGQVKVESKSNEITAIPELLRRLVLSGSLVTIDAMGCQKAIAHQLHEAGADYVLSLKENHPGLYNDVSHYFDYVSSQPEHLSEYEDVDAGHGRIERRTVQMTHVDWLPEKACWCGLHSIIRVIRERYVGNEVSRESCYFISTLRPTEAQRAATAIRSYWQIETQLHWCLDIAFNEDQQRMQEGNAAANMALLNKIALNLLRLSPTKAGIKARRKRADWEDKYLLTVLGKAQQIYMRLPWVAPVSGCNRVAHPLCKK

SEQ ID NO: 6543 - protein, 59 aa, Xenorhabdus bovienii
  Peptide sequence Name=Xb4151_4152.C424.gene106.pep
VIFFLREYHWFRPKSGCRDSWLEPQSQPSDCQHQHPYFLHNGCATRLHPETGATQGNRI

SEQ ID NO: 6544 - protein, 349 aa, Xenorhabdus bovienii
  Peptide sequence Name=Xb4151_4152.C424.gene107.pep
  Gene classification: Function=Predicted transposase; Function class=L DNA replication, recombination and repair
  Homolog annotation: Query=183..336bp; Hit=34..184bp; Blast score=70; Percent Identity=29.0; E value=2e-12; Homolog= BH2520 COG3335
MIAPMKINLTGAQKDALELMHDTTRDGRVRDRIKAVLLASEGWTAQMIAQALRIHESTVSRHLKDYFSEEKLAPENGGSESRLSAEQTTELVEYLMANLMHTTAQIVAYVRARWQVTFTVAGMTKWLHRQGFSYKKPMGAPHKFDADKQQQFIETYNALKEECGQNAPILFIDAVHPTLSTKLSYGWMKSGRKHVKVVETTGSRTRLNIMGALNLQRIEETIVREYPTINAKNVVLFFGSIRETYPLSQKIHIILDGAGYHRSGVVQFFAEVLNIELHYLPPYSPNLNPIERLWKYVNEQVRNNVYFPDTKTFRETLRHFFHVTLPEKAKELTTRLTDNFQILKPASSS

SEQ ID NO: 6545 - protein, 300 aa, Xenorhabdus bovienii
  Peptide sequence Name=Xb4151_4152.C424.gene108.pep
  Gene classification: Gene name=PrpB; Function=PEP phosphonomutase and related enzymes; Function class=G Carbohydrate transport and metabolism
  Homolog annotation: Query=39..282bp; Hit=12..254bp; Blast score=118; Percent Identity=31.0; E value=7e-27; Homolog= CC1903 COG2513
MNINILITSIAVEKYSTKNKSPRETNMQTVSLNEKIQIFRQLHEEGRLILANSWDVMSSRLAEQSGAKAIATTSSGISWSLGYPDNQLADRKLVIKALGLITDCTNLPVSADIEDGLLSIDENMDHLVQDLYSVECVGINIEDAQNGKSMSIEDGAERIAAVRTSANKLNYNLFINARIDSWLRGENTEPAHLISRANAYLAAGADCIFIPGLTDLAICQTISTHINGPLNVMAHSGAPSAEEFFAAGVKRISGGSFFAEQAYGITLASMENFVRNGMLQPNDKAKLNYMELNALLDQKV

SEQ ID NO: 6546 - protein, 37 aa, Xenorhabdus bovienii
  Peptide sequence Name=Xb4151_4152.C424.gene109.pep
MTSLKTDYVSKLCEFSRENLFCFYLIEIILILYCFLN

SEQ ID NO: 6547 - protein, 125 aa, Xenorhabdus bovienii
  Peptide sequence Name=Xb4151_4152.C424.gene110.pep
  Gene classification: Function=Predicted Fe-S-cluster oxidoreductase; Function class=R General function prediction only
  Homolog annotation: Query=13..122bp; Hit=2..109bp; Blast score=130; Percent Identity=60.0; E value=3e-31; Homolog= ykgJ COG0727
MASGMSQTLTSQSNLQDNPCISCGACCAYFRVSFYWAEAEDGGGTVPIFMTEKLNAFMSCMKGTNEPNPRCINLRGEIGQSVSCTIYDKRPSPCREFTQAWETDDYNEACDRARAAYGLPPLPKL

SEQ ID NO: 6548 - protein, 46 aa, Xenorhabdus bovienii
  Peptide sequence Name=Xb4151_4152.C424.gene111.pep
LTFNQLVAGSNPARPTMKWAISSVGRASPLQGGGHQFESGIAHHFI

SEQ ID NO: 6549 - protein, 38 aa, Xenorhabdus bovienii
  Peptide sequence Name=Xb4151_4152.C424.gene112.pep
LTFNQLVAGSNPARPTILNIKSKLSNWVVSSVGRAVDF

SEQ ID NO: 6550 - protein, 44 aa, Xenorhabdus bovienii
  Peptide sequence Name=Xb4151_4152.C424.gene113.pep
LKWAISSVGRASPLQGGGHQFESGIAHHFIRLFRSITLIFKMGR

SEQ ID NO: 6551 - protein, 53 aa, Xenorhabdus bovienii
  Peptide sequence Name=Xb4151_4152.C424.gene114.pep
NLVSPTISLVVIKNDFMIGRLAQLVEHLPYKEGVISSNLVSPTNHKSVVLMSL

SEQ ID NO: 6552 - protein, 227 aa, Xenorhabdus bovienii
  Peptide sequence Name=Xb4151_4152.C425.gene1.pep
  Gene classification: Function=Transposase; Function class=L DNA replication, recombination and repair
  Homolog annotation: Query=3..215bp; Hit=90..302bp; Blast score=151; Percent Identity=38.0; E value=7e-37; Homolog= NMA1185 COG3547
SAKTDKIDAQVLAQLALVLSQRTDRDKIVRILPSAQQRVLQAMIARRRQLVVLSISERQRLGNCHPDIRESITLMISFIQEQLKVIESALSKHIKTYHRSKLDLLSTVKGVGPATIATLIADVPELGKLTRREISALIGVAPFNRDSGFFRGKRTIFGGRAMVRRMLYMATLTAIRFNPVLCAFYKRLTEAGKPNKVAIVACMRKLLVILNAMIKTNRPWDESFHTV

SEQ ID NO: 6553 - protein, 47 aa, Xenorhabdus bovienii
  Peptide sequence Name=Xb4151_4152.C425.gene2.pep
LLINRLAKNSLFCDRAHKINTIMILSKLLPIFLFLSHDVTKKNTFYG

SEQ ID NO: 6554 - protein, 80 aa, Xenorhabdus bovienii
  Peptide sequence Name=Xb4151_4152.C425.gene3.pep
VVRYTNHIRYLRILFFNRNHFNFLRCYCRIPFFISLDLTWPLLLLYLLIIAFILFITDQSIYSDNRVPSNYRKTTYCVLN

SEQ ID NO: 6555 - protein, 111 aa, Xenorhabdus bovienii
  Peptide sequence Name=Xb4151_4152.C425.gene4.pep
LPSFYLSRISRYIRTTESLQIIGKQPIASLIRSCIKWLVAVICFRLFKDEVWPKLMSIAVIATNQNRSKDMGKEMADILVIAVIAAVRSFSWRIPIRPANPALKNRLSISR

SEQ ID NO: 6556 - protein, 92 aa, Xenorhabdus bovienii
  Peptide sequence Name=Xb4151_4152.C425.gene5.pep
MSHYSLQAGFPSIPKPALVFLIADKRPLLVDFTDNLDATFRKGKCRYVSESEVFNVFMTVAVATFRIRAVSRIPPLFIAISTICSLTPGLQA

SEQ ID NO: 6557 - protein, 96 aa, Xenorhabdus bovienii; identical to SEQ ID NO: 5468
  Peptide sequence Name=Xb4151_4152.C425.gene6.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 6558 - protein, 180 aa, Xenorhabdus bovienii
  Peptide sequence Name=Xb4151_4152.C425.gene7.pep
  Homolog annotation: Query=3..180bp; Hit=15..191bp; Blast score=164; Percent Identity=45.0; E value=6e-40; Homolog= gi|16123243|ref|NP _406556.1| hypothetical protein [Yersinia pestis] gi|22125313|ref|NP _668736.1| hypothetical [Yersinia pesti
MSSRSDVIKGRLVYTEKLGWVDTGHSKGNDARMLMAAINSGDDTKEPYFTIKYTQYMGLGLKYGTSKITRWKVRRGLSLHDKKRVALTIMMHTTHLFEAHQDSFPFNWYTDSGYSGEDLVSNLLGFYQAINGVDYLPQLQPISKDDALKRWDYYGAIGKYKNKMFKPLLFPDPQKWSCIK

SEQ ID NO: 6559 - protein, 41 aa, Xenorhabdus bovienii
  Peptide sequence Name=Xb4151_4152.C425.gene8.pep
VRLGFTNLLCNYSIIYYRSLHFNVKQQNCNFVLIQQESSIK

SEQ ID NO: 6560 - protein, 96 aa, Xenorhabdus bovienii; identical to SEQ ID NO: 5468
  Peptide sequence Name=Xb4151_4152.C425.gene9.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 6561 - protein, 92 aa, Xenorhabdus bovienii; identical to SEQ ID NO: 6203
  Peptide sequence Name=Xb4151_4152.C425.gene10.pep

SEQ ID NO: 6562 - protein, 71 aa, Xenorhabdus bovienii
  Peptide sequence Name=Xb4151_4152.C425.gene11.pep
VICFRLFKDEVWPKLMSIAVIATNQNRSKDMGKEMADILVIAVIAAVRSFSWRIPIRPANPALKNRLSISR

SEQ ID NO: 6563 - protein, 75 aa, Xenorhabdus bovienii
  Peptide sequence Name=Xb4151_4152.C425.gene12.pep
  Gene classification: Gene name=XerC; Function=Integrase; Function class=L DNA replication, recombination and repair
  Homolog annotation: Query=1..75bp; Hit=341..415bp; Blast score=96; Percent Identity=57.0; E value=5e-21; Homolog= Z1835 COG0582
LHDLRRTFSTKLNELGVAPHVVEQLLGHALPGIMAIYNKSQYLPEKLDALNKWCERLDVLAGNYENVVILKAGQQ

SEQ ID NO: 6564 - protein, 278 aa, Xenorhabdus bovienii
  Peptide sequence Name=Xb4151_4152.C425.gene13.pep
MTEYPEYVDYCLIEWYESEVILDFTIPIPDAKKEELDKVGCFIDSNEWTPTLSEKDVAYKLIFDEKMIFIWSALSNRANECRNPYMFYQSLTDEIISAIKGPSDWDLLTQKQKEEKTEKIKKLSFELNKEISNTPLDVSIMNYASHESYFQRFKRMHNSEKSNNMLDHHLEKYCFYKNSHFLPKYGHEGAIGWAWNSVGVTSPSISSFLQDLNEQANSFKCESILKRKNQIKRTFFVRKISAFFSDNFGTPLHNITATISSVFLDEDITIEEVRSMIR

SEQ ID NO: 6565 - protein, 55 aa, Xenorhabdus bovienii
  Peptide sequence Name=Xb4151_4152.C425.gene14.pep
LVLYPFIYSFLSHWRKSGILMLFYANVLCYLIMDLTSSIVISSSRKTLLIVAVIL

SEQ ID NO: 6566 - protein, 93 aa, Xenorhabdus bovienii
  Peptide sequence Name=Xb4151_4152.C425.gene15.pep
  Homolog annotation: Query=4..93bp; Hit=3..91bp; Blast score=89; Percent Identity=61.0; E value=1e-17; Homolog= Pa|Phot5-451c10.q1k _g200| 153913 - 154188 944 91 aa, chain - [Photorhabdus asymbiotica]
MTIRYNTPTPEERRSILSEYGEPYDRLIREKERHHITSISRTSAWKLENEGRFPARKPLGRNSCAWLLSDLLHWVRNPPTVENVNNPYSRKSN

SEQ ID NO: 6567 - protein, 268 aa, Xenorhabdus bovienii
  Peptide sequence Name=Xb4151_4152.C425.gene16.pep
  Gene classification: Function=Phage anti-repressor protein; Function class=K Transcription
  Homolog annotation: Query=35..147bp; Hit=3..114bp; Blast score=104; Percent Identity=43.0; E value=1e-22; Homolog= HI1422 COG3561
MKSKNAALTGQGLAHAENNQEPILVQRKENLKKNYAEMIPLTAGTINGKAAMVTDARNLHKFLGNKELFASWIKQRIDQYGFIENEDYETYLENSKKGRPRTEYRVSSDMAKELSMVERTEEGKEARQYFIDCEKRLRRVAPEEHQAALMNWRKNRVAACEDHKSMTDAMKGYMERTGDTQKGFAYSNESRFINKLVLGIDPVKWAKNKGIKSKEVRDNMTAEQLQLLTYLESRNCAFLDLDAPTEKRKAQLMELAQRWLAQRMEAKQ

SEQ ID NO: 6568 - protein, 364 aa, Xenorhabdus bovienii
  Peptide sequence Name=Xb4151_4152.C425.gene17.pep
  Homolog annotation: Query=1..263bp; Hit=1..330bp; Blast score=107; Percent Identity=35.0; E value=3e-22; Homolog= Pa|Phot5-451c10.q1k _g198| 151997 - 153088 3149 363 aa, chain - [Photorhabdus asymbiotica]
MNSVTLSYPIISGDSLSLRSPTVEVLTLADGYANIFGHPSVKYCANWDLKAHLSGNAHFSDNSLISIQTPDLAFAYNMRISFSDAVNLRSSLSGVQTEKDSTANATLWRKAHFLYKINQSFIRNPILVYDELQQLKRLTSLRGLVRLPDNIGLVSYCSINLPSLRGGVNQVNNVHSVSYCSGDALVLRWRRLISPCNAVTINCAVLSPGSFNDSTLSAISCGTRALIFCDLLLTLSRVITALHICLWVPVYTKIIIKKVLMWVPVCIYTGCQLNVAAFNKNKAPSDCSPSGASDHYVTEINAMAIQQHNQTRLKFTFLIASGTQRLVDIHPVRLITVLADSEGEARLLVGISSLVFVSRQGVAA

SEQ ID NO: 6569 - protein, 82 aa, Xenorhabdus bovienii
  Peptide sequence Name=Xb4151_4152.C425.gene18.pep
MSKPITIHQAAEKAQQLEFINQLIESYPHQIQGSEISVISSLMAKLSGDIAVFLIEVIAGEEAIDNTSNYRDMSTVQGGSHA

SEQ ID NO: 6570 - protein, 73 aa, Xenorhabdus bovienii
  Peptide sequence Name=Xb4151_4152.C425.gene19.pep
LITLPTIEICLPFRGGAMRDPAPHDYYTHQNGETVQVLSVAFNRVTFVRDGYNTPCIMPVSRFTKEYTYAGRA

SEQ ID NO: 6571 - protein, 101 aa, Xenorhabdus bovienii
  Peptide sequence Name=Xb4151_4152.C425.gene20.pep
MSDIYNHLVRNNFSTMSTEEIKDLRKHSDGAHSAVMAAMSAMGELAFWSADNENYADCQARDDLRRIGEALMYLPRIAEALNDTAQHADFEIHHRERFPKW

SEQ ID NO: 6572 - protein, 898 aa, Xenorhabdus bovienii
  Peptide sequence Name=Xb4151_4152.C425.gene21.pep
  Homolog annotation: Query=Organism:..Escherichiabp; Hit=coli..O157bp; Blast score=; Percent Identity=; E value=; Homolog= Pa|Phot5 -451c10.q1k_g195| 149072 - 151501 2582 809 aa, chain -
MVSHIDIRSVKMAAKDHWQGLLAACGVDVPAKGKHGACPICGGTDRFHFMDDHGNGDWHCRQCDEPNHGDGLDLLVRAKGITIIEAAKEVSQALSLPLPEPARKEAPKSGAPLIAERIKKLVAQTTIGQSDYLTNKGLQCPHQKLLKDGSLLLVMQALDGTVTGAQTIKPNGEKRLVSGSQKKGSFIPLSGVTETPDTIIITEGYATALTVSQLHDGVVLAAIDEGNLFAVAGHVRERWPDAKIILAADNDMKSGHKNVGKISAEKAAKSVRGWVTWPPTEDKADWDDYRQCHGIEAAKQAFSQGLHQAGEKASVLKSVVINLDDHREKERDPLIPFIDVRHTGVFYVTPKLDKETGEIIKPEQWLCSPIDVIGTGIDENDEQYLIVRWKAKGSKDPVIKGVASADIGEREGWRMLKAGGVQVTTKSNLRAILADWLIRSHTKEIWSMTAKSGWHKGAYIMPDGSVIGVPQQPVLFNGGSAAANAYTVSGTTDSWREEVARLANNNPFMMLGIATALAAPMIGIVGADGFGVHLYAQSTAGKTTTADIATSLYGKPDEQRLTWYGTALGIANEALAHNDGLLSLDEVGQGANPKHVHTSAYTLFNGKGKIQGAKEGGNRPLASWRTVAISTGEKDIPTFLMEAGIKINAGQLVRLLNIPMERAKTLHGSENGKAHADALKRGCREHHGAAGREWIGYLSSHHEEARQAYIAAQSRWGKLIPESYGEQVQRVSDRFAVLEAALMLGRVITGWKAQDCRDVLQYIFNVWVAEFGTGNKEGEQIVEQAVSFLNAHGMSRYAPLPYDERDLPIRDLAGYREKKGLHDNDPMIFYTLPATFKQEIARGFNVDMFADTLVKSDILKKPASGRSYQGKTPRLKHLGGIQQRAYIMVLVPESDEED

SEQ ID NO: 6573 - protein, 65 aa, Xenorhabdus bovienii
  Peptide sequence Name=Xb4151_4152.C425.gene22.pep
MPPMACQKDNFYPFDVVSKPLFVVSCCLNLKTKIITIHTVNKNETTETTETTDFSPHMRRSVFFV

SEQ ID NO: 6574 - protein, 49 aa, Xenorhabdus bovienii
  Peptide sequence Name=Xb4151_4152.C425.gene23.pep
MLIRVSLLRCLPHQIQDNPVGQLTIMEPLLGLSTRSRQNTRENIDFLTV

SEQ ID NO: 6575 - protein, 259 aa, Xenorhabdus bovienii
  Peptide sequence Name=Xb4151_4152.C425.gene24.pep
  Homolog annotation: Query=1..258bp; Hit=1..269bp; Blast score=214; Percent Identity=44.0; E value=2e-54; Homolog= gi|16764265|ref|NP _459880.1| Fels-1 prophage; putative chaparone [Salmonella typhimurium LT2] gi|16419413|gb|AAL19839.1| putat
MKLESALKHFHPKTPTFSDASTSTAPDRMKGMDTAAALGMAGSQAKFGMAAFFAKNEVSEEDRFSTVEELTRYARRTVPKLISKAAGNKLGPCLVILSKMAFEDYARSAASTCQCSECRGKGLIYGIKEVEKHPGIIRADGEVIMAPWIEKEQVGELCQKCNGKGTLSSRCRCKGRGVVVDEEKTALQGVPVDKICPRCSGRGYSRVPSSVAYTAIKALVPALTQSSWSRNWKPFYEKLVGKCYAEESSAEAMFSKVTK

SEQ ID NO: 6576 - protein, 34 aa, Xenorhabdus bovienii
  Peptide sequence Name=Xb4151_4152.C425.gene25.pep
MSYLTVVENAKADWQCMDYRMYRTPSRGGLCGLG

SEQ ID NO: 6577 - protein, 87 aa, Xenorhabdus bovienii
  Peptide sequence Name=Xb4151_4152.C425.gene26.pep
MYALKLITERNGRSVEESWILGDMYRLEFFPKDVADNVIARVEHSQNGNLINHDIKKTDQAYITTLTGDTVRTVCRGRSGLVAGSIQ

SEQ ID NO: 6578 - protein, 37 aa, Xenorhabdus bovienii
  Peptide sequence Name=Xb4151_4152.C425.gene27.pep
LGARYCLLSNLPPQSLPVPPYLRISYCGRHPINSLVR

SEQ ID NO: 6579 - protein, 51 aa, Xenorhabdus bovienii
  Peptide sequence Name=Xb4151_4152.C425.gene28.pep
MENRIEELERKVVGLEKQLVEKNKSASCIIENDMAILRKCDGRIIFRLGKI

SEQ ID NO: 6580 - protein, 78 aa, Xenorhabdus bovienii
  Peptide sequence Name=Xb4151_4152.C425.gene29.pep
MSYEFEKIKVDEINLEDMTYAVPVLFTILAGMVTNKEPEKLDQLYKLFDKVLENNEDGTSRESIALVGQITKFSLSEK

SEQ ID NO: 6581 - protein, 110 aa, Xenorhabdus bovienii
  Peptide sequence Name=Xb4151_4152.C425.gene30.pep
  Homolog annotation: Query=1..110bp; Hit=1..110bp; Blast score=179; Percent Identity=78.0; E value=1e-44; Homolog= gi|6066815|emb|CAB58444.1| hypothetical protein [Xenorhabdus nematophila]
MGWNMKMKENPDVWAELLNGLQNSWPQISGSVLAIAICYGRLIYDGVERKNRWVEALLCGALSWSVSSGLEMFGVPSSFAPAIGGVIGFIGVEKIREFAIRAINKRLGDK

SEQ ID NO: 6582 - protein, 133 aa, Xenorhabdus bovienii
  Peptide sequence Name=Xb4151_4152.C425.gene31.pep
  Homolog annotation: Query=1..133bp; Hit=1..136bp; Blast score=157; Percent Identity=61.0; E value=2e-38; Homolog= gi|37526797|ref|NP _930141.1| hypothetical protein [Photorhabdus luminescens subsp. laumondii TTO1] gi|36786229|emb|CAE15281.1|
MSRGIRNNNPGNIDHNSANKWQGQLPHDPKIESRFCRFESPEYGIRALMKLLCNYHKKGYQTVAKMIDRWAPTNENNTSAYINGVAKALGVDPHQVISVDKVTLIALAKSIIRHENGKQPYSEATFEKAFNLL

SEQ ID NO: 6583 - protein, 41 aa, Xenorhabdus bovienii
  Peptide sequence Name=Xb4151_4152.C425.gene32.pep
MKGRHLAISLRLYFYKLMIGFSARQYADKKKPRDCEAQDSE

SEQ ID NO: 6584 - protein, 191 aa, Xenorhabdus bovienii
  Peptide sequence Name=Xb4151_4152.C425.gene33.pep
  Homolog annotation: Query=1..189bp; Hit=1..187bp; Blast score=254; Percent Identity=64.0; E value=6e-67; Homolog= gi|20065954|ref|NP _613037.1| Ant protein [Stx2 converting bacteriophage I] gi|10799917|emb|CAC12893.1| putative antirepressor
MHTITVPFYNDELYVVEYNNEPYVPMRPIVEGMGMDWASQYTKLKQRFNTSVVNITMQLPDDKQRRDVVCLALRKLAGWLQTIYPNKVKPEIRDKVIRYQDECDDVLYDYWTKGIAINPRKRSVMEELNEACAEFKRDKQIASVFGTGLNAWKHVSVEHKSKIRGLTEEIAGLALDFVLAEIGKGKTTRTK

SEQ ID NO: 6585 - protein, 159 aa, Xenorhabdus bovienii
  Peptide sequence Name=Xb4151_4152.C425.gene34.pep
  Homolog annotation: Query=1..149bp; Hit=1..149bp; Blast score=114; Percent Identity=43.0; E value=8e-25; Homolog= gi|27550079|gb|AAO18062.1| Orf37 [Photorhabdus luminescens]
MKFNSQYFTVGALVVVSGLLWFFYSEYQQKAQDYSELDTKHQTQLIAINEQQKRIQRLAELDSKHRQELDNAKSEIDTLRADVAAGRRKLRIKAICPVSETVASGSVGDATTVELSGETGSTVLDIRESIISDRAKLRYLQEYVNTECRGNDGNIQTSH

SEQ ID NO: 6586 - protein, 75 aa, Xenorhabdus bovienii
  Peptide sequence Name=Xb4151_4152.C425.gene35.pep
MMAIFKHLTKDEIKRDYDHYGLFMGLIPVYVGDVHGECRLAVRNWLPDWLFDVADFICSLCPGDYYVIKLTGIIK

SEQ ID NO: 6587 - protein, 72 aa, Xenorhabdus bovienii
  Peptide sequence Name=Xb4151_4152.C425.gene36.pep
MLIPSVRGQITMNGLSKGEYKTNRKMHNQIFKYRQLKFYQYSKVAAGDITTLNIYVCKWFIVLIAIPNRHVM

SEQ ID NO: 6588 - protein, 71 aa, Xenorhabdus bovienii
  Peptide sequence Name=Xb4151_4152.C425.gene37.pep
MKKYLLLCLVAGTTLLASMQTYASICSMHPSNTQDWRNCISWCMAVNPDVPGSYMTCLFGMAINTMNHLHT

SEQ ID NO: 6589 - protein, 33 aa, Xenorhabdus bovienii
  Peptide sequence Name=Xb4151_4152.C425.gene38.pep
MPPALTDGVGDSFNHSREWVKEYFVEFQALTNC

SEQ ID NO: 6590 - protein, 35 aa, Xenorhabdus bovienii
  Peptide sequence Name=Xb4151_4152.C425.gene39.pep
VAFLYQHFTASGYRRLPVLAMTCSLCIERTGQNQK

SEQ ID NO: 6591 - protein, 62 aa, Xenorhabdus bovienii
  Peptide sequence Name=Xb4151_4152.C425.gene40.pep
MPQTVIISNIRCRQKKRCDSRRDGLYCHHDSLSRDRYVEKQSPIIGYWINHTYRGHYDRTEL

SEQ ID NO: 6592 - protein, 121 aa, Xenorhabdus bovienii
  Peptide sequence Name=Xb4151_4152.C425.gene41.pep
  Homolog annotation: Query=1..94bp; Hit=1..96bp; Blast score=86; Percent Identity=48.0; E value=8e-17; Homolog= gi|23505499|ref|NP _700428.1| hypothetical protein [Salmonella typhimurium phage ST64B] gi|23379246|gb|AAL25933.1| Sb55 [Salmonell
MTELNYEAIGRCKVLREKIEALHTRRHQCVYKLRDETSRLTFSDGYRIPEIAEFDRDLMQSQMKDIALVDSDLMHAVHEFNIWCQEAGEPSIKLNPSTKKDLEKLKPLPFDGFPGSALLRR

SEQ ID NO: 6593 - protein, 34 aa, Xenorhabdus bovienii
  Peptide sequence Name=Xb4151_4152.C425.gene42.pep
MLPCLYFVSCSVLQKENATLLTDGLIDNLLCTFM

SEQ ID NO: 6594 - protein, 119 aa, Xenorhabdus bovienii
  Peptide sequence Name=Xb4151_4152.C425.gene43.pep
MTQSTGTATYDITVGIKYDTDTLNQLETQLKRIAEQVDRINGRRYDAGMTLSVDTGAKAGIAADSFKVFDVTGKVYMKEAVIPQAVIKDNDNHLRQIIREEIRQFVTRESERGGLFSKW

SEQ ID NO: 6595 - protein, 139 aa, Xenorhabdus bovienii
  Peptide sequence Name=Xb4151_4152.C425.gene44.pep
  Homolog annotation: Query=24..137bp; Hit=1..114bp; Blast score=183; Percent Identity=85.0; E value=4e-46; Homolog= gi|6066821|emb|CAB58450.1| hypothetical protein [Xenorhabdus nematophila]
VKRYASSSPVRVNEADCSPSGDVMPPRIPRACRKQGCPKTTTDRSGYCNDHLHTGWENHQQGKSRHERGYGSKWDKLRATIKARDKHLCQQCLRHGRAVTGVTVDHVKPKAHGGTDALTNLVLLCWSCHRAKTATERNK

SEQ ID NO: 6596 - protein, 193 aa, Xenorhabdus bovienii
  Peptide sequence Name=Xb4151_4152.C425.gene45.pep
MILPDLPEPQNKEQASIFAKNYATAIKKSHQMKQLKMRRFECEEKDAPKWFVRMVDIEINFILYRIDYLERWDRKPDSHTYATETLRHIRVALDMMCSFLKPERMYFNSISRAEKWLELKDHPVKADTPKQVKLSRLYKGGHFKGYALSVDGMLLSNQQQVVIETHSEGVHPTLNVTFTVTDEMAGEGVDIYI

SEQ ID NO: 6597 - protein, 43 aa, Xenorhabdus bovienii
  Peptide sequence Name=Xb4151_4152.C425.gene46.pep
VPSAWGDDLICPPFQPYSEPPVFKKQGKRDKKDSRFKFHFSRG

SEQ ID NO: 6598 - protein, 164 aa, Xenorhabdus bovienii
  Peptide sequence Name=Xb4151_4152.C425.gene47.pep
  Gene classification: Function=Uncharacterized phage protein; Function class=S Function unknown
  Homolog annotation: Query=55..144bp; Hit=14..103bp; Blast score=65; Percent Identity=37.0; E value=2e-11; Homolog= Z1853 COG3747
MAGTAGRSGRRPKPTARKELAGNPGKRKLNRDEPAFTPLSGVSPPDWFMENEMPLAAVMWELTSKELCTQGLLCVTDLAVLERWCVAYQFWRKAVINIAQQGNTVTGATGGPIKNPELTAKKEQQSEMDTTGSLLGLDPSSRQRLMGAAGKAKTDNPFMRMISS

SEQ ID NO: 6599 - protein, 576 aa, Xenorhabdus bovienii
  Peptide sequence Name=Xb4151_4152.C425.gene48.pep
  Homolog annotation: Query=1..567bp; Hit=1..567bp; Blast score=1008; Percent Identity=81.0; E value=0; Homolog= gi|23505447|ref|NP _700375.1| Terminase large subunit [Salmonella typhimurium phage ST64B] gi|23379194|gb|AAL25881.1| Sb2 [Salmone
MSRKSYPNVNAASQYARDVVRGKIDAGRHVKDACRRHLDNLSQEKTTGFKYRFDKDRAEQAAKFIQLLPHTKGEWAFKRMPITLEPWQLFIICSVFGWVHKGSRLRRFREVYTEIPRKNGKSAISAGVALYCFTCDDEFGAEVYSGATTEKQAWEVFRPARLMCKRTPMLVEAFGIEVNASNLNRPADGARFEPLIGNPGDGQSPSCAIVDEYHEHDTDDLYTTMLTGMGARRQPLMWAITTAGYNIEGPCYDKRREVIEILSGNVPNEELFGVIYTVDDGDDWTSPDVLRKANPNMGVSIYADFLLSQQQRALNNPRLASVFKTKHLNIWVSAREAYFNMLSWKQCEDTTLTLEQFEGQPCFLAFDLARKLDMNSMARLFVREIDGKRHYYSIAPRFWVPYDSVYSVEQTENRRTAERFKKWVEMDLLTVTEGAEVDYRYILEEAKLACHLNPVNEAPIDPFGATGLSHSLADEGINPIIITQNFTHMSDPMKELEAAIQSGRFHHDGHPILSWCISNVVGKTMGGNDDIVRPIKEQKDSKIDGAVALIMAMGRAILHEEPDFLSNLDPDDLLML

SEQ ID NO: 6600 - protein, 88 aa, Xenorhabdus bovienii
  Peptide sequence Name=Xb4151_4152.C425.gene49.pep
MDVSGLTYTSALNRPSCSAASAVSGVFGFSSDSLRNRASSNMFPPAGDGQGIGNQQNAPDDQGVCQPILKVTAGQHCPDTRQRSAINQ

SEQ ID NO: 6601 - protein, 409 aa, Xenorhabdus bovienii
  Peptide sequence Name=Xb4151_4152.C425.gene50.pep
  Homolog annotation: Query=1..409bp; Hit=17..424bp; Blast score=687; Percent Identity=80.0; E value=0; Homolog= gi|19548993|ref|NP _599035.1| portal protein [Shigella flexneri bacteriophage V] gi|19483741|gb|AAL89412.1| portal protein [Shigel
MLLDALFRSESLENPKTPLTAEAAEHDGLFSADVYVSPETSMKLAAVYACIYVLASSVAQMPLHVMRKTGKSVEMAREHPAFYLTHDEPNDWQTSYKWRELKQRHVLGWGNGYTWVKRNRKGDVIALEACMPWETTLLNTGGRYTYGVYNDEGNFAISPDDMIHIRALGNNQKMGLSPILQHAETIGMGMSGQKYTSAFFGGNARPAGIVSVKGEISDKGWERLKLMWRKAAASLRSEENKTMLLPAELDYKALTVSPVDAQLIDMMKLNRSMIAGIFNVPAHMINDLEKATFSNISNQAIQFVRHTVMPWVVNWEQELNRRLFTRQERIAGFYVRFNLAGLLRGTPQERAQFYHFAITDGWMSRNEARAFEDMNPVDGLDEMLVSVNAANPVNGNQPNQPEHEDKPDE

SEQ ID NO: 6602 - protein, 219 aa, Xenorhabdus bovienii
  Peptide sequence Name=Xb4151_4152.C425.gene51.pep
  Gene classification: Function=Phage head maturation protease; Function class=R General function prediction only
  Homolog annotation: Query=44..196bp; Hit=29..180bp; Blast score=90; Percent Identity=36.0; E value=1e-18; Homolog= L112195 COG3740
MPPILLTAINPTNLNTRTNPMSDREMRCYSGEVRAEQLENQPTRIVGYGSVFNSRSEPLWGFREIIKPGAFDEVLNDDIRGLFNHDPNFILGRSTAGTLTVSVDERGLQYDIAAPDTQTIRDLVLAPMQRGDINQSSFAFRVARDGEHWYEDEEGIVIREIHKFSRLYDVSPVTYPAYQEAGSAVRSLNAWKEARSSGICQKAINEKRARERLLTLLNR

SEQ ID NO: 6603 - protein, 407 aa, Xenorhabdus bovienii
  Peptide sequence Name=Xb4151_4152.C425.gene52.pep
  Homolog annotation: Query=1..402bp; Hit=1..405bp; Blast score=548; Percent Identity=69.0; E value=1e-155; Homolog= gi|19548995|ref|NP _599037.1| capsid [Shigella flexneri bacteriophage V] gi|19483743|gb|AAL89414.1| capsid [Shigella flexneri
MKLHELKQKRNTIAAQMRTLHDKIGDNAWTDEQRTEWNKAKTELDSIDAQIQREEELRHLDQQLVDNTEPEQRQQPGNPETEQAERRAAAFDRFLRHGLGEMSSEERQALKELRAQGTTPDEKGGYTVPTRMLNKVVEAMKAYGGIASVAQILSTSTGQTIEWATADGTAEEGELLGENTAASEEDTLFGTESLGAKKLSSKIIRVSNELLLDSGIDMEAYLAARIAQRIGRGEAKYLVKGTGTGSPQQPKGLETSVTGTVDAATKFSWKDMNSLKHALDPAYRNTGTFRWAFNDSTLKVITEMEDAQNRPLWLPEIAGVVPSTVLGVPYVIDQAIADMGAGNKFIYCGDFNRFIVRRVTYMTLRRLVERYADYDQTAFLAFHRFDCILEDTAAIKALVGKGGSNAA

SEQ ID NO: 6604 - protein, 346 aa, Xenorhabdus bovienii; identical to SEQ ID NO: 6355
  Peptide sequence Name=Xb4151_4152.C425.gene53.pep
  Gene classification: Function=Transposase; Function class=L DNA replication, recombination and repair
  Homolog annotation: Query=15..344bp; Hit=2..335bp; Blast score=241; Percent Identity=43.0; E value=7e-64; Homolog= PA2319 COG3547

SEQ ID NO: 6605 - protein, 68 aa, Xenorhabdus bovienii; identical to SEQ ID NO: 6354
  Peptide sequence Name=Xb4151_4152.C425.gene54.pep

SEQ ID NO: 6606 - protein, 38 aa, Xenorhabdus bovienii
  Peptide sequence Name=Xb4151_4152.C425.gene55.pep
MLACLNLSGVTMGRDARASMSSAPDKPKNLWSPPFLQH

SEQ ID NO: 6607 - protein, 38 aa, Xenorhabdus bovienii; identical to SEQ ID NO: 6606
  Peptide sequence Name=Xb4151_4152.C425.gene56.pep

SEQ ID NO: 6608 - protein, 114 aa, Xenorhabdus bovienii
  Peptide sequence Name=Xb4151_4152.C425.gene57.pep
  Gene classification: Function=Predicted transposase; Function class=L DNA replication, recombination and repair
  Homolog annotation: Query=1..106bp; Hit=139..230bp; Blast score=59; Percent Identity=38.0; E value=7e-10; Homolog= mll8100 COG3293
VTAGQAHESQSAIPLLDGIGVQRKNGFMKRRGKAVLADKGYSGGKLRGYLRKLRIKSIIPYKINEKGSTDGRTQFDKQAYRDRNVVERCFGFLKGNRRIATRYENLWSPPFLQH

SEQ ID NO: 6609 - protein, 151 aa, Xenorhabdus bovienii
  Peptide sequence Name=Xb4151_4152.C425.gene58.pep
  Gene classification: Function=Predicted transposase; Function class=L DNA replication, recombination and repair
  Homolog annotation: Query=2..127bp; Hit=1..117bp; Blast score=105; Percent Identity=45.0; E value=2e-23; Homolog= mll8100 COG3293
MMARYDIPDEAWILIESCLPLVHSERAGRPYVEHRRVMNGMFWVLCSGAPWRDLPERYGPWKTVYNRFNRWSKSGIINKIFNRLLSILDEKGLIDWAEICLDGSNIRASKDAAGAKKNIPISLTIMRWVAHAVVMAPKSTWQPTERDFPST

SEQ ID NO: 6610 - protein, 45 aa, Xenorhabdus bovienii
  Peptide sequence Name=Xb4151_4152.C425.gene59.pep
MIILPIYIKGHGLVLLLILIFLATLGITLQKRMHVCVLLIPNMGL

SEQ ID NO: 6611 - protein, 76 aa, Xenorhabdus bovienii
  Peptide sequence Name=Xb4151_4152.C425.gene60.pep
MFDDGIINSVRMSPQIEPLLYDDAIKIVLDLQDQWHKAGWVLTKAQERPALANTPELRAQLRSMKGGGWNNFLASR

SEQ ID NO: 6612 - protein, 46 aa, Xenorhabdus bovienii
  Peptide sequence Name=Xb4151_4152.C425.gene61.pep
MDSSMIKLPRRRPKRRNRFNLHLHLKQLLVSIFRPNSVYYHCMITH

SEQ ID NO: 6613 - protein, 211 aa, Xenorhabdus bovienii
  Peptide sequence Name=Xb4151_4152.C425.gene62.pep
LNLLRRLGLRRGSLIILLSIVFGLTIIYLYHAFYSRDPEIALVIGEPYEAMRQRSSAKISPPYDNSIGFRIPKTDARLRFTDPKYGFITPPARFFTVSYNKGIIENVRMSPQIEPLLYDDAIKIVLDLQDQWRKAGWTLTLARESPALANTPELRAKLRSLIGSEVTYWQAGEQYQIMLIMARFKDDRHPDEERYLITLAIAEPWVKNYSD

SEQ ID NO: 6614 - protein, 33 aa, Xenorhabdus bovienii
  Peptide sequence Name=Xb4151_4152.C425.gene63.pep
VGKELFRLTRFACLLRLTGLIHYPGQSERCATF

SEQ ID NO: 6615 - protein, 206 aa, Xenorhabdus bovienii
  Peptide sequence Name=Xb4151_4152.C425.gene64.pep
MNLLQRIDIRRGSLIIVLPIVLGLTIIYLYNAFYSRFPEIALVIGEPYDEMRQRSSAAIDPHIPGHAWYNIPKTDARLRFADPKYGFVTPPARFFTVMFDDGIINSVRMSPQIEPLLYDDAIKIVLDLQDQWRKTGWMLTKGYQPLANTSELRAQLRSLRGFEATYWQVGDQYQIKLDIGRFKDDRHPNEERYLITLAIAKPWANQ

SEQ ID NO: 6616 - protein, 127 aa, Xenorhabdus bovienii
  Peptide sequence Name=Xb4151_4152.C425.gene65.pep
MRRCGSAPVLKLAHPMIIASGSESQKRMHAYALSIRNTDLLPPLHDFWSCIKWLVAVICFRLFKDEVWPKLMSIAVIATNQNRSKDMGKEMADILVIAVIAAVRSFSWRIPIRPANPALKNRLSISR

SEQ ID NO: 6617 - protein, 92 aa, Xenorhabdus bovienii; identical to SEQ ID NO: 6203
  Peptide sequence Name=Xb4151_4152.C425.gene66.pep

SEQ ID NO: 6618 - protein, 96 aa, Xenorhabdus bovienii; identical to SEQ ID NO: 5468
  Peptide sequence Name=Xb4151_4152.C425.gene67.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 6619 - protein, 116 aa, Xenorhabdus bovienii
  Peptide sequence Name=Xb4151_4152.C425.gene68.pep
MTRFFTVSYNKGIIENVRMSPQIEPLLYDDAIKIVLDLQDQWRKTGWVLTREYQPLVNTPELHDSLRRMKGTGMTFWQAGDLYQAMLNMARFKDDRHPSEERYLITLQIAEPWVKP

SEQ ID NO: 6620 - protein, 205 aa, Xenorhabdus bovienii
  Peptide sequence Name=Xb4151_4152.C425.gene69.pep
MSLLQRIGRRRSGLIFALLIVLGLASVYLYHSFSDKPEIALVIGEPYEAMWQRSSADIAPKYPNNIGFNTPKTDARLRFTDPKYGFVTPPARFFVVRYTDGIINSVRMSPQIEPLLYNDAIKIVLDLQDQWRKTGWKLTKGYHSLVNTPELHDSLRKMKGTGMTFWQAGDKYQIMLNIARFKDDRHPDEERYLITLAIATPWVNQ

SEQ ID NO: 6621 - protein, 35 aa, Xenorhabdus bovienii
  Peptide sequence Name=Xb4151_4152.C425.gene70.pep
MFLRFSELPGEFISPVTRRRQVQRVSIVLNSECEK

SEQ ID NO: 6622 - protein, 38 aa, Xenorhabdus bovienii
  Peptide sequence Name=Xb4151_4152.C425.gene71.pep
MKYIINMLFTPLSRENMCSGIEITNRNDYVSSILRVTG

SEQ ID NO: 6623 - protein, 44 aa, Xenorhabdus bovienii
  Peptide sequence Name=Xb4151_4152.C425.gene72.pep
VCHYFKFKILIPTREKFFFGITSIVIIFIFVITLRYGIYWDNTG

SEQ ID NO: 6624 - protein, 925 aa, Xenorhabdus bovienii
  Peptide sequence Name=Xb4151_4152.C425.gene73.pep
  Homolog annotation: Query=Organism:..Escherichiabp; Hit=coli..O157bp; Blast score=; Percent Identity=; E value=; Homolog= Pa|Phot5 -451c10.q1k_g195| 149072 - 151501 2582 809 aa, chain -
MMADIQHTQTHPKFTLSDKTARQKALDLIQTVKKSAMYHWENLLPACGIDIPAKGKHGACPICGGTDRFHFIDDHHYGNWHCRQCDIPNYGDGLDLVAKTKGISITEAAKIVADVLALPLPEPKPARKIIQTTQPIADRVAALMAQTVAGQSPYLAAKGLHCPNQRLLPDNSAVLRLATLDKKVTGAQIIKPDGEKKLLTGSQKKGAFIALSALEEHPDTAIITEGYATALTVNQLCNGAVLAALDAGNLLSVAQSVRERWPETKIIIAADNDWHHPDELDKNGNPKVNIGKISAEKVALAVNGWVTLPSTEYKADWDDYRQQHGIESAKQTFSNGLYQVVENVAVSKSVTANSDEYREKEYDPLKPHIDIRKNGIYWVEPKEQGGEIVEVEKWLSDYMEIVGIGNDGSEGYLIIKLRQEGSGKYIVEAFPRREIGMPVGWARLRSRGMNITVKNSLLPILAEHLQRSGDRREWIVTQKAGWHCGAYVMPDGEIIGQPYMPVAFSGGTSAIAGYVVRGTAEEWKMHVASLLKGNRSMMLGVLVGLSAPLNSLTGGSCFGVHSFAQSSAGKTTTVEAASSLYGDPEELKLSWHGTNHGLNNEAAARNDGFMPIDEIGQSSNPKEVANSAYSLFNGVGKIQGKREGGNRAVIRWKIAALSTGEEDLETFLIKGGITPKAGQLVRLLSVPFIDTECFNGYEDGDSHARAIKRESKRYCGAAGRAWVQWLSVNQEQVIEVTARKEKEWLDGLPEEASAQVKRVAVRFALLDAAGELAIHITGWSKEASHAAIKQSFDDWLADFGIGNREKYQVITRTRDFIQKYGLSRFQPYTYGRPNGDIDTSHSMRISDLAGYLVHNRRNDGQTEYHIIPSVFEAEILQGLQKKSGFEALEEAGMLVKAEKDRFISKTISVNGTQGRFVVLIFRDED

SEQ ID NO: 6625 - protein, 42 aa, Xenorhabdus bovienii
  Peptide sequence Name=Xb4151_4152.C425.gene74.pep
MCTSTLGRCFFIFCLLCYVLFCAMPLVILRSAAQSSYQSLIQ

SEQ ID NO: 6626 - protein, 68 aa, Xenorhabdus bovienii
  Peptide sequence Name=Xb4151_4152.C425.gene75.pep
  Gene classification: Gene name=AlpA; Function=Predicted transcriptional regulator; Function class=K Transcription
  Homolog annotation: Query=3..66bp; Hit=1..64bp; Blast score=77; Percent Identity=57.0; E value=2e-15; Homolog= Z3946 COG3311
MTMTAPKENLIRLPEVQRRTGYSKAWIYKLISDGEFPKQIKLGSRSIAFIESEIDNWIAQRIAGSRAA

SEQ ID NO: 6627 - protein, 33 aa, Xenorhabdus bovienii
  Peptide sequence Name=Xb4151_4152.C425.gene76.pep
VLSLSYYLSPVTESLSAHRGRCLMTGGLFKKQD

SEQ ID NO: 6628 - protein, 39 aa, Xenorhabdus bovienii
  Peptide sequence Name=Xb4151_4152.C425.gene77.pep
VVIFYSVLEAPAVTNFHTEYNSGADTPCKPINFTNGVNN

SEQ ID NO: 6629 - protein, 57 aa, Xenorhabdus bovienii
  Peptide sequence Name=Xb4151_4152.C425.gene78.pep
LYEKQAIVPRAQVCEKSPHLYALLPNFPIKTFSPRSSISIWSAYHCSISLRPSRYWA

SEQ ID NO: 6630 - protein, 105 aa, Xenorhabdus bovienii
  Peptide sequence Name=Xb4151_4152.C425.gene79.pep
MVCIPLQHFPSPLQILGVIVSSPDAVLIHMGKLGFNPSRVIALFMQDSTHGMAEAVAGCSAIITNAFNHLINGGLAHRFTRIITSWENYFPRPVIECSLIRMALT

SEQ ID NO: 6631 - protein, 296 aa, Xenorhabdus bovienii
  Peptide sequence Name=Xb4151_4152.C425.gene80.pep
  Gene classification: Gene name=XerC; Function=Integrase; Function class=L DNA replication, recombination and repair
  Homolog annotation: Query=1..292bp; Hit=1..292bp; Blast score=353; Percent Identity=57.0; E value=2e-97; Homolog= ZintL COG0582
MKLTARQVDTAKPKEKPYKLADGGGLYLLVNPNGARYWRLKYRIAGKEKLLALGVYPDISLSDARTKRNEARRTLSDGNDPIEEKKAEKAAKAFAVSNSFESIAIEWHEHKRPNWSKGYAEDILEYLKKDIFPYIGKRAVTEIKPAEMLAVLRKMEQRGVLDKLKKTRQACRQIFTYAVITGRAEFNPVTDLASALKAPKQKHFSHLLADQMNAFLVALAGYSGSEVTQSATRLLMLTGVRTIELRESEWTEFDFDKDIWQIPAERMKMRRPHIVPLSNQVKAILIKLHSITGRGK

SEQ ID NO: 6632 - protein, 69 aa, Xenorhabdus bovienii
  Peptide sequence Name=Xb4151_4152.C425.gene81.pep
VDFNLPDWTTEERKKANTAYLLGFYGLWKTLRYEWMVRPTGFEPVTYGLEGQKPLISLYFLQFHLVSSF

SEQ ID NO: 6633 - protein, 44 aa, Xenorhabdus bovienii
  Peptide sequence Name=Xb4151_4152.C425.gene82.pep
LGFKPRILLSVNKVLAIRYILHNRSSSGSSYDEMICNYMKLFKL

SEQ ID NO: 6634 - protein, 405 aa, Xenorhabdus bovienii
  Peptide sequence Name=Xb4151_4152.C425.gene83.pep
  Gene classification: Gene name=XerC; Function=Integrase; Function class=L DNA replication, recombination and repair
  Homolog annotation: Query=30..405bp; Hit=50..422bp; Blast score=155; Percent Identity=32.0; E value=7e-38; Homolog= CC2681 COG0582
MASTLLTDSKIRGLKPKNSAYYTWQAAATRGTGRLGVKTYPSGRKVFVYRYFKNGKEKFINLGDFPALSLAEALSKSRDAAANVSAPEKAIINHATIEQLFSDYIADQKRRGKRSYDKTQYRLNQVLDSQHIDRNTPAKDITPDHIKRVLAEFISRGAVAGSNKVRANLHAVFNFGLFADNDPAKLNEKVIYGLDRNPVTVVPRQEGADKALDRFLSWDEMKEILKLFRISSTVFPIHPDYGRLILLCIFTAGQRPWEIMTNTKDNWDKNNNTLTVPLHISKNGDYHVIPLCESATEILECQAKQYPDSEFLFPGDTKEGHLLTAEYAKQIRKFCARYDFEKFTPRDIRRTFKTLAGEMGISSEMRDRLQNHKKPGVSTKHYDRYDYLKEKREIIAQWESKLLSL

SEQ ID NO: 6635 - protein, 38 aa, Xenorhabdus bovienii
  Peptide sequence Name=Xb4151_4152.C425.gene84.pep
METDKLIFGIFSNIRIKSIQISTLLDNCPDCKGQLSAL

SEQ ID NO: 6636 - protein, 68 aa, Xenorhabdus bovienii; identical to SEQ ID NO: 6354
  Peptide sequence Name=Xb4151_4152.C425.gene85.pep

SEQ ID NO: 6637 - protein, 346 aa, Xenorhabdus bovienii; identical to SEQ ID NO: 6355
  Peptide sequence Name=Xb4151_4152.C425.gene86.pep
  Gene classification: Function=Transposase; Function class=L DNA replication, recombination and repair
  Homolog annotation: Query=15..344bp; Hit=2..335bp; Blast score=241; Percent Identity=43.0; E value=7e-64; Homolog= PA2319 COG3547

SEQ ID NO: 6638 - protein, 30 aa, Xenorhabdus bovienii
  Peptide sequence Name=Xb4151_4152.C425.gene87.pep
MSGFHQVDKPFMSSIISLRKTRLGTALIND

SEQ ID NO: 6639 - protein, 346 aa, Xenorhabdus bovienii; identical to SEQ ID NO: 6355
  Peptide sequence Name=Xb4151_4152.C425.gene88.pep
  Gene classification: Function=Transposase; Function class=L DNA replication, recombination and repair
  Homolog annotation: Query=15..344bp; Hit=2..335bp; Blast score=241; Percent Identity=43.0; E value=7e-64; Homolog= PA2319 COG3547

SEQ ID NO: 6640 - protein, 36 aa, Xenorhabdus bovienii
  Peptide sequence Name=Xb4151_4152.C425.gene89.pep
LHDGLLLKETPCQHTAHRVVGTISLNAPVKRNDWGS

SEQ ID NO: 6641 - protein, 31 aa, Xenorhabdus bovienii
  Peptide sequence Name=Xb4151_4152.C425.gene90.pep
MTRFSEIIATESQYHMKINYKKNLFLVKKIG

SEQ ID NO: 6642 - protein, 55 aa, Xenorhabdus bovienii
  Peptide sequence Name=Xb4151_4152.C425.gene91.pep
LLQALSRHYADNFRSLNKQSFHQNTSIKNYPHKILHHNKKATFFAAILFTFQIFD

SEQ ID NO: 6643 - protein, 948 aa, Xenorhabdus bovienii
  Peptide sequence Name=Xb4151_4152.C425.gene92.pep
  Gene classification: Gene name=PolA; Function=DNA polymerase I - 3' -5' exonuclease and polymerase domains; Function class=L DNA replication, recombination and repair
  Homolog annotation: Query=305..948bp; Hit=1..640bp; Blast score=869; Percent Identity=70.0; E value=0; Homolog= polA_2 COG0749
MAFYSLIIPQNDEENFMAQIADNPLILVDGSSYLYRAYHAFPPLTNSAGEPTGAMYGVLNMLRSLIIQYKPSHVAVVFDAKGKTFRDELFAEYKSHRPPMPDDLREQIEPLHKMVEAMGLPILVVPGVEADDVIGTLALQAEKEGRSVLISTGDKDMAQLVTPYITLINTMTNTILGPEGVSEKYGVPPELIIDFLALMGDSSDNIPGVPGVGEKTALGLLQGIGSLDDIYARLDEIATLSFRGAKTLSGKMAQHKEVAYLSYQLATIKTDVELDKTCLELAVTAPDSDELLALFSRYEFKRWLSDVQNGSWLEGNSQKSAATVSAAKSATISSAPAAVNISPENYQTILDRKSLDEWIVKLKQAPAFSFDTETDGLDTLTVNLVGMSFAIAVGESEVEAAYLPLGHDYLDAPEQLDLHEVLAALKPLLEDANLPKIGQNLKFDRGVLARYDVALNGIVFDTMLESYVLNSVSGRHDMDSLADRHLGYKTTTFEEIAGKGKKQLTFNQIPLEEAAKYAAEDADVTLRLHQVMYPQIDSVPTLKSVFQNIEMPLVPVLSRIERTGVLIDAQTLAEHSTEITARLGELEKAAYELAGEEFNLASPKQLQVILFEKLNLPVLKKTPNGAPSTNEEVLEELADNHELPRVILEHRGLAKLKSTYTDKLPQMVNPLTKRVHTSYHQAVTATGRLSSRDPNLQNIPVRNDEGRRIRQAFIAPEGYCIMAADYSQIELRIMAHLSQDKGLLEAFAQGKDIHSATAAEVFGVPLEEVTSEQRRSAKAINFGLIYGMSAFGLSRQLSIPRGEAQRYMDLYFERYPGVLAYMERTRQQAAEHGFVETLEGRRLYLPDIKSRNAMRRKASEREAINAPMQGTAADIIKLAMIAVDNWIVSEQPNVRMIMQVHDELVFEVHESELATAEQKISELMEKSMQLDVPLKVDVGIGINWDQAH

SEQ ID NO: 6644 - protein, 84 aa, Xenorhabdus bovienii
  Peptide sequence Name=Xb4151_4152.C425.gene93.pep
LIFTSCCSFFRGININLFYVPIFCAQSYPQFIHQNICQKKPVSTRKLSQNSSITTQYGILFFNHPTERRRKFYGTDSRQSPDFG

SEQ ID NO: 6645 - protein, 36 aa, Xenorhabdus bovienii
  Peptide sequence Name=Xb4151_4152.C425.gene94.pep
MCIVPVTIKLAQYLLKSPFHNINFGYIHKSVIFKSL

SEQ ID NO: 6646 - protein, 207 aa, Xenorhabdus bovienii
  Peptide sequence Name=Xb4151_4152.C425.gene95.pep
  Gene classification: Gene name=TrxA; Function=Thiol-disulfide isomerase and thioredoxins; Function class=O Posttranslational modification, protein turnover, chaperones
  Homolog annotation: Query=1..207bp; Hit=1..208bp; Blast score=243; Percent Identity=54.0; E value=1e-64; Homolog= dsbA COG0526
MKTFWLALVGIFMAFNASASGFSEDKQYVELKNPVANQPQVLEFFSFYCPHCYQFENIYHVPSTVEKNLPAGVTHERYHVDFIGPLGKDLTDAWAVAIVMKIEDKISPILFEGIQKNHTINSKADIRSAFIKAGVSGEEYDAALNSFIVKSVAAKERQAVSSLQLQGVPAIYVNGKYQVKNDGIESTTMAGYAKGFSDVVNYLVTKK

SEQ ID NO: 6647 - protein, 324 aa, Xenorhabdus bovienii
  Peptide sequence Name=Xb4151_4152.C425.gene96.pep
  Gene classification: Function=Putative homoserine kinase type II (protein kinase fold); Function class=R General function prediction only
  Homolog annotation: Query=2..324bp; Hit=5..328bp; Blast score=410; Percent Identity=60.0; E value=1e-114; Homolog= yihE COG2334
MAFNFQNITPDLIMDALVQSGLYIDSGLTELNSYENRVYQFMDENRKRYVVKFYRPQRWSQQQIQEEHDFALALQQADLSVAAPLVFAGQTVLKHGGFFFAIFPSVGGRQYESDNFDQLEGVGRLLGQIHQIGRQKIFSSRPTIGLDEYLYQPYHYLSACKLIPAKHKKVFFAALDELNQTVEGAWYFDGQIRLHGDCHAGNILWRDEAWFVDLDDARNGPAIQDLWMLLNGSRQERLIQLDILLESYSQFTDFDPKTLALIEPLRAMRMVYYLAWVARRWQDPAFPKAFPWMADSDFWHGQVSLFSEQIRLLQESPLQLNPMY

SEQ ID NO: 6648 - protein, 37 aa, Xenorhabdus bovienii
  Peptide sequence Name=Xb4151_4152.C425.gene97.pep
LLICIAIYKELKMKKILRLLCCVPEALLKINEERAGL

SEQ ID NO: 6649 - protein, 87 aa, Xenorhabdus bovienii
  Peptide sequence Name=Xb4151_4152.C425.gene98.pep
MCWYNGVPSNCSNPLSSPPMRVDSPPARIAPLIFGCVMLTHLIFGNEIFNYLVYNLCKSICNNAFMEGSITFTLIDRPILSLNHYPC

SEQ ID NO: 6650 - protein, 195 aa, Xenorhabdus bovienii
  Peptide sequence Name=Xb4151_4152.C425.gene99.pep
  Gene classification: Gene name=MobA; Function=Molybdopterin-guanine dinucleotide biosynthesis protein A; Function class=H Coenzyme metabolism
  Homolog annotation: Query=6..189bp; Hit=7..191bp; Blast score=184; Percent Identity=47.0; E value=6e-47; Homolog= mobA COG0746
MTHPKMSGAILAGGLSTRMGGDDKGLLQFDGTPLYQHIATRLQPQVQELLINANRNQAVYQQSGYPIIPDIITDFSGPLAGMLAVLKKAIHEWVIFVPCDVPDFPDDLVEKLWRYRQHSWAVYVHDCQRAHPTLALMHRSLIPRLESYLALGERKLMFFMQMIKAKAVYFPYPSAFTNLNTPEEYQHWEYFQESA

SEQ ID NO: 6651 - protein, 185 aa, Xenorhabdus bovienii
  Peptide sequence Name=Xb4151_4152.C425.gene100.pep
  Gene classification: Gene name=MobB; Function=Molybdopterin-guanine dinucleotide biosynthesis protein; Function class=H Coenzyme metabolism
  Homolog annotation: Query=14..177bp; Hit=2..166bp; Blast score=206; Percent Identity=63.0; E value=1e-53; Homolog= ZmobB COG1763
LGIFSGVSMKPTTLPLLGITAYSGTGKTTLLKQIIPLLRQQHIRVGLIKHTHHNMDVDQPGKDSYELRKAGAAQTLVASQQRWALMTETPDLPKLDLHYLASRFNADSLDLVLVEGFKEEAIAKIVLYRHGLNVAFDQIMDTHVIAIASDIPLATSLPLLNINQPQQVTAFIVAWLRAGSASKPG

SEQ ID NO: 6652 - protein, 37 aa, Xenorhabdus bovienii
  Peptide sequence Name=Xb4151_4152.C425.gene101.pep
MISEINSHQLHLCRKRRTLHVFIRKYISSLSASSDGS

SEQ ID NO: 6653 - protein, 34 aa, Xenorhabdus bovienii
  Peptide sequence Name=Xb4151_4152.C425.gene102.pep
MVLHLLYGIASVNFILYIIGALMAEPRKKPLLLV

SEQ ID NO: 6654 - protein, 41 aa, Xenorhabdus bovienii
  Peptide sequence Name=Xb4151_4152.C425.gene103.pep
MCISSFFNSIWHDFFKYSQISLFHQYYFHVENIQICTMILL

SEQ ID NO: 6655 - protein, 39 aa, Xenorhabdus bovienii
  Peptide sequence Name=Xb4151_4152.C425.gene104.pep
LLLTLIENLFLLFFIKQVSVKDKFINYANFLTNWNLGGR

SEQ ID NO: 6656 - protein, 158 aa, Xenorhabdus bovienii
  Peptide sequence Name=Xb4151_4152.C425.gene105.pep
MKKSLSTESESSLLVGKGLKIIESLSEETADRLKHKTTDDSITKLSESNTHIYYEATLSLVSYFFYYTCTLDVQGAKTFYGKAGGIGSVGKGKFSGEFFFGTNDINLIYQKATFFVAMITPLTISMAFLDPPIDKLAQFNGSGLGTISATITGAGYWE

SEQ ID NO: 6657 - protein, 52 aa, Xenorhabdus bovienii
  Peptide sequence Name=Xb4151_4152.C425.gene106.pep
MADILHMKFYIIIMLFRLFSGMLYHYYYSPDKQIMIIAPIFYYAVEGGFISL

SEQ ID NO: 6658 - protein, 37 aa, Xenorhabdus bovienii
  Peptide sequence Name=Xb4151_4152.C425.gene107.pep
MSSIKQLHFQKTAHRLCCGLCIYQSCYNAISLPVSSQ

SEQ ID NO: 6659 - protein, 99 aa, Xenorhabdus bovienii
  Peptide sequence Name=Xb4151_4152.C425.gene108.pep
  Gene classification: Function=Uncharacterized ACR; Function class=S Function unknown
  Homolog annotation: Query=1..96bp; Hit=1..96bp; Blast score=133; Percent Identity=69.0; E value=3e-32; Homolog= yneC COG1359
MQVTLVEINVKADKLDEFIEVFRDNHLGSVKEPGNLRFDVLRDENIPTRFYVYEAYADEASVAAHKKTPHYLRCVERLEALMTEPRKKTTFIGLIPEGK

SEQ ID NO: 6660 - protein, 294 aa, Xenorhabdus bovienii
  Peptide sequence Name=Xb4151_4152.C425.gene109.pep
  Gene classification: Gene name=FbaB; Function=DhnA-type fructose-1,6 -bisphosphate aldolase and related enzymes; Function class=G Carbohydrate transport and metabolism
  Homolog annotation: Query=1..290bp; Hit=1..290bp; Blast score=513; Percent Identity=86.0; E value=1e-145; Homolog= yneB COG1830
MADLDDIKDGKDFGIDTPQKNTLFELKGSGALDWGMQSRLSRIFNPTTNKTVMLAFDHGYFQGPTTGLERIDINIAPLFEHTDVLMCTRGILRSQVPPATNKPVVLRASGANSILTELSNEAVAVAMEDALRLNVCAVAAQVYIGSEHEHQSIKNIIKLVDQGMRYGMPTMAVTGVGKDMARDQRYFSLATRIAAEIGANIIKTYYVDSGFERIAAGCPVPIVIAGGKKLPEIEALEMCYQAIDQGASGVDMGRNIFQSEAPVAMLKAVQAVVHHNEKPAQAYELFLSEKAKGE

SEQ ID NO: 6661 - protein, 90 aa, Xenorhabdus bovienii
  Peptide sequence Name=Xb4151_4152.C425.gene110.pep
  Gene classification: Gene name=RbsB; Function=Periplasmic sugar -binding proteins; Function class=G Carbohydrate transport and metabolism
  Homolog annotation: Query=1..90bp; Hit=249..338bp; Blast score=134; Percent Identity=67.0; E value=2e-32; Homolog= PM1277 COG1879
MRPYVENGTVKQFGLWDVVKQGKIAIHVANEMLKKGDLNVGEQLDIPDIGKLAISPNSVQGYRYEAKGNGIVVMPERVIFTSENINQYDF

SEQ ID NO: 6662 - protein, 89 aa, Xenorhabdus bovienii
  Peptide sequence Name=Xb4151_4152.C425.gene111.pep
MNGYLALLNDIPQAELFDRAVFNVRSHHIRRTEPDDRYIPAFQVFRGLCSPRIISTNCLSATFRLPAGVFRSIEQFSWFSNCCIRLLLT

SEQ ID NO: 6663 - protein, 106 aa, Xenorhabdus bovienii
  Peptide sequence Name=Xb4151_4152.C425.gene112.pep
  Gene classification: Gene name=MglA; Function=ABC-type sugar (aldose) transport system, ATPase component; Function class=G Carbohydrate transport and metabolism
  Homolog annotation: Query=6..63bp; Hit=9..63bp; Blast score=70; Percent Identity=63.0; E value=2e-13; Homolog= ego COG1129
MFNCYVPLLAVRGVSKQFSGLAVLKHIDFTLIAGQVHALLGGNGAGQSTLMLDGRTISHLTPAKRINWASIWCHRNLCYFPVFLFRKTFYSVCLNIRSAKAGCSNY

SEQ ID NO: 6664 - protein, 368 aa, Xenorhabdus bovienii
  Peptide sequence Name=Xb4151_4152.C425.gene113.pep
  Gene classification: Gene name=DeoR (BS); Function=Transcriptional regulator, contains sigma factor-related N-terminal domain; Function class=K Transcription
  Homolog annotation: Query=61..367bp; Hit=9..315bp; Blast score=402; Percent Identity=66.0; E value=1e-112; Homolog= ZydeW COG2390
MFKFLRSPSSTSEAFMLNSLPVDKQVVMSIKPTKKQSVSERSGLSEELSYSDNNHSGHGYSGNSMSEEELLARIAWFYYHDGLTQGDIGELLGLSRLKISRLLEKGRQTGVIRVQINSRYEGCLELEDTLQKRFNLKQVRVLPALDEININTRLGVGAAHLLMALIEPSQLLAIGFGETPMCTLQHLSGFISSQQIRLVTLSGGVGPYMTGIGQLDADCPVSIIPAPLRASTHQVAATFREERSVRDVILTACAADIAVVGIGAINQRQQATIMRSGYISDGEQLMFGRKGAIGDILGYFFNAEGELVSHIDIHQELIGISLPELKTIPNVIGVAGGIEKAGAIIAALKGGYISSLVTEEQTARAMLT

SEQ ID NO: 6665 - protein, 530 aa, Xenorhabdus bovienii
  Peptide sequence Name=Xb4151_4152.C425.gene114.pep
  Gene classification: Gene name=XylB; Function=Sugar (pentulose and hexulose) kinases; Function class=G Carbohydrate transport and metabolism
  Homolog annotation: Query=13..530bp; Hit=13..530bp; Blast score=849; Percent Identity=77.0; E value=0; Homolog= ydeV COG1070
MNQRAHAHPSGKYLMALDAGTGSIRAVIFDLEGNQVAVGQAEWIHQPVPNVSGSMEFDLKTNWQLACQCIRQALQKAELPASAIQGVAACSMREGIVLYNRSGDPIWACANVDARSGHEVSELKELYDNTFEYDVYRYSGQTLALGAMPRLLWLAHHRADIYRQASTLTMISDWLAYMLSGELAVDPSNAGTTGMLDLVSRNWRPNLLEMAGLRSDILSPVKETGTLLGYITEKAAADCGLNSGTPVIMGGGDVQLGCLGIGVVKPAQTAVLGGTFWQQVVNLPAPITDPNMNIRINPHVIPGMAQAESISFFTGLTMRWFRDAFCAEEKLMAERLGVDAYSLMEDMAARVPAGAYGIMPIFSDVMRFKSWYHAAPSFLNLSIDPEKCNKATLFRALEENAAIVSACNLDLIAGFSGVKPDSLVFAGGGSKGKLWCQILADVTGLPVRVPVVKEATALGCAIAAGVGVSLYDSLPETGEKLVRWEREYQPDLTHWDIYQKAKKNWQAVYADQLHLVDDGLTTSLWKAPGL

SEQ ID NO: 6666 - protein, 31 aa, Xenorhabdus bovienii
  Peptide sequence Name=Xb4151_4152.C425.gene115.pep
MIRLPCFLFSTLMTTLNLRWICFAALFMPIR

SEQ ID NO: 6667 - protein, 90 aa, Xenorhabdus bovienii
  Peptide sequence Name=Xb4151_4152.C425.gene116.pep
  Gene classification: Gene name=HipA; Function=Uncharacterized protein related to capsule biosynthesis enzymes; Function class=R General function prediction only
  Homolog annotation: Query=1..82bp; Hit=250..332bp; Blast score=75; Percent Identity=43.0; E value=1e-14; Homolog= HI0665 COG3550
LPLLVQEEGDKGLAPGFETKYGEYLGIDFLLFGQSMGLSEKLLRKLLMDLTKETQLIESTYRNSFMSKEAIKATLQCYQQRLNRMQVLDT

SEQ ID NO: 6668 - protein, 450 aa, Xenorhabdus bovienii
  Peptide sequence Name=Xb4151_4152.C425.gene117.pep
  Gene classification: Gene name=Lpd; Function=Dihydrolipoamide dehydrogenase/glutathione oxidoreductase and related enzymes; Function class=C Energy production and conversion
  Homolog annotation: Query=1..450bp; Hit=1..450bp; Blast score=761; Percent Identity=83.0; E value=0; Homolog= gor COG1249
MSKHYDYIAIGGGSGGIASMNRAAMYGQKCALIEAKALGGTCVNVGCVPKKVMWHAAQIAESIHQYGPDYGFDTTVNRFDWKTLIASRTAYIDRTHQSYERVLGNNKVDVIHGFARFVDAHTVEVNGEKITANHILIATGGRPVCPTIPGAEYGIDSDGFFELDEMPKRVAVVGAGYIAVEIAGVLKALGSETHLFVRKHAPLRSFDPLIVETLLEVIKNEGPTLHTEAILKAVIKHADGSLTLQLQDGREQTVDTLIWAIGREPMTDNLNLAVTGVELNEKGYIQVDKYQNTNVKGVYAVGDNTGAVELTPVAIAAGRRLSERLFNNKPEEHLDYTNVPTVVFSHPPIGTVGLTEPQAREQYGDDQVKVYTSSFTAMYTAVTQHRQPCRMKLVCTGADEKIVGIHGIGFGMDEILQGFAVALKMGATKKDFDNTVAIHPTAAEEFVTMR

SEQ ID NO: 6669 - protein, 280 aa, Xenorhabdus bovienii
  Peptide sequence Name=Xb4151_4152.C425.gene118.pep
  Gene classification: Function=Protein involved in catabolism of external DNA; Function class=R General function prediction only
  Homolog annotation: Query=1..280bp; Hit=1..280bp; Blast score=451; Percent Identity=78.0; E value=1e-127; Homolog= ZyhiR COG2961
MLSYRHSFHAGNHADVLKHTVQSLIIESMKGKEKPFLYLDTHAGAGRYQLSGEHAERTGEYLEGIARIWQRDDIPEELTAYMSAVKALNPHGVLRYYPGSPLIARHLLREYDELNLSELHSSDFPLLRSEFSRDERVRLLREDGYQQLKSKLPPKSRRGFVLIDPPYELKSDYQNVVKGILEGYKRFATGTYALWYPVVLRQQIKRMLKDLESTGIRRVLQIELGVRPDSDQRGMTASGMIVINPPWKLEQQMKAVLPWLHQVLVPEGTGHTSVAWVVPE

SEQ ID NO: 6670 - protein, 84 aa, Xenorhabdus bovienii
  Peptide sequence Name=Xb4151_4152.C425.gene119.pep
VNGLSLITSKYIPQKSGQVDILIVTVNLSNELPEKFLISGNLVKKYLRGVTITPLSVFLWFGFHLFQNKYSSITLLLCFIMFLY

SEQ ID NO: 6671 - protein, 123 aa, Xenorhabdus bovienii
  Peptide sequence Name=Xb4151_4152.C425.gene120.pep
  Gene classification: Gene name=Nlp; Function=Predicted transcriptional regulator; Function class=K Transcription
  Homolog annotation: Query=44..117bp; Hit=7..81bp; Blast score=92; Percent Identity=66.0; E value=6e-20; Homolog= sfsB COG3423
MVVQAGEASASLVIVTQSANPVWIATINDQLMEGVAGISNVRNDWHQADIIAELRKRGTTLAAVSRESGLSSSTLANTLSRPWPKGEWIIANYLEIHPSEIWPSRYFDSNGQLIKRTARKVSN

SEQ ID NO: 6672 - protein, 40 aa, Xenorhabdus bovienii
  Peptide sequence Name=Xb4151_4152.C425.gene121.pep
MVKVLQPCVTIYTGRKFLPVRLLSPFQWWFRQGRLRPRWL

SEQ ID NO: 6673 - protein, 66 aa, Xenorhabdus bovienii
  Peptide sequence Name=Xb4151_4152.C425.gene122.pep
LNALGRCCYSLKGKAKVHQKYDMQVNTLICSGLVKGHVINTVYCLTSVSTYRKIQFRIIDNNPQQN

SEQ ID NO: 6674 - protein, 358 aa, Xenorhabdus bovienii
  Peptide sequence Name=Xb4151_4152.C425.gene123.pep
  Homolog annotation: Query=21..153bp; Hit=121..259bp; Blast score=116; Percent Identity=50.0; E value=6e-25; Homolog= gi|37526913|ref|NP _930257.1| hypothetical protein [Photorhabdus luminescens subsp. laumondii TTO1] gi|36786346|emb|CAE15399
MQDKKPDTPVSEDSNLVTVTTPEYVKDSIKAAIDQHAASRNHPYATLTDRGFVTLSNDVDSDSEMTAATSKAVKKAYDLANIANQNALNNNSDLYLEKAQNGADIPNKDEFVKNIGLTETINLAKNSVPNNRKINDKSLTNDIILNSKDVHALNDVIKFDGIPDSKYIGVFSASGSASGYAKGINFGLLDYDTGQIYIRSSGDLYAYYFVNGEDRVGGKVWSEVNTTIGNNGCIKKSAPTILIYSDGKYTINNKSENTIVECLSKGTYLIKGVIGFSNDEAIGSIEIPRCQNDLPLIWVNHEVLPDGSIKLMTYHREHSDVPSFARNIREGYADGDLIDIPEGRFVSVRVQMPPAKGE

SEQ ID NO: 6675 - protein, 48 aa, Xenorhabdus bovienii
  Peptide sequence Name=Xb4151_4152.C425.gene124.pep
VVTVTKLLSSETGVSGFLSCIVIPSFNQQYTLLNNMKAVGYYSACEHQ

SEQ ID NO: 6676 - protein, 31 aa, Xenorhabdus bovienii
  Peptide sequence Name=Xb4151_4152.C425.gene125.pep
MSFGTWQIEHEDFAFSLNDEQQQRLANFDGV

SEQ ID NO: 6677 - protein, 162 aa, Xenorhabdus bovienii
  Peptide sequence Name=Xb4151_4152.C425.gene126.pep
  Homolog annotation: Query=2..84bp; Hit=38..120bp; Blast score=141; Percent Identity=75.0; E value=5e-33; Homolog= gi|15801317|ref|NP _287334.1| putative portal protein of prophage CP-933C [Escherichia coli O157:H7 EDL933] gi|25499364|pir||F8
MAEGLPAVMNAVTVISEAVASMPCYLYRVQHQNGKEFREWLSDHPVDYLLNECPNDCQTPYQFKRTLMRHCLLNGNAYAVIVWGGIRTTQGDCIDYDRIRDDILKDSQHLDIKLVGFDTWNATHLRTQLQGAGLDVEPFPRTPISNRTRRSPRIKSTLQSRS

SEQ ID NO: 6678 - protein, 37 aa, Xenorhabdus bovienii
  Peptide sequence Name=Xb4151_4152.C425.gene127.pep
  Homolog annotation: Query=3..37bp; Hit=97..131bp; Blast score=62; Percent Identity=85.0; E value=2e-09; Homolog= Pa|Phot5-451c10.q1k _g192| 147172 - 147567 784 131 aa, chain -
MTSFYVDYKLKNVGYLTCDKISWMSPTTYVKDLSLCE

SEQ ID NO: 6679 - protein, 95 aa, Xenorhabdus bovienii
  Peptide sequence Name=Xb4151_4152.C425.gene128.pep
MSNNQHFLTYNQHKKRSCIKWLVAVICFRLFKDEVWPKLMSIAVIATNQDRSKDMGKEMADILVIAVIAAVRSFSWRIPIRPANPALKNRLSISR

SEQ ID NO: 6680 - protein, 92 aa, Xenorhabdus bovienii; identical to SEQ ID NO: 6203
  Peptide sequence Name=Xb4151_4152.C425.gene129.pep

SEQ ID NO: 6681 - protein, 96 aa, Xenorhabdus bovienii; identical to SEQ ID NO: 5468
  Peptide sequence Name=Xb4151_4152.C425.gene130.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 6682 - protein, 81 aa, Xenorhabdus bovienii
  Peptide sequence Name=Xb4151_4152.C425.gene131.pep
MDFLPTLALLYENPVTTLVINHNRQGANYSLIKPLISCLCECGKRYNNPSIRIRDKISLFSHDKLFGLDKKQINSHTYSEK

SEQ ID NO: 6683 - protein, 143 aa, Xenorhabdus bovienii
  Peptide sequence Name=Xb4151_4152.C425.gene132.pep
  Gene classification: Function=Uncharacterized ACR; Function class=S Function unknown
  Homolog annotation: Query=1..142bp; Hit=1..142bp; Blast score=152; Percent Identity=54.0; E value=7e-38; Homolog= Z3974 COG2128
MSSLRLAYYDLSPELLQGFRTIKQELEESPLGLALIELIYLRISQINGCAFCLNKHSQSLRENQETERRLSELAGWRVSGQFTLREKVALEWTESLTHVVTTHADDYAYLPLKDHFTDKEIADLTFAIALMNGMNRLAIGMRQ

SEQ ID NO: 6684 - protein, 356 aa, Xenorhabdus bovienii
  Peptide sequence Name=Xb4151_4152.C425.gene133.pep
  Gene classification: Gene name=ARO8; Function=Transcriptional regulators containing a DNA-binding HTH domain and an aminotransferase domain (MocR family) and their eukaryotic orthologs; Function class=K Transcription
  Homolog annotation: Query=1..348bp; Hit=99..443bp; Blast score=286; Percent Identity=45.0; E value=2e-77; Homolog= Z3973 COG1167
LDLFPRKLWNTLTVKQLRLQSRYMSYPQPAGYLPLREAIAAYLQLSRGVSCSPQQIFITAGYRGALNLIAHTLIQPRDQIWLEDPCFPPSQHFLSQIGAEIIPVPVDQEGMNIAVAQELAPNARFALVTPAHQSPLGVTLSMARRQMLLAWAEQNNAFVIEDDYDSEYQYDGRPHPALASLGSNNVLYIGTFSKVLTPTLRLAYLVVPPHLLTSFNAVCHTRQDGCPLLQQAVVTDFMQGGHFARHLRKMRTAYAQRRQIVIESLNQVFDSRLRFDIPAGGLHLLARLAHYEDDVALAQLAREHGLGITALSARRLSSDCGKGLLFSFANETTPENALKHAQLLQKCLPTASRSSN

SEQ ID NO: 6685 - protein, 30 aa, Xenorhabdus bovienii
  Peptide sequence Name=Xb4151_4152.C425.gene134.pep
MIILPIYIKGHGLVYLYSILLHPFIPHLIN

SEQ ID NO: 6686 - protein, 151 aa, Xenorhabdus bovienii; identical to SEQ ID NO: 6609
  Peptide sequence Name=Xb4151_4152.C425.gene135.pep
  Gene classification: Function=Predicted transposase; Function class=L DNA replication, recombination and repair
  Homolog annotation: Query=2..127bp; Hit=1..117bp; Blast score=105; Percent Identity=45.0; E value=2e-23; Homolog= mll8100 COG3293

SEQ ID NO: 6687 - protein, 118 aa, Xenorhabdus bovienii
  Peptide sequence Name=Xb4151_4152.C425.gene136.pep
  Gene classification: Function=Predicted transposase; Function class=L DNA replication, recombination and repair
  Homolog annotation: Query=1..105bp; Hit=139..229bp; Blast score=60; Percent Identity=39.0; E value=3e-10; Homolog= mll8100 COG3293
VTAGQAHESQSAIPLLDGIGVQRKNGFMKRRGKAVLADKGYSGGKLRGYLRKLRIKSIIPYKINEKGSTDGRTQFDKQAYRDRNVVERCFGFLKGNRRIATRYEKSMVPTFFATLIFD

SEQ ID NO: 6688 - protein, 58 aa, Xenorhabdus bovienii
  Peptide sequence Name=Xb4151_4152.C425.gene137.pep
MLACLNLSGVTMGRDARASMSSAPDKPKKPHGFREPFFMSGFHQGGSLESTARSCNAR

SEQ ID NO: 6689 - protein, 39 aa, Xenorhabdus bovienii
  Peptide sequence Name=Xb4151_4152.C426.gene1.pep
LGFAVSICRAFSFIFRGTFNNRSVGAPDYAPWCMLIAKD

SEQ ID NO: 6690 - protein, 420 aa, Xenorhabdus bovienii
  Peptide sequence Name=Xb4151_4152.C426.gene2.pep
  Gene classification: Gene name=XerC; Function=Integrase; Function class=L DNA replication, recombination and repair
  Homolog annotation: Query=1..416bp; Hit=1..414bp; Blast score=473; Percent Identity=55.0; E value=1e-133; Homolog= Z4313 COG0582
MKLNARQIETAKPKEKTYKLADGGGLYLEITSRGSKYWHMKYRRPTDKKEDRLAFGVYPIVSLADARAKRDEAKKLIAQGSDPKAEKRGTQLESKGAPSFEQVAREWHASNKRWSEDHSNRILRSLEHYIFPHIGKLDISTVRTSQLLAPIKSVDADGKHDIAQRLQQRVTSIMRYAVQNDILESNPANDMSGALSTVKAKHHPALPHERLPEFLTRLSHYRGRLITQIAVELTLLTFVRSSELRFARWEELDLENAVWKIPATRKPIEGVKFSERGMKMKTEHIVPLSRQAVSLFKILQGLSGECEVMFPHDHNPAKVMSESTVNNALRVMGYDTKTEVWGHGFRTMARGAMGESGLWNDDAIERQLSHVERKNVRAAYIHTSKHLDERRLMVQWWADYLDANREKYITPYDFAKKRRK

SEQ ID NO: 6691 - protein, 146 aa, Xenorhabdus bovienii
  Peptide sequence Name=Xb4151_4152.C426.gene3.pep
  Homolog annotation: Query=1..134bp; Hit=6..139bp; Blast score=150; Percent Identity=52.0; E value=5e-36; Homolog= gi|16120931|ref|NP _404244.1| hypothetical protein [Yersinia pestis] gi|22127450|ref|NP _670873.1| hypothetical [Yersinia pestis
MLFTIIEIQEKLNELGSKLGLSKNSIQAFDGPLGDGTPYISFENNRYNLVFSERGSEFERKRTKSLDELLYWMMSSVVLGMAFSYELENRIEDQDCRRLAFPKAIELMKQANPEWVPKIEDKINRILSEHPYDDEPTRALLKLKNK

SEQ ID NO: 6692 - protein, 56 aa, Xenorhabdus bovienii
  Peptide sequence Name=Xb4151_4152.C426.gene4.pep
MRSSHRNSNPFHTKSMLRLIILIINYFWLEKTITGRYASPYIFTNWHYVLRYFYQF

SEQ ID NO: 6693 - protein, 32 aa, Xenorhabdus bovienii
  Peptide sequence Name=Xb4151_4152.C426.gene5.pep
MWFSLLTYLYLMFLDVIRTGTIKAKFQYEIIT

SEQ ID NO: 6694 - protein, 72 aa, Xenorhabdus bovienii
  Peptide sequence Name=Xb4151_4152.C426.gene6.pep
  Gene classification: Gene name=AlpA; Function=Predicted transcriptional regulator; Function class=K Transcription
  Homolog annotation: Query=11..71bp; Hit=8..68bp; Blast score=78; Percent Identity=63.0; E value=1e-15; Homolog= Z3946 COG3311
MSIITTSKESLIRLSEVQRRTGYSKAWIYRLIGEDKFPKQIKIGTRSVAFLESEVDGWIDQRIAESRGVVAQ

SEQ ID NO: 6695 - protein, 174 aa, Xenorhabdus bovienii
  Peptide sequence Name=Xb4151_4152.C426.gene7.pep
MKAKKGSTVNATLNLLSFRELVNYQIYYWLVQPFGSTPSLSNSLRPNVFNQLPKVIPASDAASSNCAFNSGVILIWKVGDKPFPFSVLSLFKIDMYVRNLIACDLLCTYFITVYVQKETPPNDIDRIKRGLTTNDNYNIEVAMFQYTFLTGKGKARLPKFFPMCLISILEVSHV

SEQ ID NO: 6696 - protein, 119 aa, Xenorhabdus bovienii
  Peptide sequence Name=Xb4151_4152.C426.gene8.pep
  Homolog annotation: Query=1..119bp; Hit=1..119bp; Blast score=185; Percent Identity=82.0; E value=1e-46; Homolog= Pa|Phot5-451c10.q1k _g196| 151505 - 151864 424 119 aa, chain - [Photorhabdus asymbiotica]
MFKLIITTINQHTGEIKKETIRYKYKTLRGAEKAAMRIRHSCIPDNKSIDIEIVRTYERRAPISLTQAMHNTGLATSLFYVILEKAKDECSIDLNNLIALACDINQDVYHALQAAVYEE

SEQ ID NO: 6697 - protein, 814 aa, Xenorhabdus bovienii
  Peptide sequence Name=Xb4151_4152.C426.gene9.pep
  Gene classification: Function=Predicted ATPase; Function class=R General function prediction only
  Homolog annotation: Query=405..806bp; Hit=2..404bp; Blast score=415; Percent Identity=50.0; E value=1e-116; Homolog= Z0339_2 COG3378
MSQSSSYGYKAHKSSVETHPINIIRTVKQSAMNHWQSLLPACGVDVPAKGKHGACPICGGTDRFHFIDDNHHGDWHCRQCDQPNHGDGLDLVARAKGITVLTAAKQVADVLAMPLPEPIFKPVKEQPLTVKPIAERIAVLVAKSIRGESQYLVKKGLHCPNQRLLQDGSLLLVTQTLSDTNTGAQIITPNGEKRLVSGTQKKGSFIPVSEITGTPDTIIITEGYATALTVSQLHNGVVLAAIDESNLLNVAELVRKQWSESKIILAADNDWHAQGERDKNGKFKKNVGKIAAEKVAKAINGWVTLPPTGHKADWDDYRQHHGIEAAKQVFSNGLYQVGEKKLMEAEAAVIHETKPKKANNNLAQMAASQRGALLVEHYQKIAVHAESEAVYHYNGPTWETVSDNELRRAMVAIFDQHDTPYSPNGINNAIYAMKLQIPVIGEQRSDLIGFCNGVYELSTQKFTPHQPEHWLMNHNGIEFTQPAIGENLSDHAPDFYRWLSHAAGQNENKMNRIKAALFMILANRYDWQLFIEVTGEGGSGKSVFTYIATLLAGEHNTASGNMRALDEARGRYQFVGKSLITLPDQVKYVGEGAGIKAITGGDLIEVDGKYEKQFSTIIKAVVLATNNEPMSFTERNGGIARRRVIFPFNIPVKESEKDPQLPEKISRELPVIIRHLLTEFADQNKAKKLLQAQRDSNEALTVKSHSDPLYRFCGYLVSVNDVTGMKMGNKNISPRAPRLYLYHAYLSFMEAHGFERPLTLTKFGESIPKIMLEYRKEYRKVRTKKGYSYNVELSEEAEEWLPSVPECRDFKSPV

SEQ ID NO: 6698 - protein, 57 aa, Xenorhabdus bovienii
  Peptide sequence Name=Xb4151_4152.C426.gene10.pep
VPKNKKPDYISVFVFSGLPHFVYLPEAPLKIFFILSVIHPLHNTLKALLHLGLMQLI

SEQ ID NO: 6699 - protein, 38 aa, Xenorhabdus bovienii
  Peptide sequence Name=Xb4151_4152.C426.gene11.pep
MVSNKCPMMLNETGYNSIIYLFQSEYKCSNKIVINLYA

SEQ ID NO: 6700 - protein, 244 aa, Xenorhabdus bovienii
  Peptide sequence Name=Xb4151_4152.C426.gene12.pep
  Gene classification: Gene name=Hcp; Function=Hemolysin-coregulated protein (uncharacterized); Function class=R General function prediction only
  Homolog annotation: Query=1..153bp; Hit=1..153bp; Blast score=150; Percent Identity=49.0; E value=2e-36; Homolog= Z0248 COG3157
MSHIIYLSLKGKKQGLISAGCSTPESIGNRYQAGREDEIQVLSVSHSVSRDQNANHHPVSFTKPIDKSSPLLAMAIDGNELLEARFMHYRTSPMGQLEFFYEIKLTGATIVEFAYNYPHSINDNGAIPHEVVMLDYKSISCQHIAAGTSGYSITQLAGREEGKPLLSGFSNIKPLIEEAVAALFSHKFILKHQGDACQDIAYGVETGKGLIEGICQTSGMTKQFDTKKEEDLEVKYLFQTKIGI

SEQ ID NO: 6701 - protein, 280 aa, Xenorhabdus bovienii
  Peptide sequence Name=Xb4151_4152.C426.gene13.pep
  Homolog annotation: Query=24..268bp; Hit=45..295bp; Blast score=124; Percent Identity=31.0; E value=1e-27; Homolog= gi|28867708|ref|NP _790327.1| hypothetical protein [Pseudomonas syringae pv. tomato str. DC3000] gi|28850943|gb|AAO54022.1| h
MSILKTKTVKGGEKTDIEMDIFYLNQIPDAMEKMGWEMAPKLMRHWFNTKPAYTFTEEVKTKYVRDKAIDIPDERINASIIKMEWALKYKQPQDVMSVLINGWSSSAGIDQLKIQLKKEGGKKELGYEKDMREIDTFSVVNSRRFGSKFDTIDDWYGAMGNSNMKVAVKGYVDKLNGKDVFVTEQIGMYLKDTYDFVGANEPLGIWSKNGILDKISSVDYAALYATGSWMALWVKYNGYVPVINDSFRKWQKKYNEGGDFIVYSDVLWMNPLSQHKIINL

SEQ ID NO: 6702 - protein, 37 aa, Xenorhabdus bovienii
  Peptide sequence Name=Xb4151_4152.C426.gene14.pep
LATSYIPLRYIDHLHPSPQNTYSNYRRAMLMEIISIL

SEQ ID NO: 6703 - protein, 81 aa, Xenorhabdus bovienii
  Peptide sequence Name=Xb4151_4152.C426.gene15.pep
MVNIPQWYIRSCQYLHIQCGGMSLWEINILLFYMIIKTEISGRVLHLHQYHMRHFLLHLAFQPLIMMFLYTQQIMDIKASI

SEQ ID NO: 6704 - protein, 305 aa, Xenorhabdus bovienii
  Peptide sequence Name=Xb4151_4152.C426.gene16.pep
  Homolog annotation: Query=1..300bp; Hit=1..301bp; Blast score=377; Percent Identity=62.0; E value=1e-103; Homolog= gi|15801315|ref|NP _287332.1| putative capsid protein of prophage CP-933C [Escherichia coli O157:H7 EDL933] gi|15830844|ref|NP
MKKLLELRQQKADLTHQMRSLLTKAEDEKRSLNADEAKQFDELRNQSDALNAEIARYEALSDEERSQASKPQPTNKNLSNDELRHYVLTGETRSLSTGVPSEGGYTVIPELNKQIMQQLTDESVMRRICSVKTTRSNEYKQLVSVGGAAVAHGEEGKARGETGTPKMEEVSIKLFPIYAYPKTTQEIIDFSDVDILGWLTSEIADTFVDTEETDLLSGDGSKKAKGFLSYPRDTQADKIRAFGTLQKLETTALSADSLIDLKFLLKNKYRKNSVWVMNSSTAAQVQKLKNGNGDYIWRERWSCIK

SEQ ID NO: 6705 - protein, 96 aa, Xenorhabdus bovienii; identical to SEQ ID NO: 5468
  Peptide sequence Name=Xb4151_4152.C426.gene17.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 6706 - protein, 92 aa, Xenorhabdus bovienii; identical to SEQ ID NO: 6203
  Peptide sequence Name=Xb4151_4152.C426.gene18.pep

SEQ ID NO: 6707 - protein, 89 aa, Xenorhabdus bovienii
  Peptide sequence Name=Xb4151_4152.C426.gene19.pep
MDKFSLSEKGSCIKWLVAVICFRLFKDEVWPKLMSIAVIATNQNRSKDMGKEMADILVIAVIAAVRSFSWRIPIRPANPALKNRLSISR

SEQ ID NO: 6708 - protein, 43 aa, Xenorhabdus bovienii
  Peptide sequence Name=Xb4151_4152.C426.gene20.pep
MTLFPKGKIYPFICPLNINKHFDIHFKVLQAIKYPRLVWDLFT

SEQ ID NO: 6709 - protein, 58 aa, Xenorhabdus bovienii
  Peptide sequence Name=Xb4151_4152.C426.gene21.pep
MSIWINIYKMDSLCQGHLKFSPQKVCLHCNGIGYVLLISFQITNYFCFVGCNLSCLCK

SEQ ID NO: 6710 - protein, 183 aa, Xenorhabdus bovienii
  Peptide sequence Name=Xb4151_4152.C426.gene22.pep
MQTYFLGRKLQMPLTQRVHLIDIYPDAHMYISSTFHDGYVINEFTIACHGLAVFDGRPEGLAINGQLWTYDIVTSYIQSNTTVETLHRIHLLACNSANYDIASLAAKVSARIRNTEVKGYIGSVYINFRHNDIYQYYLNNGSNRVSVERYLEQIGNSRVHTNNVPNYYCIVFKNGIMERQDYL

SEQ ID NO: 6711 - protein, 39 aa, Xenorhabdus bovienii
  Peptide sequence Name=Xb4151_4152.C426.gene23.pep
LNSGLISILKRDSRRHFPFVIKGGNRVVDPLPNIFQFHK

SEQ ID NO: 6712 - protein, 271 aa, Xenorhabdus bovienii
  Peptide sequence Name=Xb4151_4152.C426.gene24.pep
  Homolog annotation: Query=1..267bp; Hit=673..939bp; Blast score=448; Percent Identity=82.0; E value=1e-125; Homolog= gi|37525066|ref|NP _928410.1| hypothetical protein [Photorhabdus luminescens subsp. laumondii TTO1] gi|36784492|emb|CAE13380
MIASDLQNALYAIARNHQQDEHGQPLITAHRRARADEMAGAMSMFTQGFEGELFNRPGTPWPEVDVTLIDLGTLARENYSAQMALAMVSLINKVNNLAERDQYQDRELQLVIDEGHITTTNPLLSPYMTKVVKMWRKLGAWLWLATQNLADYPDTAEKMLNMAEWWLCLTMSPDEVEQIARFKKLTEEQKSVLLSASKLPRCYTEGVVLAKKIEALFRVVPPSLYLALGMTEKEEKAERRALMREHQCSELEAAVLVARKMDVARGLKAVY

SEQ ID NO: 6713 - protein, 121 aa, Xenorhabdus bovienii
  Peptide sequence Name=Xb4151_4152.C426.gene25.pep
  Gene classification: Gene name=InsB; Function=Insertion element IS1 protein InsB, putative transposase; Function class=L DNA replication, recombination and repair
  Homolog annotation: Query=4..120bp; Hit=49..166bp; Blast score=112; Percent Identity=50.0; E value=5e-26; Homolog= insB_g4 COG1662
MGSFISNKKRQRWLWYAWEPRLKRIVAHAFGARSKQTLRTLLEKLSAFDVAFWCTDNFGAYDILADEKHITGKLYTQRIERENLNLRNRLKRLNRKTLGYSKSVEMHDKIIGTFIEREFYY

SEQ ID NO: 6714 - protein, 91 aa, Xenorhabdus bovienii
  Peptide sequence Name=Xb4151_4152.C426.gene26.pep
  Gene classification: Function=Transposase; Function class=L DNA replication, recombination and repair
  Homolog annotation: Query=1..89bp; Hit=1..89bp; Blast score=79; Percent Identity=44.0; E value=6e-16; Homolog= insA_g5 COG3677
MALVEVKCRFCGQTTSVKKHGKGEGGHQRYYCQSCRRTFQLEYTYRACHSGMKEQIVKLAMNNAGIRDTARALHVSINAVVRTLKNARRDV

SEQ ID NO: 6715 - protein, 56 aa, Xenorhabdus bovienii
  Peptide sequence Name=Xb4151_4152.C426.gene27.pep
VVWPQNRHFTSTNAITIPHVFTLIIREKQRDEYVIRYSWRHHITTLRTIRLIHSHG

SEQ ID NO: 6716 - protein, 71 aa, Xenorhabdus bovienii
  Peptide sequence Name=Xb4151_4152.C426.gene28.pep
LKNIAEQVGRINGRRYDAGMKLSVDTGAKAGIAADSFKVFGPVQTAEIINDDHIRQIIREEIRQFVTRESE

SEQ ID NO: 6717 - protein, 66 aa, Xenorhabdus bovienii
  Peptide sequence Name=Xb4151_4152.C426.gene29.pep
MRPTCSAIFFNCDLSWFSVSVSQLKSMMKVCWGTLCHVLFSKKKKPPVLTDGMGYSFNRSREWVKE

SEQ ID NO: 6718 - protein, 103 aa, Xenorhabdus bovienii
  Peptide sequence Name=Xb4151_4152.C426.gene30.pep
MNFSVLLGILVLVSAYLSQRSSQKKEQARYLYSLFKDHEQFIGKSPDYIISKTMKPYQSGSVEHGVEFTQWRIGKLVIEAWFKNQVCTGIDFYLPKWLTRTAP

SEQ ID NO: 6719 - protein, 79 aa, Xenorhabdus bovienii
  Peptide sequence Name=Xb4151_4152.C426.gene31.pep
MQERVMENELKPCPFCGSDNVGTERHYGFADKDYEEWVNCYNCDASGSHTCWFDDVGVADSEAIKLWNRRMENTQPQRK

SEQ ID NO: 6720 - protein, 89 aa, Xenorhabdus bovienii
  Peptide sequence Name=Xb4151_4152.C426.gene32.pep
MLILLYVSDNNLETILDQTLLINKDQFGEYTAKMEFENFPRLQSEKEAALRLADWMRRMSEAIEDHWQNKKQSPEAVQLIEEEIIGIAE

SEQ ID NO: 6721 - protein, 134 aa, Xenorhabdus bovienii
  Peptide sequence Name=Xb4151_4152.C426.gene33.pep
  Gene classification: Function=Predicted transposase; Function class=L DNA replication, recombination and repair
  Homolog annotation: Query=6..118bp; Hit=24..138bp; Blast score=72; Percent Identity=33.0; E value=1e-13; Homolog= slr1283 COG3335
MPRKQGYSEKGLRCFGTHDWHVKGRINVIGAILENTFVTLSLFTENINADVFYAWMTQDLLPKLPHGAVIVMDNAPFHKRNDTTQAIADSRCQLEWLPAYSPDLNPIEHKWGGAKAIRRQKRCSVDELFTEHIE

SEQ ID NO: 6722 - protein, 43 aa, Xenorhabdus bovienii
  Peptide sequence Name=Xb4151_4152.C426.gene34.pep
LSKTTFIQINNGSASLFIIADTLDKCLTSLRISARGLERFFSG

SEQ ID NO: 6723 - protein, 107 aa, Xenorhabdus bovienii
  Peptide sequence Name=Xb4151_4152.C426.gene35.pep
  Homolog annotation: Query=1..105bp; Hit=1..105bp; Blast score=90; Percent Identity=44.0; E value=6e-18; Homolog= gi|30249526|ref|NP _841596.1| putative transposase [Nitrosomonas europaea ATCC 19718] gi|30138889|emb|CAD85468.1| putative trans
MGYSLDFRKRVLAYKDKHSLTFEQTSAHFEISMRTLFRWCNKIEPCMTRDKPATKIPDEVLIADVQNFSDDYQWERAKRLGVSQSAIHYALKRLRITQKKNAPTPSR

SEQ ID NO: 6724 - protein, 30 aa, Xenorhabdus bovienii
  Peptide sequence Name=Xb4151_4152.C426.gene36.pep
MPVLAFENLSCSPSHFMPCYLRVRYYVILI

SEQ ID NO: 6725 - protein, 504 aa, Xenorhabdus bovienii
  Peptide sequence Name=Xb4151_4152.C426.gene37.pep
  Gene classification: Gene name=LysU; Function=Lysyl-tRNA synthetase class II; Function class=J Translation, ribosomal structure and biogenesis
  Homolog annotation: Query=3..504bp; Hit=4..505bp; Blast score=828; Percent Identity=82.0; E value=0; Homolog= lysS COG1190
MSQQQQGAEQAPDLNNELKTRREKLVALRGNGIAFPNDFRRENISEDLHAKYDDKTQEELEALNIEVTVAGRMMTRRIMGKASFATLQDMGGRIQVYVSRDDLPEGIYNEQFKKWDLGDILGARGKLFKTKTGELSIHCTELRLLTKALRPLPDKFHGLADQEMRYRQRYLDLISNDESRKTFQIRSRIMAALRNFMVKKDFMEVETPMMQAIPGGASARPFTTHHNALDIDMYLRIAPELYLKRLVVGGFERVFEINRNFRNEGISPRHNPEFTMMELYMAYADYQDLIVLTEELFRTLTQEVLGTTLVKYGEQEFDFGKPFTKMSMKEAICKYRPETNIADLDDMDKAVAIAKSLGIDIEKSWGLGRIQCEIFEETAESHLIQPTFITEYPAEVSPLARRNDDNPFITDRFEFFIGGREIGNGFSELNDAEDQAERFAEQVRHKDEGDDEAMFYDDDYVTALEHGLPPTAGLGIGIDRMVMLFTDSHTIRDVILFPAMRPNK

SEQ ID NO: 6726 - protein, 286 aa, Xenorhabdus bovienii
  Peptide sequence Name=Xb4151_4152.C426.gene38.pep
  Gene classification: Gene name=PrfB; Function=Protein chain release factor B; Function class=J Translation, ribosomal structure and biogenesis
  Homolog annotation: Query=1..286bp; Hit=80..365bp; Blast score=505; Percent Identity=90.0; E value=1e-143; Homolog= prfB COG1186
VNGLLELAVEADDEETFNEAVAELEQLEEKLGQLEFRRMFSGQYDSANCYLDLQAGSGGTEAQDWASMLMRMFLRWAESKGFKTEIIEESDGDVAGLKSATIKIIGEYAYGWLRTETGVHRLVRKSPFDSGGRRHTSFSSAFIYPEVDDDIDIEINPADLRIDVYRASGAGGQHVNKTESAVRITHIPTGLVTQCQNDRSQHKNKDQAMKQLKAKLYELEMQKKNADKQAMEENKSDIGWGSQIRSYVLDDSRIKDLRTGVETRNTQSVLDGDLDKFIEASLKAGL

SEQ ID NO: 6727 - protein, 39 aa, Xenorhabdus bovienii
  Peptide sequence Name=Xb4151_4152.C426.gene39.pep
MFSSDERSLPNACARSGSFQTSGCSSSALTSSKRSFLAS

SEQ ID NO: 6728 - protein, 34 aa, Xenorhabdus bovienii
  Peptide sequence Name=Xb4151_4152.C426.gene40.pep
VTTTYKTQNMFEINPVKSHIQDLSERTDVLRGYL

SEQ ID NO: 6729 - protein, 30 aa, Xenorhabdus bovienii
  Peptide sequence Name=Xb4151_4152.C426.gene41.pep
MTKSDCVANLQKCYKPFDRSVRIRSSKISM

SEQ ID NO: 6730 - protein, 582 aa, Xenorhabdus bovienii
  Peptide sequence Name=Xb4151_4152.C426.gene42.pep
  Gene classification: Gene name=RecJ; Function=Single-stranded DNA -specific exonuclease; Function class=L DNA replication, recombination and repair
  Homolog annotation: Query=9..581bp; Hit=4..576bp; Blast score=811; Percent Identity=68.0; E value=0; Homolog= ZrecJ COG0608
VKQPPVNIETQLRRRPVADDSHLPNSIHPLLRRLYAMRGIRQADELERGAKGLLNYQSLNGIEQAVSLLITALYDHSRIVIVGDFDTDGATSTALCIRALRAMGYRNLDYLVPNRFEDGYGLSVQIVNEVVKKGADLIITVDNGISSHEGVAAAHQHSIKVLVTDHHLPGETLPAADAIINPNLHDCTFPSKALAGVGVAFYLMSALRAELRRIAWFEQQGIPLPNLAELLDLVALGIVADVVPLDTNNRIFVYQGLNRIRAGRCCVGIRALLEISKRESTKLAASDLGFSLGPRLNAAGRLDDMSVGVALLLTDDMVQARQIACELDGLNQTRREIEQGMQQEALQICDQFERTCTQLPYGLVIYHPEWHQGVVGILASRIKERFHRPVIAFAPAGDGTLKGSGRSVNGLHMRDALERLDTRHPGLILKFGGHAMAAGLSIEQDKFDLFQRHFSALMADWLDISQLGGVVWSDGELALGELSLEIAEILREGGPWGQAFAEPIFDGKFKLLQQRIVGEKHLKVMLEPLNGGPMLDGIAFNIDTHRWPDNSVKTVELAYKLDINEFRGNRDVQLLIQHIWPY

SEQ ID NO: 6731 - protein, 240 aa, Xenorhabdus bovienii
  Peptide sequence Name=Xb4151_4152.C426.gene43.pep
  Gene classification: Gene name=DsbG; Function=Protein-disulfide isomerase; Function class=O Posttranslational modification, protein turnover, chaperones
  Homolog annotation: Query=10..240bp; Hit=2..231bp; Blast score=259; Percent Identity=51.0; E value=1e-69; Homolog= dsbC COG1651
MEIKEQKMKKLAFCFSLLLTAFAGNVFANDSAVNNSLVKMGLKAESIKPSQLAGVSTVLTDQGIIHISNDGKYLFKGQVYDISGKIPKNVTNQVLVKKLDALKNQMIVYKAPKEKYVVTVFTDITCGYCRKLHEEMKEYNDLGITIRYLAFPRHSLQHQSAKDMQSIWCSATPNKALDAAFKGDNISPIKSCKNDIAKQYQLGLQFGVQGTPAIVLQDGSVLGGFVPPKALKEDLEQQSE

SEQ ID NO: 6732 - protein, 318 aa, Xenorhabdus bovienii
  Peptide sequence Name=Xb4151_4152.C426.gene44.pep
  Gene classification: Gene name=XerC; Function=Integrase; Function class=L DNA replication, recombination and repair
  Homolog annotation: Query=28..317bp; Hit=8..297bp; Blast score=442; Percent Identity=78.0; E value=1e-124; Homolog= xerD COG0582
VPKKHDLSENYASQDKSSEPAPPANSLIEQFLDTIWLEKDLAENTLSSYRLDLQALNNWLVYSGHDLLSVESIELQLFLAERVDSGYKASSSARLLSAMRRLFQYLYREKMRLDDPTALLSAPKLPKRLPKDLSEKQVGDLLNTPLTDQPIELRDKAMLEVLYACGLRVSELVGLTLSDMSLRQGVVRVVGKGNKERLVPLGEEALYWLEKYLEYGRPWLLNGSASDVFFPSKRGTQMTRQTFWHRIKHYAVLSGIDTERLSPHVLRHAFATHLLNHGADLRVVQMLLGHSDLSTTQIYTYVATERLKMLHQQHHPRG

SEQ ID NO: 6733 - protein, 66 aa, Xenorhabdus bovienii
  Peptide sequence Name=Xb4151_4152.C426.gene45.pep
VFFWHKTSFISATSDRLLCLKKQFFCYNAAPDIRNVLVNNDENWSLLRLQYMLYRNGSRKNTRYTR

SEQ ID NO: 6734 - protein, 173 aa, Xenorhabdus bovienii
  Peptide sequence Name=Xb4151_4152.C426.gene46.pep
  Gene classification: Gene name=FldA; Function=Flavodoxins; Function class=C Energy production and conversion
  Homolog annotation: Query=2..169bp; Hit=1..168bp; Blast score=241; Percent Identity=69.0; E value=3e-64; Homolog= fldB COG0716
MMKIGLFYGSSTCYTEMVAEKIRDILGEDLIDLHNVKDCDPKLMEDYSVLILGIPTWDFGELQEDWLAIWDQLPSLDLSGKIVAMYGMGDQIDYSEWFLDSLGMLYHHLLPAGAQFVGFWPTEGYEFTSPKPLTEDGKQFVGLALDDVNQFEQTDERLSEWCMQILAEMEALF

SEQ ID NO: 6735 - protein, 117 aa, Xenorhabdus bovienii
  Peptide sequence Name=Xb4151_4152.C426.gene47.pep
  Homolog annotation: Query=2..116bp; Hit=27..138bp; Blast score=93; Percent Identity=48.0; E value=6e-19; Homolog= gi|37527427|ref|NP _930771.1| hypothetical protein [Photorhabdus luminescens subsp. laumondii TTO1] gi|36786862|emb|CAE15927.1|
MLAALLAPWPSNGFYLWLPLFVIIMVSWVWSQTNIRRCQGRLVLFSGQKMHWQKAAWKLTRPPWLSRYGMVITLHAFDKTESIRQRSLIRLWVASDSVPPKMWRHLNQLMRQYPDIA

SEQ ID NO: 6736 - protein, 88 aa, Xenorhabdus bovienii
  Peptide sequence Name=Xb4151_4152.C426.gene48.pep
  Gene classification: Function=Uncharacterized ACR; Function class=S Function unknown
  Homolog annotation: Query=1..88bp; Hit=1..88bp; Blast score=140; Percent Identity=79.0; E value=3e-34; Homolog= ygfY COG2938
MDIDNKARIHWACRRGMRELDISIMPFFEYEYDSLNDDDKQLFVRLLECADPDLFNWLMNHGRPEDDELFRMVQLIQSRNQARGPVAL

SEQ ID NO: 6737 - protein, 141 aa, Xenorhabdus bovienii
  Peptide sequence Name=Xb4151_4152.C426.gene49.pep
MPSEYALYCQYPCLKSLLIIFIRAIETAMLMSRKINKSPVVSDMSTVAKFHSQRELSTILGCFSSFMTVESRYIYNMRRASQQIIFNYPSVNNKNNSFALSLISFTISIISQIVYWQELLWLTKFYFLHNSHLLQQHFPWL

SEQ ID NO: 6738 - protein, 332 aa, Xenorhabdus bovienii
  Peptide sequence Name=Xb4151_4152.C426.gene50.pep
  Gene classification: Function=Predicted aminomethyltransferase related to GcvT; Function class=R General function prediction only
  Homolog annotation: Query=7..330bp; Hit=6..326bp; Blast score=401; Percent Identity=64.0; E value=1e-112; Homolog= ygfZ COG0354
MADQILFSAQLPSPSATLSLALISLNDWGMISVTGADAEKYLQGQVTSDIASLNQKHVLSAHCDAKGKMWSNLRLFHRGEGFAYIERRTVLDSQLTELKKYAVFSKVTFAKDEESILLGVAGAGSRNALAEMFPTLPDAETTVIQHETTTLLHFAFPAERFLLVTDQATAAQLTETLVGKLQAQLNDSQQWLALEIEAGFPVIDSASSAQFIPQATNIQVLEGSISFKKGCYTGQEMVARAKYRGANKRAMYWLAGTASSLPVAGDDLEWQLGDKWRRTGSVLTAVRLADGSIWVQVVMNNDMAADSIFRIREDEGSSLTIQSLPYSFDEEK

SEQ ID NO: 6739 - protein, 202 aa, Xenorhabdus bovienii
  Peptide sequence Name=Xb4151_4152.C426.gene51.pep
  Gene classification: Function=Predicted hydrolases of HD superfamily; Function class=R General function prediction only
  Homolog annotation: Query=10..201bp; Hit=2..197bp; Blast score=94; Percent Identity=36.0; E value=7e-20; Homolog= DR0704 COG1896
MSLAVPPVDFGPFTNVIAFIMELDKLKSVHRKTKLLNNQRHENSAEHSWHFALAVMSFAPYVGKMNIGHVVQMALIHDIVEIDAGDVIAFDLAAREAIHEHEVKAAHRIFGLLPEAQRDYFLALWREYEDSETPEAIFAKTLDRIMPVFMNLHNNGQSWVENGIRFEQVFNLLHFIAEAYPELWQYLLPQLEAAKEKGWLKA

SEQ ID NO: 6740 - protein, 48 aa, Xenorhabdus bovienii
  Peptide sequence Name=Xb4151_4152.C426.gene52.pep
MQGIIYSVSLKHIYSSDNNVSYCKFSTVFSEDTIPSRLHILSIPLSAS

SEQ ID NO: 6741 - protein, 519 aa, Xenorhabdus bovienii
  Peptide sequence Name=Xb4151_4152.C426.gene53.pep
  Gene classification: Gene name=ProP; Function=77 Permeases of the major facilitator superfamily; Function class=G Carbohydrate transport and metabolism
  Homolog annotation: Query=35..490bp; Hit=7..461bp; Blast score=187; Percent Identity=34.0; E value=3e-47; Homolog= PA1282 COG0477
MLAHLFNTSVITGEVKVMSLNRIVSTHKRAEFRTWFGLLILMLPVLLVTVDNTILGFALPKITRALEPSANQQLWIIDAYSLVLAGLLVSMGSIGDRVGHRLLLLSGSLGFTVVSALTALSTSPEQLIAGRAALGFFGAMLMPSTLALISHLFTDREQRRLAIAIWATTLTVGSALGPVIGGVLLQYFNWQAIFLLAVPVLVPLLIFAPMLLPESAKKQIGIIDGYSVLLSIIAMAGIVYAIKHFASNGFETSVIMTFAIGLIAGMLFIRRQQSLQIPLMDISLFRNGVFTGSIMVNLLSLGLLIGFVFFATQYLQVVLDMKPLAASLALIPGQIMAIVIGMAIVPIAQRVPIHWLVPILLALSGAAFFLIACVGSNLTSIVIAFALLNIGVGAIASISNDLVISAVPSSKAGAASAISETAYEVGVVFGTTILGGLVTAFYRLNLQLPASISQEQASLALETLAGAYVIAASLIEMEGRQLMGAAAHSFTSAIHITSWLTVVLTGCVVLMVSYLLRKP

SEQ ID NO: 6742 - protein, 43 aa, Xenorhabdus bovienii
  Peptide sequence Name=Xb4151_4152.C426.gene54.pep
LKPTKDDNYFEYRHYDYDSSFTGVSLSKNLNNDACLDEILFLL

SEQ ID NO: 6743 - protein, 41 aa, Xenorhabdus bovienii
  Peptide sequence Name=Xb4151_4152.C426.gene55.pep
VAIFKIVVILCWFQAICFNSTFLQLNHIFKINDIEVFKIIN

SEQ ID NO: 6744 - protein, 976 aa, Xenorhabdus bovienii
  Peptide sequence Name=Xb4151_4152.C426.gene56.pep
  Gene classification: Gene name=GcvP; Function=Glycine cleavage system protein P (pyridoxal-binding), C-terminal domain; Function class=E Amino acid transport and metabolism
  Homolog annotation: Query=484..976bp; Hit=1..492bp; Blast score=826; Percent Identity=81.0; E value=0; Homolog= gcvP_2 COG1003
MGRFLCVPFLASFRKLSSMTQTLIQLENQGEFTRRHIGSSAEQQKEMLATVGANSLDDLTNKIVPRDIALSEPPAVGEGATEQQALAELKVMAGQNRRYQSYIGMGYAPSVLPPVILRNLLENPGWYTAYTPYQPEVSQGRLEALLNFQQVTIDLTGLDLASASLLDEATAAAEAMAMAKRVSKLKGAERFFVADDIHPQTLDVVRTRAETFGFEVIVDKAEKVLELEGVFGVLLQQVGTTGEVHDYSALITKLKEKKIIVSVAADFMALVMLTAPGKQGADMVFGAAQRFGVPMGYGGPHAAFFACRDEFKRSMPGRIIGVSRDAAGNRALRMAMQTREQHIRREKANSNICTSQVLLANIAGMYAVYHGAEGLKRIAGRIHRLTDILATGLQKAGITLRHKTWFDTLTVEVADKTQVLVRAEKAQINLRTDILGAIGVALSEKTSRDDLQTLFQVLTGSDAILDIDTLDNEMAAGSQSIPVSMLRNDDILMHDNFRRYHSETDMMRYMHSLERKDLALNQAMIPLGSCTMKLNAAAEIMPITWPEFTDMHPFCPPEQAQGYHQLISQLSHWLVLLTGYDAVCMQPNSGAQGEYAGLLAIRRYYASRGEQHRHVCLIPSSAHGTNPASAHMAGMTVVVVNCDKEGNIDLTDLHEKAEKHRGELACIMVTYPSTHGVYEETIRQICDIIHQNGGQVYLDGANMNAQVGITTPGFIGADVSHLNLHKTFCIPHGGGGPGMGPIGVKKHLAPFVPGHSVVEMDTVTTLGAVSAAPFGSASILPISWMYIRMMGAKGLKQASQVAILNANYIAARLKGAYEILYTGRDGYVAHECILDIRPLKDEFGISEMDIAKRLVDYGFHAPTMSFPVAGTLMVEPTESESKVEIDRFIDAMLAIREEISNVAKGEWPLEDNPLVNAPHVQAELVSDWEHAYSREIAVFPTVETKANKYWPTVKRLDDVYGDRNLHCSCAPIEDYR

SEQ ID NO: 6745 - protein, 133 aa, Xenorhabdus bovienii
  Peptide sequence Name=Xb4151_4152.C426.gene57.pep
  Gene classification: Gene name=GcvH; Function=Glycine cleavage system H protein (lipoate-binding); Function class=E Amino acid transport and metabolism
  Homolog annotation: Query=4..132bp; Hit=1..129bp; Blast score=178; Percent Identity=72.0; E value=1e-45; Homolog= gcvH COG0509
MATMSHVPAELKYTSSHEWVRAEGNGEYTVGITEHAQELLGDMVFVDLPEVGVVVNNGNDCAVVESVKAASDIYAPLSGEVTAVNSELEGSPELVNSEPYNEGWLFRLKISDESELTHLLDAEGYQSLLAEEE

SEQ ID NO: 6746 - protein, 365 aa, Xenorhabdus bovienii
  Peptide sequence Name=Xb4151_4152.C426.gene58.pep
  Gene classification: Gene name=GcvT; Function=Glycine cleavage system T protein (aminomethyltransferase); Function class=E Amino acid transport and metabolism
  Homolog annotation: Query=1..363bp; Hit=1..363bp; Blast score=594; Percent Identity=78.0; E value=1e-170; Homolog= gcvT COG0404
MSKHTPLYDQHLACGARMVDFHGWMMPLQYGSQIDEHHTVRTDAGMFDVSHMTIVDLHGTGCRDFLRYLLANDITKLTEQGKALYTGMLNVSGGVIDDLIVYFFTDDFYRMVVNSATRDKDLAWIQQHATNYPVEITVRDDLALIAVQGPNAQSKAQSLLNDEQKQAVAGMKPFFGVQSGDLFIATTGYTGEAGYEIALPKEQAADFWQKLLAAGVKPAGLGARDTLRLEAGMNLYGQEMDETISPLAANMGWTIAWKPEDRQFIGREALERQREVGTEQLVGLIMREKGVLRGGLTVHFTDKAGEMRSGVITSGTFSPTLGFSIALARVPQGIGEQAIVQIRNREMLVQVVKPGFVRMGKSLVE

SEQ ID NO: 6747 - protein, 36 aa, Xenorhabdus bovienii
  Peptide sequence Name=Xb4151_4152.C426.gene59.pep
MIVSVFSGYYCNAANLFYGSFLFSVITSKPRYRLRH

SEQ ID NO: 6748 - protein, 34 aa, Xenorhabdus bovienii
  Peptide sequence Name=Xb4151_4152.C426.gene60.pep
MKYRIRSFFIRKRLKCEVNQLNTLQSYMRKTNLK

SEQ ID NO: 6749 - protein, 410 aa, Xenorhabdus bovienii
  Peptide sequence Name=Xb4151_4152.C426.gene61.pep
  Gene classification: Gene name=UbiH; Function=2-polyprenyl-6 -methoxyphenol hydroxylase and related FAD-dependent oxidoreductases; Function class=H Coenzyme metabolism
  Homolog annotation: Query=1..400bp; Hit=1..399bp; Blast score=567; Percent Identity=71.0; E value=1e-161; Homolog= ZvisC COG0654
MQSFDVVIAGGGMVGLALACGLQGSGLRIAIVEEHPPTGTFHANDEHALRVSAINAASERLLTHLGVWQHITAMRASAYLGMDVRDQDSFGRIKFDATENGLTHLGHIIENHVIRQALWQQAENLPDVTIFTPASLKNVAWGENEAFITLSDERMLTSRLVVGADGANSWLRQHADIPLTFWDYEHHALVATIRTEEPHQAVARQVFHGDGILAFLPLSDPHLCSIVWSLPAEAAQQRKVIDAVLFNRQLGVTFDMQLGLCELVSERQAIPLMGRYARNFAAHRLALLGDAAHTIHPLAGQGVNLGFMDVAELIGELSRLHRQGKDIGQYLYLGRFERRRKHSAAVMLAGMQGFRQLFDGNHPAKKLLRDIGLTFADHLPGVKSQLLRHAMGLNDLPDWLISQTSSVEKI

SEQ ID NO: 6750 - protein, 396 aa, Xenorhabdus bovienii
  Peptide sequence Name=Xb4151_4152.C426.gene62.pep
  Gene classification: Gene name=UbiH; Function=2-polyprenyl-6 -methoxyphenol hydroxylase and related FAD-dependent oxidoreductases; Function class=H Coenzyme metabolism
  Homolog annotation: Query=1..390bp; Hit=1..391bp; Blast score=502; Percent Identity=63.0; E value=1e-142; Homolog= ubiH COG0654
MNVIIVGGGMAGATLALAISSLSRGQVQVSLIESTEPTQEHQGFDARAIALAYGTCQRLSQIGVWPVLKDCATPITHVHVSDRGHSGFVNIRADDYAIPALGNVIELHDAGIRLFNLLRQAPNVKLHCPAKVNSVERLDTSVVVKLDNGEKITGELLVAADGSHSAVAKACNIPWQQQTYGQVAMIANVLTSEHPQGQAFERFTEHGPLALLPMSEGRSALVWCHPLEKQTEINGWSNEEFLQQLQKAFGWRLGKMLETGQRHSYPLALFTASQQISHRLALVGNASQTLHPIAGQGFNLGMRDVMTLARVISAAADSGQDIGAYDVLARYQQQRHTDRETTIGITDGLVRIFANDYFPLKIGRNLGLMTMETLSPLRDLFAHQTLGWVAHHSSAE

SEQ ID NO: 6751 - protein, 438 aa, Xenorhabdus bovienii
  Peptide sequence Name=Xb4151_4152.C426.gene63.pep
  Gene classification: Gene name=PepP; Function=Xaa-Pro aminopeptidase; Function class=E Amino acid transport and metabolism
  Homolog annotation: Query=1..437bp; Hit=4..440bp; Blast score=692; Percent Identity=75.0; E value=0; Homolog= ZpepP COG0006
MTKQEYLSRRQALLSKMAPASAAIIFAAPPARRNSDCEYPYRQHSDLLYLTGFNEPKAVLVLIKSDENHNHSVLFNRVRDLTAEIWFGRRLGQDAAPEKLGVDRALPFDDLSKQLYLLLNGLDVVYHAQGEFEYADNIVFSALDTLRKNSRRNLSAPSMIADWRPWLHEMRLFKSAAELDIMRKAGDISAKAHTRAMQNCRPGMFEYQLEAEIHHEFTRQGARYPAYNTIVGAGENACILHYTENERRMKEGDLVLIDAGCEYEGYAGDITRTFPVNGKFTRPQREIYDIVLQSINVSFELYRPGTSIRKVTEHVVRIMVEGLVKLGIMHGEVEQLIETNAYRQFFMHGLSHWLGLDVHDVGHYGIDRDRILEPGMVLTVEPGLYIAPDADVPPEYRGIGIRIEDDIVITEAGNENLTEHVVKDPDEIEALMAQAKQN

SEQ ID NO: 6752 - protein, 192 aa, Xenorhabdus bovienii
  Peptide sequence Name=Xb4151_4152.C426.gene64.pep
  Gene classification: Function=Uncharacterized BCR; Function class=S Function unknown
  Homolog annotation: Query=1..192bp; Hit=3..194bp; Blast score=198; Percent Identity=58.0; E value=4e-51; Homolog= ygfB COG3079
MSIQNSLPNYQSFDEILHQQSVALTAAEMHGLISGLLCGGNHDSSWQTLMHDLTNDGLAFSQALAQSIRALYETTFESLDDSDFVFNLLLPDDEASVFDCADALAGWVNHFLLGLGVANPQLTEKQEIQEVVTDLRNIGMLGYDEDEDQEELSQALEEVLEYVRVAVQLCYIALATPKTANSVKKNDKPTLH

SEQ ID NO: 6753 - protein, 102 aa, Xenorhabdus bovienii
  Peptide sequence Name=Xb4151_4152.C426.gene65.pep
MYIDHRWRYKFMLCYHQGESLYQTAHTDIRRVAFWYCTVMVVVGLVLIPKSAFMPESRYRHSNKSGRCHVCTTSRYSDFWAIITCQLSTRAGRGFASCREGT

SEQ ID NO: 6754 - protein, 101 aa, Xenorhabdus bovienii
  Peptide sequence Name=Xb4151_4152.C426.gene66.pep
  Gene classification: Function=Uncharacterized BCR; Function class=S Function unknown
  Homolog annotation: Query=1..101bp; Hit=1..101bp; Blast score=132; Percent Identity=79.0; E value=8e-32; Homolog= ygfE COG3027
MSAQPVDIQIFGRSLRVNCPPEQVEALQAAAKELDQRLHNLKERTRVTNTEQLVFIVALNVCHELAQEKMKTRDYSYNMEQKIKMLQQTIEQALLEQGKIT

SEQ ID NO: 6755 - protein, 61 aa, Xenorhabdus bovienii
  Peptide sequence Name=Xb4151_4152.C426.gene67.pep
MPRQVVTLEPLVQGERSVAPIRLLGLAKHAHKKRSTTFYRYEISAQGTYLLTHTSEKFCSA

SEQ ID NO: 6756 - protein, 197 aa, Xenorhabdus bovienii
  Peptide sequence Name=Xb4151_4152.C426.gene68.pep
  Gene classification: Function=5-formyltetrahydrofolate cyclo-ligase; Function class=H Coenzyme metabolism
  Homolog annotation: Query=10..197bp; Hit=5..194bp; Blast score=220; Percent Identity=60.0; E value=7e-58; Homolog= VC2479 COG0212
MQSDPFLSLRKSIRKQIRQLRQNLSPEQQSRFAQQAAQNVVSHPKVQQANKVALYLSFDGELDTRPLIQQLWQQNKQVYLPVLHPFSRHHLLFLYYHAGTPLNYNRFNIEEPPLDVRQVLPVSELDVMFIPLVAFDNTGQRLGMGGGFYDRTLAKWQQQNFYPIGLAHDFQLVNLLPSASWDIPLPEIITPEKIWRW

SEQ ID NO: 6757 - protein, 413 aa, Xenorhabdus bovienii
  Peptide sequence Name=Xb4151_4152.C426.gene69.pep
  Gene classification: Gene name=SerA; Function=Phosphoglycerate dehydrogenase and related dehydrogenases; Function class=E Amino acid transport and metabolism
  Homolog annotation: Query=1..413bp; Hit=1..410bp; Blast score=627; Percent Identity=75.0; E value=1e-180; Homolog= serA COG0111
MVKVSLEKDKIKFLLLEGVHQSTVDNLRAAGYSNIEYHKGALEPEELKEAIRDARFVGIRSRTQLTEEIFEAAEKLVAVGCFCIGTNQVDLKAAEKRGIPVFNAPFSNTRSVAEMVLGELLLLLRRIPIANAKAHRGIWDKQAKGCYEARGKKLGIIGYGHIGTQLGILAENIGMHVHFYDIENKLPLGNAQQVHHLSELLNMSDVVSLHVPETGSTKNMIGVEELELMKPGAILINASRGMVVDIPALHDALECEHLSGAALDVFPSEPATNNEPFISPLSKFDNVLLTPHIGGSTQEAQENIGYEVAGKLVKYSDNGSTLSAVNFPEVSLPIHAKDTHRLLHIHENRPGILTSINQVFTDQEINIEAQYLRTNGDIGYVVIDITTQNPAQAEMVLQNLKALSGTIRSRLLY

SEQ ID NO: 6758 - protein, 60 aa, Xenorhabdus bovienii
  Peptide sequence Name=Xb4151_4152.C426.gene70.pep
LTICPSYRCLNFQNIHNEFHQNNKKNSNSNTIVCSRNRVNRSKKVVIRSNMTCYSLKTEF

SEQ ID NO: 6759 - protein, 219 aa, Xenorhabdus bovienii
  Peptide sequence Name=Xb4151_4152.C426.gene71.pep
  Gene classification: Gene name=RpiA; Function=Ribose 5-phosphate isomerase; Function class=G Carbohydrate transport and metabolism
  Homolog annotation: Query=1..219bp; Hit=1..219bp; Blast score=340; Percent Identity=83.0; E value=5e-94; Homolog= rpiA COG0120
MTQDELKKAVGWAALEYVKPGTIVGVGTGSTASHFIDALGTIKNQIEGAVSSSEASTEKLKNLGIPIFDCNEVDSLDIYVDGADEINDHMHMIKGGGAALTREKIIAAVAKKFICVIDESKRVDVLGKFPLPVEVIPMARSYVARELVKLGGTPVYRQNVVTDNGNVILDVHNLAILDPIALENKINGIAGVVTVGLFANRSADVVLIGTADGVKTIAE

SEQ ID NO: 6760 - protein, 52 aa, Xenorhabdus bovienii
  Peptide sequence Name=Xb4151_4152.C426.gene72.pep
MLPNLLLFSVRPVSYQSQPIISYKEKSGHQYKQYFASPGEKIWHSAVQHKKI

SEQ ID NO: 6761 - protein, 301 aa, Xenorhabdus bovienii
  Peptide sequence Name=Xb4151_4152.C426.gene73.pep
  Gene classification: Gene name=LysR; Function=Transcriptional regulator; Function class=K Transcription
  Homolog annotation: Query=1..297bp; Hit=1..297bp; Blast score=494; Percent Identity=85.0; E value=1e-140; Homolog= iciA COG0583
MKRPDYRSLQALDTVIRERGFERAAQKLCITQSAVSQRIKQLENMFGQPLLVRTVPPHPTEQGQKLLALLHQVELLEAQWLGDENGNDIPLLLSLAVNADSLATWLLPALHPVLSDVPIRLNIQVEDETRTQESLRRGEVVGAISIQSQPLPSCLVDKLGALDYLFVASPKFAERFFPNGVTRSALLKAPAVAFDHLDDMHQAFLQQHFDLSPGSVPCHIVNSSEAFVQLAKQGSTCCMIPHLQVDKELQAGELIDLTPGLCQRRMLYWHRFAPESGAMRKVTDTLLKLGRQMLRQEDEIS

SEQ ID NO: 6762 - protein, 235 aa, Xenorhabdus bovienii
  Peptide sequence Name=Xb4151_4152.C426.gene74.pep
  Gene classification: Function=Uncharacterized BCR; Function class=S Function unknown
  Homolog annotation: Query=1..234bp; Hit=8..233bp; Blast score=209; Percent Identity=55.0; E value=3e-54; Homolog= yggE COG2968
MMAVGSLSCMAASAADLPPAPHISTSGNAIIKAAPDIATLMIHVKVTQKSAADAKQKVDERVAKYFDFLKTNGIDKKDIDAANLRTQPEYQYEQKTGKSTITGYSASRSVEVKVRQLDQLSTLLDGALKAGLNEISSVQFSIDNPQRYRDEARQKAIENAIQQATALAKGFNSKLGPVYSVTYRSPEAMPFPISRLKYRSALMAAAPAEDSASETYEPQSIEFSDQVEVVFELQR

SEQ ID NO: 6763 - protein, 57 aa, Xenorhabdus bovienii
  Peptide sequence Name=Xb4151_4152.C426.gene75.pep
VGRGVNQQQKQPYRTNFLLPSLQRISVIYVSQNLLRIQQVNRHFLQFTVRQSAFQKH

SEQ ID NO: 6764 - protein, 207 aa, Xenorhabdus bovienii
  Peptide sequence Name=Xb4151_4152.C426.gene76.pep
  Gene classification: Function=Lysine efflux permease; Function class =R General function prediction only
  Homolog annotation: Query=1..203bp; Hit=1..203bp; Blast score=223; Percent Identity=63.0; E value=1e-58; Homolog= ZyggA COG1279
MLSTFIQGFFLGAAMILPLGPQNVFVMQQGSRKQFHLMSATLCATSDIVLITAGVFGGSALLGQSAFLLQAVTWGGVAFLLWYGWSAFRVALSANIELSRSENIVQNRSRVIVTLFAVTWLNPHVYLDTFVVLGSVGGGLSSELRSWFTVGAATASISWFFALSILAAWFSPVLNQPRSQRIINLFVGCVMWYIAWGLLKQGLQIFY

SEQ ID NO: 6765 - protein, 36 aa, Xenorhabdus bovienii
  Peptide sequence Name=Xb4151_4152.C426.gene77.pep
MAAPRKKPCINVESMQKFLIITQSAMLYMHIRKDRI

SEQ ID NO: 6766 - protein, 290 aa, Xenorhabdus bovienii
  Peptide sequence Name=Xb4151_4152.C426.gene78.pep
  Gene classification: Gene name=MscS; Function=Small-conductance mechanosensitive channel; Function class=M Cell envelope biogenesis, outer membrane
  Homolog annotation: Query=1..275bp; Hit=1..275bp; Blast score=321; Percent Identity=60.0; E value=5e-88; Homolog= yggB COG0668
MEEINLSGEIDKAANWFASNQELLIQYAVNVVSAIVILIVGLLVAKLANKAVKRVMSLRGIDATISDFLSAIIRYAIIAFTIIAVLGKLGIQTASVIAVIGAAGLAVGLALQGSLSNFAAGVLLVIFRPLRTGEYVIIGGVEGTVVQVQIFSTTLRSGDDRIIVIPNGKIIANDIINTSREPNRRTQIMVGVAYNADIDEVKRVLGNVVKADKRIQHEKGITIRLHEMAPSSLNFIVRVWTSNGDAWSVYWDLMEGFKRTLDQHNISIPFPQMDVYLHQQQAAVQKKVDE

SEQ ID NO: 6767 - protein, 43 aa, Xenorhabdus bovienii
  Peptide sequence Name=Xb4151_4152.C426.gene79.pep
MQKTNGKTSNTTYKSDGVSIMSKNPLWLNTNTYLWFFCKIKSL

SEQ ID NO: 6768 - protein, 124 aa, Xenorhabdus bovienii
  Peptide sequence Name=Xb4151_4152.C426.gene80.pep
  Gene classification: Function=Uncharacterized BCR; Function class=S Function unknown
  Homolog annotation: Query=2..121bp; Hit=17..136bp; Blast score=134; Percent Identity=54.0; E value=2e-32; Homolog= yacL COG3112
MMEYEFTQDIAGHVTTYFSMDHEAIGHWLNEEVKGDLSVLDKITSALAGIKGSERQWQLIGHEYTLLMSEGEIMIRANQLQFDTEMVEEGMSYYDNESLAFCGTDDFIGMLADYKDFILQKNQR

SEQ ID NO: 6769 - protein, 60 aa, Xenorhabdus bovienii
  Peptide sequence Name=Xb4151_4152.C426.gene81.pep
MTNRFMIHRKISCNVTRNILRKFIFHHAPHYIVDINHIWILNISAALTSETVHKLTQNLP

SEQ ID NO: 6770 - protein, 865 aa, Xenorhabdus bovienii
  Peptide sequence Name=Xb4151_4152.C426.gene82.pep
  Gene classification: Gene name=AcnB; Function=Aconitase B; Function class=C Energy production and conversion
  Homolog annotation: Query=1..865bp; Hit=1..865bp; Blast score=1527; Percent Identity=88.0; E value=0; Homolog= acnB COG1049
VLEEYRKHVAERAAQGIVPKPLDAAQAAALVELLKNPPKGEEDFLLDLLTNRVPPGVDEAAYVKAGFLAAIAKSETASPLVTREKSIELLGTMQGGYNIHALIDALDEEKLAPIAAKALSHTLLMFDSFYDVEEKAKAGNSHAKQIIQSWADAKWFLERPELAEKITVTVFKVTGETNTDDLSPAQDAWSRPDIPLHALAMLKNVREGIEPDQAGAVGPINQIEELNKKGHPLAYVGDVVGTGSSRKSATNSVLWFMGDDIPFVPNKRGGGVVLGGKIAPIFFNTMEDAGALPIEVDVSNLNMGDVIDIYPYKGEIRHHDTNELLATFGLKTDVLLDEVRAGGRIPLIIGRGLTTKARESLELPHSDVFRQAKAIEKSEGGFSLAQKMVGRACGTEGIRPGEYCEPKMTSVGSQDTTGPMTRDELKDLACLGFSADLVMQSFCHTAAYPKPVDVTTHHTLPDFIMNRGGVSLRPGDGIIHSWLNRMLLPDTVGTGGDSHTRFPIGISFPAGSGLVAFAAATGVMPLDMPESVLVRFKGKMQPGITLRDLVHAIPYYAIQQGLLTVEKKGKKNIFSGRILEIEGLPELKVEQAFELADASAERSAAGCTIKLDKAPITEYLQSNIVLLKWMIAEGYGDRRTLERRIIGMENWLKDPQLLEADADAEYAAVIEIDLAEIKEPILCAPNDPDDARLLSAVANSKIDEVFIGSCMTNIGHFRAAGKLLDQHKGQLPTRLWVAPPTKMDAAQLTEEGYYSIFGKSGARVEIPGCSLCMGNQARVADGATVVSTSTRNFPNRLGAGANVYLASAELAAVASLLGRLPMPEEYLQFMDKVDETAADTYRYLNFDQLNQYTEKANEVIFQTAV

SEQ ID NO: 6771 - protein, 43 aa, Xenorhabdus bovienii
  Peptide sequence Name=Xb4151_4152.C426.gene83.pep
LRYSSSTTYSSLSLSFYIPGCLHPVTIIKEQPSRVSGQRILLA

SEQ ID NO: 6772 - protein, 46 aa, Xenorhabdus bovienii
  Peptide sequence Name=Xb4151_4152.C426.gene84.pep
MLDNETQREYYSFIHHFFLLKPENASISICYIFLLYFLSQRSFQSC

SEQ ID NO: 6773 - protein, 43 aa, Xenorhabdus bovienii
  Peptide sequence Name=Xb4151_4152.C426.gene85.pep
LYCSEFKGFHLYFRVKISVRGAWFVSSFESSADSENITGKYNR

SEQ ID NO: 6774 - protein, 476 aa, Xenorhabdus bovienii
  Peptide sequence Name=Xb4151_4152.C426.gene86.pep
  Gene classification: Gene name=Lpd; Function=Dihydrolipoamide dehydrogenase/glutathione oxidoreductase and related enzymes; Function class=C Energy production and conversion
  Homolog annotation: Query=2..475bp; Hit=1..474bp; Blast score=867; Percent Identity=93.0; E value=0; Homolog= lpd COG1249
MMSTEIKAQVVVLGAGPAGYSAAFRCADLGLDTVLVERYSTLGGVCLNVGCIPSKALLHVAKVIEEAKALAQHGIVFGEPQTDIDKIRLWKEKVISQLTGGLGGMAKGRKVNVVNGIGKFTGANTLVVEGEKGATTINFDNAIIAAGSRPIQLPFIPHDDPRVWDSTDALELKTVPERLLVMGGGIIGLEMGTVYHALGSQIDVVEMFDQVIPAADKDIVKVFTKRISKKFNLMLETKVTAVEAKEDGIYVTMEGKKAPAEPQRYDAVLVAIGRVPNGKSLDAGQAGVAVDERGFIHVDKQMRTNVPHIFAIGDIVGQPMLAHKGVHEGHVAAEVISGKKHYFDPKVIPSIAYTEPEVAWVGLTEKEAKEKGISYETATFPWAASGRAIASDCAEGMTKLIFDKESNRIIGGAIVGTNGGELLGEIGLAIEMGCDAEDIALTIHAHPTLYESIGMAAEMYEGSITDLPNPKAKKKK

SEQ ID NO: 6775 - protein, 33 aa, Xenorhabdus bovienii
  Peptide sequence Name=Xb4151_4152.C426.gene87.pep
LSGGSDEKKPYSTGTYTPRAVYRIVNNLKSALT

SEQ ID NO: 6776 - protein, 31 aa, Xenorhabdus bovienii
  Peptide sequence Name=Xb4151_4152.C426.gene88.pep
MITIVTDILDLHLACWDFCHVNALFRLFTIL

SEQ ID NO: 6777 - protein, 616 aa, Xenorhabdus bovienii
  Peptide sequence Name=Xb4151_4152.C426.gene89.pep
  Gene classification: Gene name=AceF; Function=Dihydrolipoamide acyltransferases; Function class=C Energy production and conversion
  Homolog annotation: Query=1..616bp; Hit=1..630bp; Blast score=805; Percent Identity=76.0; E value=0; Homolog= ZaceF COG0508
MSIEINVPDIGADEVEVTEILVKAGDTVEAEQSLITVEGDKASMEVPSPQAGVVKEIKVAVGDKIETGKLIMIFESAKGAAEAAPVQQKAAASAAAESKVVNVPDIGGDEVEVTEIMVKVGDTITEEQSLITVEGDKASMEVPAPFAGTVKEIKIAAGDKVKTGSLIMVFEVAGSGAAPAAAPAPVAAAPAASAAKEVNVPDIGGDEVEVTEIMVKVGDTITEEQSLITVEGDKASMEVPAPFAGTVKEIKIAVGDKVKTGSLIMVFEVVGAAPAVALAAAPSLAVESVKAAPAASQPAEGKNEFAENDAYVHATPVIRRLAREFGVNLAKVKGTGRKGRILREDIQAYVKDAIKRAEAAPTAAAGGGMPGMLPWPKIDFSKFGEIEEVEMSRIQKISGANLSRNWVMIPHVNLFDEADITEVEEFRKQQNKEAEKKQLGVKITPLVFVMKAAAKALEAMPRFNSSISEDGQKLILKKYINIGIAVDTPNGLVVPVFKDVNKKGIMELSRELAEVSKKARAGKLTASDMQGGCFTISSLGGIGTTGFAPIVNAPEVAIMGLSRSSMKPVWNGKEFVPRLILPMSLSFDHRVIDGADGARFITYINEVMSDIRRLAM

SEQ ID NO: 6778 - protein, 887 aa, Xenorhabdus bovienii
  Peptide sequence Name=Xb4151_4152.C426.gene90.pep
  Gene classification: Gene name=AceE; Function=Pyruvate dehydrogenase, decarboxylase component; Function class=C Energy production and conversion
  Homolog annotation: Query=1..887bp; Hit=1..887bp; Blast score=1635; Percent Identity=87.0; E value=0; Homolog= aceE COG2609
MSDILKNDVDPIETRDWLQAIESVIREEGVERAQFLIDQVLNEARKGGVSVAAGVASRDYINTIPVEDEPAYPGNLDLERRIRSAIRWNAVMTVLRASKKDLDLGGHMASFQSSATFYDVCFNHFFRARNENDGGDLVYFQGHISPGVYARAFLEGRLTEEQMNNFRQEIGGNGLSSYPHPKLMPDFWQFPTVSMGLGPISAIYQAKFLKYLEHRGLKNTSQQTVYAFLGDGEMDEPESKGAITIATREKLDNLVFVINCNLQRLDGPVTGNGKIVNELEGIFAGAGWKVLKVLWGERWDELLRKDTSGKLVQLMNETLDGDYQTFKSKDGTYVREHFFGRYPETAALVKDMTDDEIWALNRGGHDPKKVYAALNKAQNTTGQPTVILAQTIKGYGMGDTAEGKNIAHQVKKMNMEGVRHFRDRFNVPVSDEHIEKLPYVTFDKDSEESKYLHERRNALGGYLPSRRVNFDEKLEMPALEDFSSLLEEQSKEISTTIAFVRALNVMLKNKSIKDRLVPIIADEARTFGMEGLFRQIGIYSPNGQQYTPQDREQVAYYKEDAKGQILQEGINELGAASSWLAAATSYSTNNLPMIPFYIYYSMFGFQRIGDLCWAAGDQQARGFLVGGTSGRTTLNGEGLQHEDGHSHIQSLTIPNCISYDPAFAYEVAVIMHDGLERMYGEKQENIYYYITTLNENYHMPAMPAGAEEGIRKGIYKLEAFDSAKGKVQLLGSGSILRHVREAAKILSDEYGIGSDVYSVTSFTELARDGQDCERWNMLHPSEEPRVPYIAQIMNEAPAIASTDYMKLFAEQVRNFVPVSEFRVLGTDGFGRSDSRENLRHHFEVDASYVVVAALGELAKRGEVDVKVVEEAIKKYNINPEKVNPRLA

SEQ ID NO: 6779 - protein, 35 aa, Xenorhabdus bovienii
  Peptide sequence Name=Xb4151_4152.C426.gene91.pep
MLPLKLLNKELTNCTDAAAKICTAKIIKPTPIREF

SEQ ID NO: 6780 - protein, 270 aa, Xenorhabdus bovienii
  Peptide sequence Name=Xb4151_4152.C426.gene92.pep
  Gene classification: Gene name=FadR; Function=Transcriptional regulators; Function class=K Transcription
  Homolog annotation: Query=17..250bp; Hit=1..234bp; Blast score=325; Percent Identity=79.0; E value=3e-89; Homolog= pdhR COG2186
MTNPKQHLLIEWLTADMAYSKIRQPKLSDVIEQRLEHLILEGSLRPGEKLLPERELAKQFEVSRPSLREAIQKLEAKGFLFRRQGGGTFVQSNLWQSFSDPLARLIADNQESQFDLLEARHALEGIAAYYAALRGTDEDFERIEKSHFAIQEAQQGGDVKAESDAVLQYQLVVTEAAHNVVLLHLLRCMIPILEQNIRRNFEFIYTRKEMLAAVSNHRTEIFRAIMAREPEKAREASHRHLAFIEEVLLDLTREHTRRERSLRRLQQHQE

SEQ ID NO: 6781 - protein, 40 aa, Xenorhabdus bovienii
  Peptide sequence Name=Xb4151_4152.C426.gene93.pep
MTLRITLAGIFLVRCLERVSPVNLVDPLTIIDYYSSIKFN

SEQ ID NO: 6782 - protein, 40 aa, Xenorhabdus bovienii
  Peptide sequence Name=Xb4151_4152.C426.gene94.pep
MSITLFLFSGKYYRYNTIMFFINSYFISFNVSISLYILNI

SEQ ID NO: 6783 - protein, 284 aa, Xenorhabdus bovienii
  Peptide sequence Name=Xb4151_4152.C426.gene95.pep
  Gene classification: Function=Membrane protein required for beta -lactamase induction; Function class=T Signal transduction mechanisms
  Homolog annotation: Query=1..283bp; Hit=1..283bp; Blast score=287; Percent Identity=54.0; E value=8e-78; Homolog= ZampE COG3725
MTLFILLLVLAWERVFKMGDHWQLERYLSPLFARMKLFSLWSSLGMTLLIALLTWKLIDVLSDVVFGVPGILLYIMISLLCIGAGSLRYDYREYLRAVRLDELDQQNNHLVRLTMIQGTLPDTTKDERLREIQNALIWINFRYYLAPIFWLVVMGKLGPAILMGYGFLRGYQGWLAQHGTTVQRAQTGVDSLLHCLDWVPARLAGIAYALLGHGEKALPAWVASLSDLRTSQYKVVSQLAQFALSKEPHLNPIETPVAAVRLAKKATLTIVIIVALLTIYGALA

SEQ ID NO: 6784 - protein, 180 aa, Xenorhabdus bovienii
  Peptide sequence Name=Xb4151_4152.C426.gene96.pep
  Gene classification: Gene name=AmpD; Function=Negative regulator of beta-lactamase expression; Function class=M Cell envelope biogenesis, outer membrane
  Homolog annotation: Query=1..180bp; Hit=1..180bp; Blast score=252; Percent Identity=66.0; E value=1e-67; Homolog= ZampD COG3023
MKLHEGWIDGARKVISPYYDLRPEGEIPSLLVIHNISLPPGKFGGPYIDQLFMGTLNSDEDPFFNEIKGLCVSAHCLIRRDGEIVQYVPFDKRAWHAGVSCYCDREKCNDFSIGIELEGTDYEPFSEIQYLRLAEVTQLLICHFPDIRNNITGHSDIAPGRKTDPGPYFYWEHYRQLLKE

SEQ ID NO: 6785 - protein, 56 aa, Xenorhabdus bovienii
  Peptide sequence Name=Xb4151_4152.C426.gene97.pep
MGFHLPDADHNMERLPSLHHQSTLHAASFFYSPQYLNSNIPNQVEWHHSKCNRLTC

SEQ ID NO: 6786 - protein, 53 aa, Xenorhabdus bovienii
  Peptide sequence Name=Xb4151_4152.C426.gene98.pep
MSAFIRMTKTEKNKIASVIVMEIARKNNYSLHFLQRNFRAGSQMKNTPEIVLD

SEQ ID NO: 6787 - protein, 160 aa, Xenorhabdus bovienii
  Peptide sequence Name=Xb4151_4152.C426.gene99.pep
  Gene classification: Gene name=HofG; Function=General secretory pathway proteins G and H and related periplasmic/secreted proteins; Function class=N Cell motility and secretion
  Homolog annotation: Query=23..160bp; Hit=4..142bp; Blast score=140; Percent Identity=46.0; E value=4e-34; Homolog= ZppdD COG2165
MPTSIGDHAPYHEKTHKGGRMNQQGFTLMELMVVMAIVSILGAIAIPSYQGYIQKAALTDMLQTIVPYKSGVELCRFETENYKDCNTGHASIPSGHNSRYISTVTVKDGEIIIVGQQNLNGLTTTLKPTQDTKTGVIYWRTICDTKNESLKLKCQETFKF

SEQ ID NO: 6788 - protein, 511 aa, Xenorhabdus bovienii
  Peptide sequence Name=Xb4151_4152.C426.gene100.pep
  Gene classification: Gene name=GspE; Function=Predicted ATPases involved in pili biogenesis, PilB homologs; Function class=N Cell motility and secretion
  Homolog annotation: Query=12..507bp; Hit=5..456bp; Blast score=394; Percent Identity=42.0; E value=1e-109; Homolog= ZhofB COG2804
MRNKENVLMEREINELCQRHQAIIIKREIHTMTIACSKSPNEDFIAALRFISGSIINVDIWPKAKIESMLTQGSSLVSCTENHCAENDDEEHYRIEKLDVPHSSHSEIQTNDAYSEDMDTPVIQLINQTISTSIQKRASDIHFEPAQRGYRIRIRVDGILHAVSSPSPQMNTGIPARLKIMAKLNIAEKRQPQDGQFAWNDSKNSYAIRISTLPTLHGEKIVLRVLNTIHQLSLEQLGLPEPQLQLLKQKIHLPQGMILVTGPTGSGKTVTLYSCLQYLNQAKKNICSVEDPVEIPLSGINQTPVNNKIGLDFAKVLRALLRQDPDIIMVGEIRDNETAEISMKAAQTGHLVLSTLHTNSTIDTLSRLQNLGISGYTTASCVKLIIAQRLVRTLCPHCRQQDKECTVINVDNAAIPIKKTDSVKQSISIRQWLAVGCEHCFSGYYGRTAIYEFLELQPTLQQTLSEHSIDNLPQLLAAQQHSTLFSAGLVLVEKGITTLEEVYQITGQETA

SEQ ID NO: 6789 - protein, 399 aa, Xenorhabdus bovienii
  Peptide sequence Name=Xb4151_4152.C426.gene101.pep
  Gene classification: Gene name=HofF; Function=General secretory pathway protein F; Function class=N Cell motility and secretion
  Homolog annotation: Query=1..399bp; Hit=1..397bp; Blast score=199; Percent Identity=34.0; E value=6e-51; Homolog= ZhofC COG1459
MKMEYIYQWQAVNKKGNIVKGESIGQSRQNVFQYLSHLDLQPYTIKCKKLIHYSEKEIAYRLHFIHQLSTLLASGIPLLKGLTLLLQECKQMLWRCVLTDIIQKISQGESFSTTLGHYPRLFSPLFRQLIAVGEETGQLETCCQLIINRLEQQDILRKKIQKAYRYPLIVAFVTILVILLMLIFVLPEFKQVYSSFNASLPLLTQWILSASDLLINHGVLLLAIASLLIISYLWLRHQFPKLKTREKMFLLKLPLFRQLTIYQQTNQIFHILFMTQKAGLTLTTGLECALNATHHPVFMAGIKNLYRQIQQGIPMSDALKKEMYFPPLCQQFVMIGEESGELELFLGNLAAWYQEQSISLADSLVQLLEPVLMLIMAVIVGLLLLAMYLPVFQLGTILT

SEQ ID NO: 6790 - protein, 207 aa, Xenorhabdus bovienii
  Peptide sequence Name=Xb4151_4152.C426.gene102.pep
  Gene classification: Gene name=CoaE; Function=Dephospho-CoA kinase; Function class=H Coenzyme metabolism
  Homolog annotation: Query=1..203bp; Hit=1..204bp; Blast score=223; Percent Identity=60.0; E value=1e-58; Homolog= coaE COG0237
MSYIIALTGGIGSGKTTISNVFSSLGVPLIDADIIAREVVAPGSPALQAIAEHFGSDILLPDGSLNRVFLRQKIFAVPAEKQWINALLHPLIHTETQQQLSQVTAPYAIWVVPLLIENNLMHLADRILVVDVPPEIQISRTMTRDGVSREQVENILAAQANRHERLEKADDVIFNHHNEQDIISRVAELHQQYLKQAESVRQENRNE

SEQ ID NO: 6791 - protein, 252 aa, Xenorhabdus bovienii
  Peptide sequence Name=Xb4151_4152.C426.gene103.pep
  Homolog annotation: Query=1..252bp; Hit=1..250bp; Blast score=333; Percent Identity=71.0; E value=2e-90; Homolog= gi|37527506|ref|NP _930850.1| hypothetical protein [Photorhabdus luminescens subsp. laumondii TTO1] gi|36786941|emb|CAE16015.1|
MSDATSTIIFEHPLNEKMRSWLRIDSSLQQLEKQQYLDSSASCLAFFRTIAELIEILERGEVRSELLKELDRQQAKLKQWLGSPDVDTAMIHLLIEQLKERSIALNKAPRLSQHIKEDRIINIVRKRLSIPGGCCSFDLPTLHLWLHLPQSVRDKTVKSWLDSLHPLQQALESILGLIRQSAIFSPKISHNGFYQGNADESDLLRLKLDVVLDALVYPQISGHKTRFAIRFLPMDSEHGVVPAHLSFELACC

SEQ ID NO: 6792 - protein, 65 aa, Xenorhabdus bovienii
  Peptide sequence Name=Xb4151_4152.C426.gene104.pep
  Gene classification: Function=Uncharacterized BCR; Function class=S Function unknown
  Homolog annotation: Query=1..63bp; Hit=1..63bp; Blast score=94; Percent Identity=76.0; E value=2e-20; Homolog= yacG COG3024
MSEVLTVACPTCAKTVIWGEINPYRPFCSKRCQLIDLGEWASEEKKIASQDDSSENDSWSEEPDR

SEQ ID NO: 6793 - protein, 105 aa, Xenorhabdus bovienii
  Peptide sequence Name=Xb4151_4152.C426.gene105.pep
MRSAFVQQSHYAAVCWRKLISDQFGLQNPTGRLPLFTKWLIFPLIHKVKIECDVSVRKFMSDGFHQFTMGYRDPHFFLQFPNKCLLRNFFLFKFSSRKFPKAAHM

SEQ ID NO: 6794 - protein, 31 aa, Xenorhabdus bovienii
  Peptide sequence Name=Xb4151_4152.C426.gene106.pep
MMPAAICRCFFSIIVFLAVDYLINVIISCGL

SEQ ID NO: 6795 - protein, 68 aa, Xenorhabdus bovienii
  Peptide sequence Name=Xb4151_4152.C426.gene107.pep
MNDASLIFKVRLYAFYVGFYLSANVRYRLPKCVHIIRFYLGESWQKAIRRDYGSHEINPVSFSYDCLL

SEQ ID NO: 6796 - protein, 545 aa, Xenorhabdus bovienii
  Peptide sequence Name=Xb4151_4152.C426.gene108.pep
  Gene classification: Gene name=Uup; Function=ATPase components of ABC transporters with duplicated ATPase domains; Function class=R General function prediction only
  Homolog annotation: Query=25..525bp; Hit=22..526bp; Blast score=245; Percent Identity=36.0; E value=7e-65; Homolog= PA1425 COG0488
MQSESQPLIEAKQIAYQFSGEIIPLFSGIDMVLNAEQHALVGRNGIGKSWLASILARQIPPTEGSVNHFRDVGYLSQGLTSFSGNAAEMLGLTEIMNANERILAGVGDVTDFDIMENHWDWQFQAESLLAEGELRPEVLKQPFSSLSGGEQTRLRLLALKYQGAEFMILDEPSNHLDRQGRLWLAQWLTNFSGGILLITHDPQLLQHVSVVYELSGLGLCRSTGGWETWLESKEQLRLGVQREVDQTRKNLKQALRDKQKDREKASKRQSQGKQRRENANQSKIILDRELGRSEATLSRQAKQHEERLQRSTSLATDARARLEIIDPLSITVAAPQIAPAPLLYLQNVILPFGSGSPISLTMNHSDRLAITGKNGSGKSTLLKVMAGLFPTKQGTCRITPSYRLMDQHFSFLDKNQSALHNFQLQSPGWPEDRYRTRLAQLRIRGEEALKPVGYLSGGEQLKVALACLFCGPYAPALLLLDEPDNHLDIESRELLQKALHSYTGAMVLISHDAQFIANIGNMQELLLGSSEDFLHKKTLKSFSER

SEQ ID NO: 6797 - protein, 902 aa, Xenorhabdus bovienii
  Peptide sequence Name=Xb4151_4152.C426.gene109.pep
  Gene classification: Gene name=SecA; Function=Preprotein translocase subunit SecA (ATPase, RNA helicase); Function class=N Cell motility and secretion
  Homolog annotation: Query=1..902bp; Hit=1..900bp; Blast score=1528; Percent Identity=86.0; E value=0; Homolog= ZsecA COG0653
MLIKLLTKIFGSRNDRTLRRLRKSVEIINHMEPDFEKLSDEELKAKTEQFRARLKAGESLEKILPEAFATVREASKRVFGMRHFDVQLLGGMVLNERCIAEMRTGEGKTLTATLPAYLNALGGRGVHVVTVNDYLAQRDAENNRPLFEYLGLTVGINLPNMPAPAKREAYAADITYGTNNEYGFDYLRDNMAFSPEERVQRKLHYALVDEVDSILIDEARTPLIISGPAEDSSELYIKVDKLIPKLIRQEKEDSEAFQGEGHFSVDEKTRQVNLTERGLVLVEELLVGAKLMDEGESLYSPTNIMLMHHVTAALRAHVLFTRDVDYIVKDGEVIIVDEHTGRTMQGRRWSDGLHQAVEAKEGVEIQNENQTLASITFQNYFRIYEKLAGMTGTADTEAFEFSSIYKLDTIVVPTNRPMIRKDLPDLVYMTEAEKIDAIIEDIKERTNNGQPILVGTISIEKSEVIAKALTKAGIEHNVLNAKFHAMEADIIAQAGQAGTVTIATNMAGRGTDIVLGGSWQSEIAKLEEPSQEKIEQIKAAWQERHDEVLAAGGLHIIGTERHESRRIDNQLRGRAGRQGDAGSSRFYLSMEDSLMRIFASDRVTGMMRKLGMQPGESIEHPWVTKAIANAQRKVESRNFDIRKQLLEYDDVANDQRRAIYAQRNDLLDVGDVSETIASIREDVFKVTIDAYIPPQSLEEMWDIEGLHERLVNDFDLDMPIKEWLDKEPELHEETLRERILEKAIEVYKQKEEIVSTEMMRNFEKGIMLQTLDTLWKEHLAAMDYLRQGIHLRGYAQKDPKQEYKRESFAMFANMLESLKYEVISTLSKVQVRIPEEVEALENQRREEAERLAKKQHLSHEVEQGALMSETEAQMASGARKLGRNDPCPCGSGKKFKHCHGSL

SEQ ID NO: 6798 - protein, 30 aa, Xenorhabdus bovienii
  Peptide sequence Name=Xb4151_4152.C426.gene110.pep
LMRQLCLDSLEDTIGWPQLWPYLRCINYAD

SEQ ID NO: 6799 - protein, 178 aa, Xenorhabdus bovienii
  Peptide sequence Name=Xb4151_4152.C426.gene111.pep
  Homolog annotation: Query=1..172bp; Hit=1..172bp; Blast score=198; Percent Identity=60.0; E value=3e-50; Homolog= gi|37527510|ref|NP _930854.1| hypothetical protein [Photorhabdus luminescens subsp. laumondii TTO1] gi|36786945|emb|CAE16019.1|
MSILNLWRQFGRRYFWSHLLLGMVATGIGVPAVLAGITESLPHSNTSSSQKNQNQVFSSFDHLFQLQSVQRQPSNHLNYWQQHAVRNIIRRLSFTFSITGPIQHEVAKESIRFSSPCMQQLMLDTLYAMLIQAPSQFESILDIEITATILPDSHTPALWVAKTQGIRAGPTANHLSLL

SEQ ID NO: 6800 - protein, 178 aa, Xenorhabdus bovienii
  Peptide sequence Name=Xb4151_4152.C426.gene112.pep
  Homolog annotation: Query=1..175bp; Hit=1..171bp; Blast score=229; Percent Identity=76.0; E value=2e-59; Homolog= gi|37527511|ref|NP _930855.1| hypothetical protein [Photorhabdus luminescens subsp. laumondii TTO1] gi|36786946|emb|CAE16020.1|
MRDSRPQSLDTLFEDEAAVGKSPLQIIQQHAIALLKLNRAMLSLLPAQLHPWCRVANYRKHILVLEAGNASWMTRLRYEVPVLLSTLRSEILPSLSSIDIRINPSLMVKRSNNAQDFAKSSTTAPNNNNQNLPKRQLSHESAETLMILAERSPEKLKRKLERLAALAGEGTSTAKKKC

SEQ ID NO: 6801 - protein, 316 aa, Xenorhabdus bovienii
  Peptide sequence Name=Xb4151_4152.C426.gene113.pep
  Gene classification: Gene name=LpxC; Function=UDP-3-O-acyl-N -acetylglucosamine deacetylase; Function class=M Cell envelope biogenesis, outer membrane
  Homolog annotation: Query=12..316bp; Hit=1..305bp; Blast score=568; Percent Identity=88.0; E value=1e-162; Homolog= lpxC COG0774
LAGWVTLRDIMMIKQRTLKRTVQATGVGLHTGKKVTLTMRPAPANTGVIYRRTDLNPPVDFPANAKSVRDTMLCTCLVNEHNVRISTVEHLNAALAGLGIDNIVIDVDAPEIPIMDGSASPFVFLLLDAGIEELNVAKKFVRMKDAVRVEDGDKWAELAPYHGFSLDFTIDFNHPAIDSSSQRYSLDFSADSFVRQISRARTFGFMRDIEYLQSQGLCLGGSFDCAIVVDDYRVLNEDGLRFEDEFVRHKMLDAIGDLFMCGYNIIGAFTAFKSGHALNNKLLQAVLAHESAWEFVTFEDEAEMPLAFRAPSTVMA

SEQ ID NO: 6802 - protein, 60 aa, Xenorhabdus bovienii
  Peptide sequence Name=Xb4151_4152.C426.gene114.pep
  Gene classification: Gene name=FtsZ; Function=Cell division GTPase; Function class=D Cell division and chromosome partitioning
  Homolog annotation: Query=4..60bp; Hit=330..383bp; Blast score=64; Percent Identity=59.0; E value=2e-11; Homolog= ftsZ COG0206
VPPQVSQSIHGSRYRQSSVEIPSLSEEKKTAAKVVNDQNAQTSKEPDYLDIPAFLRKQAD

SEQ ID NO: 6803 - protein, 675 aa, Xenorhabdus bovienii
  Peptide sequence Name=Xb4151_4152.C427.gene1.pep
  Gene classification: Gene name=GlyS; Function=Glycyl-tRNA synthetase, beta subunit; Function class=J Translation, ribosomal structure and biogenesis
  Homolog annotation: Query=1..675bp; Hit=1..675bp; Blast score=1072; Percent Identity=81.0; E value=0; Homolog= glyS COG0751
MIQQTFLVEIGTEELPPKALRSLAESFAANFEAELKNANLGHGEISWFAAPRRLALKVANLAVAQADREVEKRGPAIAQAFDAEGKPTKAAEGWARGCGITVDQAERMVTDKGEWLLYRAQVKGREAKELLADMVSSSLGKLPIPKLMRWGDKETQFVRPVHTVTMLLGSDVIDGEILGIKSDRIIRGHRFMGEAEFAIDNAEQYPTILQERGRVIADYYARKALIKRDAEQAAMQLGGVADLTDSLLEEVTSLVEWPVVLTAKFEEKFLEVPAEALVYTMKGDQKYFPVYDKSGKLMANFIFVANIESSDPQQIISGNEKVVRPRLADAEFFFKTDRKQRLEDNLLRLETVLFQKQLGTLRDKTDRIQALAGWIAEKIGADVTHATRAGLLSKCDLMTNMVFEFTDTQGVMGMHYARHDGEAEDVALALNEQYQPRFSGDELPSTAVSCAVAIADKMDTLAGIFGIGQHPKGDKDPFALRRAALGVLRIIVEKKLPLDLQTLAEEAVRLYGDKLTNENVVDDVVEFMLGRFRTWYQEQGYSVDAIQAVLARRPTQPADFDARMKAVTHFRTLDEAVSLAAANKRVSNILAKSEEKLNDCVLASVLKAAEEIQLATHLVVLKDKLAPLFAEGNYQDALVELASLREVVDAFFDNVMVMDEDQQVRINRLTLLSEL

SEQ ID NO: 6804 - protein, 302 aa, Xenorhabdus bovienii
  Peptide sequence Name=Xb4151_4152.C427.gene2.pep
  Gene classification: Gene name=GlyQ; Function=Glycyl-tRNA synthetase, alpha subunit; Function class=J Translation, ribosomal structure and biogenesis
  Homolog annotation: Query=1..302bp; Hit=1..302bp; Blast score=605; Percent Identity=94.0; E value=1e-173; Homolog= ZglyQ COG0752
MQKFDTKTFQGLILTLQDYWARQGCTIVQPLDMEVGAGTSHPMTCLRALGPEPIAAAYVQPSRRPTDGRYGENPNRLQHYYQFQVIIKPSPDNIQELYLGSLKALGLDPTVHDIRFVEDNWENPTLGAWGLGWEVWLNGMEVTQFTYFQQVGGLECKPVTGEVTYGLERLAMYIQGVDSVYDLVWSDGPLGKTTYGDIYHQNEVEQSTYNFEHADVDFLFTCFEQYEKEAQELLALEAPLPLPAYERILKAGHTFNLLDARKAISVTERQRYILRIRTLTKSVAEAYYASREALGFPMCKKN

SEQ ID NO: 6805 - protein, 195 aa, Xenorhabdus bovienii
  Peptide sequence Name=Xb4151_4152.C427.gene3.pep
  Gene classification: Gene name=Tag; Function=3-Methyladenine DNA glycosylase; Function class=L DNA replication, recombination and repair
  Homolog annotation: Query=10..188bp; Hit=3..181bp; Blast score=256; Percent Identity=61.0; E value=7e-69; Homolog= Ztag COG2818
MEFINKESIRCGWVTADPDYLAYHDNEWGKPLKNSQQLFELLCLEGQQAGLSWLTILKKRQGYRKCFHQFDPVKIAGMDENDVEQLLKDPAIVRNRTKINAIIHNARIYLQMADQGEDFSSFIWHFVDDSPLINHWKSRTDVPVRTPISDDLSNALKKRGFKFIGSTTCYAFMQAAGLVNDHLTSCLCRKIEINA

SEQ ID NO: 6806 - protein, 418 aa, Xenorhabdus bovienii
  Peptide sequence Name=Xb4151_4152.C427.gene4.pep
  Gene classification: Gene name=AvtA; Function=PLP-dependent aminotransferases; Function class=E Amino acid transport and metabolism
  Homolog annotation: Query=1..416bp; Hit=1..416bp; Blast score=662; Percent Identity=74.0; E value=0; Homolog= ZavtA COG0436
MKFSQFGNKFTQDSGITRLMNDLNQGLRTPGTIMLGGGNPAHIPEMDDYFQQILADLVSSGQLTETLCNYDGPQGKNTLIAALAQELQEKLGWEIHPQNIALTNGSQSAFFYLFNLLAGRSEDGSMKRVLFPLAPEYIGYSDSGLDEGLFVANKPNIELLPNGQFKYRVDFDHLNISEDISLICVSRPTNPTGNVITDEELLRLDGLAQQHQIPLLIDNAYGVPFPGIIFNDATPLWNPNIILCMSLSKLGLPGSRCGIIIANEKIISAVSNMNGVISLAPGGVGPAIALEMIRRNDLFRLSQNVIQPFYKTRVDNVIEIIRRHMSEDLCLIHKPEGAIFLWLWFKNLPITTEVLYQRLKKRKVLMVPGHFFFPGLEHNWPHAHQCMRMNYVPDLEKIEEGIRILSEEIEIAHREATR

SEQ ID NO: 6807 - protein, 349 aa, Xenorhabdus bovienii; identical to SEQ ID NO: 5796
  Peptide sequence Name=Xb4151_4152.C427.gene5.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 6808 - protein, 332 aa, Xenorhabdus bovienii
  Peptide sequence Name=Xb4151_4152.C427.gene6.pep
  Gene classification: Function=Predicted transposase; Function class=L DNA replication, recombination and repair
  Homolog annotation: Query=1..285bp; Hit=1..281bp; Blast score=306; Percent Identity=55.0; E value=2e-83; Homolog= Z4330 COG3335
MKKFIHKTRDKDYARRLMALLMLHEGKTVSAISRTLHCSRSSVNRWINWFTLYGLEGLKSLPSGRPAIWNLAPLFSLLSFLLQHSPQDFGCLRSRWSIELITRIINELFGLSLSQSTFYRYFCQVGIVWRRAAPTVKKPDPEYDEKMAKITEALSSVSEQHPVFYEDEVDIDLNPKIGADWCLKGQQKRVMTPGKNQKHYFAGCLDAQTGQVTYVSGIKKNSDLFINMLKELNGQYRHAKNITLILDNYGIHKSRKVRAWLQQNPKFNLLFLPVYSPWINKIERLWQSLHETVTRDHCCQYMWQLLKCVEAFINAFSSGQQPGMRKMSVSLL

SEQ ID NO: 6809 - protein, 42 aa, Xenorhabdus bovienii
  Peptide sequence Name=Xb4151_4152.C427.gene7.pep
MQVIAAVVEFERDLLLERTYSGITQKRPGLSILDLSTLNRPM

SEQ ID NO: 6810 - protein, 392 aa, Xenorhabdus bovienii
  Peptide sequence Name=Xb4151_4152.C427.gene8.pep
  Gene classification: Gene name=AraJ; Function=Arabinose efflux permease; Function class=G Carbohydrate transport and metabolism
  Homolog annotation: Query=1..376bp; Hit=1..375bp; Blast score=242; Percent Identity=42.0; E value=6e-64; Homolog= mlr2770 COG2814
MPAAIWALAIATFGIATTEFIIAGLLPEIATEFNISIPMAGYMATSYALGVFVGAPVLIILGRQVERKKMLAILMMLFIIGNALTALAPTFYLAIVGRIVTSLTHGAFMGIGAIIAAELVAENKKTSAIAFMFSGMTLANLIGIPLGTWIGKIISWRVTFAIITFIGIIALLGILKLLPKFTQQTPTSIKKELLAFTNIHVLLAMGITVLGPAAFFTAITYIAPLMTHIAGFSESAITWILVVLGLGFFFGNIVGGKLADKAMMPLLYWTLGLQALVLFIFWLYGDNPFIACLSIFLMAAFGFATVSPIQRLVMDKAQEAGAPNLVSSVNIGFFNLGNALGAWLGGIVIAANYGYASLNLVGGLLASTALLLAVISGFLTYNKARVEVLKSS

SEQ ID NO: 6811 - protein, 74 aa, Xenorhabdus bovienii
  Peptide sequence Name=Xb4151_4152.C427.gene9.pep
MAQALVKFLNQQFIDVDGEEYPFIRGVATGFAKQKKRRQIPLPAANPSRKWLFTWEKDHQWVNGVAYVEKHTRR

SEQ ID NO: 6812 - protein, 231 aa, Xenorhabdus bovienii
  Peptide sequence Name=Xb4151_4152.C427.gene10.pep
  Gene classification: Gene name=CitB; Function=Response regulator containing a CheY-like receiver domain and an HTH DNA-binding domain; Function class=T Signal transduction mechanisms
  Homolog annotation: Query=15..220bp; Hit=24..218bp; Blast score=62; Percent Identity=23.0; E value=4e-10; Homolog= PA1347 COG2197
MSFSYKNNEPYFKGLIAMMEHLSDPWGIKDLASRHIYMNKAAYLYTNTPEDFDIEGKLDCEFPTHWSEDQFSQDLKEHDRRTEESKDKVSIIETHYWYGKNSLAPFISEKFPVYNDKKECIGIVWNAKPMSTLSPLKYINRQKPSVLTTEATTDLFTKSELDTIFFMLQRRSNKEIAQIYNVSHKTIENRIYTIYQKANVHSTQQFEEFCMQFQLDRYIPERLIEKGVLFI

SEQ ID NO: 6813 - protein, 198 aa, Xenorhabdus bovienii
  Peptide sequence Name=Xb4151_4152.C427.gene11.pep
  Homolog annotation: Query=6..172bp; Hit=14..178bp; Blast score=130; Percent Identity=41.0; E value=9e-30; Homolog= gi|37525441|ref|NP _928785.1| hypothetical protein [Photorhabdus luminescens subsp. laumondii TTO1] gi|36784869|emb|CAE13783.1
MEHLRKNLQYLLDSRGESRVSICDRTGLNRTTIYNILDGRVQNVHSSTIQKVSNFFGVSYREIETIDIAEKERIDAIVSYEGNMNPCAVPLFMQSECIISGFFDSKIGSLIVERKLTYYFGSGPNIVAILLENDFPGKYNAGDLLIIKRGNYQNNNPKLCFDQRQQLFHIKEFNSEVTTNLMVIGDIMEERFGYGKKI

SEQ ID NO: 6814 - protein, 285 aa, Xenorhabdus bovienii
  Peptide sequence Name=Xb4151_4152.C427.gene12.pep
  Gene classification: Function=Uncharacterized ACR; Function class=S Function unknown
  Homolog annotation: Query=69..282bp; Hit=1..209bp; Blast score=74; Percent Identity=27.0; E value=1e-13; Homolog= TM0792 COG1738
MGKKYKLLGFNGQDSTANVLILSTGKILKINVKELEKSEIADDLDNHEIKSLYRKIYSSFPNVPSVYEIEERNEKSWVVYSFLALLLTIFYTFSNIAAAKPVYIDYLDIIVTPGTFIYPFSFLVIDLLSEFYGFRLARKAIYMSLASNLIIVSLLSISTSLPAIASWDLNDQYNALMSHILSAIFASSLSFLVSELVNSYILCKLKDVTNSRFLALRVFFSTFIASILDSFVFCFIAFYGKLPVNQIVVMMIVQILIKIFFALFNIFPAYGSRYLFNRWVGKTAN

SEQ ID NO: 6815 - protein, 178 aa, Xenorhabdus bovienii
  Peptide sequence Name=Xb4151_4152.C427.gene13.pep
  Gene classification: Gene name=AcrR; Function=Transcriptional regulator; Function class=K Transcription
  Homolog annotation: Query=3..162bp; Hit=9..170bp; Blast score=120; Percent Identity=38.0; E value=7e-28; Homolog= mlr7895 COG1309
MSKKEHILDIAESLFNEFGYNAVGVDLIRDKANVSKTSMYRYFGSKNKLIESMLIRRHKRFEEELNTVVFATKGTENKLNAILDWHFSWFRSADFQGCLFMHALAEFKGHDELIVKQAQRHKTWLKSLLSSIFSANQTDAEIKTEALMTFIEGMIVRAEFGEMTGHEKIYRLSAKILV

SEQ ID NO: 6816 - protein, 176 aa, Xenorhabdus bovienii
  Peptide sequence Name=Xb4151_4152.C427.gene14.pep
  Gene classification: Function=CBS-domain-containing membrane protein; Function class=T Signal transduction mechanisms
  Homolog annotation: Query=25..167bp; Hit=45..184bp; Blast score=122; Percent Identity=48.0; E value=1e-28; Homolog= slr0789 COG3448
MSKLRGGGGLPPKPDLVQLTKGLSGGFLGILLLSYLSQTTEYPWLMAPFGATCAILFAAPTSPLAQPRNVIGGHLLTTAVGLVALYTLGNSMIVMSLAVGIAIMLMQLFRVVHPPAGANPLVVLLAGQEAVGFDFLLTPVLTGSLALVIIASFLNNLGKESCWPLYWYGFTKRKDS

SEQ ID NO: 6817 - protein, 3788 aa, Xenorhabdus bovienii
  Peptide sequence Name=Xb4151_4152.C427.gene15.pep
  Gene classification: Gene name=EntF; Function=Non-ribosomal peptide synthetase modules and related proteins; Function class=Q Secondary metabolites biosynthesis, transport and catabolism
  Homolog annotation: Query=2282..3543bp; Hit=1..1276bp; Blast score =602; Percent Identity=32.0; E value=1e-171; Homolog= PA2400 COG1020
MDNILASPFTRLFWNEWILEPDSVKYNMVMDQTIQGDLDESKLRSAIQGLINQYPLFQYQLDEENGELYWKPGPNSLNTLQIFDSEEKLRQFALQPFDLRQGSLIRFGLFQQAERQFQLVIVLHHIVVDGGSTEEFYHSISDLYNQRPLRHTPLTLDQIAEKFAQYRQQIKTLEEHQPEQFWKTCLTEVAATNPLPYLSELAEDEQELVGEVRFNLPLNDWLHLKRSLRHCTPFLVFKTLWAALIAQYMPDGKVHVSYPVAVTGGESLSLGAQINTAVFPLQLDDTVSFASLYRQTLHYTSSLKAPSGLRFSYWPLFKVLPFTPIRKLNVVVNQAHFKDFCLELEGCEVHYNHRFDNDLADSEWALEYQQQDDQWSFRIRYPRRRFHPEQITALAEQFQQLLVNALTNPEKPIRQFPFLTPDQRITLLKCGHQGEQGDVPETTIHEKFQQQVCLHPQQIALIDNQQQLSYAELEQRSNQLAHLIRERYLQATGQSLSPDTLLPIFMNRGVDMVIAMLAVMKAGAAYLPLDPQVPTQRLAYILTDSQSRLAITDMTHQTILRDYGQNLALLTFGNDWDDYRDQPDSAPQTASEPSSLAYSIYTSGTTGRPKGTLLEHRGVLLMLDGLYARVIEGIERPQRWLQFASLAFDAHVFETFMALCFGHTLVIASEEERHDPELLKKLIETYQVEVATFPPTLLKTKPALPARLQNILVGGEATPQTILDHYAMQGRRIFNAYGPTEASVCVTMHHYQWDGAQNIGRPFPGIQAYVLDEQLQLVPMGMSGELYLSGAVLARGYLGQPELTAKAFIANPFAQHTDDQRLYRTGDQARWLPNGELEYLGRKDFQVKIHGYRIELAEIEQVFIAASGLSQCAAQVRGQDRSHIVLYYVSEITLNEDNLRRTLQLSLPDYMMPSAFVQLASLPMTISGKLDATALPEPDFKQSRYVYRAAETELEHRLQNIWHGILGLDEIGIDDDFFHLGGDSISAIRLVSEMRRQQLPCSTKLLYQCRTIAELAVQLATTPDSQMMHSEQGILQGDFPLHPIQHWFFEQVFAEPHHWNQAFLIRVPPLQPHKLETAIQALVERHDMLRARFIPAERQIYLDINQVAPMALEICHYDPLTDGALHDCLDSWQRDFDITAGPLWRFAYIDGYPDGSARIYCALHHLIVDAVSWRILLDDLKQLYHDKNLGAKTASYRQWQTALTEQLSGFESQCEFWQQQCVSQSDYRPLLEASHTRQFLQQSLEPAASIRLLSVTTGAASFAPNEVLLTAFLHVLGHLSGIANHTLLLEGHGRHLPSVQLDVGRTVGWFTALYPLHFSAEGEEAISLQQVHATLGGVPDSGISFGALRHLGAEASALSLPYSGVIFNYLGQLQAPENDWQISAESAGQTISPRNVDSGLLTLNLWLIGQELHYRWDGLLSQSQLAQLDHGFQTALISLIDTMAPSASKIQQTVDDGIDTALLARLPAGLTPVVAYPANSLQQGFIHHYLSHPDNSTYHFQFVLDYEQPIDLNDYYRAWEYAQQRYPVLRTGFDWQEQPQQIVFRQAELLWQYHDLSTCSTQEQALTALCQQQYHQSFELNKPELMRVCFVKLAADRYSLIHTSHHIIIDGWSSQILLEYVHRTYQQLQAGQMPDTRTDTAYLATQRYYASQIAECRHHWQQRNTRHWESTDISLLFNHNLSNTTRNDVPETQATAHHTLPHADALSLQETARNHGLTLNIMLQFAWHKLLHLFSQQSQTIVGITLSGRNHPVSGIEHSVGLFINTLPLVMDWEPQSTCLQQLRTLHQRMIDLDTYSYQPLAELQPAGEKLFQSIFVYENYPTTALDTLRGNLRTASGNNTDYPLNLIAEGNVEQGLTLSLSYNQNCLDAERANAILQMLGTLLARLPSHLHYPHPQLLALSDDKRRQLLEEWAFAVDQGLELMTLHGLLERQARLTPQNPVLMDDHRTLSYQELDEITSHQAVRLRAAYRRLFQRELASGELIGLCCGRSIDMVVALLAILKAGAAYVPMDTNVPAERLNYILQDSQIRLVLTEPDLAPLFERPDLQQLYLSELADTEATDDIPQPLPQVEPRQLAYVIYTSGTTGRPKGTLVEHCGSAAMARSLFARMEMEQSGVRFLQFSSIVFDAHLMEIFPALVGGHSLVVASDAQRYDLQELQTLLQKWQIGYAMLPPVLLKLKPTLPASLQWLIVGGEATSQDVFDHYADQGINVFNCYGPTESSVCCIVNPYRYNGARNIGRPLAQCAAYVLDSDLQPLPVGAPGELFLSGVGLARGYLNQPELSREKFIPNPFQQHPDHARLYRTGDIVHWLDGGSLEYLGRNDSQVKIRGHRIELGEIECVLANIEGVDQAVAIIHGKESPKIVCYYTVSPLNSSNSIDSSEIRQILAQVLPHYMQPSALIPLPRIPMTINGKLDRRLCPAPVFTDVQQEYTAAETPLQQQCCDIWAALLQCERIGIDDNFFRLGGNSIIAIQLSNRLSQLLQCTIPLVALNRHPTVRSLSAFLSGNCTHLDQIPQAGLQRGSLSFAQLRLWFIETLMQENNVYHIPLLFRLQTDIQTDSFVHSLQAVVHRHQILRCTFEQDEHGKSFLQAHDEALAVVHAEVQADEWHDFLQKEIFRVFDLRCEYPIRATLLQRTESDGQVSHFCLLNIHHISFDGWSLNVFLKELAEFYGAELNNRPPALPPLSIQYMDYAAWQQQMLSSDKLEQLKQFWLKQLQDCPQLELPCDYPRPDIFDHRGSTTFFSLTPQLSHQLRQLARQLDVTLHAVLLTGMNLLLVRYCGKHDIVIGSPIANRSHPQLEPLIGMFVNMLVLRNQVSSEWSVAEQIRQVFASTITSQQHQEMPFEKLVEFLKLNRDLSRHPLFQISFSLEQKATDVDAPFSMQNLAELYDVAKFDLSFGFEEGNDALSGNINYAKALFAPETINEMVRHFQNILMQMVAHPEQLVQDISLYSPEERIALLQPPMETQDAALYSYPLYQGLLDWTRQQPNDIALIDTLGQCSYAEVLQAAQTLAAQIHQHPRNQSELIVIQVSKGRAQIIAVLAVLLAGRAYVPVDISWPQQRCQQIIDQTDTQLVISSKAWATETCGIIQLDPYGCAINLTEPQPMSLPVPIACDSLAYVIFTSGSTGTPKGVAVRHDTACNTLIDINRKLNVVRGDTLLALNALCFDLSVYDMFGILGVGGRLVIPSEEQRYQPEILLRLICEHSVTIWNAAPALFELLLQEVENLAERPTVAMDRVLLSGDWIPVNHIPRCRDWLPGCRVFSGGGVTETSVWSILFEVPQGAGYSQSIPYGKALVNQYFLILDKDLEPVPAQAIGEMYIGGIGVAIGYYRDPVRTEERFLYHPISGERLYRTGDLGRWLPDGNIEFLGRIDSQIKINGYRIELGEIENTLMAIPGIRQCALVKVSGLSDSLAAYYVSDEPLDETDVRQHLAQVLPPYMVPSVLTHLPKLPLNASGKIDRKQLSALNYIAPRQHQYQPPETEQEQQLCQLWQQKLELDHVGVNDDFFECGGTSILAIPVCQQMSVLLGQAVTVMELFKRRSIRGILASLEYQLIQPLNNGSAKETLWMIHPAMAGCEVYLDIARTLDGKLTCLGVDNYNLYHRPLIMSLRDIASFYLEQMERYQPLTQGPVRILGWSMGGLIALEIAAQLEARGIRDIHLYLLDSFYRVSLGALHPSWRQMLLQELGLEGDAAVRALEAGPADDAICQHELLQPLQHSPVTLFKATQLPEFHAQLNEQGKIPAALHADDNQIGQACRHLSVIPLPCDHHNIIELKSQIIEGVLELVD

SEQ ID NO: 6818 - protein, 695 aa, Xenorhabdus bovienii
  Peptide sequence Name=Xb4151_4152.C427.gene16.pep
  Gene classification: Gene name=SpoVK (BS); Function=ATPases of the AAA+ class; Function class=O Posttranslational modification, protein turnover, chaperones
  Homolog annotation: Query=436..691bp; Hit=512..767bp; Blast score =193; Percent Identity=42.0; E value=5e-49; Homolog= mlr6544 COG0464
MNIASVFSDPFKEDNDPNLAFLFSQLERIDLVLQYHFHCITDQRSDLLDEFLLSEEDVIARLDKPLGKPHWVNDDYLAIPQTVNPVASRLTDLIARFDLTDFERDVLLLGLLPHFDSRYYHLFALIQGEQQSRLPCFALALELFCHSPLEKQAQQASFLHRAPLIGCQLLSVDSRQKTLTWLQTAFVTDSGVYHFLLGHHYITPALEHYAEWITPIETGGYPTGLKQALGNLLLPDHEDIRSIVLLRGTAGSARAHVVANMMASEKRQTLWVDIAKLADGDDKTTLFQIKHILREIRMRGACLLLRNFCLLAEKNKQLLDSLSALLNQPELRVICLVEPYSPLIWLKKLPTLLVEMPVFTSVEKNRLLTANLPHNCSEDIDVITLSQRYAFNPETLPLILQEAQIYQQQRDPSGILQQCDIRKALNLRAQQNFGQLGQRITPKRSLKDLLVSDEVAQQIQEILMAIKYREQILAGGFKDKIGYSAGISALFYGDSGTGKTMAAEVIADCIGVDLIKVDLSTVVNKYVGETEKNLSRIFDLAKQDAGVLFFDEADALFGKRSETKDAQDRHANIEVSYLLQRLENFPGLVILSTNNRNHLDSAFNRRFTFITRFTYPDEKIRKKMWQSIWPKNIKLSKDIDFNKLAKETSVTGANIRNVALLSLFLAAGKGNDEVNNEIIEMALVRELAKMGRLSF

SEQ ID NO: 6819 - protein, 96 aa, Xenorhabdus bovienii
  Peptide sequence Name=Xb4151_4152.C427.gene17.pep
  Gene classification: Gene name=LysR; Function=Transcriptional regulator; Function class=K Transcription
  Homolog annotation: Query=1..85bp; Hit=8..92bp; Blast score=62; Percent Identity=35.0; E value=7e-11; Homolog= ygfI COG0583
MFTSKELLNFIAVAKNKSINKATQERFITQSPICRSLKKLEFSLGVKLFQRKSHGLVLTEEGECLYNKVSPICEQLENIENDYKNHKLPYCSVYQK

SEQ ID NO: 6820 - protein, 95 aa, Xenorhabdus bovienii
  Peptide sequence Name=Xb4151_4152.C427.gene18.pep
  Homolog annotation: Query=2..90bp; Hit=141..230bp; Blast score=96; Percent Identity=55.0; E value=1e-19; Homolog= gi|37525592|ref|NP _928936.1| hypothetical protein [Photorhabdus luminescens subsp. laumondii TTO1] gi|36785020|emb|CAE13944.1|
LLGTGIGTGINLLGNMAVDKLDEKLKIAHPYPKTMNMIFDINNYDKNFVTKTIKNNFQKDNLKDTVGSGIVSGIAGKLSPVKIPIYKISDFGCIT

SEQ ID NO: 6821 - protein, 58 aa, Xenorhabdus bovienii
  Peptide sequence Name=Xb4151_4152.C427.gene19.pep
MKAILHRLLGLKILGWAYSNELSENNESSTERHTRGYLSGNSVSIHKTGRQKCLCHVE

SEQ ID NO: 6822 - protein, 59 aa, Xenorhabdus bovienii
  Peptide sequence Name=Xb4151_4152.C427.gene20.pep
MLSLCAYSDFKEITLDLFMKVTISGVFNLTEGFEISQPQYNTDRTDTNIHVVVSFGQRS

SEQ ID NO: 6823 - protein, 478 aa, Xenorhabdus bovienii
  Peptide sequence Name=Xb4151_4152.C427.gene21.pep
  Homolog annotation: Query=1..476bp; Hit=1..476bp; Blast score=657; Percent Identity=65.0; E value=0; Homolog= gi|37527439|ref|NP _930783.1| hypothetical protein [Photorhabdus luminescens subsp. laumondii TTO1] gi|36786874|emb|CAE15940.1| unn
MNYDVIVVGSGAIAGSIAYELVGRQLKVCRLGRLDRSNAASRAAGAMNGCFGEVTSGLIASDYGKLKLKMDRIAKDRWSTWAQRLAASSGDTRPLFTAKGTHVILNTAGMEVVDSVNYDAIESVLREYNEPYEVIEPRSIKGMKPNDLVRSLKGLYIPEEHALNSHLLLEMLDAALLREGGEIVDNNVKRVLTENGIIVGVETVDGVRFTANKVIIAAGVQSLDILSDQTSIVQKIPPLFAGYGVSVLLKVKNPDELPTSVIRTPNRAFACGLHCVPRSDGVLYVGATNLLSNQPRTHATVATIQFLLECAYNQINVDLFESEILAIQVGNRPISADGFPLIGSCGIDGLWLVTGTYRDGLHQSPLLADYVANALMGLPNLEIDLADFTPIRRPLVGLSRDMTISEAAKQTVAMGYEFIWNLKPGWDELIYKSLLNIYGAQVESIDAIYTPPPDLVAFSCKDEQITKRLRDYYRCWKK

SEQ ID NO: 6824 - protein, 32 aa, Xenorhabdus bovienii
  Peptide sequence Name=Xb4151_4152.C427.gene22.pep
MEAFQFYYHWELDYLRQLEKLVGEEKGHVLND

SEQ ID NO: 6825 - protein, 91 aa, Xenorhabdus bovienii; identical to SEQ ID NO: 5467
  Peptide sequence Name=Xb4151_4152.C427.gene23.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 6826 - protein, 336 aa, Xenorhabdus bovienii
  Peptide sequence Name=Xb4151_4152.C427.gene24.pep
  Homolog annotation: Query=24..326bp; Hit=97..397bp; Blast score=114; Percent Identity=31.0; E value=3e-24; Homolog= gi|37525966|ref|NP _929310.1| hypothetical protein [Photorhabdus luminescens subsp. laumondii TTO1] gi|36785395|emb|CAE14342.
MTPDYVKDSVRESIEDHAKSRNHPDATLQDKGFVTLSNDVGSDSENNAATPKAVKAAYDLANTANQNANNAGANANTRLAKEQNGADIPNTPEFVKNIGLDNALKVGDYGIGGPGITVEPGQTVEDLAGKTGFYQRGSSPIPPDSPRGTEAMKYLSIGPGWWATQLAFDAYRNIAWIRSRIAASKSFQKWSQFSILGVNTFMDANGNFKLSSSIINLWSDGKFETNNESKGATVERISEGIYLIKGVKGFNIDGTMNNIEIPLCQNKLPLIWVNHEVLSDGTVKLMTYHREHSDAPAFARNTREGYSDGDLIDIPSGRFVSVRVQMPATEDKESQA

SEQ ID NO: 6827 - protein, 123 aa, Xenorhabdus bovienii
  Peptide sequence Name=Xb4151_4152.C427.gene25.pep
  Homolog annotation: Query=1..123bp; Hit=1..124bp; Blast score=168; Percent Identity=69.0; E value=1e-41; Homolog= Pa|Phot3-163e06.p1k _g5| 5346 - 5720 221 124 aa, chain +
MYDWSGSVPANAEQGQPTGLILLKGDIISIIAKGWIKFGSANNEWSAPQGDTRSIPKISYDLRAKIADKTYGIGNGVLHKTVPVDGELILLYDDSPGEYNNNSGEFHVNVIIESRYSPLEEIK

SEQ ID NO: 6828 - protein, 41 aa, Xenorhabdus bovienii
  Peptide sequence Name=Xb4151_4152.C427.gene26.pep
MTQSTGTATYDITVGIKYDTDTLNQLETQLPKIQTKHSPMR

SEQ ID NO: 6829 - protein, 123 aa, Xenorhabdus bovienii
  Peptide sequence Name=Xb4151_4152.C427.gene27.pep
  Homolog annotation: Query=1..123bp; Hit=1..126bp; Blast score=155; Percent Identity=62.0; E value=1e-37; Homolog= gi|18466689|ref|NP _569496.1| hypothetical protein [Salmonella enterica subsp. enterica serovar Typhi] gi|16506005|emb|CAD09891
MTNQDIEKETQEKGKTAPRITPQHIEDTITYEMYFTAYDGFSASAKDNPDAVYAPIGVRINAKTLTFCVLTLKNGFTVTGESACASPENFDAEMGRKIARQNAVNKIWSLEGYLLKQKLHDEK

SEQ ID NO: 6830 - protein, 146 aa, Xenorhabdus bovienii
  Peptide sequence Name=Xb4151_4152.C427.gene28.pep
  Homolog annotation: Query=11..146bp; Hit=10..142bp; Blast score=127; Percent Identity=53.0; E value=3e-29; Homolog= Pa|Phot5-548f08.p1k _g88| 92822 - 93271 781 149 aa, chain -
MKWKVKAVSVVVGIVLIGSAAYSIYSVYVENGRLTDEKKSLTTQLSEKNAIITNQQERIQHLAELDTKHTQELTNAKSEIDTLRADIAAGRRKLRVQAVCPVPETTSSRSMGDAGTPQLTEAARQDYYDLLRMMAENERQTKYLQD

SEQ ID NO: 6831 - protein, 57 aa, Xenorhabdus bovienii
  Peptide sequence Name=Xb4151_4152.C427.gene29.pep
VNSCAGWPTTKALGVDHHQVITVDKVTLIVLAKSIIRHENGKQPYSEATFEKAFELL

SEQ ID NO: 6832 - protein, 327 aa, Xenorhabdus bovienii
  Peptide sequence Name=Xb4151_4152.C427.gene30.pep
  Homolog annotation: Query=61..324bp; Hit=1..264bp; Blast score=379; Percent Identity=67.0; E value=1e-104; Homolog= Pa|Phot5-468c10.q1k _g12| 11378 - 12178 522 266 aa, chain -
MTMTMTMTMTISIRLTVAVTLLAATLPVLAKMPENFIYTSSGDLETASVIMARSDIGGAQIVYNWRLLEPEKNKYDFSQIERDLARLKVANKKLFIQIQDRFFEQDARYVPDYLMNDARYGGGISPQFDNPGEGKPIGSGWVAQQWDPAVRQRYQALLAAIAERFDGQVYGVNLPETAIDFDKKKLPKGFSCDNYFAGEMENLTFARKVFTKSHVVQYVNFWPCEWNNDHNYMGRLFEFASANNIGLGGPDIVPNRKAQMKNSYPFFNKYKSKLALIAMAVQEPTLTYKNPNTGKPFSKDEFVQFAEDYLGADIIFWSTTSPWLAKK

SEQ ID NO: 6833 - protein, 213 aa, Xenorhabdus bovienii
  Peptide sequence Name=Xb4151_4152.C427.gene31.pep
  Gene classification: Function=Predicted transposase; Function class=L DNA replication, recombination and repair
  Homolog annotation: Query=1..208bp; Hit=41..247bp; Blast score=160; Percent Identity=40.0; E value=9e-40; Homolog= mll8100 COG3293
MKTGIPWRGLPSEFGKGNSVFQRFDAWSKKGVFDLLFKELSKDSDTEWLFIDSSIVRAHQHSSGATSKKDEAIGKSRGGRSTKIHLAVDSYGLPVNFELSGGQVHDIVHAESLVVQSPPSGVVIADKGVQCQAFRTDIEQQGATPVIPYRKNNRKLDQKIDKCLYCYRHLVENTFARIKHFRVIATRYDKLERNYTSTLVLAFIIVWLPMWVD

SEQ ID NO: 6834 - protein, 180 aa, Xenorhabdus bovienii
  Peptide sequence Name=Xb4151_4152.C427.gene32.pep
  Homolog annotation: Query=9..179bp; Hit=15..186bp; Blast score=164; Percent Identity=52.0; E value=6e-40; Homolog= gi|37524576|ref|NP _927920.1| hypothetical protein [Photorhabdus luminescens subsp. laumondii TTO1] gi|36784000|emb|CAE12865.1
MDSQLSGILLLLVGLFFSATAMAMPIQNDEMASLVNQRLSYMKDVAGYKANNHLAIEDLRQEAKVLSSSVLEAEKLGLDGESVKPFIQAQMDAAKAIQYRYRADWLSISEKGWQPEPLEQVRSKISVLNTDILTEVSTRLTTGDLFTDKTAFTKVLDQTHLKDGDKERLWSSMKQITLKK

SEQ ID NO: 6835 - protein, 303 aa, Xenorhabdus bovienii
  Peptide sequence Name=Xb4151_4152.C427.gene33.pep
  Gene classification: Function=Predicted restriction endonuclease; Function class=L DNA replication, recombination and repair
  Homolog annotation: Query=14..293bp; Hit=12..291bp; Blast score=363; Percent Identity=58.0; E value=1e-100; Homolog= Z5892 COG3440
MIAIPSPINQTAYMSTIKELQVAISNLSIWRKGDQRAPHKPLLLLYVLSQYQKGHERLFDYGEEIHQPLLALLNNFGPRRKSHYPSLPFWRLRGDGFWELQNSERCTPQKGSKEPPKRELIEFGVKGGFDQQSYQLLRKKPTTINKLAQQILSEHFPDSIQELLANQLDFSLSDIRKIRDPHFRQQILRAYNYECAICGYNLRHDSTPVGLEAAHIKWKQYGGPCTVNNGLALCSLHHSAFDMGSISIDDNMKLLVSESINGGPMVKQLFWNFAKQPILLPKNRDYLPLESFITWHRSQVFKQ

SEQ ID NO: 6836 - protein, 305 aa, Xenorhabdus bovienii
  Peptide sequence Name=Xb4151_4152.C427.gene34.pep
LYKQKKKRDNRVISLRDPIRNKKIEITLHQEMDFTDCYRDNKVILSKSYICGIKLKIFGKDEEHSKDEEHSKQIKMEFLLPICYAINKIHAKVNNLSKIVRSIHIYIEEEKGKTEVRWPAREDKIADNTSITKTGGTVGIGLPHLHINAKKVKEIKSPQYSFWRRNKNITNQIGWGVPDQLHHEAISVSRKSLELNSENSTKVIATIVHEIGHIIHAQRTESEEKFWLAKRIDQNNIHIIPAKIVEQVSGYAIEKQNSNEFVAEVFTGLVYGKKYSQEVLEYYQYYSGPELTGIKLPKLPPNWSP

SEQ ID NO: 6837 - protein, 349 aa, Xenorhabdus bovienii; identical to SEQ ID NO: 5796
  Peptide sequence Name=Xb4151_4152.C427.gene35.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 6838 - protein, 91 aa, Xenorhabdus bovienii; identical to SEQ ID NO: 5467
  Peptide sequence Name=Xb4151_4152.C427.gene36.pep
  Gene classification: Function=Transposase; Function class=L DNA replication, recombination and repair
  Homolog annotation: Query=1..87bp; Hit=1..87bp; Blast score=74; Percent Identity=43.0; E value=2e-14; Homolog= insA_g5 COG3677

SEQ ID NO: 6839 - protein, 325 aa, Xenorhabdus bovienii
  Peptide sequence Name=Xb4151_4152.C427.gene37.pep
  Gene classification: Gene name=ThiJ; Function=Putative intracellular protease/amidase; Function class=R General function prediction only
  Homolog annotation: Query=73..197bp; Hit=48..172bp; Blast score=102; Percent Identity=36.0; E value=6e-22; Homolog= PA4436_1 COG0693
MKIAFVLYDKALQSGITLASDMLNSASSLRSRVQQREEPFYMSVIGDVKENNEHIAQITLHTHHKFSDPVDFDLVFLPPMWGNPSPSMAGREDIIEWLRRQKENQAIIVATGTGVYWLAKAGLLEEKTVTTHWSFYGKFERRFPTVGVNRKASITYCDNIYCVRSINSQTELLVYLIAQFFSAPIAKIIEKHFMHEVSNFQSEPFFQVGGNTQFDEMVSIAQSYIKQHVTSQITIKDIATHVGVSESTLIRRFKGQVGISPHKYMLDQRLLIAKQLLQDNSLTLLYIAQLVGFKDPHYFSKVFEQHFKLTPVAYRKLVKAKVFHS

SEQ ID NO: 6840 - protein, 398 aa, Xenorhabdus bovienii
  Peptide sequence Name=Xb4151_4152.C427.gene38.pep
  Homolog annotation: Query=1..398bp; Hit=21..420bp; Blast score=587; Percent Identity=67.0; E value=1e-167; Homolog= gi|16128789|ref|NP _415342.1| hypothetical protein [Escherichia coli K12] gi|3025028|sp|P75791|YBIU_ECOLI Hypothetical protei
MKQAMRKQIGDVESLFAQVCDRIEKEIAATRVDEKNIGSAWPEIHGSDVAERKVTEQTLQKIKRRGCLVVRQNFPRDKALAWDQSMLDYLAINNFDRVYQGPGDNFFDSLEASRPEIYPIYWSHAQMEARQSEEIARVQSFLNRLWKFESNGISWFDPDINMIYPDRIRRRPPGTTSRGLGAHTDSGTLERWLQPAYQKVFNKIFTNRFGEYDPWDAAYRPEVTEYDNTTKCSVFRTFQGWTALSDMTLGQGLLHVVPVPEAMAYILLRPLLNDVPEDELCGVAPNKALPISEKWHPHLVRGLCSIPSLQAGDSVWWHCDLIHSVAPVKNQQGWGNVMYIPAAPLCDRNLAYAHHVADALEHGTSPADFPKEHYEKNWKGRFTAADLNIIGLRGLGLN

SEQ ID NO: 6841 - protein, 564 aa, Xenorhabdus bovienii
  Peptide sequence Name=Xb4151_4152.C427.gene39.pep
  Homolog annotation: Query=19..555bp; Hit=122..677bp; Blast score=300; Percent Identity=34.0; E value=4e-80; Homolog= gi|22984529|ref|ZP _00029673.1| COG1807: 4-amino-4-deoxy-L-arabinose transferase and related glycosyltransferases of PMT fam
MNSIHRFSNADIKALFLFVAFMLLYLLPGIYSHTPWKQDENYSFGVIQTMYETGHWLVPTNAGEPFMEKPPLYYWTATTFIHLLSQWLPMYDAARTATLFFSIINFSFFILLARRAFNVQNFTNSRIWIAFALYACAPGIVRHSHDMFTDTSLITGTTIGLYGLLGLIKNEKKCYSILWLAIGTAITMLSKGVFIPGLLWICLLLTPVFLKSCRAKQYWLNAFFAGVIALILILPWPAMLLVEHPDLFKVWFWDNNIGRFLGFSVEDLGARAAPSRIPEAVLLFAFPAGLLAFIVIVKNPIKTLTDQRYFIFAAFILLGIILLQISASSRALYLLPFIAPMAILATGIFTKLPEKMYSVLSLCFSMLWSILILFVWSVYLLSLSSDYKHWLAPFGKWLPMGYQMHFSGFIFTSAVIITIIWVTKNKILSKSPVLHTAQNWLLGIAVVWGLVFTLFIGWIDYTKGYKEVFTDLKQRLAGEYKTDDCMSSYSIGESEAPMLYYFAHILHQRQKDFAVPQTCRWLIVLSEDIESAPTGMALFWSGHRPNDKNKNLVVYKKVTSETAQ

SEQ ID NO: 6842 - protein, 402 aa, Xenorhabdus bovienii
  Peptide sequence Name=Xb4151_4152.C427.gene40.pep
  Gene classification: Gene name=ProP; Function=77 Permeases of the major facilitator superfamily; Function class=G Carbohydrate transport and metabolism
  Homolog annotation: Query=1..389bp; Hit=1..389bp; Blast score=292; Percent Identity=47.0; E value=4e-79; Homolog= PA2269 COG0477
MANPYRELLTTPGVMGLVIASSIVRLPQAMIGISIITMLVQKTGLYWLAGSIAGTFALTNALIGPQVSKLVDQRGQGRVLPFMAAFSIGMLLALIIAVYMNAPTLLLFILAVLVGTMPSMPAMIRARWTQLFRGKPQLHTAFSLDTVLTELAFIIGPPLAIGLSTSFFAEAGPLVAVLLLIIGVTTFLLQRETEPKIAVGIRRNASSTLLIPGVRTIVLALLAMGTIGGSINVAVVAFANAQGWPASASFILAAYALGSMIAGLMFGVLRVSLPIEKQFFIGVLVTSVTAVLTIFSPNVYILSGMLFVAGVSFAPTMIIVMNLGTIIVPPSRITEGLTWMTTGFSIGVALGSIFTGIVIDVYGARTGFGVAIVAGLVMVVIVLLGLRTLRATSSAGAEPTFH

SEQ ID NO: 6843 - protein, 227 aa, Xenorhabdus bovienii
  Peptide sequence Name=Xb4151_4152.C427.gene41.pep
  Gene classification: Gene name=PspE; Function=Rhodanese-related sulfurtransferases; Function class=P Inorganic ion transport and metabolism
  Homolog annotation: Query=115..216bp; Hit=3..105bp; Blast score=96; Percent Identity=51.0; E value=2e-20; Homolog= Rv1674c_2 COG0607
MKTINRTSHALSEMADFAKTLGHSHRLTLIEAIFRHESSVEHLAEISGLSITNTSQHLQQLRRAGFVQTRREGKHVLYRIGDGPVANILAALRDYLAYQQTEIQRVVSDSIHHPEHLEGVSIEELLRRQEEGVLLLDVRSEEDYAAGHIPGAINIPTDALVHHLGELPRNQDILAYCGGRYCVLSTQAVSLLRSKGFKALRLGDGFPGWQAAGLRVEVSPIRLKKLQ

SEQ ID NO: 6844 - protein, 85 aa, Xenorhabdus bovienii
  Peptide sequence Name=Xb4151_4152.C427.gene42.pep
  Homolog annotation: Query=13..84bp; Hit=11..82bp; Blast score=96; Percent Identity=58.0; E value=8e-20; Homolog= gi|20135928|dbj|BAB88913.1| GTP cyclohydrolase II [Burkholderia glumae]
MNEAQIILTLNASVRTRVKVPIHPRTRHQRFEAEMVTLSGPCDTSEYPVIVFEPLGNSPHVRMHSEYLTDDVFGSERCDCGRELQ

SEQ ID NO: 6845 - protein, 565 aa, Xenorhabdus bovienii
  Peptide sequence Name=Xb4151_4152.C427.gene43.pep
  Gene classification: Function=WD40 repeat protein; Function class=R General function prediction only
  Homolog annotation: Query=17..158bp; Hit=1519..1659bp; Blast score =88; Percent Identity=36.0; E value=2e-17; Homolog= sll0163 COG2319
MITHHAPISGIAAYRDKYVLTAGYDNQIILWDAKTQRPLARAMHDHLANQGVFSPDGAYAVTSSSDYSARLWTVPDLRLVAVFADHEDDVEMSVFHPDKPLVATASRDHHVRVYDFSGKLLQTFKGHSADVISVEWMHNADELVSSSDDGTIKRWSLEKNCLVADIDLGGIETDTIAIAADGRIFAGNDEGEIILIGTDGSQVTFRAHDAGVKRLVLDHNRGLLVSLSYDRTMRLWKVEPFGQLEELVSASLPPEVWPRSCSFEGDDHIVFATFQASYRLYNWKTDEWDLAELAPTLVVNAAALVDGQQWTIGDAGIVWIDQREHTHTGSLCNFLTPVGDVILTGGQLGKVFDARTGHELYQHRSPLNCGVSFKRNGIDHAVIGAYTGEGIVLRIDGSQVTHVADLPLHDNAVKGVAISGDLLFSIAADASAAWYRVSTLEQVYTLKRAHEKIANGCIGLGDGYFASVSRDLKLRIWSPDHQADVIATPHTHSLKCVSAGVNGRYIATGSYNGRVAIYDRIDDLWVINMWVTTAGVSSLSYDPITHVFLASSYDGNVYHIPMEPI

SEQ ID NO: 6846 - protein, 231 aa, Xenorhabdus bovienii
  Peptide sequence Name=Xb4151_4152.C427.gene44.pep
MSSNTKPHYIDAQRTIVPVDVPSTAPRDYEKVLRSDFVSSYNEGRDVWTEEAAMQQASAILHAHLGRSSDVLDAGAGRGRDTGFLLAQGHRVTAVDLVELPEWTQLVQNWGSQVQFRITPVTELDGENLFDGVLDNGCLHHQHPDAYVVYLRRIHKLLRPTGLFTISVFESKEPGRLYANKMRRLYREFTDSELTELLRAAHFTLVSVHRVPRPTAGLNYLVLTVRKSSSY

SEQ ID NO: 6847 - protein, 327 aa, Xenorhabdus bovienii
  Peptide sequence Name=Xb4151_4152.C427.gene45.pep
  Gene classification: Function=Uncharacterized BCR; Function class=S Function unknown
  Homolog annotation: Query=121..309bp; Hit=27..222bp; Blast score=88; Percent Identity=35.0; E value=1e-17; Homolog= CT145_2 COG1262
MKPILADNPNHLSDRAAMALPENIFVARMPTTVFSMHLDLLQSEPAEWIAIAQNPSTSFERRYAAGTLLSFSGDPRIRPFDPEMCDVPGASVWLGTAPERVPQIVAEWQRVGVIEEWIAKECPCYNVEIKAFRIMRYPVTNLEYRLFLEQTRAPWFPTSWPFGVYPVERANHPVWSVPPEAAEAYADWLSEATGRRFRLPGEAEWEYAASGGTGSEYPWGNEFDPYAANTVEAGPLSTTPVGIFPLGRSTFGIDDLAGNVEEYVADDYSPYPGGEVINDDLASTQGSYRIARGGSFTRFGDLTRCARRHGHYQRDIYAMGFRLVESL

SEQ ID NO: 6848 - protein, 350 aa, Xenorhabdus bovienii
  Peptide sequence Name=Xb4151_4152.C427.gene46.pep
  Gene classification: Gene name=SmtA; Function=SAM-dependent methyltransferases; Function class=Q Secondary metabolites biosynthesis, transport and catabolism
  Homolog annotation: Query=25..306bp; Hit=8..298bp; Blast score=73; Percent Identity=25.0; E value=3e-13; Homolog= Rv0567 COG0500
MSELATETIYESTNDKVALTSVVDLVKLSDQYRQSAVLHYAVAEKLFDLTQESCTSAKVAGNLGMVEGKVLILLNALVALGLLKKAGNEFLNTELTTRYLTSKSSDYIGAIVEHQHLQWDNWPRLGEILRSEKPLDFQQENRFMRDERARDAFNDAMVRLSQPMRDVVSGLNIFTNANTSIDLAGGHGTYLAEALLRHPQLTGQIWDLPTTRDAAQKTIEAYGLSGRLKFCEKNLLDALNFERAAADVVMLNDCLHYFNETEALAVIRHAACLVKPGGALLLLTMTMDENRVTPALSADFSLHMMVNTNHGELHPTQWIARAVHGNGLSISELSIGRYTLLIGQRPASEV

SEQ ID NO: 6849 - protein, 287 aa, Xenorhabdus bovienii
  Peptide sequence Name=Xb4151_4152.C427.gene47.pep
MLTFKLINLDINPTDAEQITRVLSEQCAAAGYRLSMAEVDNTTPDGMFVLSHGASTAINNERLAGVGWIAVAQIGIDPKNTGGEASAIWHENPQGVFCYPLALEMESVGTSSDVVRDWLAGFATFTACIKMWRRLRDKPEDGRPHELRVNHINILARDLDKSVDFYHRILGASYCYNLGPKKVVMELNGFDFFIEQTDTVTYPPGYHFGVRTDPEGVKSIAAIVGADGGIKIVKGNGPTIGYHTGPDRVRTAFYFEDPDGLVIEIYSPEIEMLESNPHLISQHFSQA

SEQ ID NO: 6850 - protein, 467 aa, Xenorhabdus bovienii
  Peptide sequence Name=Xb4151_4152.C427.gene48.pep
  Gene classification: Gene name=ProP; Function=77 Permeases of the major facilitator superfamily; Function class=G Carbohydrate transport and metabolism
  Homolog annotation: Query=2..459bp; Hit=4..460bp; Blast score=179; Percent Identity=36.0; E value=8e-45; Homolog= Rv1634 COG0477
MSSNNAPSWGELLSGRNGLLSIALAGGVALHAINIYIATTILPSVVRDIGGLEYYAWNTTLFMVASIIGAPLSKNVLSRFGPRAAYLVALIVFCVGTLVCASAKDMLWMLVGRFVQGFGGGILFALSYALIRIVFDGRLWPRAMAMVSGMWGIATLCGPAIGGIFAHSDTWRLAFIALLPVAAVLAVIVLVQLPAYEKSSAQTDRAAIGKILLLGVSVLIISVASLSKEIFANIAGVAAGLVIVVLIARVDRKSKIKLLPTGAYDVRASLGAIYACMSLLVIGMTTEIFVPYFLQTIHGYQPLIAGYATALMAAGWTAGSLFSSGRSAHTAQALVRRGPILVVLALIMLAVIMPSQHLLSPVSSLTLMCIALAAVGAGIGAAWPHLLTQVFTNAPAGQEDLASTSITTVQLYATAIGSAFAGIVANLAGFSDPGGLAGAQNAAMWLFAVFAIAPVLATFVVRRVRLT

SEQ ID NO: 6851 - protein, 170 aa, Xenorhabdus bovienii
  Peptide sequence Name=Xb4151_4152.C427.gene49.pep
  Homolog annotation: Query=1..159bp; Hit=19..176bp; Blast score=107; Percent Identity=40.0; E value=7e-23; Homolog= gi|26989229|ref|NP _744654.1| hypothetical protein [Pseudomonas putida KT2440] gi|24984072|gb|AAN68118.1|AE016443_9 hypothetic
MDPITGIALFKALHAFGIAGWATIGMINNVQSFTVTTGTVGRMMSMTLLKQEPPVNTPLLRRATTSRAIHSAALAVIVILQALTAIAMWISGYLLLTTAASHPDTLLWLSVGITGFAACAFVLLLGGLWYGYWIRQEGLQLTHIAIIIWSIAAFLLFHLSMTSELIGDIR

SEQ ID NO: 6852 - protein, 451 aa, Xenorhabdus bovienii
  Peptide sequence Name=Xb4151_4152.C427.gene50.pep
MINSLPLHDGDCFVQVDDDVAAKLDGFELRLLASRVVAIRDNQFFDLQNLIAGGGTITRNGNPYDLRRQNLAVLYYDLSRHGELEWRESDADGARLAVLTPKVTVAASSSPIQAVRLSPSDRLAFLPFEETRNVPNIAADAIHNTATRLTLSHWPANRTPARYQANLSTESVLRFLPDMSEYPDVRHVTTDHFDLDGLASVYALIAPEHAQSHGQLLADVARFGDFACGHSTKARRLAFALNAITEQALHAAGTVPNESVRITALFRTLLPALRDLLDASVIHDALWRDAEQHHMETEVLLDSPNVMVEQYPEIDLAVFRLPTSNVPYVRVPQRYFGLSSIAFHNRTPLSTIALVTQGDIVVHQRYEGWVELHSAAPRPRRDLSILARALQSAETKDCRWHYDGVQHIMPRLGRDGASLSSLSVETIVCELKRFLAIAPAAWSPSVYAAPK

SEQ ID NO: 6853 - protein, 38 aa, Xenorhabdus bovienii
  Peptide sequence Name=Xb4151_4152.C428.gene1.pep
EAAYLTLSSPGVSLYFRAFLPLSSAACLRSASVSGGAL

SEQ ID NO: 6854 - protein, 633 aa, Xenorhabdus bovienii
  Peptide sequence Name=Xb4151_4152.C428.gene2.pep
  Gene classification: Gene name=PurH; Function=AICAR transformylase/IMP cyclohydrolase PurH (only IMP cyclohydrolase domain in Aful); Function class=F Nucleotide transport and metabolism
  Homolog annotation: Query=105..633bp; Hit=1..529bp; Blast score=897; Percent Identity=84.0; E value=0; Homolog= ZpurH COG0138
VVAHYRDFSVPDNSFFHKRLSFAALHSKRLIYTYLYTNLSTNGYFGKICRASRKRFRYNYRRKKHHVIFSDCFEMLLRMPFFLSIPGFFLNSTVLFYEIQGITPMQQLRPIRRALLSVSDKAGIVEFAKALSSRGIELLSTGGTARLLAEAGLNATEVSDYTGFPEMMDGRVKTLHPKVHGGILGRRGQDDEVMSLHQISPIDMVVVNLYPFAQTVAKPDCPLEDAVENIDIGGPTMVRSAAKNHKDVAIVVNSQDYGKIIEEMDSHQNSLTQLTRFDLAIKAFEHTAAYDSMIANYFGKLVPAYHGETNQPSGRFSRTLNLNFIKKQDMRYGENSHQDAAFYIEEQIAEASIATATQLQGKALSYNNIADTDAALECVKTFAEPACVIVKHANPCGVAVGTDIHTAYDRAFKTDPTSAFGGIIAFNHELDADTAKAIIERQFVEVIIAPSINEKALPILATKQNVRVLACGEWHSPVAGLDFKRVNGGLLVQDRDLGMVAEADLKVVSKRKPTEQEMRDALFCWKVAKFVKSNAIVYAKDNMTVGIGAGQMSRVYSAKIAGIKAADEGLEVQGCAMASDAFFPFRDGIDAAAAVGVSCVIQPGGSIRDDEVIAAADEHGIAMIFTGMRHFRH

SEQ ID NO: 6855 - protein, 427 aa, Xenorhabdus bovienii
  Peptide sequence Name=Xb4151_4152.C428.gene3.pep
  Gene classification: Gene name=PurD; Function=Phosphoribosylamine -glycine ligase; Function class=F Nucleotide transport and metabolism
  Homolog annotation: Query=1..425bp; Hit=1..426bp; Blast score=646; Percent Identity=75.0; E value=0; Homolog= ZpurD COG0151
MNILIIGNGGREHALAWKAAQSPLADKVYVAPGNAGTALEANLENIDIAATDIAGLLAFAQSQHIGLTIVGPETPLVIGIVDAFQQAGLTIFGPTKAAAQLEGSKAFTKDFLARHQIPTAAYQNFTEIEPALTYLKKMGAPIVIKADGLAAGKGVVVAMTMEEAQNAVKDMLAGNAFGDAGHRIVIEEFLDGEEASFIVMVDGKNVVPMATSQDHKRVGDGDTGPNTGGMGAYSPAPVVTDEVHQRVMEKVIYPTVEGMAAEGHTYTGFLYAGLMIDKQGEPKVIEFNCRFGDPETQPIMMRLRSDLVELCLAGAQGQLSGKTSEWDTRPALGVVLSAGGYPANYVKGDVISGLNQETDTDEKVFHAGTAFKDKDVVTAGGRVLCVTALGDDIAEAQKKAYLRAEKIGWQGCFYRKDIGYRAIARLK

SEQ ID NO: 6856 - protein, 217 aa, Xenorhabdus bovienii
  Peptide sequence Name=Xb4151_4152.C428.gene4.pep
  Homolog annotation: Query=3..217bp; Hit=19..234bp; Blast score=296; Percent Identity=65.0; E value=1e-79; Homolog= gi|37524502|ref|NP _927846.1| hypothetical protein [Photorhabdus luminescens subsp. laumondii TTO1] gi|36783926|emb|CAE12788.1
MLQGLLALGFISLLSACSVQPKVPLFSASGFITDGGVIRLWRLNDQNSNPQVIMSVYSPYRNTDTSVTFYEYRYGNLWQIRRSVLDSHPIEETLRIDKDNKVIFMQRQTKEHNEPLSNDEIVRLRFDAKRIKEISDALIAGNVHLVQGHWQDGKVTTCSEKQLSIQFEPEDRAWLKGREKNSAGILTIAWLDAPEGKQLLLVANDDFCRWEPTKDKL

SEQ ID NO: 6857 - protein, 90 aa, Xenorhabdus bovienii
  Peptide sequence Name=Xb4151_4152.C428.gene5.pep
  Gene classification: Gene name=HimA; Function=Bacterial nucleoid DNA -binding protein; Function class=L DNA replication, recombination and repair
  Homolog annotation: Query=1..90bp; Hit=1..90bp; Blast score=125; Percent Identity=84.0; E value=6e-30; Homolog= hupA COG0776
MNKTELVDAIAEQAGLTKTQAKTALESTLNAITESLRNGDSVQLVGFGTFKVNHRAERTGRNPQTGNEIKIAAANVPAFSAGKALKDAVK

SEQ ID NO: 6858 - protein, 57 aa, Xenorhabdus bovienii
  Peptide sequence Name=Xb4151_4152.C428.gene6.pep
VLELPDLKTSHLPSLCSTLGVKRSGYRCVYAGVLSNRHIRRTRCFANDKHTVRIIYE

SEQ ID NO: 6859 - protein, 196 aa, Xenorhabdus bovienii
  Peptide sequence Name=Xb4151_4152.C428.gene7.pep
  Gene classification: Function=Uncharacterized BCR; Function class=S Function unknown
  Homolog annotation: Query=1..196bp; Hit=1..196bp; Blast score=307; Percent Identity=78.0; E value=6e-84; Homolog= yjaG COG3068
MLRNPIHLRLEKFESWQHWTFMASLCERMYPNYQVFCRQTGFADPAQYRRILDLAWETLIVKDAKVNFDSQLEKLETIIPSADSYDIYGVYPAIDACIALSEVIHSRLSGATLEHAIAVSETSIRTVAMLEMTQAGREMTEDELKALPAIEEEWDIQWEIYRLLADCEERDIELIKGLRADLRETKVSNIGINLEQ

SEQ ID NO: 6860 - protein, 30 aa, Xenorhabdus bovienii
  Peptide sequence Name=Xb4151_4152.C428.gene8.pep
MMPNLRRSLPENQEYPHISAAIIDFSALFA

SEQ ID NO: 6861 - protein, 294 aa, Xenorhabdus bovienii
  Peptide sequence Name=Xb4151_4152.C428.gene9.pep
  Gene classification: Gene name=Nfi; Function=Deoxyinosine 3'endonuclease (endonuclease V); Function class=L DNA replication, recombination and repair
  Homolog annotation: Query=60..286bp; Hit=2..217bp; Blast score=288; Percent Identity=62.0; E value=5e-78; Homolog= nfi COG1515
MLLQRELKRKFRRFCRILVRVMGMFSIWGMAFIRMSHRNMLAHSSKRYTDFQKNITDDFMIDTKALRQEQIEKARQVIRHDSFMTTSTSAMPASTPFMPELIAGADVGFEKNGTVTRAAIAVLHYPSLELLEYQVARIDTVLPYIPGLLSFREYPALMAAWQKLSLRPDLVMVDGQGIAHPRRFGVASHFGLLADIPTIGVAKSRLCGEHPPVGDAVGSYQSLMDHAEQIGVVWRSKKRCNPLYISIGHKVSLDSAVFWVEQCMKGYRLPEPTRWADGIASNRLFFKQTMQKNL

SEQ ID NO: 6862 - protein, 354 aa, Xenorhabdus bovienii
  Peptide sequence Name=Xb4151_4152.C428.gene10.pep
  Gene classification: Gene name=HemE; Function=Uroporphyrinogen-III decarboxylase; Function class=H Coenzyme metabolism
  Homolog annotation: Query=1..354bp; Hit=1..354bp; Blast score=634; Percent Identity=85.0; E value=0; Homolog= hemE COG0407
MNELKNDRYLRALLRQPVDVTPVWMMRQAGRYLPEYKATRQEAGDFISLCKNTELACEVTLQPLRRFPLDAAILFSDILTIPDAMGLGLYFETGEGPRFHSPILNHTDVEKLPVPDPEMELGYVMDAVRAIRKALAGQVPLIGFSGSPWTLATYMVEGGSSKAFTKIKSMMYAQPATLHLLLDKLANSVILYLNAQIKAGAQSVMIFDTWGGVLSHRDYREFSLQYMHKIVDGLIREHDGRRVPVTLFTKGGGQWLEAMVATGCDALGLDWTTNIADARRRVGDKVALQGNMDPSMLYAAPARIEEEVSTILQDFGTGNGHVFNLGHGIHQDVPPEHAGAFVEAVHRLSEKYHR

SEQ ID NO: 6863 - protein, 50 aa, Xenorhabdus bovienii
  Peptide sequence Name=Xb4151_4152.C428.gene11.pep
LAAKFFGYGRFNFHYKKPTHCNMPEIELLAQLPITCAIRSSSQSSSHVTA

SEQ ID NO: 6864 - protein, 256 aa, Xenorhabdus bovienii
  Peptide sequence Name=Xb4151_4152.C428.gene12.pep
  Gene classification: Gene name=NPY1; Function=NTP pyrophosphohydrolases containing a Zn-finger, probably nucleic-acid -binding; Function class=L DNA replication, recombination and repair
  Homolog annotation: Query=9..254bp; Hit=8..253bp; Blast score=346; Percent Identity=68.0; E value=2e-95; Homolog= yjaD COG2816
MIQQKLTGMERGWWVISLENLVWLPQGELPSGTARQWSLQGHMARPIGEWLGETVWLVCQKMASEMASPRMVVSQHPKLFQLVGRGVQLAEFYRSHHYCGYCGHEMQHSQHEWACLCNHCHERYYPQIAPCVIVGIRRDDHILLAQHQSHRNGIHTVLAGFVEVGEMLEEAAHREVMEESGIKIRNLRYVASQPWPFPQSLMMGFLADYDSGEIQHDPVELISADWYRYDDLPLIPQSDTIARRLIEETVALCRNM

SEQ ID NO: 6865 - protein, 34 aa, Xenorhabdus bovienii
  Peptide sequence Name=Xb4151_4152.C428.gene13.pep
LIKLGRCSDRIRRKGVSCLMLNLDTMSLELWCGR

SEQ ID NO: 6866 - protein, 33 aa, Xenorhabdus bovienii
  Peptide sequence Name=Xb4151_4152.C428.gene14.pep
MKGRYNAHISQSVIDTFLDQQIWGNIIHWHVSR

SEQ ID NO: 6867 - protein, 220 aa, Xenorhabdus bovienii
  Peptide sequence Name=Xb4151_4152.C428.gene15.pep
  Gene classification: Gene name=SerB; Function=Phosphoserine phosphatase; Function class=E Amino acid transport and metabolism
  Homolog annotation: Query=1..220bp; Hit=1..220bp; Blast score=213; Percent Identity=47.0; E value=2e-55; Homolog= VC1940 COG0560
MSQQIAVFDLDDTLICGDSSLLWTEYLWEKGIITDHRFIEADQKMMADYSAGKLDMHDYLAFNLQSLNQVHHEQVDIWLTDFVETKIKPISYPAAKKQLDIYRQQNIPIIIISATVSFVVKKVAAALGVLTAMGIDMVMENGCYTGSILGTPTFREGKVVRLQQWLTEQNLSPQHISFYTDSINDLPMCLFANEVFTVNADIRLQKEAGNHGWKQLNWVL

SEQ ID NO: 6868 - protein, 38 aa, Xenorhabdus bovienii
  Peptide sequence Name=Xb4151_4152.C428.gene16.pep
MIINIKLNTINYELIIHFINKKPLFHYTKTIKPLLIKI

SEQ ID NO: 6869 - protein, 85 aa, Xenorhabdus bovienii
  Peptide sequence Name=Xb4151_4152.C428.gene17.pep
LSECLAFNVYHDEHRLRPLIRDPQNLIGLIPAKGTRVITPLTYPPVSIEILFSTNHYSLRAPDKQFSQLKPIPAGNAPVRMMDRL

SEQ ID NO: 6870 - protein, 657 aa, Xenorhabdus bovienii
  Peptide sequence Name=Xb4151_4152.C428.gene18.pep
  Gene classification: Gene name=ThiC; Function=Thiamine biosynthesis protein ThiC; Function class=H Coenzyme metabolism
  Homolog annotation: Query=28..650bp; Hit=8..630bp; Blast score=1110; Percent Identity=83.0; E value=0; Homolog= thiC COG0422
MSNNIVIPTTDVIPAADIAPKTYPARPRKAQRDAAQEFINSVQGVTFPNSRRIYLAGSRKDIQVPMREIQLSPTLIGGTNENPQFEENEPVPIYDTSGSYGDPDSVLDVRAGLKKIRQLWIEERNDTEPVAVLSSDFTQQRLADAGLDHLRFNQLPHPLKARQSKRVTQLHYARQGIVTPEMEFIALRENMGRERIRSEVLLQQHPGQSFGANLPDNITPEFVRQEVAAGRAIIPANINHPESEPMIIGRNFLVKVNANIGNSSVTSSIEEEVEKLIWSTRWGADTVMDLSTGRYIHETREWILRNSPVPIGTVPIYQALEKVNGVAENLTWEMFRDTLLEQAEQGVDYFTIHAGVLLRYVPMTAKRLTGIVSRGGSIMAKWCLSHHQESFLYTHFREICEICAAYDVSLSLGDGLRPGSIQDANDEAQFAELHTLGELTKIAWEYDVQVMIEGPGHIPMQLIRRNMTEELEHCHEAPFYTLGPLTTDIAPGYDHFTSGIGAAMIGWFGCAMLCYVTPKEHLGLPNKDDVKQGLITYKISAHAADLAKGHPGAQIRDNAMSKARFEFRWEDQFNLALDPETARAYHDETLPQQSGKVAHFCSMCGPKFCSMKITQDVRDYAAKLEQEAGMEQMSEEFLAHGSELYHSAEDISDEKSA

SEQ ID NO: 6871 - protein, 224 aa, Xenorhabdus bovienii
  Peptide sequence Name=Xb4151_4152.C428.gene19.pep
  Gene classification: Gene name=ThiE; Function=Thiamine monophosphate synthase; Function class=H Coenzyme metabolism
  Homolog annotation: Query=12..214bp; Hit=3..205bp; Blast score=273; Percent Identity=68.0; E value=1e-73; Homolog= thiE COG0352
MKNQPEASSIPQAPFAPTVHRLGLYPVVDSLTWIERLLKAGIRTLQLRIKDLPEDQVEEDIQSAIVLGRQYNARLFINDYWDLAIKHRAYGVHLGQEDLDIADLNAIRQAGLRLGISTHDEYELARTKALRPSYIALGHIFPTTTKEMPSKPQGLSALKHQVEITPEYPTVAIGGISLDRVPDVVATGVGGVALVSAITKAKDWRQVTDQLLHLIEGSDRELLC

SEQ ID NO: 6872 - protein, 269 aa, Xenorhabdus bovienii
  Peptide sequence Name=Xb4151_4152.C428.gene20.pep
  Gene classification: Gene name=ThiF; Function=Dinucleotide-utilizing enzymes involved in molybdopterin and thiamine biosynthesis family 2; Function class=H Coenzyme metabolism
  Homolog annotation: Query=8..246bp; Hit=1..238bp; Blast score=273; Percent Identity=61.0; E value=1e-73; Homolog= thiF COG0476
MLNDQEFMRYSRQLLLEDIGSDGQEKLKAGKVLIVGLGGLGSPAALYLAAAGVGHLYLADDDTLHVSNLQRQILYRTADIPAGKAVLAAKQLKALNPLVENTVLTERQDRESLENLVRQADLVLDCCDNMATRYAINAACVAENKPLISGSAVGFSGQLIVFEPPYLHGCYACLYPDQEEPHRNCRTAGVLGPVVGMIGTLQSLEAIKMLVGLPSPLSGKLRLFDGRQQSWSTLQLTLLSQCPVCGTHAAKSDRAETISGKTRSGKEVA

SEQ ID NO: 6873 - protein, 66 aa, Xenorhabdus bovienii
  Peptide sequence Name=Xb4151_4152.C428.gene21.pep
  Gene classification: Gene name=ThiS; Function=Sulfur transfer protein involved in thiamine biosynthesis; Function class=H Coenzyme metabolism
  Homolog annotation: Query=1..66bp; Hit=1..66bp; Blast score=65; Percent Identity=53.0; E value=7e-12; Homolog= ZthiS COG2104
MNIIVNDQPITLSTSMTVQQLLEHVQRPQSGTALAINQTIIPRSEWNSHQINDGDIILLFQAIAGG

SEQ ID NO: 6874 - protein, 255 aa, Xenorhabdus bovienii
  Peptide sequence Name=Xb4151_4152.C428.gene22.pep
  Gene classification: Gene name=ThiG; Function=Uncharacterized enzyme of thiazol biosynthesis; Function class=F Nucleotide transport and metabolism
  Homolog annotation: Query=1..254bp; Hit=26..279bp; Blast score=356; Percent Identity=73.0; E value=1e-98; Homolog= thiG COG2022
MLKIADTSFHSRLFTGTGKFANANLMIEAIRASGSQLVTMAMKRIDLHGNDDGILAPLQQLGVKLLPNTSGAKTAEEAVFAAHLAREALGTHWIKLEIHPDVKYLLPDPIETLKAAGQLVKEGFVVLPYCGADPVLCRRLEEVGCAAVMPLGAPIGSNKGLLTRDFLQMIIEQSNVPVVVDAGIGAPSHALAAIEMGADAVLVNTAIAVARNPIKMAQAFKTAIEAGELSHQAGVASQKSHAEASSPLTDFLGAL

SEQ ID NO: 6875 - protein, 380 aa, Xenorhabdus bovienii
  Peptide sequence Name=Xb4151_4152.C428.gene23.pep
  Gene classification: Gene name=ThiH; Function=Thiamine biosynthesis enzyme ThiH and related uncharacterized enzymes; Function class=H Coenzyme metabolism
  Homolog annotation: Query=11..380bp; Hit=3..372bp; Blast score=590; Percent Identity=76.0; E value=1e-168; Homolog= ZthiH COG1060
MTDNTVTTDHTFRQRWQQLDWDDITLRINSKATQDVEQVLNRDRLTLDDFMALLSPAALPFLEPLAQRAQQLTRQRFGNTVGFYIPLYLSNLCANDCTYCGFSMSNHIRRKTLNEQEIKAECQAIKKLGFEHILLVTGEHQNKVGMDYFCRYLPMIRSYFSSITMEVQPLAQEEYAELKTLGLDGVMVYQETYHAPSYQLHHLKGKKQDFHWRLETPERLGRAGIDKIGLGALIGLSPSWRTDCYMVAEHLLFLQKQFWKSRYSISFPRLRPCAGGIEPASLMSEAELVQLICAFRLLAPDVELSLSTRESPFFRDHVVPLAINHVSAGSKTQPGGYADDHYELEQFAPHDNRSVVQVAAALVKSGLQPVWKDWDNYLGR

SEQ ID NO: 6876 - protein, 198 aa, Xenorhabdus bovienii
  Peptide sequence Name=Xb4151_4152.C428.gene24.pep
  Gene classification: Function=Uncharacterized ACR; Function class=S Function unknown
  Homolog annotation: Query=8..198bp; Hit=14..198bp; Blast score=191; Percent Identity=51.0; E value=5e-49; Homolog= YJL217w COG3506
MNFQHCHWLNEPASWKHREDILHVTTDIKTDFWRDTWYGFQRHSGHVFGRYVDDVHIEAGFTFQLCIEGRFEHLYDQAGIMLLVDEQHWLKAGVEHSDGQATIGSVLTNSCSDWAMGVFPGNPDKFWLRLTYSEGVIRLQYSIDGVKWPLLRLSPFAVGSQRVFVGAMCCSPEREGLQVKFSDFSLKSCLKRHLHDLS

SEQ ID NO: 6877 - protein, 405 aa, Xenorhabdus bovienii
  Peptide sequence Name=Xb4151_4152.C428.gene25.pep
  Gene classification: Gene name=ProP; Function=77 Permeases of the major facilitator superfamily; Function class=G Carbohydrate transport and metabolism
  Homolog annotation: Query=42..403bp; Hit=19..383bp; Blast score=143; Percent Identity=33.0; E value=3e-34; Homolog= mlr3825 COG0477
LCVRVHCFGTDGFREQGYGGIKLSEEYAVSSIKQPIIATRLAFFIAGFSMAAWAPLIPLVKERFALDDGAMGLLILVFGIGSFITMPLAGMLASRFGCRKIFPLFALLAILMLPGLSILPTPWALACALFMFGVGIGATDVVINIHAVNVEKMAQQPIMSGFHALFSLGGIAGAGSVSFLLLMGISPFQVMAAVSLFIILLLLPAWSGLLDHTETGNTPFFALPRGIVILLGFLCFVVYLMEGSMLDWSGILLSSVHNIDSHQAGLGYTLFAITMTCGRFLGDKIISMFGYRRVFLASAILATSGFVLIYLASSMMVLGISFLMIGAGLSNLAPMFFTASGQQKVMPDSQAVSAVSTMGYSGILLGPAIIGGLAHQVTLHGAFACIALLSLTLLAGYGLIHPARK

SEQ ID NO: 6878 - protein, 30 aa, Xenorhabdus bovienii
  Peptide sequence Name=Xb4151_4152.C428.gene26.pep
MYSDAQSCPPQVLLEGINIYIVITLKLSSR

SEQ ID NO: 6879 - protein, 212 aa, Xenorhabdus bovienii
  Peptide sequence Name=Xb4151_4152.C428.gene27.pep
  Gene classification: Function=Predicted phosphatase/phosphohexomutase; Function class=R General function prediction only
  Homolog annotation: Query=6..183bp; Hit=4..189bp; Blast score=70; Percent Identity=30.0; E value=1e-12; Homolog= TM1254 COG0637
MDKFNVIFDIDGVIVDSEQLHFDVLCELAPDHTRDVQPQQLIGLSLAETLNEIGVPLPEQQGITDRIISVYQEKLSAHYLRPGVTRLIAALQQNDIAFGFVSTAPRAVCLANLGLLDLFDEPALISGDDVERTKPFPDPYLAMLKLKRMDVQQTLVIEDTDLGIAAAKQAGIPWVYAWPHDLSVAEQYGQATCIIGELTDIPQFSGINSLSA

SEQ ID NO: 6880 - protein, 353 aa, Xenorhabdus bovienii
  Peptide sequence Name=Xb4151_4152.C428.gene28.pep
  Gene classification: Gene name=Tdh; Function=Threonine dehydrogenase and related Zn-dependent dehydrogenases; Function class=E Amino acid transport and metabolism
  Homolog annotation: Query=28..323bp; Hit=29..326bp; Blast score=120; Percent Identity=28.0; E value=2e-27; Homolog= BH0189 COG1063
MKALKFNQVWNVQIQQVEPLHCIEPDDVVVDIAVCGICGTDIGIITGSYPVAVPGTTLGHETTGVVTQIGSHVTRFQIGDRVVINPTYSCGHCRMCQTGNPNHCEKKLGTEAGVSYDGAFAEQYLAKESSLIKLDDHVSMEAASLTEPLSCTLTGVDKLGITHTNIRAVVAGAGPMGMLYLWALHERGVKAFMIEKNPSRVQFAINNLPAECRLYTDFDEALMQEYGDKSALIDLCVDTTGQLTEYVFDHLAAGGKLLNVALKDKHANLDILKIADKSLSVIGSIDSLNNSFERAYAMIRDGVIPAERLISQIFDFEDYQQAFLTVGCDIAAKAQVPLSTPNCKILIRLADFK

SEQ ID NO: 6881 - protein, 416 aa, Xenorhabdus bovienii
  Peptide sequence Name=Xb4151_4152.C428.gene29.pep
  Gene classification: Gene name=ArgD; Function=PLP-dependent aminotransferases; Function class=E Amino acid transport and metabolism
  Homolog annotation: Query=15..401bp; Hit=44..444bp; Blast score=187; Percent Identity=31.0; E value=2e-47; Homolog= TVN0024 COG0160
MENRKHLDDMLSRFVGHGPYLEIDGEKHIDAASGTFNLPLGYTNHRVAEKLKQQIDRCTHLSSAYTREMSQYILTKLVKHTPEGIDRMWLRDVSGSGAVEGAIRIAQKATGRSGIISFFLAHHGQSLATAQISGNAFRIKDFHISIDGSIKIPAPASVMAEPDPNETENQYVDLEQFIQLGSSDNIACLIIEPIQGNGGNTVFPVEFYRKIREICHQHGIIIIADEIQTGFGRTGTFFASTGYAKELEPDIIVFAKGAGGIGIPTGGVLMRSSLDVLESFEHSSTSGANPLSLVALNEIIDIIEDDAILENVQQNEAFLRDGLLALQHKYPEITGVRGMGYMFGFDTPTPEFAAQVIETASRHRLILRGSRYGKGRALKVRPPLVCTQEHLHEILHKLDLAFAELTVSAPKHREVA

SEQ ID NO: 6882 - protein, 958 aa, Xenorhabdus bovienii
  Peptide sequence Name=Xb4151_4152.C428.gene30.pep
  Gene classification: Gene name=MalT; Function=ATP-dependent transcriptional regulator; Function class=K Transcription
  Homolog annotation: Query=50..953bp; Hit=1..901bp; Blast score=1203; Percent Identity=71.0; E value=0; Homolog= malT COG2909
MKSINLFAKDRRFSKFGWALMNVSGENESITLNRVLVSVLFIAYEGKKPMLIPSKLSRPLRLNNMVMRERLLELLSEVQHYRLVLITSPAGYGKTTLMSQWAAGQSNLGWYSLDDSDNQPERFASYLIAAIQQATQGHCVKSDVLAQKHQYANLPALFAQLFIELSEWKQPIFLVIDDYHLIENNLIHEAMRFFLRHQPENLTLTILSRHLPSLGVANLRVREQLLEFDSQQLAFDYRETQQFFDKRLASPLDADNCKQLCNDVAGWATALQLIALSARQSGNTAEMSAKRLSGINASHLADYLVDEVLNRVDQATRDFLLRSSILRSMNDGLIVCLTGEDNGQQRLEDIERQGLFIQRMDDSGEWFCFHPLFASFLRQRCQWEMAAKLPELHRAAAEGWLMQGFPGEAIHHALAAGDTVLLRDILLQHAWDLFNHSKLSLLEECMNALPYEQLLENPRLVLLQAWLAQSQHRYYEVNALLNQTEQSLKQKQIIIEPELLAEFDALRAQVAINDGRPDDADTLAEKALAALLPDNEYGRIVAMSVKGEVLHCKGELSHALALMKQTEQLARRCHVYHYALWALLQQSEILLAQGYLQAAYEIQNHAFDLISEQHLEQLPMHEFLLRIRSQLLWCWARIDESEEAARRGLEVLSSVQPQQQLQCLTQLAKCSLIRGDIDNARRYLSRCENLLNNGHYHRDWRTNTDKLRVIIWQNLEDSSSATQWLVQAERPESFNNHFNQNQWRNIARAQILLGQYEEAESILGTLNKYARELLLISDLNRNLLLCNLLHWQLGYKAEAQAVLMEALSLANRTGFISHFVLEGELMAQQLRQLIQLNILPELEQHRAQRILREINRQHRHKFAHFDETFVEQLLTHPDVPELIRNSPLTQREWQVLGLIYSGYSNDQIAAELEVAATTIKTHIRNLYQKMGITHRQDAIQQAQHLMQMMGLSVASMNI

SEQ ID NO: 6883 - protein, 92 aa, Xenorhabdus bovienii
  Peptide sequence Name=Xb4151_4152.C428.gene31.pep
MNKTDTKTLFNVIDSFSPLTFINAQPNLEKRLSFANRLIDFIVLSCTLSHSLLAIFPVPNEIAKSLEKTGQVGNFSYQVVGQFLQPPALLFI

SEQ ID NO: 6884 - protein, 44 aa, Xenorhabdus bovienii
  Peptide sequence Name=Xb4151_4152.C428.gene32.pep
LVNFFSHPPCCLFNYSQWLRPCTPPCEYPRRMMPTASRIFSISR

SEQ ID NO: 6885 - protein, 802 aa, Xenorhabdus bovienii
  Peptide sequence Name=Xb4151_4152.C428.gene33.pep
  Gene classification: Gene name=GlgP; Function=Glucan phosphorylase; Function class=G Carbohydrate transport and metabolism
  Homolog annotation: Query=1..802bp; Hit=1..796bp; Blast score=1131; Percent Identity=67.0; E value=0; Homolog= ZmalP COG0058
MQQPKLDRAVFQAALTRQWQRFGLSSAQEMTPHQWWQAISAALLELLPSSSPNHGHQLHNSKRHVNYISMEFLIGRLTANNLLNLGWYDDVQAYLAEDGLTLSDLLEQEADPALGNGGLGRLAACFLDSMATIDQPATGYGLNYQYGLFRQSFDQGLQIEAPDDWKQGSYPWFRHNAQLKVDVGFGGKIVMTDEGHETWLPAFTLIGEAWDLPVVGYGNGVTQPLRLWQATHDNPFDLSLFNDGQFLNAEQQGIEATSLTKVLYPNDNHQDGKRLRLMQQYFQCACAVADILRRHQQAGRKVEELPRYEVIQLNDTHPTIAVPEMMRLLLDEHRLDWETAWEITGQTFAYTNHTLLPEGLERWDEHLVSELLPRHHRIIQEINRRFQKTVEQTWPGNQQVWEKLAVTHGNQVRMANLCVVACFAVNGVAALHSSLIVTDLFPEYYHLWPKKFHNVTNGVTPRRWLKQCNPALSSLIDQTLNHEWVNDLESLKQLEPYANDTAFCEAYRSIKQENKIRLSNYVNKVMGLKIDPHAIFDVQIKRLHEYKRQHLNLLHILSLYRQIQENPSLDVHPRVFLFGAKAAPGYYLAKNIISAINHAAEKINHDPIVRDRIKIAFIPDYNVSTAELMIPAADVSEQISTAGKEASGTGNMKLALNGALTIGTLDGANVEIAEQVGNDHIFIFGNNVEEAKALLKSGYNPRHILQQNPHLQGILDALASGEFSHGDTQAFNLMLHSLVDGGDPYLVLADFDSYCQAHKQIDTLYRNPQHWTHSTILNTARMGKFSSDRAIQDYQQRIWQAK

SEQ ID NO: 6886 - protein, 702 aa, Xenorhabdus bovienii
  Peptide sequence Name=Xb4151_4152.C428.gene34.pep
  Gene classification: Gene name=MalQ; Function=4-alpha -glucanotransferase; Function class=G Carbohydrate transport and metabolism
  Homolog annotation: Query=1..695bp; Hit=1..681bp; Blast score=844; Percent Identity=58.0; E value=0; Homolog= malQ COG1640
MENKHLDNLATEAGIAAEYINAYGKPQAIPAEIRHRILAAMYTDPPANRPVSDASILTLPVVKVMTQGQTITLPLSSTENYRWQIQTEQGETFQGDCQYQITLPTNLPLGYHTLTLMPVKSISVTEPHSQHPVMQIIVTPERCYEPETLINGEKLWGACIQLYTLRSENNWGIGDFGDLKYMLQELTQRGGAFIGLNPLHAMYPAMPEDASPYSPSSRHWLNIIYIDVNQVEDFTYSVEAQKWWRLPETQLKLQHVRQTGLVDYTSVMTLKITALRLAYQQFQTRSATDPLHIAFQQFVTKGGKSLYSQAAYDALHRKLYDEDSAYWGWPVWPEKYREPDSDTVKEFCQSHWPEVEFFLWLQWLADTQLAGCFTESQHNHMPIGIYRDLAVGVAQGGSETWCNRTVYCTKASIGAPPDILGPLGQNWGLPPINPHVLRVQAYQPFIELLRSNMRHCGALRIDHVMSLLRLWWIPQGETADKGVYVHYPVDDLLAILALESQRHHCMVIGEDLGIVPEEIVGKLHTRGVYSYKVFYFERDGHGEFRSPDEYPTQAMATITTHDLPTLRGFWQNKDLILGESIGLYPDKTLLDGLYDERKRCKQKLLDGLNRHGYSSASLSMTDTPAPMSASINQNIHHYIAHSTSALLGLQPEDWLDMELPVNIPGTSTEYPNWRRKLSITLEAMFQDEHINQLLQTVGEYRR

SEQ ID NO: 6887 - protein, 296 aa, Xenorhabdus bovienii
  Peptide sequence Name=Xb4151_4152.C428.gene35.pep
  Gene classification: Function=ABC-type maltose transport systems, permease component; Function class=G Carbohydrate transport and metabolism
  Homolog annotation: Query=1..296bp; Hit=1..296bp; Blast score=436; Percent Identity=83.0; E value=1e-122; Homolog= malG COG3833
MAMVQPKSQRWRVGATHMLMLSFIALILLPMLMVIAISLRPGNFATGSLIPETISWEHWKLALGYSVESPDGRITPPPFPVIQWLWNSVKIAFITATGIVALSTTCAYAFARMRFRGKSTLLKGMLIFQMFPPVLSLVALYALFDRLGAYIPFMGLNTHGSVIFAYMGGIALHVWTIKGYFETLDGSLEEAAMLDGATSWQVFRLILLPLSVPILAVVFILSFIGVITEVPVASLLLRDVDSYTLAVGMQQYLHPQNSLWGDFAAAAVLSAIPITVMFLLAQRWLVGGLTSGSVKG

SEQ ID NO: 6888 - protein, 521 aa, Xenorhabdus bovienii
  Peptide sequence Name=Xb4151_4152.C428.gene36.pep
  Gene classification: Function=ABC-type maltose transport systems, permease component; Function class=G Carbohydrate transport and metabolism
  Homolog annotation: Query=6..521bp; Hit=4..514bp; Blast score=709; Percent Identity=71.0; E value=0; Homolog= malF COG3834
MMSARLDKTEWWSHPVLKWFGVSLCLFFTGYLIVLMYAQGEYLFAMLTLVLLGSGIYVFANRKSYAWRYTYPGIAGMSLFVLFPLICTVAIAFTNYSSTNQLTFERAQTVLMSRQYQAGQTLNFKLYPESEQWVLALSVPDSSQLLVSDPFSLSTSAGEEVILPLHKQEKVFESDAAALRTITQYRQALGQLVTVLPDGSKLRMSSLRQFSGIHPLYSIGEDGITLTNNQTGTEYRPNMDTGFYQATNAEGVWSEGTLSPGFTVSVGWKNFLRVIQDDGIQKPFLSIFVWTVIFSLLTVILTVALGMILACIVQWEALKGRAIYRVLLILPYAVPSFISILIFKGLFNQSFGEINLLLNGLFGLKPEWFTDPTLARTMLIIVNTWLGYPYMMILCMGLLKSIPDDLYEASAIDGAGPLHNFSRITFPLLIKPLTPLIIASFAFNFNNFVLVQLLTNGRPDRIGTTTPAGYTDLLVNYTYRIAFEGGGGQDFGLAAAIATLIFLLVGALAIINLKATRIKFD

SEQ ID NO: 6889 - protein, 399 aa, Xenorhabdus bovienii
  Peptide sequence Name=Xb4151_4152.C428.gene37.pep
  Gene classification: Gene name=MalE; Function=Maltose-binding periplasmic proteins/domains; Function class=G Carbohydrate transport and metabolism
  Homolog annotation: Query=6..399bp; Hit=3..396bp; Blast score=637; Percent Identity=78.0; E value=0; Homolog= malE COG2182
MTKTTLKVGSRALMLSVLTTWILSAPAFAKLEEGKLVIWINGDKGYNGLAQVGEKFAKETGIPVAVEHPDKFEEKYSQIAANGDGPDIIFWAHDRFGGYAQSGLLAEVTPDQPFMDKLFPFTWDAVRYDGKLIGYPIAVEALSLIYNKDLVKSPPKTWEEIPALDNELKKQNKSAIMFNLQEPYFTWPLIAADGGYAFKVENGAYNTKDSGVNNAGSKAGMQFLVDLVKNKHLSADIDYSIAEAAFNKGKTAMTINGPWTWTNIDKSKINYGVTLLPTFKGKPSKPFVGILTAGINAASPNKELAKEFLENYLLTNEGLATVDKDKPLGAVALKSYQDILAKDPRIAATMANAQQGEIMPNVSQMSSFWYAMRSAVLNAVNGRQSIDAALNDAENRIAK

SEQ ID NO: 6890 - protein, 93 aa, Xenorhabdus bovienii
  Peptide sequence Name=Xb4151_4152.C428.gene38.pep
MLLKRKASEREIPLSELFLSSFRPFRRLQVQDEFLVTPLENGSQCAINRKQAHPPLFYASPQMSVKLITKILKISMLTLKRHRFLGLKSHLAQ

SEQ ID NO: 6891 - protein, 431 aa, Xenorhabdus bovienii
  Peptide sequence Name=Xb4151_4152.C428.gene39.pep
  Gene classification: Function=ABC-type sugar transport systems, ATPase components; Function class=N Cell motility and secretion
  Homolog annotation: Query=63..431bp; Hit=1..371bp; Blast score=618; Percent Identity=82.0; E value=1e-177; Homolog= malK COG3839
LLSDFSQNIPITLISSSLCLPHKKLWDGGFLFLLFCTQFCYQFFTKFFTTNIKLGWQLRGEHMSSVTLRDVSKTYGETVISKNFNLEIEEGEFVVFVGPSGCGKSTLLRMIAGLEDITSGDLLIAGQRMNDVPPAKRSVGMVFQSYALYPHLSVADNMSFGMKLAGIKKSDIQKRVQQVAETLQLAHLLDRRPKALSGGQRQRVAIGRTLVAEPNIFLLDEPLSNLDAALRVQMRIEISRLHQRLQRTMIYVTHDQTEAMTLADKIVVLDAGNIAQVGKPLEIYHYPANRFVAGFIGSPKMNFLPVKVSATAIDQVQIILPNGQPVWLPVESKDVTVGSNVSLGIRPEHLLPNDVADVTLEGTVQIVEQLGNETQVHIRIPAIHQNLVYRQPDVVLVEEGATFTIGLAPHRCHLFREDGTACQRLHKEPGV

SEQ ID NO: 6892 - protein, 425 aa, Xenorhabdus bovienii
  Peptide sequence Name=Xb4151_4152.C428.gene40.pep
  Homolog annotation: Query=1..425bp; Hit=4..428bp; Blast score=734; Percent Identity=84.0; E value=0; Homolog= Pa|Phot3-141b11.p1k_g72| 43823 - 45109 3969 428 aa, chain +
MRILPLSLAILTGLLSMQATAVEFHGYARSGIGWAGKGGEQKCVQSTGAQSKYRLGNECETYAELKLGQELWKEGNKRFYFDTNVAYSVAQKDDWESTNPAFREVNVQASNVIDWLPGSTLWAGKRFYQRHDVHMIDFYYWDISGPGAGLQDIDLGFGKLSLAVTRNTESGGSVGWIADKRDEIPTSNDVFDVRLANLQVNEGGTLELGIDYGRANARKGYHLDQKASKDGVMLTAEHTQSMLGGFNKFVVQYATDAMTSYNSGHSEGASVNNDGNMLRILNHGAINITDKWDLMYLAMYQNIDRDNRNGNTWYTVGVRPMYKWTPIMSTLLEVGYDNVKSQRTKDTNNQYKITLAQQWQAGDSIWSRPAIRLFATYAKWDEKWGYANKNGSYTKGVAYSDSSSHRFSRGNSDEFTFGAQFEAWW

SEQ ID NO: 6893 - protein, 330 aa, Xenorhabdus bovienii
  Peptide sequence Name=Xb4151_4152.C428.gene41.pep
  Homolog annotation: Query=9..328bp; Hit=1..304bp; Blast score=380; Percent Identity=64.0; E value=1e-104; Homolog= Pa|Phot3-141b11.p1k _g74| 45230 - 46150 2672 306 aa, chain +
MDSDKANTMKIKLLSVCLSTLLCYALPAASYAAPDTAMPDSSDNIVVPDSKLHNTTAPALTISSLQKLKWLPANTHATQTIILNSASSRIHEGDIQGAVAAFALPANQGALEITLNSLIKDKQVYSPNVLVLDEQLRPAAFYPSHYFQYQRPGIMSVDRLEGTLKLTPALGQQQIYLLVYTTRADLQSSTQMVDPAKAYAQGVGNAVPNIPDPMARHTETGILTLKVKSERDAGNVLIGQAFSAPAPKPVIVGSMQTATTAVTALQPVVPAIAPKNKPVLGDTEKYFNNAIKKAINDGDIDKALHLLDEAERLGSATARDTFIKRIKNLK

SEQ ID NO: 6894 - protein, 31 aa, Xenorhabdus bovienii
  Peptide sequence Name=Xb4151_4152.C428.gene42.pep
LAKILIEYLVNKGIIDCKMNISFLTITPIIN

SEQ ID NO: 6895 - protein, 417 aa, Xenorhabdus bovienii
  Peptide sequence Name=Xb4151_4152.C428.gene43.pep
  Gene classification: Gene name=CDA1; Function=Predicted xylanase/chitin deacetylase; Function class=G Carbohydrate transport and metabolism
  Homolog annotation: Query=11..417bp; Hit=5..405bp; Blast score=437; Percent Identity=53.0; E value=1e-123; Homolog= ZyadE COG0726
MRQIVYVIEVALLLFFSFFSNSVLAQHHNLSNYRYMEVTKDSEIYARVGEHIVQVGLLKKGHFLKAAQEQGKQNDHYEFHFGNGQGYIDKENLKEVKQSVSFNGSLATLDKKTSENLMIFKDIRVYSTPEVNSSSIAILNANLRYPILDKLKDPSYQTWYEVNLGGRVGYISGQDAELDHGIPLLTYHHILKDKENKRFLHTSTTTSLSAFREQMDYLKQAGYTTISLYELEGYLNGTLNLPAKVVGLTFDDGLKSIYRYAYPILKKNGQKATLFIISSRIKRYPQEWNSENLQFMSLSTLYATKDVFDFQSHTHFLHRLGKNKGPILFSRSYHTILYDFERSRRALSQFNPHVLYLSYPFGGYNQQAIDAARNAGFHLAVTTKQGKVKLGDNPFSLKRLYILRTDSIEKMEKIIAN

SEQ ID NO: 6896 - protein, 1423 aa, Xenorhabdus bovienii
  Peptide sequence Name=Xb4151_4152.C428.gene44.pep
  Gene classification: Gene name=RpoC; Function=DNA-directed RNA polymerase beta' subunit/160 kD subunit (split gene in archaea and Syn); Function class=K Transcription
  Homolog annotation: Query=16..1422bp; Hit=1..1407bp; Blast score =2571; Percent Identity=91.0; E value=0; Homolog= rpoC COG0086
MGHSPNRSNSDRSHFVKDLLKFLKAQTKTEEFDAIKIALASPDMIRSWSFGEVKKPETINYRTFKPERDGLFCARIFGPVKDYECLCGKYKRLKHRGVICEKCGVEVTQTKVRRDRMGHIELASPTAHIWFLKSLPSRIGLLLDMPLRDIERVLYFESYVVVEGGMTSLERAQILTEEQYLDALEEFGDEFDAKMGAEAIQALLKNLDLENECETLREELNETNSETKRKKLTKRIKLLEAFIQSGNKPEWMVLTVLPVLPPDLRPLVPLDGGRFATSDLNDLYRRVINRNNRLKRLLDLAAPDIIVRNEKRMLQEAVDALLDNGRRGRAITGSNKRPLKSLADMIKGKQGRFRQNLLGKRVDYSGRSVITVGPYLRLHQCGLPKKMALELFKPFIYGKLELRGLATTIKAAKKMVEREEAVVWDILDEVIREHPVLLNRAPTLHRLGIQAFEPVLIEGKAIQLHPLVCAAYNADFDGDQMAVHVPLTLEAQLEARALMMSTNNILSPASGEPIIVPSQDVVLGLYYMTRDCVNAKGEGMVLTGPKEAERVYRAGLASLHARVKVRITEEVRDGEGNVTTNTGLVDTTVGRAILWMIVPRGLPYSLINQALGKKAISKMLNTCYRILGLKPTVILADQTMYTGFAYAARSGVSVGIDDMVIPEKKEGIIAEAEAEVAEIQEQFQSGLVTAGERYNKVIDIWAAANERVAKAMMENLSTEAVINRDGEEEQQVSFNSIFMMADSGARGSAAQIRQLAGMRGLMATPDGSIIETPITANFREGLNVLQYFISTHGARKGLADTALKTANSGYLTRRLVDVAQDLVVTEDDCGTHNGILMTPVIEGGDVKEPLRERVLGRVTAEDVLKPGTADILVPRNTLLNEKWCDLLEESSVDSVKVRSVVSCETDFGVCANCYGRDLARGHIINKGEAVGVIAAQSIGEPGTQLTMRTFHIGGAASRAAAESSIQVRNKGHLKLFNAKYVTNSAGKLVITSRNTELRLIDDFGRTKESYKVPYGSVLSKGDGETVTGGETVANWDPHIMPVVSEVSGIIQFYDMVDGQTITRQTDELTGLSSLVVLDSAERTGSGKDLRPALKIVDAQGKDVLISGTDMPAQYFLPGKAIVQLEDGMSISAGDTLARIPQESGGTKDITGGLPRVADLFEARRPKEPAILAEISGIVSFGKETKGKRRLVISPLDGSDAYEEMIPKWRQLNVFEGEVAERGDVISDGPESPHDILRLRGVHAVARYITNEVQEVYRLQGVKINDKHIEVIVRQMLRKVTIANAGSSEFLEGEQVEYARVKVANRKLELDGKLAATFHRDLLGITKASLATESFISAASFQETTRVLTEAAVAGKRDELRGLKENVIVGRLIPAGTGYAYHQERIRRRHANEVVEAPPVSVDEATANLAELLNAGFGSSSDKE

SEQ ID NO: 6897 - protein, 39 aa, Xenorhabdus bovienii
  Peptide sequence Name=Xb4151_4152.C428.gene45.pep
VAHATPPYDQCNHWLVNCPAYSYRTVPAGKRFIRLPARC

SEQ ID NO: 6898 - protein, 1342 aa, Xenorhabdus bovienii
  Peptide sequence Name=Xb4151_4152.C428.gene46.pep
  Gene classification: Gene name=RpoB; Function=DNA-directed RNA polymerase beta subunit/140 kD subunit (split gene in Mjan, Mthe, Aful); Function class=K Transcription
  Homolog annotation: Query=1..1342bp; Hit=1..1342bp; Blast score=2510; Percent Identity=94.0; E value=0; Homolog= rpoB COG0085
MVYSYTEKKRIRKDFGKRPQVLDIPYLLSIQLDSFQKFIEQDPEGQNGLEAAFRSVFPIQSYSGNSELQYVSYRLGEPVFDVQECQIRGVTYSAPLRVKLRLVIYEREAPEGTVKDIKEQEVYMGEIPLMTDNGTFVINGTERVIVSQLHRSPGVFFDSDKGKTHSSGKVLYNARIIPYRGSWLDFEFDPKDNLFVRIDRRRKLPASIILRAMNYSTEDILNLFFNKTIFEIRDNKLQMTLVPERLRGETASFDIEANGKLYVEKGRRITARHIRQLEKDQVDRIEVPVEYIAGKVVAKDYIDQNTGEILCAANMELSLDLLARLSQSGHKTIETLFTNDLDHGAYISETLRVDPTNDRLSALVEIYRMMRPGEPPTREAAENLFENLFFSEDRYDLSAVGRMKFNRSLDRTEIEGSGILSKEDITDVMKKLIDIRNGKGEVDDIDHLGNRRIRSVGEMAENQFRVGLVRVERAVKERLSLGDLDTLMPQDMINAKPISAAVKEFFGSSQLSQFMDQNNPLSEITHKRRISALGPGGLTRERAGFEVRDVHPTHYGRVCPIETPEGPNIGLINSLSVYARTNEYGFLETPYRLVRDGVVTDEIHYLSAIEEGNYVIAQANTVLDEEGHFVEDLVTCRHYDESSLFNRDQVQYMDVSTQQIVSVGASLIPFLEHDDANRALMGANMQRQAVPTLRADKPLVGTGMERAVAVDSGVTSVAKRGGVIQYVDASRIVIKVNEDEMYAGEAGIDIYNLTKYTRSNQNTCINQMPCVSLGELVERGDVLADGPSTDLGELALGQNMRVAFMPWNGYNFEDSILVSERVVQEDRFTTIHIQELACVSRDTKLGPEEITADIPNVGEAALSKLDESGIVYIGAEVKGGDILVGKVTPKGETQLTPEEKLLRAIFGEKASDVKDSSLRVPNGVAGTIIDVQVFTRDGVEKDKRALEIEEMQLRQAKKDLTEELRIFEAGLFARIHSVLVAGGVEAEKLSKLPRERWLELGLADEEKQNQLEQLAEQYDELKTEFEKKLDAKRRKITQGDDLAPGVLKIVKVYLAVKRQIQPGDKMAGRHGNKGVISKINPIEDMPYDENGTPVDIVLNPLGVPSRMNIGQILETHLGMAAKGIGDKINAMLKQQQEVAKLREFIQKAYDLGDDTRQKVDLNTFTDEEVLRLAENLKKGMPIATPVFDGAKETEIKELLQLAGLPTSGQITLFDGRTGEQFERQVTVGYMYMLKLNHLVDDKMHARSTGSYSLVTQQPLGGKAQFGGQRFGEMEVWALEAYGAAYTLQEMLTVKSDDVNGRTKMYKNIVDGNHQMEPGMPESFNVLLKEIRSLGINIELEDE

SEQ ID NO: 6899 - protein, 48 aa, Xenorhabdus bovienii
  Peptide sequence Name=Xb4151_4152.C428.gene47.pep
MSITENILFSVRTNSVAECCPKGRAEWVTDQRAEEPYGLLLYREKTYS

SEQ ID NO: 6900 - protein, 121 aa, Xenorhabdus bovienii
  Peptide sequence Name=Xb4151_4152.C428.gene48.pep
  Gene classification: Gene name=RplL; Function=Ribosomal protein L7/L12; Function class=J Translation, ribosomal structure and biogenesis
  Homolog annotation: Query=1..121bp; Hit=1..122bp; Blast score=122; Percent Identity=68.0; E value=4e-29; Homolog= BU035 COG0222
MSITKEQILDAVAEMSVMDVVELITMMEEKFGVSAAAAVAVVGGAAEAVEEKTEFDVILSSIGANKVAVIKAVRGATGLGLKEAKDLVESAPAALKEGISKDDAEALKKSLEEAGASVEIK

SEQ ID NO: 6901 - protein, 165 aa, Xenorhabdus bovienii
  Peptide sequence Name=Xb4151_4152.C428.gene49.pep
  Gene classification: Gene name=RplJ; Function=Ribosomal protein L10; Function class=J Translation, ribosomal structure and biogenesis
  Homolog annotation: Query=1..165bp; Hit=1..165bp; Blast score=233; Percent Identity=89.0; E value=1e-61; Homolog= rplJ COG0244
MALNLQDKQAIVAEVSEVAKGALSAVVADSRGVTVGKMTELRKAGREAGVYMRVVRNTLMRRAVEGTDYECLKEAFVGPTLIAFSSEHPGAAARLFKEFAKANPAFEIKAAAFEGEFISGENIDRLATLPTYEEAIARLMATMKEASAGKLVRTLAALRDQKEAA

SEQ ID NO: 6902 - protein, 40 aa, Xenorhabdus bovienii
  Peptide sequence Name=Xb4151_4152.C428.gene50.pep
VFQRSGTLGALSEVSPGFSRLIQEQEANGTKSSRQTSDCC

SEQ ID NO: 6903 - protein, 50 aa, Xenorhabdus bovienii
  Peptide sequence Name=Xb4151_4152.C428.gene51.pep
VSRIQKINFIWLCHRLRRILSNHLRLRSWTGLGLGQAPTENCFLPNIGFI

SEQ ID NO: 6904 - protein, 233 aa, Xenorhabdus bovienii
  Peptide sequence Name=Xb4151_4152.C428.gene52.pep
  Gene classification: Gene name=RplA; Function=Ribosomal protein L1; Function class=J Translation, ribosomal structure and biogenesis
  Homolog annotation: Query=1..232bp; Hit=1..232bp; Blast score=356; Percent Identity=92.0; E value=1e-98; Homolog= rplA COG0081
MAKLTKRMRTIRGKVDATKQYDINEAVALLKELATAKFVESVDVAVNLGIDARKSDQNVRGATVLPHGTGRSVRVAVFAQGANAEAAKAAGAELVGMDDLADQIKKGEMNFDVVIASPDAMRVVGQLGQILGPRGLMPNPKVGTVTPNVAEAVQNAKAGQVRYRNDKNGIIHTTIGKVDFDADKLKENLEALVVALKKAKPSSAKGIFIKKVSLSTTMGAGVAIDQSGLNATA

SEQ ID NO: 6905 - protein, 142 aa, Xenorhabdus bovienii
  Peptide sequence Name=Xb4151_4152.C428.gene53.pep
  Gene classification: Gene name=RplK; Function=Ribosomal protein L11; Function class=J Translation, ribosomal structure and biogenesis
  Homolog annotation: Query=1..141bp; Hit=1..141bp; Blast score=224; Percent Identity=91.0; E value=3e-59; Homolog= rplK COG0080
MAKKVQAYVKLQVAAGMANPSPPVGPALGQQGVNIMEFCKAFNAKTESIEKGLPIPVVITVYADRSFTFVTKTPPAAVLLKKAAGVKSGSGKPNKEKVGKVTSAQIREIAETKAADMTGADVDAMMRSIEGTARSMGLVVEG

SEQ ID NO: 6906 - protein, 34 aa, Xenorhabdus bovienii
  Peptide sequence Name=Xb4151_4152.C428.gene54.pep
LQLNVGLYFLSHLYFLYMGIIASKRGSPNDSGPV

SEQ ID NO: 6907 - protein, 181 aa, Xenorhabdus bovienii
  Peptide sequence Name=Xb4151_4152.C428.gene55.pep
  Gene classification: Gene name=NusG; Function=Transcription antiterminator; Function class=K Transcription
  Homolog annotation: Query=1..181bp; Hit=1..181bp; Blast score=327; Percent Identity=94.0; E value=4e-90; Homolog= nusG COG0250
MSESPKKRWYVIQAFSGFEGRVAQSLREHIKLDGMEDSFGEVMVPTEEVVEIRSGQRRKSERKFFPGYVLVQMVMNDATWHLVRSVPRVMGFIGGTSDRPAPISDKEVDAIMDRLQQVGDKPRPKTLFEPGEMVRVSDGPFADFNGVVEEVDYEKSRLKVSVSIFGRATPVELDFSQVEKA

SEQ ID NO: 6908 - protein, 127 aa, Xenorhabdus bovienii
  Peptide sequence Name=Xb4151_4152.C428.gene56.pep
  Gene classification: Gene name=SecE; Function=Preprotein translocase subunit SecE; Function class=N Cell motility and secretion
  Homolog annotation: Query=1..127bp; Hit=1..127bp; Blast score=140; Percent Identity=76.0; E value=2e-34; Homolog= secE COG0690
MSANSNAQESRRGLDIAKWLLVAVLLVVAIVGNYYYREYNLALRAIAVVAIVALAGAVAFWTAKGKATLAFAREARVEMRKVIWPTRQEALHTTLIVAAVTAVMSLILWGLDGILVRLVSFITGLRF

SEQ ID NO: 6909 - protein, 40 aa, Xenorhabdus bovienii
  Peptide sequence Name=Xb4151_4152.C428.gene57.pep
MQIRKVLLNYGAKSDTITIIFGFGLICFALARQAGYLFTS

SEQ ID NO: 6910 - protein, 43 aa, Xenorhabdus bovienii
  Peptide sequence Name=Xb4151_4152.C428.gene58.pep
VFILEGHRQMPFLYVVLRRTYLINSCLIMNGSLLNGCSELLVR

SEQ ID NO: 6911 - protein, 394 aa, Xenorhabdus bovienii
  Peptide sequence Name=Xb4151_4152.C428.gene59.pep
  Gene classification: Gene name=TufB; Function=GTPases - translation elongation factors; Function class=J Translation, ribosomal structure and biogenesis
  Homolog annotation: Query=1..394bp; Hit=1..394bp; Blast score=697; Percent Identity=92.0; E value=0; Homolog= tufB COG0050
VSKEKFERKKPHVNVGTIGHVDHGKTTLTAAITTVLAKTYGGSARAFDQIDNAPEEKARGITISTSHVEYDTPTRHYAHVDCPGHADYVKNMITGAAQMDGAVLVVAATDGPMPQTREHILLGRQVGVPYIIVFLNKCDMVDDEELLELVEMEVRELLSQYDFPGDDTPIIRGSALKALEGEAEWEAKIIELADALDSYIPEPERDIDKPFLLPIEDVFSISGRGTVVTGRVERGIVKVGDEVSIVGITDTVKTTCTGVEMFRKLLDEGRAGENVGVLLRGTKRDEIQRGQVLAKPGSIQPHTQFESEVYILSKDEGGRHTPFFKGYRPQFYFRTTDVTGTIELPEGVEMVMPGDNINMIVTLIAPIAMDEGLRFAIREGGRTVGAGVVAKVIA

SEQ ID NO: 6912 - protein, 702 aa, Xenorhabdus bovienii
  Peptide sequence Name=Xb4151_4152.C428.gene60.pep
  Gene classification: Gene name=FusA; Function=Translation elongation and release factors (GTPases); Function class=J Translation, ribosomal structure and biogenesis
  Homolog annotation: Query=1..699bp; Hit=1..702bp; Blast score=1188; Percent Identity=84.0; E value=0; Homolog= fusA COG0480
MARKTPIARYRNIGISAHIDAGKTTTTERILFYTGVNHKIGETHEGSATMDWMEQEQERGITITSAATTAFWSGMAKQYEPHRVNIIDTPGHVDFTIEVERSMRVLDGAVMVYCAVGGVQPQSETVWRQANKYNVPRIAFVNKMDRMGANFLRVVEQIKTRLAATPVPLQLAIGAEDTFTGVVDLLKMKAINWSEADQGVTFEYEEIPADMVELAQEWHQNLIESAAEASEELMDKYLGGEELTEEEIKSALRKRVLASEIILVTCGSAFKNKGVQAMLDAVIDYLPAPTDVESIKGMLPDGKDTPAERHSSDEEPFSALAFKIATDPFVGNLTFFRVYSGIVNSGDTVLNPVKDRKERFGRIVQMHANKREEIKEVRAGDIAAAIGLKDVTTGDTLCDLNSPIILERMEFPEPVISVAIEPKTKADQEKMGIALGRLAQEDPSFRVTSDEETGQTIIAGMGELHLDVLVDRMRREFNVEANVGKPQVAYRETIRNTVEQEGKHAKQSGGRGQYGHVWIRVEPLEPGGEGYVFENAIVGGVVPKEYIPGVDKGVREQLKGGVLAGYPIVDVKVTLFDGSYHDVDSSEIAFKIAASMAFKEGFMKAKPVLLEPIMKVEVETPEDYMGDVIGDLNRRRGMIEGMDDLATGKIVRAQVPLSEMFGYATDLRSQTQGRASYSMEFLKYNEAPSNVAQAIIETRKAR

SEQ ID NO: 6913 - protein, 49 aa, Xenorhabdus bovienii
  Peptide sequence Name=Xb4151_4152.C428.gene61.pep
VKTFTVWQKLTRRSHTTVGNSFVVNMFWVASRGYPFSKLNAHERGKHGS

SEQ ID NO: 6914 - protein, 156 aa, Xenorhabdus bovienii
  Peptide sequence Name=Xb4151_4152.C428.gene62.pep
  Gene classification: Gene name=RpsG; Function=Ribosomal protein S7; Function class=J Translation, ribosomal structure and biogenesis
  Homolog annotation: Query=1..156bp; Hit=1..156bp; Blast score=265; Percent Identity=95.0; E value=2e-71; Homolog= rpsG COG0049
MPRRRVIGQRKILPDPKFGSELLAKFVNILMVDGKKSTAEAIVYSALETLAQRSSKGHLEAFELALDNVRPTVEVKSRRVGGSTYQVPVEVRPVRRNALAMRWIVDAARKRGDKSMALRLANELSDAAENKGTAVKKREDVHRMAEANKAFAHYRW

SEQ ID NO: 6915 - protein, 124 aa, Xenorhabdus bovienii
  Peptide sequence Name=Xb4151_4152.C428.gene63.pep
  Gene classification: Gene name=RpsL; Function=Ribosomal protein S12; Function class=J Translation, ribosomal structure and biogenesis
  Homolog annotation: Query=1..124bp; Hit=1..124bp; Blast score=212; Percent Identity=93.0; E value=5e-56; Homolog= HI0581 COG0048
MATINQLVRKSRSSKVVKSNVPALEACPQKRGVCTRVYTTTPKKPNSALRKVCRVRLTNGFEVSSYIGGEGHNLQEHSVILIRGGRVKDLPGVRYHTVRGALDCSGVKDRKQGRSKYGVKKPKA

SEQ ID NO: 6916 - protein, 34 aa, Xenorhabdus bovienii
  Peptide sequence Name=Xb4151_4152.C428.gene64.pep
LPLLKKLLVFLLRKHGFYPLSAIMTKHEDAEFYC

SEQ ID NO: 6917 - protein, 37 aa, Xenorhabdus bovienii
  Peptide sequence Name=Xb4151_4152.C428.gene65.pep
LSVNTLSLQVFYQHRKAVYFLTPRQVSNKIPRPHVLS

SEQ ID NO: 6918 - protein, 95 aa, Xenorhabdus bovienii
  Peptide sequence Name=Xb4151_4152.C428.gene66.pep
  Gene classification: Gene name=DsrH; Function=Uncharacterized ACR involved in oxidation of intracellular sulfur; Function class=P Inorganic ion transport and metabolism
  Homolog annotation: Query=1..95bp; Hit=1..95bp; Blast score=94; Percent Identity=50.0; E value=2e-20; Homolog= yheL COG2168
MLYTVSRSPYHDDFNAMLSLVSDADDVLLMQNGVLLGINDNRYLAELIRTGAGVYALQEDLTARGLVEQISDRVQVIDYKGFVSLTAKHPQNFGW

SEQ ID NO: 6919 - protein, 119 aa, Xenorhabdus bovienii
  Peptide sequence Name=Xb4151_4152.C428.gene67.pep
  Gene classification: Gene name=DsrF; Function=Uncharacterized protein involved in the oxidation of intracellular sulfur; Function class=P Inorganic ion transport and metabolism
  Homolog annotation: Query=1..119bp; Hit=1..119bp; Blast score=148; Percent Identity=61.0; E value=1e-36; Homolog= yheM COG2923
MKKIAFVFTEAPHGSSAGREGLDALLATSALTEKIGVFFISDGVFQLLTNQQPETILARDYISTFKILPLYDIDKCYICLDDLNARGGSPASDLVLEAEFLPAAAIREVLSEYDVVLKF

SEQ ID NO: 6920 - protein, 131 aa, Xenorhabdus bovienii
  Peptide sequence Name=Xb4151_4152.C428.gene68.pep
  Gene classification: Gene name=DsrE; Function=Uncharacterized ACR involved in intracellular sulfur reduction; Function class=P Inorganic ion transport and metabolism
  Homolog annotation: Query=4..131bp; Hit=1..128bp; Blast score=163; Percent Identity=67.0; E value=6e-41; Homolog= ZyheN COG1553
MSSLSYCLLVTGPAYGTQQASSAYQFAQALVASDHKLHSVFFYREGVQNGNRLVAPASDEFDLVRAWQAMATQHQCNLFICVAAALRRGVADEQQANELNLSAANLADGFELSGLGSLAEAMMLCDRVVQF

SEQ ID NO: 6921 - protein, 244 aa, Xenorhabdus bovienii
  Peptide sequence Name=Xb4151_4152.C428.gene69.pep
  Gene classification: Function=Uncharacterized BCR; Function class=S Function unknown
  Homolog annotation: Query=1..244bp; Hit=1..244bp; Blast score=386; Percent Identity=78.0; E value=1e-107; Homolog= ZyheO COG2964
MVYCMSTPLLSGDNSDIDLLENQPFSETDHEILKSYEAAVDGLAMLIGGHCEIVLHSLEDLKCSAVRIANGEHTGRKIGSPITDLALRMLHDITDEDCNVSRAYFTRAKSGALMKSVTIAIRNRSRRVIGLLCINMNLDVPFSEIIQTFIPEKTHEVSSNVNFASSVDDLVAQTLEFTIEEVNADRNVSNNAKNRQVVLNLYEKGIFDIKDAINQVADRLNISKHTVYLYIRQFKNGEYASSEK

SEQ ID NO: 6922 - protein, 42 aa, Xenorhabdus bovienii
  Peptide sequence Name=Xb4151_4152.C428.gene70.pep
MQYTILQAQTLPHRKYQGEIYYKITLMQLNRKHFKCSVFYSE

SEQ ID NO: 6923 - protein, 30 aa, Xenorhabdus bovienii
  Peptide sequence Name=Xb4151_4152.C428.gene71.pep
VIKLCGLCSKGLTAIQCGFNVIILNRTQNI

SEQ ID NO: 6924 - protein, 35 aa, Xenorhabdus bovienii
  Peptide sequence Name=Xb4151_4152.C428.gene72.pep
LPSSPCCTDRRVLSQLLYSIYLKYEKVISFNTVKK

SEQ ID NO: 6925 - protein, 252 aa, Xenorhabdus bovienii
  Peptide sequence Name=Xb4151_4152.C428.gene73.pep
  Gene classification: Gene name=FkpA; Function=FKBP-type peptidyl -prolyl cis-trans isomerases 1; Function class=O Posttranslational modification, protein turnover, chaperones
  Homolog annotation: Query=1..251bp; Hit=1..254bp; Blast score=265; Percent Identity=60.0; E value=3e-71; Homolog= fkpA COG0545
MKSLLKTTLLAASLAMAFSVPQALSANTENEVKLNSAFKTENQQNAYALGSSLGRYMGASLKEQESLGIKLDQSQLLAGVEDALKDKSKLNDQEIQQILGTFEAKVKSAAQAKAEKEADENAEKGTKYSQQFAKTSGVVKTKTGLLYKIEKEGSGKTPTEKDTVVVNYKGSLIDGKVFDSSYERKEPLTIGLDRIIPGWKEGLQHVKKGGKITLVIPPDLAYGKTSLPSIPTNSTLVFDIELLDIKPAAKAK

SEQ ID NO: 6926 - protein, 35 aa, Xenorhabdus bovienii
  Peptide sequence Name=Xb4151_4152.C428.gene74.pep
VNELTITVCGNRTQYSSYIGFRTIKTKRFHGNPLL

SEQ ID NO: 6927 - protein, 72 aa, Xenorhabdus bovienii
  Peptide sequence Name=Xb4151_4152.C428.gene75.pep
VLLSEFEQKFEQLETKLAYQEVTIEELNKEVRKQQIETEKLKKQLQLMSERLKTHQSSIIAPLSEETPPPHY

SEQ ID NO: 6928 - protein, 50 aa, Xenorhabdus bovienii
  Peptide sequence Name=Xb4151_4152.C428.gene76.pep
MLWRRLPLIVKQKKGSADELLFFVFPPSLASIFLPEKAGTVLVMRGRCFF

SEQ ID NO: 6929 - protein, 178 aa, Xenorhabdus bovienii
  Peptide sequence Name=Xb4151_4152.C428.gene77.pep
  Gene classification: Gene name=SlpA; Function=FKBP-type peptidyl -prolyl cis-trans isomerases 2; Function class=O Posttranslational modification, protein turnover, chaperones
  Homolog annotation: Query=1..148bp; Hit=1..148bp; Blast score=238; Percent Identity=87.0; E value=3e-63; Homolog= slyD COG1047
MKVAQDLVVSLAYQVRTEEGVLVDESPVSAPLDYLHGRGSLISGLEKAVEGREAGERFDVSVEANDAYGQYDENLVQRVPKDVFVGVDELQVGMRFLADTDMGPVPVEITALEGDEVVVDGNHMLAGQNLKFNVEIVAVREATEEELAHGHVHGQGGCGDHDHDHDHEEHACCGGGCH

SEQ ID NO: 6930 - protein, 37 aa, Xenorhabdus bovienii
  Peptide sequence Name=Xb4151_4152.C428.gene78.pep
LISQADHQVLCYFHDISYIPEGKKPREGKFLRLKKCC

SEQ ID NO: 6931 - protein, 43 aa, Xenorhabdus bovienii
  Peptide sequence Name=Xb4151_4152.C428.gene79.pep
MLLIVTEFYLSVPSDSKIYPLFVVHIFNYCGVKIPITCSCSLT

SEQ ID NO: 6932 - protein, 87 aa, Xenorhabdus bovienii
  Peptide sequence Name=Xb4151_4152.C428.gene80.pep
MSVAGRKAGTNINSNGGESCQSVVNVLLQERFVPSVSRGTHWRCGRKIKSILWSVFIVGMCSGKPMKPWRLMLESRNRLSVSSHHNN

SEQ ID NO: 6933 - protein, 615 aa, Xenorhabdus bovienii
  Peptide sequence Name=Xb4151_4152.C428.gene81.pep
  Gene classification: Gene name=KefB; Function=Kef-type K+ transport systems, membrane components; Function class=P Inorganic ion transport and metabolism
  Homolog annotation: Query=14..412bp; Hit=1..399bp; Blast score=467; Percent Identity=70.0; E value=1e-131; Homolog= kefB_1 COG0475
MAEIAFVFGRNVIMENSALLSAGTLFLSAAVVAVPLAQKFKIGAVLGYLIVGIVLGPWGLGFIKDVEEILHFSELGVVFLMFIIGLELNPAKLWQLRRSIFGAGTAQVVLTALVLILFLCLTNFAWQAAVIGGIGLAMSSTAMALQLMEEKGMTDSEGGQLGFSILLFQDIALIPSLALIPLLAGSTASSDWYRVGLKFVAFAGMLLGGRYLLRPLFRLVVKSGVREVFTAAALLVVLGAAIFMEELGFSMALGTFIAGVLLADSEYRHELEISIEPFKGLLLGLFFISVGMSLNMGVLLTHLSGVLFSVLGLVLIKTFILYVIGRFAGLKKASCFQFSGVLSQGGEFAFVLFSTALGQRVLDQNQMSLLLVVVTLSMMTTPLVMQLIQSILARHYNAQEEKSSEQPFVEDNEPQVILVGFGRFGQVVGRLLMANKIRITVLERDASAISTLRRYGYKVYYGDARERELLRAAGAANAEAIVIASDEPEETMAIVHLCQKHFPQLHIIARARGRLEAHELLQNDVKDFSRETFSSALELGRKALIKTGMHPHQAYRAQQHFRRLDMRMLRELMPQLHGDVAQISRVKEARRELEELFEREMLNERRRPEGWDEYK

SEQ ID NO: 6934 - protein, 182 aa, Xenorhabdus bovienii
  Peptide sequence Name=Xb4151_4152.C428.gene82.pep
  Gene classification: Gene name=MdaB; Function=Putative NADPH-quinone reductase (modulator of drug activity B); Function class=R General function prediction only
  Homolog annotation: Query=1..181bp; Hit=2..183bp; Blast score=252; Percent Identity=70.0; E value=2e-67; Homolog= yheR COG2249
MLLPPKILLLYIHPEPQISVANNVLLQPVRALEHVTLHDLYGCYPDFFIDVPLEQKLLREHEIIVFQHPLYTYSCPALLKEWMDRVLSRDFVSGSELALTGKYWRSVITTGEPEGAYRKGGYNLYPMEEILRPFELTASMCHMHWLSPMIIYWARRQRPEVLASHAKAYRKWLKSPLSLGGM

SEQ ID NO: 6935 - protein, 650 aa, Xenorhabdus bovienii
  Peptide sequence Name=Xb4151_4152.C428.gene83.pep
  Gene classification: Gene name=Uup; Function=ATPase components of ABC transporters with duplicated ATPase domains; Function class=R General function prediction only
  Homolog annotation: Query=1..642bp; Hit=1..630bp; Blast score=973; Percent Identity=79.0; E value=0; Homolog= yheS COG0488
MIVFSSLQIRRGIRVLLDNASATINPGQKVGLVGKNGCGKSTLLSLLKGELQSENGSVTFPNNWALAWVNQETPALEISALEYVIDGDREFRQLEQKLKIANEQNDGHAIAHLHGQLDTIQAWTIRARASSLLHGLGFSQTKLEQSVSSFSGGWRMRLNLAQALICRSDLLLLDEPTNHLDLDAVIWLEKWLKNYTGTLILISHDRDFLDPIIDKILHIEQLILAEYTGNYSSFERQRAAKLAQQQALYQSQQEKVTHLQSYIDRFRAKASKAKQAQSRIKMLERMELIAPAHVDNPFRFSFRQPDSLPSPLLVMEKVSAGYGEKTVLDSIKLNLVPGSRIGLLGRNGAGKSTLIKLLAGGLAPQRGEIALAKGIKLGYFAQHQLEYLRADESPLQHLVRIAPQETEQQLRDYLGGFGFKGDQVTDPSGRFSGGEKARLVLALIVWQRPNLLLLDEPTNHLDLDMRQALTEALIDFDGALVVVSHDRHLLRSTTDELYLVHDGEVEPFTGDLEDYQQWLTEQQRQQTRENQEKEKATSSPDASMNGAQNYSAQERKDQKRREAEFRNQTQPLRKQLTALEKQMEKLGATLAGWEEKLSDNTIYENDRKTELTECLQQQTQTKSKLEDVEMEWLDIQEQLEQMSETFNVNQ

SEQ ID NO: 6936 - protein, 39 aa, Xenorhabdus bovienii
  Peptide sequence Name=Xb4151_4152.C428.gene84.pep
LIFNAQILKKAGPCLQNKKVNTCRRTAILLTVKNDNSFI

SEQ ID NO: 6937 - protein, 222 aa, Xenorhabdus bovienii
  Peptide sequence Name=Xb4151_4152.C428.gene85.pep
  Gene classification: Gene name=Tra8; Function=Transposase, IS30 family; Function class=L DNA replication, recombination and repair
  Homolog annotation: Query=1..207bp; Hit=106..312bp; Blast score=240; Percent Identity=59.0; E value=9e-64; Homolog= NMB0225 COG2826
LHHETVYRLIYKDKLNDGNLWQHLRIAKKPYRKRYGSYERRGKIKNRVSIDKRPKLVDKKQRIGDWEGDTIVGKNHKSALLTLVERKSLFTIIIKLENKTAEGVAKAATRHLSLIKHKIKTMTFDNGLEFAEHELISKNLETKIYFAHPYSPWERGINENTNGLIRDYFPKGTDFNKVSEREINLVANRLNNRPRKTRDYKTPNELFKGIPSHLLRPLRCCA

SEQ ID NO: 6938 - protein, 60 aa, Xenorhabdus bovienii
  Peptide sequence Name=Xb4151_4152.C428.gene86.pep
  Homolog annotation: Query=1..44bp; Hit=1..44bp; Blast score=61; Percent Identity=77.0; E value=4e-09; Homolog= gi|37524850|ref|NP _928194.1| Transposase, IS30 family [Photorhabdus luminescens subsp. laumondii TTO1] gi|37525554|ref|NP_928898.
MAYKQLTETERYQIFSLKEAGFSQREISKSLNRNPSTISRELRQIGRQRNIRLNKLSLRP

SEQ ID NO: 6939 - protein, 296 aa, Xenorhabdus bovienii
  Peptide sequence Name=Xb4151_4152.C428.gene87.pep
  Gene classification: Gene name=LysR; Function=Transcriptional regulator; Function class=K Transcription
  Homolog annotation: Query=1..82bp; Hit=1..82bp; Blast score=76; Percent Identity=45.0; E value=3e-14; Homolog= XF1722 COG0583
MDIRNLEAFIVLAETLNYHKASERLYLSQPALTKKIHGLEDILGASLFIRGPNGTRLTDFGHKTLENARKFLSHYEQFKSRVHFDSKEDIIRHLYVGSCFPIHNYSQIEKQIADKKGNVILALMTGLSVEQQISLLNAGMLHVAVMPLVAITQLEPKKIFTEKLIYIFKRRSHLIPKFRTEKSQFGNGNVPVYSSEKKDIVELTDCLNVFPVYTGDSKHLLLKTNDIMLIMEMITKNSAYACVPQRIISSIPEYYMNLLEIVETDKKIELGVIWGKSIDDHLIDDVESFSALVANL

SEQ ID NO: 6940 - protein, 40 aa, Xenorhabdus bovienii
  Peptide sequence Name=Xb4151_4152.C428.gene88.pep
MIIKSLSQNDKSFKIAYIHVLSLNDCLIATKHYRFMVIAF

SEQ ID NO: 6941 - protein, 32 aa, Xenorhabdus bovienii
  Peptide sequence Name=Xb4151_4152.C428.gene89.pep
LCIWIFSFCCNCLCSKLKCRINKSFANCALIN

SEQ ID NO: 6942 - protein, 42 aa, Xenorhabdus bovienii
  Peptide sequence Name=Xb4151_4152.C428.gene90.pep
LPIDKSYQLITCRSLFFSGDSQNCTTYKITSNVIMCMVYWQV

SEQ ID NO: 6943 - protein, 38 aa, Xenorhabdus bovienii
  Peptide sequence Name=Xb4151_4152.C428.gene91.pep
LEQTIDNSHSLYYIIYFRSLILWLFLYLLLLRVNKPQL

SEQ ID NO: 6944 - protein, 30 aa, Xenorhabdus bovienii
  Peptide sequence Name=Xb4151_4152.C428.gene92.pep
LSVNTIFNAQSNHLTYNLHITKTQYITTIK

SEQ ID NO: 6945 - protein, 66 aa, Xenorhabdus bovienii
  Peptide sequence Name=Xb4151_4152.C428.gene93.pep
  Gene classification: Gene name=InsB; Function=Insertion element IS1 protein InsB, putative transposase; Function class=L DNA replication, recombination and repair
  Homolog annotation: Query=4..61bp; Hit=109..166bp; Blast score=58; Percent Identity=48.0; E value=1e-09; Homolog= insB_g3 COG1662
VYGRLPEEDHLTGKTFTQRIERTNLTHRTRIKRLNRKTMGYSESEEMHNKVIGTFIERKHYFQCSI

SEQ ID NO: 6946 - protein, 67 aa, Xenorhabdus bovienii
  Peptide sequence Name=Xb4151_4152.C428.gene94.pep
MYFNIKMNNGGIHDTVRVLNVAIATAMKTFDKFYPPLIFGFTVRMIIGCMAAFLRKITLPERRLPNV

SEQ ID NO: 6947 - protein, 56 aa, Xenorhabdus bovienii
  Peptide sequence Name=Xb4151_4152.C428.gene95.pep
LILKYIKKDFIFISNEFYIKSSTIIMLPMNSIFTFPSHTTGTNNENRSEQYGDRKP

SEQ ID NO: 6948 - protein, 300 aa, Xenorhabdus bovienii
  Peptide sequence Name=Xb4151_4152.C428.gene96.pep
  Gene classification: Function=Predicted sugar phosphate isomerase; Function class=R General function prediction only
  Homolog annotation: Query=1..299bp; Hit=6..304bp; Blast score=399; Percent Identity=72.0; E value=1e-111; Homolog= VC0206 COG2103
MKIDLSNMVTESRNPASTHIDELSTLDMLRVINDEDQKVALAVAETLPQIARVVDKVAEAFRHGGRLIYSGAGTSGRLGILDASECPPTYGTKPEWVVGLIAGGHQAILKAVENAEDNQQSGVEDLKGLHFNEKDVLVGIAASGRTPYVLGAMKYARSVGATIACISCNPDSPMTQLADIAITPVVGPEIVTGSSRMKAGTAQKLVLNMITTGAMIRMGKVYGNLMVDIEATNAKLIERQKNIVMAATECSREMAEQALSACDGHCKTAIVMILSGTCAEDAKRLLAEHQGFIRPAISKS

SEQ ID NO: 6949 - protein, 482 aa, Xenorhabdus bovienii
  Peptide sequence Name=Xb4151_4152.C428.gene97.pep
  Gene classification: Gene name=PtsG; Function=Phosphotransferase system IIC components, glucose/maltose/N-acetylglucosamine-specific; Function class=G Carbohydrate transport and metabolism
  Homolog annotation: Query=108..482bp; Hit=1..375bp; Blast score=481; Percent Identity=70.0; E value=1e-136; Homolog= PM1575_2 COG1263
MAKISQEMLVEILRAMGGADNVVHCGNCMTRLRLTLHDDSLVDKTVLNKISGVLGVIENDEQLQIVLGPGKAQTAADRLNGLLSTADHSAAGHQPADLKEIASSNKKQLKEKQTRSVHKFLAKFATIFTPLIPGFIAVGLLLGFATLLEQIFIQGTGHPNAVLVEMVGYMKVFSKGMFSFLSILIGYNAQKAFGGSGVNGAIIASLFVLGYNASATSGFYSGISDFFGFAIDPRGNIIGVLIACILGAWVEKQIRKMMPSDLDMILTSTLTLLIMGAVAFIVIMPVGSYLFTAMSWLFMHLNGNPFGAAILAGLFLIAVMFGVHQGFVPVYFTLMDVQNFNSLFPILAMAGAGQVGSALALYMKAQKGSLLRTQIKGAIIPGFLGIGEPLIYGVTLPRVKPFVTACFGGAIGGFFIGLVAWLGVPVGLNSVFGPSGLVALPLMTSDSGIFTGMAVYGAGLIIAYISGFILTFFFGSKNIDLS

SEQ ID NO: 6950 - protein, 224 aa, Xenorhabdus bovienii
  Peptide sequence Name=Xb4151_4152.C428.gene98.pep
  Gene classification: Gene name=RhtB; Function=Putative threonine efflux protein; Function class=E Amino acid transport and metabolism
  Homolog annotation: Query=24..213bp; Hit=3..190bp; Blast score=109; Percent Identity=36.0; E value=3e-24; Homolog= PA2306 COG1280
VNNILLFSSKGNVNHLGKRNNPPMTASLIFSLSTFLLISGITPGPNNMLLTSSGANFGFRRSLPLWVGILLGIQTILLLSAFGVGAVLLLYPAMHTVLKVLGSLYLLRLAWKTSTAHYKRLETANLAAVPIKSHQGWLLQFLNPKAWMMGLGAVGSYSLQGDLYNHSVVVISVVMLISNMIAGTVWIVLGSLIGSLLKSRNAWFIFNITMGILTAVCVPLLWIS

SEQ ID NO: 6951 - protein, 72 aa, Xenorhabdus bovienii
  Peptide sequence Name=Xb4151_4152.C428.gene99.pep
  Gene classification: Function=Uncharacterized BCR; Function class=S Function unknown
  Homolog annotation: Query=1..71bp; Hit=1..71bp; Blast score=102; Percent Identity=78.0; E value=1e-22; Homolog= yheU COG3089
MMIPWQQLAPETLLDLIESFVLREGTDYGEDEKTLEQKVQDVKRQLERGEVLLVWSELHETVNIMPKEMFRP

SEQ ID NO: 6952 - protein, 56 aa, Xenorhabdus bovienii
  Peptide sequence Name=Xb4151_4152.C428.gene100.pep
LNGEKSYWFGLNCMRPSISCPKRCFALSAFFLSGCSVCLILLCIADYEKDSPNFFG

SEQ ID NO: 6953 - protein, 289 aa, Xenorhabdus bovienii
  Peptide sequence Name=Xb4151_4152.C428.gene101.pep
  Homolog annotation: Query=1..288bp; Hit=1..288bp; Blast score=530; Percent Identity=88.0; E value=1e-149; Homolog= Pa|Phot2-74c01.p1k _g53| 24724 - 25593 1670 289 aa, chain +
MSAKHPVIAITGSSGAGTTTTSVAFRKIFQQLEVTAALIEGDSFHRYTRPEMDAEIRKAKEQGRHVSYFGPEANDFSMLEKTFYNYGETGTGRCRRYLHTYDEAVPYNQVPGTFTPWESLPSNTDILFYEGLHGGVVTPQYNVASYVDLLIGVVPIVNLEWIQKLIRDTSERGHSREAVMDSVVRSMDDYIRYITPQFSRTHINFQRVPTVDTSNPFSAKAIPSLDESFIVIRFRGLKQIDFPYLLSMLQGSFISSINTIVVPGGKVGLAMELIMAPWVQQLLEGKKIS

SEQ ID NO: 6954 - protein, 34 aa, Xenorhabdus bovienii
  Peptide sequence Name=Xb4151_4152.C428.gene102.pep
LERRLYCSTTYRKSNNASISKGKRRNNIKTGTAE

SEQ ID NO: 6955 - protein, 42 aa, Xenorhabdus bovienii
  Peptide sequence Name=Xb4151_4152.C428.gene103.pep
LPASLVTSFVTQENVSVFPCIASARQINRNLFGASSLLLYDL

SEQ ID NO: 6956 - protein, 36 aa, Xenorhabdus bovienii
  Peptide sequence Name=Xb4151_4152.C428.gene104.pep
LPRTIRFILCCYFRLDDVRNSFSSPGWLYKVNSLTY

SEQ ID NO: 6957 - protein, 210 aa, Xenorhabdus bovienii
  Peptide sequence Name=Xb4151_4152.C428.gene105.pep
  Gene classification: Gene name=Crp; Function=cAMP-binding domains - Catabolite gene activator and regulatory subunit of cAMP-dependent protein kinases; Function class=T Signal transduction mechanisms
  Homolog annotation: Query=1..210bp; Hit=1..210bp; Blast score=406; Percent Identity=96.0; E value=1e-113; Homolog= crp COG0664
MVLGKPQTDPTLEWFLSHCHIHKYPSKSTLIHQGEKAETLYYIVKGSVAVLIKDEEGKEMILSYLNQGDFIGELGLFEEGKLRTAWVRAKSACEVAEISYKKFRQLIQVNPDILMRLSSQMARRLQTTSEKVGNLAFLDVTGRIAKTLMNLAKQPDAMTHPDGMQIKITRQEIGQIVGCSRETVGRILKMLEDQNLISAHGKTIVVYGTR

SEQ ID NO: 6958 - protein, 73 aa, Xenorhabdus bovienii
  Peptide sequence Name=Xb4151_4152.C428.gene106.pep
VFPRNSWPHSQDVRRSKPDLCSWQNHCSIWNPLISEITLETEPAQPLSCTGFFVASFVLSVQWQHQAPLRRFL

SEQ ID NO: 6959 - protein, 33 aa, Xenorhabdus bovienii
  Peptide sequence Name=Xb4151_4152.C428.gene107.pep
MANIKIRWGKSRLSQRNIRARPVKYYRKRRNGA

SEQ ID NO: 6960 - protein, 191 aa, Xenorhabdus bovienii
  Peptide sequence Name=Xb4151_4152.C428.gene108.pep
  Gene classification: Gene name=PabA; Function=Anthranilate/para -aminobenzoate synthases component II; Function class=E Amino acid transport and metabolism
  Homolog annotation: Query=1..189bp; Hit=1..190bp; Blast score=286; Percent Identity=72.0; E value=1e-77; Homolog= VC2619 COG0512
MLLIIDNYDSFTFNLYQYFCELGTNVLVKRNDELQLEDIEKLAPTHLVISPGPCTPNEAGISLEAIAHFAGKLPILGVCLGHQAIGQAFGASVVKAREVMHGKNSLIHHNQQGVFKGLNRPLTVTRYHSLVIAAETLPASFEVTAWSQHNGNVDEIMGIRHRTLPLEGVQFHPESILSEQGHDLLNNFLRY

SEQ ID NO: 6961 - protein, 60 aa, Xenorhabdus bovienii
  Peptide sequence Name=Xb4151_4152.C428.gene109.pep
VPSSPLTCVIFSRQALTTGECCCLYPTILKIRLWYDERPAAVDAALPDFIEIQNAQCPLG

SEQ ID NO: 6962 - protein, 188 aa, Xenorhabdus bovienii
  Peptide sequence Name=Xb4151_4152.C428.gene110.pep
  Gene classification: Gene name=PpiB; Function=Peptidyl-prolyl cis -trans isomerase (rotamase) - cyclophilin family; Function class=O Posttranslational modification, protein turnover, chaperones
  Homolog annotation: Query=1..188bp; Hit=1..190bp; Blast score=270; Percent Identity=72.0; E value=8e-73; Homolog= ppiA COG0652
MFKRIFVSLMAACAISVMATPALAAETHVKLVTSAGEIELALDSNKAPITTKNFIEYVNEGFYNNTIFHRIIPGFMVQGGGFTKDMKQKVTKAPIKNEADNGLRNLRGTIAMARTADKDSATSQFFINVTDNAFLDHGQRDFGYAVFGKVIKGMDVVDKISQVKTENVGPYQNVPVKPIVILSAKVAP

SEQ ID NO: 6963 - protein, 34 aa, Xenorhabdus bovienii
  Peptide sequence Name=Xb4151_4152.C428.gene111.pep
LRDICIVYPLVEYSIFLAIYNVIPHINKIQVMRP

SEQ ID NO: 6964 - protein, 35 aa, Xenorhabdus bovienii
  Peptide sequence Name=Xb4151_4152.C428.gene112.pep
VANVRCTRDKVGHVIVVVFDGQNGYLPEEYTKTAR

SEQ ID NO: 6965 - protein, 198 aa, Xenorhabdus bovienii
  Peptide sequence Name=Xb4151_4152.C428.gene113.pep
  Gene classification: Function=Predicted GTPases; Function class=R General function prediction only
  Homolog annotation: Query=7..198bp; Hit=3..196bp; Blast score=290; Percent Identity=77.0; E value=1e-78; Homolog= ZyihA COG0218
MTHFVTSAPDIRHLPQDVGIEVAFAGRSNAGKSSALNALTKQKSLARTSKTPGRTQLINLFEVEDGIRLVDLPGYGYAEVPEEMKRKWQNALGEYLQKRECLLGLVVLMDIRHPLKDLDMQMIEWAVVMQVPVMVLLTKADKLASGARKSQLAKVRQELTSLGGEIQIENFSALKKIGIDQLEQKLDYWFNQPAIEVE

SEQ ID NO: 6966 - protein, 68 aa, Xenorhabdus bovienii; identical to SEQ ID NO: 6354
  Peptide sequence Name=Xb4151_4152.C428.gene114.pep

SEQ ID NO: 6967 - protein, 87 aa, Xenorhabdus bovienii
  Peptide sequence Name=Xb4151_4152.C428.gene115.pep
  Gene classification: Function=Transposase; Function class=L DNA replication, recombination and repair
  Homolog annotation: Query=1..85bp; Hit=251..335bp; Blast score=74; Percent Identity=48.0; E value=2e-14; Homolog= PA2319 COG3547
LVPRQYSTGGKNTLLGISKRGDKNLRRLLVQCARVFIQRIDYQSGRLAEWVKAQLERKHSNVVACALANKLARIAWAITTRQTVFER

SEQ ID NO: 6968 - protein, 485 aa, Xenorhabdus bovienii
  Peptide sequence Name=Xb4151_4152.C429.gene1.pep
  Gene classification: Gene name=RfbX; Function=Membrane protein involved in the export of O-antigen and teichoic acid; Function class=R General function prediction only
  Homolog annotation: Query=17..367bp; Hit=5..358bp; Blast score=124; Percent Identity=28.0; E value=2e-28; Homolog= PA3153 COG2244
MNYIKNILLKIKEKNKFYYNVLSLAGGTLLAQLITIAFMPLMTRLYSPNSFGVLATYISIIAILNVIVSLRYELAIVLPKYDNQAKVILFLALAFTIITSFTSILIIIFFPKKLLGNMGLQDFNNYLYLIPASLLFIGIYQALTYWASRNKNFTLIARTKFSQTLSMLIAQLSLYKLQDLGLILGQLLNQFMGSLKLYKYSKKTKSFVIPSRKRLIWGIRKYKDFPKYILMGSLLDNTSSRIPIFLLAIHFNPAYAGFYAITDRILTLPVQLIGKSLSNVYYAEASNFYRENRLNELTYQIYKKLVTLAFPFVILIMLISPTMFNYIFGNEWKTAGHYARILCMLMYIVFITSPISSAYMILGKQKIWTLFQAIILLTSIVTLYIGIYLDNDIYTILFYSIGNMLCWSIILVYLFRILKIKFKQYFKDQYINFILSLLTNSPLIIYMLYIHLNNTQENTIYWAGCIIISLILIIFRYMHMLKKKV

SEQ ID NO: 6969 - protein, 357 aa, Xenorhabdus bovienii
  Peptide sequence Name=Xb4151_4152.C429.gene2.pep
  Gene classification: Gene name=WecE; Function=Predicted pyridoxal phosphate-dependent enzyme apparently involved in regulation of cell wall biogenesis; Function class=M Cell envelope biogenesis, outer membrane
  Homolog annotation: Query=1..352bp; Hit=2..353bp; Blast score=530; Percent Identity=73.0; E value=1e-150; Homolog= PA3155 COG0399
MQFTDLAAQQLKIKDKIDENIQKVLAHGKYILGPEVSELEEKLVEYTGAKYCITCANGTDALQIALMAIGIKPGDEVITPGFTYIATAETVALLGGIPVYVDVKPTTYNLDPALLEAAITPKTKAIIPVSLYGQCADFDEINAIAEKHNITVIEDAAQSFGATYKGKRSCNLTTIACTSFFPSKPLGCYGDGGAIFTSDEGLAKIIRQIARHGQDRRYHHIRVGVNSRLDTLQAAILLPKLEIFDEEMKSRQIVAKNYNRALNQIGILTTPYIESHNVSAYAQYTIRVRNRDELQLRLKEQGIPTTVHYPIPLNKQPAVANNTILPVGDIISQEVISLPMHPYLENSDIRKIIRSIK

SEQ ID NO: 6970 - protein, 196 aa, Xenorhabdus bovienii
  Peptide sequence Name=Xb4151_4152.C429.gene3.pep
  Gene classification: Gene name=WbbJ; Function=Acetyltransferases (the isoleucine patch superfamily); Function class=R General function prediction only
  Homolog annotation: Query=10..195bp; Hit=6..189bp; Blast score=284; Percent Identity=72.0; E value=4e-77; Homolog= PA3156 COG0110
MSITEEVMIHTSAIVDDGAKIGKNSRIWHFTHICSGAQIGENCSLGQNVFIGNKVIIGNHCKIQNNISIYDNVYLEDGVFCGPSMVFTNVYNPRSFIERKNEYKNTLVKKGATLGANCTIVCGTTIGSYAFIGAGAVVNKDVPDYALMVGVPAKQIGWMSEFGEQLDLPLHGKSTTTCPYTGHIYHLDDNSVKKIK

SEQ ID NO: 6971 - protein, 349 aa, Xenorhabdus bovienii
  Peptide sequence Name=Xb4151_4152.C429.gene4.pep
  Gene classification: Gene name=MviM; Function=Predicted dehydrogenases and related proteins; Function class=R General function prediction only
  Homolog annotation: Query=9..346bp; Hit=2..346bp; Blast score=215; Percent Identity=35.0; E value=5e-56; Homolog= TM0585 COG0673
MFDIIKGRKIKFALVGCGRIAKNHFNSLDAHKNNAELVAVCDTDPVALNTAMEKTGANGFNNLHDMLDNISADIIILTTPSGLHPEQAIACLEKGFHVVTEKPMATRFSDGEKMVKAADKAGKRLFVVKQNRLNATLQLLKRAVEEQRFGQINMVHLNVFWTRPQDYYDQAAWRGTWEFDGGAFMNQASHYVDLLEWLIGPVKDIQAMMSTHLDIEAEDTGVLNIRWRNGALGSMAVTMCTYPSNLEGSITILGEKGSVRVGGLAVNEIQEWNFADEKDYDQQVKGANYETTSVYGFGHPLYYKNVIDVMRGEAEPMTDGREGLKSLELLIAAYLSARDNKTVSLPLIY

SEQ ID NO: 6972 - protein, 436 aa, Xenorhabdus bovienii
  Peptide sequence Name=Xb4151_4152.C429.gene5.pep
  Gene classification: Gene name=WecC; Function=UDP-N-acetyl-D -mannosaminuronate dehydrogenase; Function class=M Cell envelope biogenesis, outer membrane
  Homolog annotation: Query=1..436bp; Hit=1..436bp; Blast score=672; Percent Identity=73.0; E value=0; Homolog= PA3159 COG0677
MSSLNKLVNKFNNKSANIAIVGLGYVGLPLMLRYNDIGFKVIGFDIDKDKTEKLSRGLSYIEHISSSRIQKAIETGFEATTDFSRISECDAIILCVPTPLNKYREPDMSFVINTTDMVKPFLRKGQVLSLESTTYPGTTEEELLPRAEESGLRVGEDIFLVYSPEREDPGNPDFETRTIPKVIGGHTENCLNAGIAVYQPAIDKVVPVSSTKAAEMTKLLENIHRAVNIGLVNEMKLVADKMGIDIHEVIRAAATKPFGFVPYYPGPGLGGHCIPIDPFYLTWKAREYGVNTRFIELSGEVNSSMPDYVVTKTVLALNKVNKSINGSNVLVLGISYKKNVDDMRESPSVHIMEKLRDLGAFVEYSDPHVPAFPKMREHQFDLISQSITSNNLKEFDCIILATDHDKFDYDLIINNAKLIVDTRGKYSPNHNNVIKA

SEQ ID NO: 6973 - protein, 456 aa, Xenorhabdus bovienii
  Peptide sequence Name=Xb4151_4152.C429.gene6.pep
  Gene classification: Gene name=BaeS; Function=Signal transduction histidine kinase; Function class=T Signal transduction mechanisms
  Homolog annotation: Query=1..456bp; Hit=1..456bp; Blast score=635; Percent Identity=75.0; E value=0; Homolog= cpxA COG0642
MINSLTARIFAIFWLTLALVLMVALMAPKLDSRQLTPLLDSEYQQGIILAKQIEKELTRYPANELFWWLRLDRAIAKWTPPGQLLLLVTSEGRIVDIQTSEKQVVRNFIGQSNNADHPKKKKYGRSEILGPFSIRDGEDHYQLYLIRPAGSPQSDFINLMFDRPLLLPAATMLISAPLLLWLAWSLAKPARKLKNAADQVAKGNLRPHPELESGPQEFLAAGSSFNQMINALDRMVTAQQRLISDISHELRTPLTRLQLASALLRRRHGESKELQRIETETQRLDEMINDLLVLSRNQHKNELLRENIKANDIWHDILENAKFEVEQMNKTLDIVSPPGSWVIYCNPAVLGSAFENIVRNALRYSSSHIAVAFKADNHGVTITVDDDGPGVSPEDREQIFRPFYRTDEARDRESGGTGLGLAIVETAVSQHRGWVKAEDSPLGGLRLIIWLPLHGR

SEQ ID NO: 6974 - protein, 230 aa, Xenorhabdus bovienii
  Peptide sequence Name=Xb4151_4152.C429.gene7.pep
  Gene classification: Gene name=OmpR; Function=Response regulators consisting of a CheY-like receiver domain and a winged-helix DNA -binding domain; Function class=T Signal transduction mechanisms
  Homolog annotation: Query=1..229bp; Hit=1..231bp; Blast score=354; Percent Identity=87.0; E value=5e-98; Homolog= cpxR COG0745
MHKILLVDDDRELTSLLKELLEMEGFTVVLAHDGEQALQYIDSSIDLLLLDIMMPRKNGIETLKELRQDHQTPVIMLTARGSDLDRVLGLELGADDYLPKPFNDRELVARIRAILRRSNWSEQQADSGTPVLEVDKLQLNPGRQEASFDGTILDLTGTEFTLLYLLAQHLGQVVSREHLSQEVLGKRLTPFDRAIDMHISNLRRKLPNRTDELPWFKTLRGRGYLMVSAK

SEQ ID NO: 6975 - protein, 52 aa, Xenorhabdus bovienii
  Peptide sequence Name=Xb4151_4152.C429.gene8.pep
MSVHGHHQLIRFYACFLPPRAKYDNKLCYSITLRSFTCSDASLQQQGYSDPH

SEQ ID NO: 6976 - protein, 165 aa, Xenorhabdus bovienii
  Peptide sequence Name=Xb4151_4152.C429.gene9.pep
  Gene classification: Gene name=Spy; Function=Uncharacterized periplasmic protein; Function class=S Function unknown
  Homolog annotation: Query=61..162bp; Hit=44..143bp; Blast score=80; Percent Identity=45.0; E value=5e-16; Homolog= yiiO COG3678
MRNIAILALASMFVLGATDALAGTAGTDNVIADDFSQYCMPYGNKNNVSYCLNDERNYNYSCIFAGVSLTEQQRQQIWDLVKKQRLHEKPVADIRAERRKMYSLLDSTNFDEAAVRSQLEKIAKENVDLSVEIARIRNQIYQLLTTEQKVQLQRRYEVRVNREMN

SEQ ID NO: 6977 - protein, 36 aa, Xenorhabdus bovienii
  Peptide sequence Name=Xb4151_4152.C429.gene10.pep
VSFVHKLYGKIICSTLICDTTLENFQVAYKIFIADF

SEQ ID NO: 6978 - protein, 193 aa, Xenorhabdus bovienii
  Peptide sequence Name=Xb4151_4152.C429.gene11.pep
MRISKNNISSIAAAMALSLAPVPADSVGSYMATSTTQNTLMLQNVNDSMVYMPIAEAQKYVADMANRMRGHLRNLRAEWEEKRIPIDDKSMSKFARDNLNYLTRHITLCAVLVRASKVALNQTSDQELRNTIMQFGRSAADLRYTYEEILTFTKNTHESPNVLEMADQFSKEGVQALISSEHQALGLDKPMFH

SEQ ID NO: 6979 - protein, 103 aa, Xenorhabdus bovienii
  Peptide sequence Name=Xb4151_4152.C429.gene12.pep
  Homolog annotation: Query=1..102bp; Hit=24..125bp; Blast score=107; Percent Identity=47.0; E value=5e-23; Homolog= gi|37526943|ref|NP _930287.1| hypothetical protein [Photorhabdus luminescens subsp. laumondii TTO1] gi|36786376|emb|CAE15429.1
LKEWKNGGLRPIIFGDEGRWEDHASLCASFVFKIHIKLPDEEPWSAKMPVVARKSNSYLVYTRHWCEPKKYQLISIMTPNAHELARTSFLSVLVDRAEDFQNN

SEQ ID NO: 6980 - protein, 55 aa, Xenorhabdus bovienii
  Peptide sequence Name=Xb4151_4152.C429.gene13.pep
LIVVIVTNQKMSKDREKVIEVIPATAAMPAVKSFSWHTPIKLANRESKSRLLIWR

SEQ ID NO: 6981 - protein, 57 aa, Xenorhabdus bovienii
  Peptide sequence Name=Xb4151_4152.C429.gene14.pep
MNVIPVKRKRRHVPGVEFLSVFITVAVATFNTRAVSRMPLLFIAISIVCSLTPGLQA

SEQ ID NO: 6982 - protein, 140 aa, Xenorhabdus bovienii
  Peptide sequence Name=Xb4151_4152.C429.gene15.pep
  Gene classification: Gene name=InsB; Function=Insertion element IS1 protein InsB, putative transposase; Function class=L DNA replication, recombination and repair
  Homolog annotation: Query=1..139bp; Hit=27..166bp; Blast score=117; Percent Identity=42.0; E value=5e-27; Homolog= insB_g4 COG1662
VTTLPLDGDDIHLICEVDEQESFVGSQKNQRWLWYAWEPRMKRIVAHTFGDHSRKTWEKLLALLSPFNIRFYCTDDYAVYDCLPEEVHLTGKIFTQRIERTNLTHRTRIKRLNRKTIGYSKSEEMHDKVIGTFIERENYI

SEQ ID NO: 6983 - protein, 49 aa, Xenorhabdus bovienii
  Peptide sequence Name=Xb4151_4152.C429.gene16.pep
LSVKTIFSEHSNYLIHDRLLSRLSAPKCQENRSWPHFWWARFLFFILPH

SEQ ID NO: 6984 - protein, 213 aa, Xenorhabdus bovienii
  Peptide sequence Name=Xb4151_4152.C429.gene17.pep
  Gene classification: Gene name=PlsC; Function=1-acyl-sn-glycerol-3 -phosphate acyltransferase; Function class=I Lipid metabolism
  Homolog annotation: Query=23..211bp; Hit=15..203bp; Blast score=181; Percent Identity=47.0; E value=4e-46; Homolog= PA2537 COG0204
MANSHKISLLARCMGATLLGLCRVLTGVQVRWIGCQPSTSSRIYYANHTSHLDGLVIWSGLPPKLRYQIHPVAARDYWDKTKLRRYLMYKVFRAVLIERKGEHTSKSGVLAPLEAILAKKESLIFFPEGTRGDGEQLNPFKGGLYHLARQYPDAEMIPVYLENSNRVLPKGKRLLVPIICSATFGKPLDKLGENESKVAFLQRAQSALEELMR

SEQ ID NO: 6985 - protein, 314 aa, Xenorhabdus bovienii
  Peptide sequence Name=Xb4151_4152.C429.gene18.pep
  Gene classification: Gene name=CdsA; Function=CDP-diglyceride synthetase; Function class=I Lipid metabolism
  Homolog annotation: Query=10..314bp; Hit=7..310bp; Blast score=308; Percent Identity=56.0; E value=3e-84; Homolog= PA2536 COG0575
MIKIDNGLMLLLGGIFGVLIIASAIGGILSLRYSGAKRSATIDNLNARIRGWWMMCIICVLAVIVGSVGSVILFTVMSFFALREFITLTPTRRGDHEALFWCFFVFMPIQYVLIGMQWYGLFSVFIPVYVFLFLPVRIALVGDTTRFLERTAKIQSAMLITVFALSHAPALLMLHIPDYEDQNIKLLLFLMIVVQMSDILQYVFGKLFGKRPIVPKLSPNKTVEGFIGGILASSLLGMSLYWVTPFSPWEAGLMSLAITLMGFIGGLCMSAIKRDSGVKDFGGIIEGHGGMLDRIDSLCFAAPIFFHLTRYFYT

SEQ ID NO: 6986 - protein, 299 aa, Xenorhabdus bovienii
  Peptide sequence Name=Xb4151_4152.C429.gene19.pep
  Gene classification: Gene name=MMT1; Function=Predicted Co/Zn/Cd cation transporters; Function class=P Inorganic ion transport and metabolism
  Homolog annotation: Query=1..295bp; Hit=1..295bp; Blast score=415; Percent Identity=72.0; E value=1e-116; Homolog= yiiP COG0053
MSINYGRWVSAAALLATVLASVLLVVKIFAWWLTGSVSLLAALVDSLVDLAASLTNFFAVRYSLQPADKEHTFGHGKAESLAALAQSMFISGSAIFLFLTGFQHLVSPEPLEHATIGIWVIVVALISTICLVTFQKWVINKTQSQAIRADMLHYKSDLLMNGAILLALVLSMYGFRRADALFALGIGAYILYSALRMGYDAVQSLLDRALPDEERQEIIEMIKCYPGIAGGHDLRTRQSGPTRFIQFHLEIDDHLPLVDAHALAEGIENKLRDRFPGADIIIHQDPCSVVPEEHKNRWD

SEQ ID NO: 6987 - protein, 45 aa, Xenorhabdus bovienii
  Peptide sequence Name=Xb4151_4152.C429.gene20.pep
MIRKNTQSALRLCLFSDALLIMNKFPVNPNGFYAPLAQRNKDLGE

SEQ ID NO: 6988 - protein, 325 aa, Xenorhabdus bovienii
  Peptide sequence Name=Xb4151_4152.C429.gene21.pep
  Gene classification: Gene name=PfkA; Function=6-phosphofructokinase; Function class=G Carbohydrate transport and metabolism
  Homolog annotation: Query=5..325bp; Hit=2..320bp; Blast score=523; Percent Identity=80.0; E value=1e-148; Homolog= pfkA COG0205
MINKIKRIGVLTSGGDAPGMNAAIRGVVRVALTEGLEVYGIYDGYLGLYENRMKKLDRFSVSDMINRGGTFLGSARFPEFRDDKVREIAIENMRKNDIDALVVIGGDGSYLGAKKLTEAGFPCIGLPGTIDNDVAGTDYTIGYFTALETVVEAIDRLRDTSTSHKRISIVEVMGRYCGDLTLSAAIAGGCEFIVLPENEIPFDREELLAEIKAGIQKGKRHAIVAITEHVCNVDELAKYIEAETRHETRATVLGHIQRGGAPVAYDRILASRMGAYSVQLLMEGFGGRCVGIQNEKLVHHDIIDAVQNMQRVFKKDWLETAKQLY

SEQ ID NO: 6989 - protein, 50 aa, Xenorhabdus bovienii
  Peptide sequence Name=Xb4151_4152.C429.gene22.pep
MRCKICSVFSRKTGWKRRSSFTKPFSPATYFFKGCHILWLLFSALYSTYA

SEQ ID NO: 6990 - protein, 35 aa, Xenorhabdus bovienii
  Peptide sequence Name=Xb4151_4152.C429.gene23.pep
MAALFCTIFHLCISRNFKLFLRHTAFCQLLWRYHK

SEQ ID NO: 6991 - protein, 337 aa, Xenorhabdus bovienii
  Peptide sequence Name=Xb4151_4152.C429.gene24.pep
  Gene classification: Gene name=Sbp; Function=ABC-type sulfate transport system, periplasmic component; Function class=P Inorganic ion transport and metabolism
  Homolog annotation: Query=16..337bp; Hit=8..329bp; Blast score=506; Percent Identity=76.0; E value=1e-143; Homolog= sbp COG1613
MVTRWAARRCAVLTALLMVLAGGSAWAKEVQLLNVSYDPTRELYQQYDQAFSQYWQQKTGDHVTVRQSHGGSGKQATSVINGLQADVVTLALAYDVNAIAERGRIAKDWIDRLPENSAPYTSTIVFLVRKGNPKHIKDWSDLVRPGVSVVTPNPKTSGGARWNYLAAWGYGLAQNNQDQGKTKAFVKALYKNVEVLDSGARGATNTFVERGIGDVLIAWENEALLATHALAQGKFEIVTPSLSILAEPTVAVVDKVVDKRGTRKLATEYLKYLYSPVGQEIAANNYYRPRDKAIAEKYHAVFPVLKLFTIDEVFGGWDKAQKVHFATGGIFDEIIRR

SEQ ID NO: 6992 - protein, 318 aa, Xenorhabdus bovienii
  Peptide sequence Name=Xb4151_4152.C429.gene25.pep
  Gene classification: Function=Transposase; Function class=L DNA replication, recombination and repair
  Homolog annotation: Query=9..306bp; Hit=6..302bp; Blast score=201; Percent Identity=38.0; E value=8e-52; Homolog= NMA1185 COG3547
MTKTICIGIDVAKASLEIALGAQGTVMTYPNTPEGHDELAATLTNYEIDLVVLEATGGYEVSVACVLQTIGLAVAIVNPRQARDFAKAMGNLAKTDKIDAQVLAQLALVLSQRTDRDKIVRILPSAQQRVLQAMIARRRQLVVLSISERQRLGNCHPDIRESITLMISFIQEQLKVIESALSKHIKTYHRSKLDLLSTVKGVGPATIATLIADVPELGKLTRREISALIGVAPFNRDSGFFRGKRTIFGGRAMVRRMLYMATLTAIRFNPVLCAFYKRLTEAGKPNKVAIVACMRKLLVILNAMIKTNRPWDESFHTV

SEQ ID NO: 6993 - protein, 54 aa, Xenorhabdus bovienii
  Peptide sequence Name=Xb4151_4152.C429.gene26.pep
LATSIPIQIVLVMVLRLPFLQIRIVFQATVRVSRRKVTIMRRKLINGLNPLMVI

SEQ ID NO: 6994 - protein, 346 aa, Xenorhabdus bovienii; identical to SEQ ID NO: 6355
  Peptide sequence Name=Xb4151_4152.C429.gene27.pep
  Gene classification: Function=Transposase; Function class=L DNA replication, recombination and repair
  Homolog annotation: Query=15..344bp; Hit=2..335bp; Blast score=241; Percent Identity=43.0; E value=7e-64; Homolog= PA2319 COG3547

SEQ ID NO: 6995 - protein, 68 aa, Xenorhabdus bovienii; identical to SEQ ID NO: 6354
  Peptide sequence Name=Xb4151_4152.C429.gene28.pep

SEQ ID NO: 6996 - protein, 44 aa, Xenorhabdus bovienii
  Peptide sequence Name=Xb4151_4152.C429.gene29.pep
VEFESGGFIAVIGVKSHRVVAGKVSGRKTKKSMVPTFFATLIFD

SEQ ID NO: 6997 - protein, 60 aa, Xenorhabdus bovienii
  Peptide sequence Name=Xb4151_4152.C429.gene30.pep
  Homolog annotation: Query=12..60bp; Hit=423..471bp; Blast score=77; Percent Identity=61.0; E value=5e-14; Homolog= gi|37526851|ref|NP _930195.1| hypothetical protein [Photorhabdus luminescens subsp. laumondii TTO1] gi|36786283|emb|CAE15335.1
VGENGLPAWGDIPPLQDAVDLDMATDSEKSALTEWRKYRVLLNRVDCTTAPDIQWPEQPK

SEQ ID NO: 6998 - protein, 71 aa, Xenorhabdus bovienii
  Peptide sequence Name=Xb4151_4152.C429.gene31.pep
LTAWLSRITVQIYALLKTLSNRERQLLTMLFWNQKRLRLQGSWLVTRGQAPRSGREWFTCMGRYPAVTGCG

SEQ ID NO: 6999 - protein, 93 aa, Xenorhabdus bovienii; identical to SEQ ID NO: 6053
  Peptide sequence Name=Xb4151_4152.C429.gene32.pep
  Gene classification: Function=Predicted transposase; Function class=L DNA replication, recombination and repair
  Homolog annotation: Query=1..80bp; Hit=53..131bp; Blast score=119; Percent Identity=71.0; E value=4e-28; Homolog= VC0870 COG1943

SEQ ID NO: 7000 - protein, 58 aa, Xenorhabdus bovienii
  Peptide sequence Name=Xb4151_4152.C429.gene33.pep
  Gene classification: Function=Predicted transposase; Function class=L DNA replication, recombination and repair
  Homolog annotation: Query=20..58bp; Hit=1..39bp; Blast score=58; Percent Identity=61.0; E value=1e-09; Homolog= VCA0493 COG1943
MLLMGKSESVIPITEKDLTMSRFKKASHVLWCCQYHIVWTPKYRFRILKNNVGKEISR

SEQ ID NO: 7001 - protein, 42 aa, Xenorhabdus bovienii
  Peptide sequence Name=Xb4151_4152.C429.gene34.pep
MGITDSDFPMSSIIGRANLLLTTSAGGGFQLRIKKVANATLY

SEQ ID NO: 7002 - protein, 50 aa, Xenorhabdus bovienii
  Peptide sequence Name=Xb4151_4152.C429.gene35.pep
  Gene classification: Gene name=RelE; Function=Uncharacterized ACR; Function class=S Function unknown
  Homolog annotation: Query=4..49bp; Hit=50..95bp; Blast score=57; Percent Identity=67.0; E value=2e-09; Homolog= relE COG2026
LAGCFKIKLRSSGFRLVYQVIDEDIVIWVIAVGKREDSKAYKIASERIVR

SEQ ID NO: 7003 - protein, 31 aa, Xenorhabdus bovienii
  Peptide sequence Name=Xb4151_4152.C429.gene36.pep
VNSLKRSYGSYRIIPILNLPDYTVIWQVASK

SEQ ID NO: 7004 - protein, 33 aa, Xenorhabdus bovienii
  Peptide sequence Name=Xb4151_4152.C429.gene37.pep
MLLSSFYHSFKARSSNSILNVIEIYPNSFGGIF

SEQ ID NO: 7005 - protein, 84 aa, Xenorhabdus bovienii
  Peptide sequence Name=Xb4151_4152.C429.gene38.pep
  Gene classification: Gene name=RelB; Function=DNA-damage-inducible protein J; Function class=L DNA replication, recombination and repair
  Homolog annotation: Query=1..84bp; Hit=1..79bp; Blast score=68; Percent Identity=44.0; E value=2e-12; Homolog= relB COG3077
MSTIQIRVDEELKKNAYQAFEKLNLSPSDAMRLFLRYVAENEKLPFTEVSVMVAEHDEDEDILDVVRDRLKNPAKRIRVNLDDI

SEQ ID NO: 7006 - protein, 33 aa, Xenorhabdus bovienii
  Peptide sequence Name=Xb4151_4152.C429.gene39.pep
VQSILKRLTAHLTLNTFDNSRILNNLRQESLPV

SEQ ID NO: 7007 - protein, 30 aa, Xenorhabdus bovienii
  Peptide sequence Name=Xb4151_4152.C429.gene40.pep
VHLARFGQFRSSLIFPERKRMEFRRGAINT

SEQ ID NO: 7008 - protein, 69 aa, Xenorhabdus bovienii
  Peptide sequence Name=Xb4151_4152.C429.gene41.pep
MNSEIVQILQDALDTGVSQIDPSMSPEDAQATFEDGMEELRRLLTKKQEEILNTARVFAKLTSSNKKAP

SEQ ID NO: 7009 - protein, 87 aa, Xenorhabdus bovienii
  Peptide sequence Name=Xb4151_4152.C429.gene42.pep
MTFKNGAMTIHGMKSGDYVGHEMAMTAPPVTRDGRKLMSEREFKYDDGEFSEDFSPKYRIATLTIGNPRYGGITQHLTNCKKEQEQE

SEQ ID NO: 7010 - protein, 41 aa, Xenorhabdus bovienii
  Peptide sequence Name=Xb4151_4152.C429.gene43.pep
MKRILIVCTALTLIGCGDNYSEFNGVYTCKIGLSMNAVAVD

SEQ ID NO: 7011 - protein, 158 aa, Xenorhabdus bovienii
  Peptide sequence Name=Xb4151_4152.C429.gene44.pep
  Homolog annotation: Query=5..145bp; Hit=21..161bp; Blast score=166; Percent Identity=61.0; E value=2e-40; Homolog= gi|1175807|sp|P44203|YE56_HAEIN Hypothetical protein HI1456 gi|1074787|pir||F64030 hypothetical protein HI1456 - Haemophilus
MMNTKKLLLSASLLGALFLNGCASVPLATEQKSAQAKSFSAPEESKSGLYIYRDSFVGKALKKDIYVDGKCIGETADKTFFYTQVSGSQNHKISTESEFSPNDLVIFTESGKNYFIRQYIKMGVFVGGAGLSASTEEEGKRVISQAGVRLAKEGHCDS

SEQ ID NO: 7012 - protein, 40 aa, Xenorhabdus bovienii
  Peptide sequence Name=Xb4151_4152.C429.gene45.pep
LRNKAPKREADKSNFLVFIIKNRTFCIKVKKLTSQLRLLR

SEQ ID NO: 7013 - protein, 119 aa, Xenorhabdus bovienii
  Peptide sequence Name=Xb4151_4152.C429.gene46.pep
MKKSVCLLLSLMALAGCGEKEQKTPEQTYSDLVIKSLSNIIIMDQDKGIEKTCLVTFDIDANANPSNILSEGRDKVFCGKVEAMIDISDTPRPPNSLIVNGIAHIRMEINKSDLYVIER

SEQ ID NO: 7014 - protein, 47 aa, Xenorhabdus bovienii
  Peptide sequence Name=Xb4151_4152.C429.gene47.pep
MISVTDYLISNFRSVRGVTKVGHDSILLIVMNVQIISYNSVMHFYGF

SEQ ID NO: 7015 - protein, 167 aa, Xenorhabdus bovienii
  Peptide sequence Name=Xb4151_4152.C429.gene48.pep
  Gene classification: Gene name=InsB; Function=Insertion element IS1 protein InsB, putative transposase; Function class=L DNA replication, recombination and repair
  Homolog annotation: Query=1..167bp; Hit=1..167bp; Blast score=224; Percent Identity=64.0; E value=3e-59; Homolog= insB_g3 COG1662
MSGDSTSDGDWPEYRTSAFKKLKPKSVTEAIKPGTEVIVCCEMDEQWSYVKSKKPPRWLFYADDRIRRKVIAHVFGPRTKKTLMRLLALLAPFNIIIYMTDGWKNYEKALAGKRHVASKRYTQRIEKHNLNLRQHLARLTRKTLSFSKSIEMHDRIIGYYLNIHHYQ

SEQ ID NO: 7016 - protein, 96 aa, Xenorhabdus bovienii
  Peptide sequence Name=Xb4151_4152.C429.gene49.pep
MPKYGIQANPHHSCCRPTSHSIHSHIDDLLMGTETTSGISELLLPGVTAGLAKITLVTRTRAPIAMDPFHCGTRGASYINLCHLNVFQIDRLYMIQ

SEQ ID NO: 7017 - protein, 397 aa, Xenorhabdus bovienii
  Peptide sequence Name=Xb4151_4152.C429.gene50.pep
  Gene classification: Gene name=UbiH; Function=2-polyprenyl-6 -methoxyphenol hydroxylase and related FAD-dependent oxidoreductases; Function class=H Coenzyme metabolism
  Homolog annotation: Query=8..397bp; Hit=4..391bp; Blast score=468; Percent Identity=61.0; E value=1e-132; Homolog= ubiF COG0654
MNMNNPQQKFDIVVVGAGMVGAATALGLAQEGWRVALLEHQLPQPYNEGNEPDIRVSAISCASVDLLKQLGVWNHVLRMRSAPYRKLETWEQHDSNVTFDVQSLGLTELGYMVENYILQLALWQEFERYPNLTLFCPAALKSMQRQHAHQIWQVTLMDGTEMNARLIIGADGARSQVRQLAGIGSNGWQYRQSCMLITVKTEQPQQDTTWQQFFPSGPRAFLPLFDQWASLVWYDSPARIRQLQSMTMVQLEREIFQAFPSRLGKVTPIAVGSFPLTRHHASHYVREGLALLGDAAHTINPLAGQGVNLGYRDVEVLLKVLINAKELQEEWDSQAVLVRYQRRRMPDNLVMQAGMDLFHTAFSYDLPGLKTMRNLALMAAQRSGAMKKLALKYALGL

SEQ ID NO: 7018 - protein, 67 aa, Xenorhabdus bovienii
  Peptide sequence Name=Xb4151_4152.C429.gene51.pep
LCESQSRRCTNHTRTHDDDIEFLLWIIHIHHAINFLIKIVYRNFPFPAVNIRCYSLVTGASNDYNSL

SEQ ID NO: 7019 - protein, 476 aa, Xenorhabdus bovienii
  Peptide sequence Name=Xb4151_4152.C429.gene52.pep
  Gene classification: Gene name=MiaB; Function=2-methylthioadenine synthetase; Function class=J Translation, ribosomal structure and biogenesis
  Homolog annotation: Query=5..476bp; Hit=3..474bp; Blast score=830; Percent Identity=84.0; E value=0; Homolog= yleA COG0621
MSTIKKLYIKTWGCQMNEYDSSKMADLLETTHGYQLTDVAEEADILLLNTCSIREKAQEKVFHQLGRWKGLKDKNPEIIIGVGGCVASQEGDFIRQRAPSVDIIFGPQTLHRLPEMINHVKGTHSPIVDISFPEIEKFDRMPEPRAEGPSAFVSIMEGCNKYCTFCVVPYTRGEEVSRPCDDILFEIAQLAAQGVRDVNLLGQNVNAYRGAAFDGDICTFAELLRLVAAIDGIDRIRFTTSHPIEFTDDIIAVYEDTPELVSYLHLPVQSGSDRILTQMKRAHTALEYKGIIRRLRKARPDILISSDFIIGFPGETQDDFEKTMQLIADVNFDMSFSFIYSARPGTPAADLPDDVSEEEKKQRLYLLQQRINQQAMSFSRAMVGSTQRILVEGTSRKNIMELSGRTENNRVVNFEGTPDMIGKFVDAEIVDVYANSLRGKVIRTEDEMNLRIHESPESVIARTRKEDEIGVGIYQP

SEQ ID NO: 7020 - protein, 55 aa, Xenorhabdus bovienii
  Peptide sequence Name=Xb4151_4152.C429.gene53.pep
VGHTDSSAVDYLRVPERSLVLLLVSLFVSLIISMLGPVKADKCQRRFHLPCGYGR

SEQ ID NO: 7021 - protein, 325 aa, Xenorhabdus bovienii
  Peptide sequence Name=Xb4151_4152.C429.gene54.pep
  Gene classification: Gene name=PhoH; Function=Phosphate starvation -inducible protein PhoH, predicted ATPase; Function class=T Signal transduction mechanisms
  Homolog annotation: Query=1..325bp; Hit=32..356bp; Blast score=536; Percent Identity=85.0; E value=1e-153; Homolog= ybeZ COG1702
MSLCGPLDDNLKQLERRLGVEISRRDNRFKLVGKPLCVSAVAGILRHLYVETAPVRSVIPNIEPEQIHLAITESRVLEQSAESIPDYGKAVNIRTKRGVVKPRTPNQAQYIANILDYDITFGIGPAGTGKTYLAVAAAVDSLERQEIRRILLTRPAVEAGEKLGFLPGDLSQKVDPYLRPLYDALFEMLGFEKVEKLIERNVIEVAPLAYMRGRTLNDAFIILDESQNTTIEQMKMFLTRIGFNSKAVITGDVTQIDLPKGQKSGLSHAVEVLSEVDELSFNFFHSEDVVRHPVVAKVVIAYEAWESAEQKRKQELNDKRKQEAQ

SEQ ID NO: 7022 - protein, 155 aa, Xenorhabdus bovienii
  Peptide sequence Name=Xb4151_4152.C429.gene55.pep
  Gene classification: Function=Predicted metal-dependent hydrolase; Function class=R General function prediction only
  Homolog annotation: Query=1..155bp; Hit=1..155bp; Blast score=211; Percent Identity=74.0; E value=2e-55; Homolog= ybeY COG0319
MNSVILDLQIACENPEGLPDEALFQRWLESILPQFQAESEVTIRLVDEAESHDLNLTYRGKDKPTNVLSFPFEAPPEVELPLLGDLIICRQVVEQEAEEQQKTVEEHWAHMVIHGSLHLLGYDHIEDDEAEEMESLETEILQKMGYADPYLAEKK

SEQ ID NO: 7023 - protein, 300 aa, Xenorhabdus bovienii
  Peptide sequence Name=Xb4151_4152.C429.gene56.pep
  Gene classification: Function=Hemolysins and related proteins containing CBS domains; Function class=N Cell motility and secretion
  Homolog annotation: Query=9..299bp; Hit=1..292bp; Blast score=424; Percent Identity=82.0; E value=1e-119; Homolog= ybeX COG1253
MGNFHSNAMSDDHPSNNDSPGPKKGFLALLNQLFHGEPKNRHDLVELIRDSEQNDLIDPDTREMLEGVMDIADQRVRDIMIPRSQIVTLKRNQPLDECLDVIIDSAHSRYPVISEDKDHIEGILMAKDLLPFMRTNAETFSIDKVLRQAIVVPESKRVDRLLKEFRSQRYHMAIVIDEFGGVSGLVTIEDILELIVGEIEDEYDDDDDNDIRALSRHTYSVRALAQIEDFNDVFGTNFSDEEVDTIGGLVMQAFGHLPSRGESIDINGYLFKVAMADSRKIIQVHVKIPDDADVPGLDKQ

SEQ ID NO: 7024 - protein, 529 aa, Xenorhabdus bovienii
  Peptide sequence Name=Xb4151_4152.C429.gene57.pep
  Gene classification: Gene name=Lnt; Function=Apolipoprotein N -acyltransferase; Function class=M Cell envelope biogenesis, outer membrane
  Homolog annotation: Query=24..528bp; Hit=4..510bp; Blast score=625; Percent Identity=65.0; E value=1e-179; Homolog= lnt COG0815
MSKYRMMLTFLALINNNRIWMNKASLLSCQRLRALLALFLGASGTLAFSPFDFWPAAFLSLFGLQILTLNRTTRQSLFIGFCWGFGLFGSGTNWVYVSIADFGGMPTVVNIFLVILLSAYLALYPTLFAGLLNRFFPAANGIRLVIASPALWQLTEFLRGWVLTGFPWLQFGYSQIDGPMKAIAPILGVEGITFLMLMISGLLVLATTRKKLSLAIAAVILLLLPWPMRYYQWYTLLPEKSADIALVQGNIPQVIKWNPSELENTLDTYLNNSRPFIGKIPIIIWPESAITAYEITQGNFLTELDSLLRQRNTRLITGIPDARPTLEGYKFYNSIIVLGDKTPYRYPAPIRYDKHHLVPFGEFVPLESILRPLAPFFNLPMSSFNRGGYIQPQLSVAGHNITAAICYEIILGEQVRDNLKPDTEFLLTISNDAWFGRSIGPWQHFQMARMRSLELGRPLLRGTNNGITAVIRPDGSIQARLPQFTRQVLEAKVTPASGNTPYFRVGYWPIWGLALLFISFGLISNRRRT

SEQ ID NO: 7025 - protein, 45 aa, Xenorhabdus bovienii
  Peptide sequence Name=Xb4151_4152.C429.gene58.pep
VYLVKFVVNVMNYCILLGFSVECIRHREDKGINNIPLSSIEGSTE

SEQ ID NO: 7026 - protein, 32 aa, Xenorhabdus bovienii
  Peptide sequence Name=Xb4151_4152.C429.gene59.pep
MFLFRDLPRTINKQFYLCTIKEKIILDSVHSL

SEQ ID NO: 7027 - protein, 336 aa, Xenorhabdus bovienii
  Peptide sequence Name=Xb4151_4152.C429.gene60.pep
  Gene classification: Gene name=ArtI; Function=ABC-type amino acid transport system, periplasmic component; Function class=E Amino acid transport and metabolism
  Homolog annotation: Query=40..336bp; Hit=1..302bp; Blast score=443; Percent Identity=77.0; E value=1e-124; Homolog= ZybeJ COG0834
MNYFFTAYKQKDSGNRFYKNVNATICKQTQSSKNNPIKELYMRKLMLTMMLLSAVGAAHAEELTGTLKKIKDNGIIVVGHRESSVPFSYYDNQQNVVGYAQDYSNLIVDAVKKKLDMPNLQVKLIPITSQNRIPLLQNGTYDFECGSTTNNLERQKQAAFSNTIFVVGTRLLTNKDSGIKGFDDLAGKHVVVTSGTTSEILLNKLNDEKQMQMRIISAKDHGDSFRTLESGRAVAFMMDDALLAGERAKAKKPDQWVIVGKPQSEEAYGCMLRKDDPQFKKLIDGTIVKVQTSGEAEKFFDLWFKQPIPPKKLNMNFSMSDEMKTLFKSPNDKALN

SEQ ID NO: 7028 - protein, 246 aa, Xenorhabdus bovienii
  Peptide sequence Name=Xb4151_4152.C429.gene61.pep
  Gene classification: Gene name=ArtM; Function=ABC-type amino acid transport system, permease component; Function class=E Amino acid transport and metabolism
  Homolog annotation: Query=1..246bp; Hit=1..246bp; Blast score=389; Percent Identity=82.0; E value=1e-108; Homolog= gltJ COG0765
MSVDWNWGIFLQAAPFGNTTYLGWLISGFQVTVALSVCAWVIALAVGSLFGILRTVPNKFLATLGACYVELFRNIPLIVQFFIWYLVVPEFLPKNLSNWFKMELDPNIQFFISSVICLGLFTAARICEQVRAAIQSLPRGQKAAGQAMGLTLPQTYRYVLLPNAYRVIIPPMTSEMLNLVKNSAIASTIGLVDMAAQAGKLLDYSAHAYESFTAITLAYVGINLVIMLAMTLLEKKVRLPGNLGGR

SEQ ID NO: 7029 - protein, 240 aa, Xenorhabdus bovienii
  Peptide sequence Name=Xb4151_4152.C429.gene62.pep
  Gene classification: Gene name=ArtM; Function=ABC-type amino acid transport system, permease component; Function class=E Amino acid transport and metabolism
  Homolog annotation: Query=17..239bp; Hit=1..223bp; Blast score=313; Percent Identity=82.0; E value=1e-85; Homolog= gltK COG0765
LRKKCACQAILEGDRKMYQFDWSSIIPSLPFLLNGLVITAKITVIAIIIGIAWGTLLAMMRLSSIKILSWFATLYVNLFRSVPLVMVLLWFYLIVPNLLQNVLGISPRTDIRLISAMVAFSLFEAAYYSEIIRAGIQSISRGQSSAALALGMTHMQSMRLIILPQAFRAMIPLLLTQGIVLFQDTSLVYVLSLADFFRTATNIGERDGTQIEMILFAGVVYFVISFAASMLVNYLKKRTV

SEQ ID NO: 7030 - protein, 241 aa, Xenorhabdus bovienii
  Peptide sequence Name=Xb4151_4152.C429.gene63.pep
  Gene classification: Gene name=GlnQ; Function=ABC-type polar amino acid transport system, ATPase component; Function class=E Amino acid transport and metabolism
  Homolog annotation: Query=1..241bp; Hit=1..241bp; Blast score=403; Percent Identity=88.0; E value=1e-112; Homolog= gltL COG1126
MISLKNVSKWYGQFQVLTDCSTEVKKGEVVVVCGPSGSGKSTLIKTVNGLEPVQQGEIRVNNTPVNDKSTNLAQLRSKVGMVFQHFELFPHLSIIENLTLAQIKVLKRDKKSATEKALKLLERVGLTSHADKFPAQLSGGQQQRVAIARALCMDPIAMLFDEPTSALDPEMINEVLDVMVKLANEGMTMMVVTHEMGFAKKVAHRVIFMDEGKIVEDSKKEDFFANPKSERARDFLAKILH

SEQ ID NO: 7031 - protein, 41 aa, Xenorhabdus bovienii
  Peptide sequence Name=Xb4151_4152.C429.gene64.pep
VRSLKFTYFRSRLRSAEVVLSADREKISVEFSPENHGHVLI

SEQ ID NO: 7032 - protein, 39 aa, Xenorhabdus bovienii
  Peptide sequence Name=Xb4151_4152.C429.gene65.pep
LPVKLYLSLYVFWTILFLHGTDNPMVSNKAAPVTRIVCL

SEQ ID NO: 7033 - protein, 860 aa, Xenorhabdus bovienii
  Peptide sequence Name=Xb4151_4152.C429.gene66.pep
  Gene classification: Gene name=LeuS; Function=Leucyl-tRNA synthetase; Function class=J Translation, ribosomal structure and biogenesis
  Homolog annotation: Query=1..860bp; Hit=1..860bp; Blast score=1463; Percent Identity=79.0; E value=0; Homolog= ZleuS COG0495
MQEQYRPEDIERQVQLHWQEKQTFKVTEDSNKEKYYCLSMLPYPSGRLHMGHVRNYTIGDVISRYQRMLGKNVLQPIGWDAFGLPAEGAAVKNNTAPAPWTYSNIEYMKAQLKTLGFGYDWDREVTTCTPEYYRWEQWFFTKLYEKGLVYKKTSAVNWCPHDLTVLANEQVIDGCCWRCDSQVERKEIPQWFIKITAYAEELLNDLDKLEDWPEQVKTMQRNWIGRSEGVEITFNVADSQETLTVYTTRPDTFMGTTYVAVAAGHPLAKQAAENNPELAEFINECRNTKVAEADMATMEKKGVSTGMFAIHPLTNEKIAIWVANFVLMEYGTGAVMAVPAHDQRDWEFATKYNLPMKTVILDNDGNVPTVQEGAATDKNALVNSGEFSGLSNEEGFSAIADKLVEMGAGNRKVNYRLRDWGVSRQRYWGAPIPMATLEDGTVVPVPEDQLPVILPEDVVMNGITSPIKADPEWAKTTINGQPALRETDTFDTFMESSWYYARYTCPDYDKGMLDPAAANYWLPVDQYIGGIEHAIMHLMYFRFFHKLMRDSGMVNSDEPAKHLLCQGMVLADAFYYTGNSGEKIWVSPANAIVERDDKGRIVKSVDQDGHELVYTGMSKMSKSKNNGIDPQIMVDKYGADTVRLFMMFAAPPELTLEWQESGVEGANRFLKRVWRLVYEHSSKGTTQPLDIASLTTEQKDLRRDLHKTLAKVTDDIGRRQAFNTAVAAIMELMNKLTRVPQETEQDRALMQEALTAVVRMLSPITPHACFVMWKELGNESDIDTAAWPQADEQAMVDDTKLVIIQINGKVRGRITVPADVTKEYVQEMAAKEYSVAKYLESISIRKVIYVPGKLLNLVVG

SEQ ID NO: 7034 - protein, 186 aa, Xenorhabdus bovienii
  Peptide sequence Name=Xb4151_4152.C429.gene67.pep
  Gene classification: Gene name=RlpB; Function=Rare lipoprotein B; Function class=M Cell envelope biogenesis, outer membrane
  Homolog annotation: Query=12..177bp; Hit=6..173bp; Blast score=165; Percent Identity=51.0; E value=3e-41; Homolog= rlpB COG2980
LVGNNVRHGIFTLFLGLAVLVTAGCGFHLRGTTQVPKELQTLQLSSADPYGPLARAVRQQLRLNDVKIVERGDASVPILKLLGSNEHKETASVFQDGKAAERQLVLYVDAQVLMPNGGIYPLRARVDRSFFDNPLEALAKDAENELIQQEMREQAAHQLMRQLLTVHSAELLKTEEKQQAATAQKQ

SEQ ID NO: 7035 - protein, 346 aa, Xenorhabdus bovienii
  Peptide sequence Name=Xb4151_4152.C429.gene68.pep
  Gene classification: Gene name=HolA; Function=DNA polymerase III delta subunit; Function class=L DNA replication, recombination and repair
  Homolog annotation: Query=1..342bp; Hit=1..342bp; Blast score=417; Percent Identity=66.0; E value=1e-117; Homolog= holA COG1466
MIRLYPEQLLSQLNEGLRNNYLLWGNEPLLLQESQDSIRRVAEQHGFLEHFTFSLDNHTEWDEIFSLCQSLSLFSSRQSLTLLLPENGPNAAMVERLTKLSGLLHADILLILRGHKLTKAQENSPWFKTLGQNGVYVSCLTPEQNRLPQWVAQRARSMGLSLEDEANQLLCYCYEGNLLALAQALERLSLLHPDNRLTLPRVEEAVNDAAHFAPYHWVDALLAGKIKRAWHILKQLRQEDTESIILLRTIQRELILLLTLKRQDKTTPLKTLFDQHKIWQNRRSLLTAALQRLSQQDLQSAIHLLTQMELCVKQDYGQSIWANLETLSMLLCGKTLPESFLNASFH

SEQ ID NO: 7036 - protein, 226 aa, Xenorhabdus bovienii
  Peptide sequence Name=Xb4151_4152.C429.gene69.pep
  Gene classification: Gene name=NadD; Function=Nicotinic acid mononucleotide adenylyltransferase; Function class=H Coenzyme metabolism
  Homolog annotation: Query=16..225bp; Hit=4..213bp; Blast score=247; Percent Identity=59.0; E value=7e-66; Homolog= ZybeN COG1057
MLHSTDSTIDPSSPIIQALFGGTFDPIHYGHLRPVEALAKQVGLKQVILLPNHVPPHRPQPEATASQRLEMVRLAVQDNPLFTVDTRELERQTPSYTIETLKSFRQEVGEQRPLAFIIGQDSLQSIHTWYKWEELLGICHLLVCSRPGYQSQLSTSDMQKWLEQHKIDTPISLRQKPHGCIYLATTPLLNISATDIRQRHQQGLSCDDLLPPAIQNYVNSQGLYRQ

SEQ ID NO: 7037 - protein, 134 aa, Xenorhabdus bovienii
  Peptide sequence Name=Xb4151_4152.C429.gene70.pep
  Gene classification: Function=Uncharacterized ACR (homolog of plant Iojap proteins); Function class=S Function unknown
  Homolog annotation: Query=35..133bp; Hit=4..102bp; Blast score=125; Percent Identity=61.0; E value=1e-29; Homolog= PM1922 COG0799
LPLSRLLLQRLACYYSALFNQFDEIKVILLQGTELQKFVIDKLEDSKAQDIVSIDVRGKSSITDCMVICTGTSTRHLMSVADNLVDDCREAGIMPLGVEGQGISDWIVVDLGEIMIHVMQEDSRRMYELEKLWS

SEQ ID NO: 7038 - protein, 145 aa, Xenorhabdus bovienii
  Peptide sequence Name=Xb4151_4152.C429.gene71.pep
  Gene classification: Function=Uncharacterized ACR; Function class=S Function unknown
  Homolog annotation: Query=1..145bp; Hit=12..155bp; Blast score=255; Percent Identity=88.0; E value=9e-69; Homolog= ybeA COG1576
MPDWVQTGFIDYLHRFPKDMPFELIEVPAGKRGKNADIKRILEKEGEQMLSAVGKGNRIVTLDIPGSHWDTPQLAQQLERWKQDGRNVSLLIGGPEGLAPACKAAAAQSWSLSPLTLPHPLVRVLVAESLYRAWSITTNHPYHRE

SEQ ID NO: 7039 - protein, 637 aa, Xenorhabdus bovienii
  Peptide sequence Name=Xb4151_4152.C429.gene72.pep
  Gene classification: Gene name=FtsI; Function=Cell division protein FtsI/penicillin-binding protein 2; Function class=M Cell envelope biogenesis, outer membrane
  Homolog annotation: Query=14..635bp; Hit=7..631bp; Blast score=981; Percent Identity=73.0; E value=0; Homolog= mrdA COG0768
VNSGNGMKNKRTPFRDHTAESALFMRRALVAFIGIIILTGILIANLYNLQIIRHEDYQTRSNGNRIKLVPIAPSRGIIYDRNGTPLATNRTIYQLEIIPQKIDNLDKTLDELRAIVDLTDEDIENFKKERQRARRFTSVPLKTSLNQVQVARFYVNQYRFPGLEIKGYQRREYPFGSALTHVIGYVAKINDKDVERLEKEGILADYAATHDIGKLGIERYYESTLHGKPGYEEVEVNNRGRVIRQLHEQPPQAGKDVYLSIDLSLQNYIEQILTTSRAAVVVTDPRTGEVLAMVSNPSYDPNLFVDGISSKDYKNLLNDPNRPLINRATQGAYPPASTVKPFIASAALSSDIITKNTTIFDPGWWQLPGSEKRYRDWKRWGHGKLNVHKAIVESSDTFFYQVAYDMGIDRLSEWMSRFGYGQFTGIDLREETPGNIPTREWKVKRYKKPWYQGDTISVGIGQGYWTATPMQMVKALMTLINDGEVKTPHFLLGTRVNGEMHPYQPPVNHSIGDIHSGYWEIAKDGMYGVANAPNGTARRFFAGTPYKAAVKSGTAQVFSYETYNASKLAEHLRDHKLMIAFAPYDSPTVAISIILENGGSGPAVGTIIRQILDHILIKDSKRITPVAAPAVTGTQAN

SEQ ID NO: 7040 - protein, 370 aa, Xenorhabdus bovienii
  Peptide sequence Name=Xb4151_4152.C429.gene73.pep
  Gene classification: Gene name=FtsW; Function=Bacterial cell division membrane protein; Function class=D Cell division and chromosome partitioning
  Homolog annotation: Query=1..370bp; Hit=1..370bp; Blast score=508; Percent Identity=80.0; E value=1e-144; Homolog= mrdB COG0772
MTDSQKKVPFWTRVHIDIPLLLCILALLVYSLFIMWSASGQDVDMMERKAGQVIMGLIVMIVLAQVPPRIYENWAPYLYIGCVFLLILVDVFGQISKGAQRWLDLGIVRFQPSEIAKIAVPLMVARFMNRDLCPPSLKNTGIALILTFLPTLLVAAQPDLGTSILIAASGVFILFLAGMNWRLITIAILLIACFLPILWFFLMHDYQRARVMMLLDPESDPLGKGYHIIQSKIAIGSGGEFGKGWLQGTQSQLEFLPERHTDFIFAVLSEELGLVGVLVLLALYLLLIMRGLVIAARAQNTFGRVMAGGLILILFVYVFVNIGMVSGILPVVGVPLPLISYGGSALIVLMAGFGIIMSIHTHRKLLSKSL

SEQ ID NO: 7041 - protein, 347 aa, Xenorhabdus bovienii
  Peptide sequence Name=Xb4151_4152.C429.gene74.pep
  Gene classification: Gene name=RlpA; Function=Lipoproteins; Function class=M Cell envelope biogenesis, outer membrane
  Homolog annotation: Query=1..344bp; Hit=1..358bp; Blast score=224; Percent Identity=42.0; E value=1e-58; Homolog= ZrlpA COG0797
MRQQWLILGIVAVLISGCTTTGNKREDSSIPPVPTREVLGAEPQYEPYHPSANQDYQRDGQTYRIVQDSANFTQTGYASGFGEEANGKLTAIGERASPYALAAAHPTLPIPSYVRVTNLSNGRMIIVRINDRGPYNKPGKIIELSRATTERLNLMPQSRVKLDGIQVAPDGSISGLGTEGAIIVKQSYALPDRPDIGAPAMMDSPSEQNIAEQNTVSQPAVEQNLSGNTENPFLTSPSAGTPSAPKQSETKWILQPQTEPVATSPVIPESAATSTGGFMVQVGAISSEQKAKEWQQSLSQRFNVQGRVMQFSNIYRVQLGPLSRQQATELQKKLTDQMHQSSFIVAP

SEQ ID NO: 7042 - protein, 37 aa, Xenorhabdus bovienii
  Peptide sequence Name=Xb4151_4152.C429.gene75.pep
LFNVSFFIICYYVAYYQSLSHGCYLINHEIHSYFPFY

SEQ ID NO: 7043 - protein, 402 aa, Xenorhabdus bovienii
  Peptide sequence Name=Xb4151_4152.C429.gene76.pep
  Gene classification: Gene name=DacC; Function=D-alanyl-D-alanine carboxypeptidase; Function class=M Cell envelope biogenesis, outer membrane
  Homolog annotation: Query=1..402bp; Hit=1..403bp; Blast score=652; Percent Identity=78.0; E value=0; Homolog= dacA COG1686
MKYIVTSRFIKNATLGIALATSASAFANTDDNFKTMIPGVPQTDAEAYILIDYNSGKILAEKNSDIRRDPASLTKMMTSYVIGQAIKSGKIGPNDTVTVGKDAWATGNPVFKGSSLMFLKPGDQVSVAMLSRGINLQSGNDACVAMADYVAGSQDAFVNLMNKYVQNLGLQNTHFETVHGLDAAGQYSSAHDMALIGQALIRDVPDEYAIYKEKEFTYNNIHQPNRNGLLWDKSLNVDGIKTGHTSGAGYNLVSSATESNMRLISVVMGSPTFKGRETDSKKLLTWGFRFFETVSPLQVGKEFASEPVWFGDADKVQLGVDKNVYLTIPRGRLKDLKASYVLNNTELHAPLAKDQVVGTINFQLDGKTIEQRPLVVMQEIKEGGFFSRMIDYIKLMFHHWFG

SEQ ID NO: 7044 - protein, 35 aa, Xenorhabdus bovienii
  Peptide sequence Name=Xb4151_4152.C429.gene77.pep
MSRGTQAVHLILFSWALLVYLPRQCGSFCRGVIIF

SEQ ID NO: 7045 - protein, 87 aa, Xenorhabdus bovienii
  Peptide sequence Name=Xb4151_4152.C429.gene78.pep
  Gene classification: Function=Uncharacterized ACR; Function class=S Function unknown
  Homolog annotation: Query=1..87bp; Hit=1..87bp; Blast score=143; Percent Identity=86.0; E value=4e-35; Homolog= ybeD COG2921
MKTKLNELLEFPCSFTYKVMGLAQPELVDQVIEVVQRHAPGDYSPVVKPSSKGNYHSVSITINATHIEQVETLYEELGNLELVRVVL

SEQ ID NO: 7046 - protein, 39 aa, Xenorhabdus bovienii
  Peptide sequence Name=Xb4151_4152.C429.gene79.pep
LIILIQTIKETASVFASGTSFRSFINQFHGVLVEIFIRG

SEQ ID NO: 7047 - protein, 30 aa, Xenorhabdus bovienii
  Peptide sequence Name=Xb4151_4152.C429.gene80.pep
MINYISNTTRSCLLPPQKRQNAFEQRIRIG

SEQ ID NO: 7048 - protein, 486 aa, Xenorhabdus bovienii
  Peptide sequence Name=Xb4151_4152.C429.gene81.pep
  Gene classification: Gene name=TrkG; Function=Trk-type K+ transport systems, membrane components; Function class=P Inorganic ion transport and metabolism
  Homolog annotation: Query=9..485bp; Hit=8..484bp; Blast score=558; Percent Identity=62.0; E value=1e-159; Homolog= trkG COG0168
MVRKNQLLIVGHLCSFLVLLYSLSMLLPIFVALFYKEKSVFAFFDTLLIGLSIGSVGWYFTRKTKAQPSTQDGFLIIVLFWLLFSLLSALPFVLDKSLNINLVDAVFEGVSGITTTGATVLNDVSALPKSMLYYRAQLNFIGGLGVIVLAVAILPLLGIGGVKLYQSEMPGPFKEERLTPRLADSAKSLWLVYLLLGALCSVSFKVAGMSWFDAVCHGISTVSLGGFSTRNESLGYYDSAAIEMVGGIFSVLAAVNFTLYFVALTRRSLKPLLKNAELKFFLLVLAAVVCIIWLELYRSGMYGVKEAFVHGFFMTSSMMTDNGLATSDYAQWPSHTILMLLAVSFFGGCVGSTCGGIKALRFLILAKQSISEINQLVHPNAISTIKVGQSSVHERVLRSVWGFFFLYVFFSCFFIWALNLLGYDLVTSFATVAACINNMGVGYGATAQGFGDLDAIAKWMMCAAMLLGRLEIYPILILCSKAFWRF

SEQ ID NO: 7049 - protein, 66 aa, Xenorhabdus bovienii
  Peptide sequence Name=Xb4151_4152.C429.gene82.pep
MPHNQELVFSDHLLAQTEIKGEIIEIYNHHNIKFKYIRLINNISALKHSQTGGNPFRALYWRIIFC

SEQ ID NO: 7050 - protein, 216 aa, Xenorhabdus bovienii
  Peptide sequence Name=Xb4151_4152.C429.gene83.pep
  Gene classification: Gene name=LipB; Function=Lipoate-protein ligase B; Function class=H Coenzyme metabolism
  Homolog annotation: Query=6..213bp; Hit=3..209bp; Blast score=285; Percent Identity=65.0; E value=3e-77; Homolog= VC0944 COG0321
MMKFPLQHNTVILRQLGIQPYEPVSDAMHQFTEQRTAETSDEIWLVQHEKVFTQGQAGKAEHVLTPGEIPVIQSDRGGQVTYHGPGQQIMYVLVDLKRAKIGVRQLVTAIENAVIETLAHFGVEAHARPDAPGVYVQNNKICSLGLRIRKGCSFHGLALNIAMDLQPFLRINPCGYAGMQMTQLSDLAAEVTVEDVQPVLVEKFCRILGFQLINER

SEQ ID NO: 7051 - protein, 321 aa, Xenorhabdus bovienii
  Peptide sequence Name=Xb4151_4152.C429.gene84.pep
  Gene classification: Gene name=LipA; Function=Lipoate synthase; Function class=H Coenzyme metabolism
  Homolog annotation: Query=1..321bp; Hit=1..321bp; Blast score=618; Percent Identity=92.0; E value=1e-177; Homolog= ZlipA COG0320
MSKPIQMERGVKYRDADKMALIPVKTVATEREALLRKPEWMKIKLPADSSRIQGIKAAMRKNGLHSVCEEASCPNLAECFNHGTATFMILGAICTRRCPFCDVAHGRPTAPDTNEPTKLAQTIQDMALRYVVITSVDRDDLRDGGAQHFADCISAIREKNPSIKIETLVPDFRGRMDRALEILTATPPDVFNHNLENVPRVYRQVRPGANYEWSLKLLEKFKETHPNIPTKSGLMVGLGETNEEILEVMRDLRRHGVTMLTLGQYLQPSRHHLPVQRYVSPAEFDEMKEAALEMGFTHAACGPFVRSSYHADMQAKGMEVK

SEQ ID NO: 7052 - protein, 93 aa, Xenorhabdus bovienii
  Peptide sequence Name=Xb4151_4152.C429.gene85.pep
  Gene classification: Gene name=CrcB; Function=Integral membrane protein possibly involved in chromosome condensation; Function class= D Cell division and chromosome partitioning
  Homolog annotation: Query=29..93bp; Hit=1..65bp; Blast score=73; Percent Identity=56.0; E value=4e-14; Homolog= crcB COG0239
VVHLSAPLTMLICRPKAWKSNNLPTVTIMINIIFAVFIGGGLGSVLRWLISLRLNNASTPLAVGTLTANCVGAFIIGLGLAYFNKATHLDPVW

SEQ ID NO: 7053 - protein, 82 aa, Xenorhabdus bovienii
  Peptide sequence Name=Xb4151_4152.C429.gene86.pep
MNPKDSVLSLQKMVAKMFSYTFPPFSLMVSKLWLKVKESSLKSLRVRKVHLLQTLSQSNFYPRILKTRLLQRVFYVFKFNLI

SEQ ID NO: 7054 - protein, 33 aa, Xenorhabdus bovienii
  Peptide sequence Name=Xb4151_4152.C429.gene87.pep
LLPSSGVIKPNPLDSLNHLTLPLIFDIKLTFNK

SEQ ID NO: 7055 - protein, 161 aa, Xenorhabdus bovienii
  Peptide sequence Name=Xb4151_4152.C429.gene88.pep
  Gene classification: Gene name=Ada; Function=Methylated DNA-protein cysteine methyltransferase; Function class=L DNA replication, recombination and repair
  Homolog annotation: Query=19..154bp; Hit=16..157bp; Blast score=145; Percent Identity=45.0; E value=2e-35; Homolog= VCA1017 COG0350
MYHHYLNTPEGFPKPYVHITADDEGVTSIYFVNEKKELESKNTITKQCVKELQEYFKGKRHTFTVPLSMKGTEFQKRVWQQLCNIPFGDMWSYKQLALTLGSVNYCRAVGMANSRNPISLIVPCHRVIGHDGKLVGYTGGLDIKGWLLEHEKNKKIKAKQS

SEQ ID NO: 7056 - protein, 72 aa, Xenorhabdus bovienii
  Peptide sequence Name=Xb4151_4152.C429.gene89.pep
VSFIKKDNVYCIYFINRLSEYNTKMLVFIISYSDTQKVILPEALSFMANTVVFGTILSASSTTQDLSDEIFK

SEQ ID NO: 7057 - protein, 57 aa, Xenorhabdus bovienii
  Peptide sequence Name=Xb4151_4152.C429.gene90.pep
VARVSESCHNKLKYLIYSNIFIASEIKIQINSNFLQYFKNRHIKKNKKQLYNRYIYH

SEQ ID NO: 7058 - protein, 46 aa, Xenorhabdus bovienii
  Peptide sequence Name=Xb4151_4152.C429.gene91.pep
MIYFLYYSESFFSHIYPSTLKYVDNPLFRIINQIDIYYGVMFVTAI

SEQ ID NO: 7059 - protein, 400 aa, Xenorhabdus bovienii
  Peptide sequence Name=Xb4151_4152.C429.gene92.pep
  Gene classification: Gene name=ProV; Function=ABC-type proline/glycine betaine transport systems, ATPase components; Function class=E Amino acid transport and metabolism
  Homolog annotation: Query=1..398bp; Hit=1..398bp; Blast score=580; Percent Identity=73.0; E value=1e-166; Homolog= proV COG1125
MTIKLEVRNLYKIFGDHPEPAFKLLESGFNKEQIFEKTGLAIGVQNANLAIEEGEVFVIMGLSGSGKSTLVRLLNRLIEPTRGQVIIDGKDIAAISDTQLREVRRSKISMVFQSFALMPHLNVLENTAFGMELAGIPKKERHYKALETLKQVNLENYALSYPDELSGGMQQRIGLARALANDPDILLMDEAFSALDPLIRTEMQDEVLRLQGEHQRTIIFISHDLDEAMRIGDRIAIMQGGIIVQVGTPDEILNNPANDYVKTFFRGVDISHVFSAKDVARRRHEALLHIATGFGPRSALKVLDDEDRNYGYLIEKGQKFIGVVSVCSLQKALTEKQPIEYATLKEPAAVSADMPLHELISIVAQSPCAVPVVGDNDRYLGVISKGILLQALDKETPNEQ

SEQ ID NO: 7060 - protein, 364 aa, Xenorhabdus bovienii
  Peptide sequence Name=Xb4151_4152.C429.gene93.pep
  Gene classification: Gene name=ProW; Function=ABC-type proline/glycine betaine transport systems, permease component; Function class=E Amino acid transport and metabolism
  Homolog annotation: Query=5..348bp; Hit=10..354bp; Blast score=420; Percent Identity=72.0; E value=1e-117; Homolog= ZproW COG1174
MSSKTLQTASDQATFSDPWINSATVDPSSNNDWLDTSATEISSEHFNIMAPFQHKLIPFDSWVTHAIDWLVLHFRPIFQGVRIPVDFILTGFEQFLISMPAPVTILIFALLAWQLTGAGMGVTSFISLILIGAIGAWSEAMITLALVLTALLFCILIGLPLAIWLAHNERVARIVRPLLDAMQTTPAFVYLVPIVMLFGIGNVPGVMVTIIFALPPIVRLTILGIKQVPADLIEAAQSFGASPRQMLFKVQLPLAMPTIMAGVNQTLMLALSMVVIASMIAVGGLGQMVLRGIGRLDIGLAAVGGAGIVILAIILDRLTQSLGKNNRARGGLWYHSGPIGLFITLFARKWAQKSSCDNNTQTDK

SEQ ID NO: 7061 - protein, 344 aa, Xenorhabdus bovienii
  Peptide sequence Name=Xb4151_4152.C429.gene94.pep
  Gene classification: Gene name=ProX; Function=ABC-type proline/glycine betaine transport systems, periplasmic components; Function class=E Amino acid transport and metabolism
  Homolog annotation: Query=11..338bp; Hit=1..328bp; Blast score=473; Percent Identity=67.0; E value=1e-133; Homolog= proX COG2113
MRIITRCKKIMNKNTILGLALSSLVSIPLFASELPGQGISVQPLQSTISEETFQTLIVCKVLEKLGYDIKPIKEVDYNVAYASIAAGDATFMAVNWVPLHNSQYKAAGGDKKLYRKGTYVENAVQGYLIDKKTAEKYRITNIAQLQDPQLAKLFDSNGDGKADLTGCNPGWGCEKAINSQLKAYGLENTVEHNQGNYAAMMADTIARYRESKPIFYYTWTPYWVSDVLKLDTDVIWLQVPFSALNDDEVVDTQLPNGRNYGFPPSTMHIVANKIWAEKNPAAAMLFAVIKLPVADINAQNLRMHRDKVSEIDIEHHAEGWLRAHQTIVDEWLEAARKATDQKTS

SEQ ID NO: 7062 - protein, 39 aa, Xenorhabdus bovienii
  Peptide sequence Name=Xb4151_4152.C429.gene95.pep
MNGLRLPEKRLTKKQANPELLKNSCKFINKNLWLLSPYC

SEQ ID NO: 7063 - protein, 40 aa, Xenorhabdus bovienii
  Peptide sequence Name=Xb4151_4152.C429.gene96.pep
LLIGETTLTKYGESENIKYINYLINIIKSRVFDRFLAVWR

SEQ ID NO: 7064 - protein, 276 aa, Xenorhabdus bovienii
  Peptide sequence Name=Xb4151_4152.C429.gene97.pep
  Gene classification: Gene name=AzlC (BS); Function=Predicted branched- chain amino acid permease (azaleucine resistance); Function class=E Amino acid transport and metabolism
  Homolog annotation: Query=32..263bp; Hit=4..235bp; Blast score=299; Percent Identity=68.0; E value=2e-81; Homolog= Z3983 COG1296
MLFHLLTKKLVSSMPIPDKPVPDIPKSGASIPEPPIPNKISSFSEGIIDSLPIAIGYIPIAFAFGLSAVKLGFAPLEAIFFSCVIYAGASQFVITALLSAGMSLWVSALTVLAMDIRHILYGPALRYRIKQKLSEKKTAIWAFGLTDEVFAAATAKLIKDQRSWSENWMVAIAVCSWLSWVLGTVAGSLLGNGYLDSYPAVEAAMTFMLPALFLSFLLASVKKQNSYCVTASLAGALIGVTYFSIPIAILAGILGGCLAALLQFHTTQLNKNKTDD

SEQ ID NO: 7065 - protein, 111 aa, Xenorhabdus bovienii
  Peptide sequence Name=Xb4151_4152.C429.gene98.pep
  Homolog annotation: Query=1..111bp; Hit=1..112bp; Blast score=132; Percent Identity=70.0; E value=2e-30; Homolog= gi|37525245|ref|NP _928589.1| hypothetical protein [Photorhabdus luminescens subsp. laumondii TTO1] gi|36784672|emb|CAE13572.1|
MIDNRILLIGIVVGVANFLFRYLPLRFGVNRSPMTKAGNTGVVLDSIGIASICSLLIVSGIPEVIREHNKFFPTLIGSLTICLLFYKTRSISIATLSGATVFGLTFKVFMN

SEQ ID NO: 7066 - protein, 50 aa, Xenorhabdus bovienii
  Peptide sequence Name=Xb4151_4152.C429.gene99.pep
LLNLTFNIVFVGFLTEVTLPVETNKVSKQWKVHSLPLKSCLIAVLHSKKS

SEQ ID NO: 7067 - protein, 175 aa, Xenorhabdus bovienii
  Peptide sequence Name=Xb4151_4152.C429.gene100.pep
  Gene classification: Gene name=MarR; Function=Transcriptional regulators; Function class=K Transcription
  Homolog annotation: Query=1..169bp; Hit=1..165bp; Blast score=205; Percent Identity=68.0; E value=2e-53; Homolog= emrR COG1846
MESSFTPTEELLNCRVTQQKELNKSLPYQEILLTRLSMHVQGKLLENRNNMLRAQGINETLFMALMILDTKESRSIQPSELSAALGSSRTNATRIADELEKQGWIERKESHNDRRCLHLHLTDKGTDFLNSLLPPQHDCLIKLWSALEQEEQKQLEKLMRKLLARLDNIGDCFKK

SEQ ID NO: 7068 - protein, 47 aa, Xenorhabdus bovienii
  Peptide sequence Name=Xb4151_4152.C429.gene101.pep
VCIYTTGKGELHGFKYYLRIIVSHMKYQMIQASRKDFLGHVAITRFS

SEQ ID NO: 7069 - protein, 392 aa, Xenorhabdus bovienii
  Peptide sequence Name=Xb4151_4152.C429.gene102.pep
  Gene classification: Gene name=EmrK; Function=Multidrug resistance efflux pump; Function class=Q Secondary metabolites biosynthesis, transport and catabolism
  Homolog annotation: Query=1..390bp; Hit=1..389bp; Blast score=433; Percent Identity=59.0; E value=1e-121; Homolog= ZemrA COG1566
MNIKEEIKSPTATGRNKKRQRRNIIILLTLLFLILGAAYTVYWFLVLRHHQETDNAYVTGNQVQVMSQVTGSVTTVYFDNTDFVKSGSVLVQLNPLDAELVLKKAENELAIAVRTTHQRILDNQQYQAVINLKKIALSKAQNDLNRREILGIKEVIGKEELQHTRESVAIAKADLDVAIAQYNSNQATILDTPLDKQPAVEKAASGVRDAWLALQRTKIVSPVDGYVSRRHVQVGSRINSGTPLMVIVPASNMWIEANFKETQLATMRIGQPVKIISDFYNDGVVYTGKVAGLDMGTGSAFSLLPAQNASGNWIKVVQRLPVRIELDPEQLKQYPLRIGLSTKVTVDTADTRKMTLATSERHHPAYHTNALTIDMAPANKIINDVINSHSRN

SEQ ID NO: 7070 - protein, 513 aa, Xenorhabdus bovienii
  Peptide sequence Name=Xb4151_4152.C429.gene103.pep
  Gene classification: Gene name=ProP; Function=77 Permeases of the major facilitator superfamily; Function class=G Carbohydrate transport and metabolism
  Homolog annotation: Query=1..502bp; Hit=1..502bp; Blast score=695; Percent Identity=73.0; E value=0; Homolog= emrB COG0477
MVTREPLTGAKLALLTISLAMATFMLVLDSTIANVAIPTIAGNLGASNSQGIWVITSFGVANAISIPITGWLAKRIGEVKLFIWSTALFTFSSWLCGISNSLEVLIFFRVIQGVVAGPIIPLCQSLLLNNYSPAKRNMALALWSVVIIVAPICGPILGGYISDNYHWGWIFFINIPLGIAIIFVARHTLRNRETKTEIHAIDTVGLVLLILGIGCLQIMLDQGKELDWFNSTEIIVLTVIAVVSLTILIVWELTDDHPIIDLSLFKERNFTIGTLCLSLAFMFYFGTIVLLPQLLQEVFGYTATWAGLAAAPIGLMPLLLSPLIGKYGHKIDMRYIVTASFIIYTVCFYWRAYTFEPGMNFAAIAWPQFFQGFAMACFFMPLTTITLSGLPPERMASASSLSNFIRILSGSIGASITTTIWTQREAMHHSYFTEHINPYDSNYQQTYQQLTQLGMNDQQISAYLAKQITHQGLIISANEIFWLAAGVFLVLVLLVWMAKPPFSVGSKDSGGAH

SEQ ID NO: 7071 - protein, 155 aa, Xenorhabdus bovienii
  Peptide sequence Name=Xb4151_4152.C429.gene104.pep
  Homolog annotation: Query=2..154bp; Hit=64..216bp; Blast score=142; Percent Identity=48.0; E value=2e-33; Homolog= gi|27367372|ref|NP _762899.1| Uncharacterized low-complexity protein [Vibrio vulnificus CMCP6] gi|27358941|gb|AAO07889.1|AE016
MLKEASFKNCDLSMADFRYINALGIEICGCRLQGADFRGASFMNRVSANIQFCSAYITKSNLSYTNFADVILEKCELWENRWHETHILGARLSGSDLSGGEFISFDWNAADFTYCDLTNSTLGELDIRKVDLKGVKLESYQVAELLERIGIVVMD

SEQ ID NO: 7072 - protein, 66 aa, Xenorhabdus bovienii
  Peptide sequence Name=Xb4151_4152.C429.gene105.pep
LKPAPANLYTKGINIPEVCHGQITVFETSLFQHSVFEITAQITCWLIKLAIDKLSISQIATRKVAI

SEQ ID NO: 7073 - protein, 44 aa, Xenorhabdus bovienii
  Peptide sequence Name=Xb4151_4152.C429.gene106.pep
MQGLELYEEKIERDQFRGEIIKNSKFLNCDFSSSDLRDTQFIDC

SEQ ID NO: 7074 - protein, 802 aa, Xenorhabdus bovienii
  Peptide sequence Name=Xb4151_4152.C429.gene107.pep
  Gene classification: Gene name=RimL; Function=Acetyltransferases, including N-acetylases of ribosomal proteins; Function class=J Translation, ribosomal structure and biogenesis
  Homolog annotation: Query=28..179bp; Hit=29..180bp; Blast score=73; Percent Identity=29.0; E value=7e-13; Homolog= BH2621 COG1670
MSAVATISFEKTLPDLGTFSLRPLDLTEDIAAITDWVNQEYAYYWGMQSHTEQQVKTFYQDLLNRQPDSVFIGIYQEQPVFLLECYWAQDDQIGKYYPARSDDMGMHILVAPSEQKISQFTWGIFQTIIAFIFKNPAVNRIVVEPDIRNEKIHRLNLRAGFVYDKTVQLSHKTAGLAFCTREQHQMALQSAKLTVPSNQTHSLVSHLHPAIWQKVNRLHLRKAISEFSHECLLFPEQLTEKADQDGYHHYRLDNPECSVNYHFRARRLALDHWLIDADSLRKMQAGDWCELDFISFIIEFKQQLGISDTVMPTYLEELTSTLHSSAFKYHRNGIDVEELVNADFQTIEAEMMEGHPIFVANNGRIGFDAEDFHKFSPESASDMRLVWLAAHKSKAHFACIEQLSYQQLMEQELGEAEIAKFNHQLLLLGLNPEEYLLMPFHPWQWQNKLPSVFAHDLANRKLVYLGQGTDVYQAQQSIRTLFNRSHPQRYYVKVALSILNMGFMRGLSPYYMATTPGINDWLFDLVQKDAVLQGYGFRLLREVASIGFRNSYYEQAIHGDTPYKKMMAMLWRENPLPLIEPNQKLMTMAALLHHDQQGKAFLPALISASGLPSQEWIRRYLDCYLSPLLHCLYAYDLMFMPHGENIIMVLENHIPQYIFMKDLAEEILVVNPDADLPEKASRVKVSMPEEMKTLTILSDVFDGVFRYLSAILDEQGGYSQERFWQAVADCILDYQSHHPEFSKQFLRYELFTPEIKRCCLNRLQIANNRQMLDLSDPALSFKFADNLTNPIAPFVKNIANVV

SEQ ID NO: 7075 - protein, 439 aa, Xenorhabdus bovienii
  Peptide sequence Name=Xb4151_4152.C429.gene108.pep
  Gene classification: Gene name=IucD; Function=Lysine/ornithine N -monooxygenase; Function class=Q Secondary metabolites biosynthesis, transport and catabolism
  Homolog annotation: Query=7..433bp; Hit=8..430bp; Blast score=338; Percent Identity=42.0; E value=8e-93; Homolog= BH2620 COG3486
MTTKTYDFIAIGIGPFNLGLACLVQPIKEITSLFIDQKAGFNWHPGMMLESSTMQTPFMADLVTLASPTHPLSFLNYIKQKGRIYSFYIRESFFLMRKEYNQYCQWAAEQLSNLRFNTQVENITYDASTSLYTLHCADTLTGQKHQFSCKKLVLGTGPSSYIPKCCRPFADHMVTSGDYLENKAALQQKKSITVLGSGQSAAEIFYDLLEDIDAHGYQLNWVTRSPRFFPLEYTKLTLEMTSPEYVDYFYSLPENKREALNRSQQSLYKGINSSLINEIFDLMYTKRLSGELDVSLYTNSELRQVHFIAERQGIVEEQKLILDLFQHEQETAFSLETEGLVLATGYQYQIPSFMEGIQHLIRWDKQGRYDVQRNYSIDCRNEIFVQNVELHTHGFVTPDLGMASYRNSCLIQEITGTAHYDIEKSIAFQQFGVASEGVF

SEQ ID NO: 7076 - protein, 255 aa, Xenorhabdus bovienii
  Peptide sequence Name=Xb4151_4152.C429.gene109.pep
  Homolog annotation: Query=1..253bp; Hit=1..253bp; Blast score=372; Percent Identity=69.0; E value=1e-102; Homolog= gi|37528444|ref|NP _931789.1| Ferric iron reductase protein FhuF [Photorhabdus luminescens subsp. laumondii TTO1] gi|36787882|
MINKNNDISSEWASKIEIEDIIRLFDSAFSHFNSSMKVNAENIPSDSMEFYQWSSEKEFSLLMKRYQDAYYGNNEQKPNQKGLYSLWAQWYFGLTIPPMMLMLLEYPQPIDTDYHLFQIEFHESGRPDIVYYQLTWLNESLSLLERYHSLLDRHIIPVCEKIESYRGINGRLLWNNIGYVIHWYLDNFKGRMSTEQYESLIQNLFFEQALPDGRDNPLYRTMILKNNIIQRRSCCQRNKLPGVGNCHDCPLESTA

SEQ ID NO: 7077 - protein, 37 aa, Xenorhabdus bovienii
  Peptide sequence Name=Xb4151_4152.C429.gene110.pep
MSLFLFIIKNSPIIYFHPNPNTRYIKIALLVIYSFCI

SEQ ID NO: 7078 - protein, 271 aa, Xenorhabdus bovienii
  Peptide sequence Name=Xb4151_4152.C429.gene111.pep
  Gene classification: Gene name=FepC; Function=ABC-type cobalamin/Fe3+- siderophores transport systems, ATPase components; Function class=P Inorganic ion transport and metabolism
  Homolog annotation: Query=13..265bp; Hit=20..273bp; Blast score=276; Percent Identity=55.0; E value=2e-74; Homolog= VC0779 COG1120
MSSDANSPVVTSRLKAHDLSLAYGKRTIIEGVNLAIHDSEFSVIIGSNGCGKSTLLRAISRNMQPQRGEVQLDGINIHRYKPKAVARELSLLTQGATVTEAMTIYDLVSRGRYAYQSFLRQWSAEDERVVNEALQAVDLDEMSQKLVSELSGGQRQRAWFAMTLAQQTPIILLDEPTTYLDITHQIELLDLCQRLHRQGKTLVLVLHDINLALRYASRLIMMKNGQIYAEGVPEDIVTEQSIADVFGLECRIIRDPESHKPLIIPKYKMNK

SEQ ID NO: 7079 - protein, 348 aa, Xenorhabdus bovienii
  Peptide sequence Name=Xb4151_4152.C429.gene112.pep
  Gene classification: Gene name=BtuC; Function=ABC-type cobalamin/Fe3+- siderophores transport systems, permease components; Function class=P Inorganic ion transport and metabolism
  Homolog annotation: Query=24..340bp; Hit=35..351bp; Blast score=137; Percent Identity=36.0; E value=1e-32; Homolog= VC0778 COG0609
MAQINFTAGQPKIKTFTLGNAVFIAPSLHTSRVILSILLLLVALFYLALSLGREGMDNPFLAMETPYQEFILLQIRLPRALVAIGAGMTLALSGSLFQLTTRNALGSPDIIGINAGAAVGIMVVLLFWPSILPVPLGALLGACLAVLLVYIGNGSGVGNMQANKIVISGIAVAAFFMAFVDFAISNIRIEQAQQISSLLRGSLASRRWQDVGLISGMVIFIPFLCWLGRQLNYTHFGDDIANTLGVPVRFIRIVSILLAVTFATMSVLVVGPVAFIALSAPQIARRLVRAKGAALFCSALVGALLMLASDLITLILPTVARLPVGVITAVVGGIYLMYLLYAELRRTR

SEQ ID NO: 7080 - protein, 335 aa, Xenorhabdus bovienii
  Peptide sequence Name=Xb4151_4152.C429.gene113.pep
  Gene classification: Gene name=BtuC; Function=ABC-type cobalamin/Fe3+- siderophores transport systems, permease components; Function class=P Inorganic ion transport and metabolism
  Homolog annotation: Query=3..326bp; Hit=16..339bp; Blast score=193; Percent Identity=37.0; E value=2e-49; Homolog= slr1316 COG0609
MNAKRRTALILGLVLMALLTCLCIAASLSLGSKSLPLSAIWQHYWLGDQGSYYDLVINAREPRTLIGLMAGAALALAGTVTQGLLRNPLGDPGLLGINAGAATAVVCFSFIPALDILPRFWTAFIGASLSTLLFYLLSGGPRNTNPVRLVLTGASINICLFALVQGIVLINAQAMDNYRFWTIGSLSAMSLNEASLLIPYLLVAVVVTLSLSASLNVMVFGEGIASSLGANVARTRILSLVMVTMLAATATAMAGPIAFIGLAAPHLMRALVGSDFRWLLPYCLFAGPCLLLISDVVARLLIAPQEIMVGIITAGMGAPLLYLVAKHRSQKIMAE

SEQ ID NO: 7081 - protein, 342 aa, Xenorhabdus bovienii
  Peptide sequence Name=Xb4151_4152.C429.gene114.pep
  Gene classification: Gene name=FecB; Function=ABC-type cobalamin/Fe3+- siderophores transport systems, periplasmic components; Function class=P Inorganic ion transport and metabolism
  Homolog annotation: Query=20..179bp; Hit=22..178bp; Blast score=67; Percent Identity=29.0; E value=3e-11; Homolog= Rv0265c COG0614
MVLTRCKMLVAVPLILLVSLLVGCDKPTASKNLPTDAVGYPKTITTALGTAVINQSPQRIVALGTGSEDILLDLGIIPIGIESHRWGGDAEGYLPWFRDEIERRGEKLPAIIEMYPELDIEKIISLKPDLILATQSGITQEQYDHLSYFVPVITYPEKPWQTTPQRQIALVAHALDKIQLGEKLSAELDTMLSQAGSTVPNIERYRFAYIKAGMTGSILSIYVKNDPRVDTMVHLGLSLLPLADTLTAPFGSFSVDIGLENADLLNGADILVTWYSSEKERQDTESQPLFSSIRAVRQGGYIPLTDQSIVVSMSYGSPLSLRWGLPRFMPLLKQEIAKHNER

SEQ ID NO: 7082 - protein, 757 aa, Xenorhabdus bovienii
  Peptide sequence Name=Xb4151_4152.C429.gene115.pep
  Gene classification: Gene name=CirA; Function=Outer membrane receptor proteins, mostly Fe transport; Function class=P Inorganic ion transport and metabolism
  Homolog annotation: Query=22..757bp; Hit=2..729bp; Blast score=457; Percent Identity=37.0; E value=1e-128; Homolog= fhuE COG1629
LRQITDGNVKVNIITNQFGNGISRVINPILQPNHLTKKKVLSLMIPLILAGNSTAMAEEAQSKNDKIIVTAGAPRHEGVTEDTGMYNTSSMVTATGLNMSARETPQSVSVMTKQRMVDENLNSVESAIGSITGMTVRQADSDRFTFTSRGMTIKNMLRDGVPTFYDIRFNYGDNLMDTTIFDRLEVVRGAAGLMVGPGTPSAAVNVIRKRPTQNFRGEITLGGGSWDKWRTGLDLSGPLNEDGTVRGRFVTAYQRSNSFIDRDKHEKYPFYGILEADLTENTLLTVGADYQINHTRGGMFGGLPIYFKDGSKTDYKRSNSYAPDWAFSKVRSFSTFTSLQHQFDNGWSAKGTFTYDHGTLDQKVLWATGFPDRATNEGMYPGNMTLIDGTRRQRNFDLQVNGDYRLLGRTHHASFGLNYQKQNFQNDYYWAACMPRNCSTSPIGDFTNSSWGYAEPTWNKTRNNGSDGYNEQTAGYAVTQISLADPVTLILGGRVTSWKTRGDNFSMPQNASYSDEFVPYGGLVYNITPDFSVYGSYTKIFDPESRINRNGRLLKPVTGENYELGLKGVALDNGLDYSLAIFDIRQDNFTELDSTAPRRPDNIRTYYVINGVKTRGFEAEVSGQITDDWRVYAGYTQFRATDPKGKRINTDNPSRLFKLFTTYTLPGAMSDLTLGGGVNWQDKTWLELDTPTGKRQDEQGSFATVNLMGRYQFTPDLSLSVNLKNLFDKKYYTSFGGYTQYYYGAPRNVEATLSYKF

SEQ ID NO: 7083 - protein, 606 aa, Xenorhabdus bovienii
  Peptide sequence Name=Xb4151_4152.C429.gene116.pep
  Homolog annotation: Query=1..600bp; Hit=1..599bp; Blast score=947; Percent Identity=79.0; E value=0; Homolog= gi|37528438|ref|NP _931783.1| hypothetical protein [Photorhabdus luminescens subsp. laumondii TTO1] gi|36787876|emb|CAE16993.1| unn
MSPLYTKLSPQTSHLTRENWLHANRHLVAKILRELLHEKLIFPVNQSTDKSYSIEIDKFQYHFKAQSYQLDHLDIDAASITKFSHNQPEPLDAIQLIIELHPLLDISEKMLPIYLDEISSTLYGCAFKYQNNRLTAQDLTQADYQAVETAMTEGHPVFIANNGRIGFDADDYLDYAPESANPVTLIWIAVHRNKTVFSALSSLSYSQLVAEELEKYLPARFEQHMQTLGLNLSDYYLMPVHPWQWLHRIAISFAADIANQEIVYLGEGHDRYLAQQSIRTFFNISQPKKNYVKTALSVLNMGFMRGLDPHSMVTTPQVNEWLNHLVESDIFFQEKGFTILRERAAIGYFNHYFEAAIKKDNPHKKMLSALWRESPMTILKETQRLMTMASLLHVDREGDAVVAALVKDSGLSAEKWVTRYLDAYFSPLLHSFFTYDLVFMPHGENLMLVLENNVPVKMLMKDIGEEIAILNGDIQLPEEIDFLHVTIKDEMKINYIFLDIFDCFFRYLTPLLQKHLALPEARFWELVAQCVYNYQSQHLNQIEKFRKFDLFKHDFVRTCLNRLQMANNQQMIDLDDREKNLKFAGTLVNPLHALREKYAVTVETDN

SEQ ID NO: 7084 - protein, 33 aa, Xenorhabdus bovienii
  Peptide sequence Name=Xb4151_4152.C429.gene117.pep
MRGLRTQFSVQRTHLIKPFIHIQHHPVSMHKHD

SEQ ID NO: 7085 - protein, 40 aa, Xenorhabdus bovienii
  Peptide sequence Name=Xb4151_4152.C429.gene118.pep
MVNSVVTYLVPHSLVKFHLKSLHFMVVNSNDFNYHSCKKK

SEQ ID NO: 7086 - protein, 339 aa, Xenorhabdus bovienii
  Peptide sequence Name=Xb4151_4152.C429.gene119.pep
  Gene classification: Gene name=SpoU; Function=rRNA methylases; Function class=J Translation, ribosomal structure and biogenesis
  Homolog annotation: Query=1..339bp; Hit=1..345bp; Blast score=426; Percent Identity=64.0; E value=1e-119; Homolog= yfiF COG0566
MNDSYSGKNGKVKVMYVRSEDNNDRRSNNDSRSNNKRPSSGKGRDQGRRRDNERPAYSDDRSPWKTVSRPVEESLTPDHGGISGKSQIDPEQLRRQRLEETRIYGENACQAMFKNRPEAIVRAWFVQSVTPRFRDALKWMAANRKAYHVVDDEELVKASGTEHHGGVCFLIKKRNGLDVETYLQQAPAKDCVLALENVGNPHNLGAIMRSCAHFGVQGVILQDVAMLESGAAVRTAEGGAEHIKGIDADGFTTTLNQFRCAGYTIVTTSSHKGSTTLAKADLPEKMVLVLGQESDGLSDSIWEDGDIRLSIGGTGRIESLNVSVATGIMLAEWWRQNKA

SEQ ID NO: 7087 - protein, 273 aa, Xenorhabdus bovienii
  Peptide sequence Name=Xb4151_4152.C429.gene120.pep
  Gene classification: Function=Uncharacterized ACR; Function class=S Function unknown
  Homolog annotation: Query=35..257bp; Hit=4..225bp; Blast score=246; Percent Identity=58.0; E value=2e-65; Homolog= yfiP COG3148
MARRLPDVRARSYLWQRQSIKIPANFLSALFTNMFEFKMRNNNTVYQLRQQRLARSTRPFQARGCRVQRCLHCLLPQKSCLCETISPVTATSRFCLIMFDTEPMKPSNTGKLIADILTDTHAFLWSRTEPDQRMLEVLRDPTRQPYLIFPESYATPPRTVYQQLPDNQKAPLFIILDGTWPEARKMFRKSPYLDGIPLLSINNCAKMDYLLRIPSRKEQHCTAEVAAAALELANDLDASQTLLRHFNHFREQYLAGKPHRQEESITVILDNPR

SEQ ID NO: 7088 - protein, 33 aa, Xenorhabdus bovienii
  Peptide sequence Name=Xb4151_4152.C429.gene121.pep
LGVIMLPVRADSFLGFLISYHINKQSPLIKQLL

SEQ ID NO: 7089 - protein, 880 aa, Xenorhabdus bovienii
  Peptide sequence Name=Xb4151_4152.C429.gene122.pep
  Gene classification: Function=Acyl-CoA synthetase (NDP forming); Function class=C Energy production and conversion
  Homolog annotation: Query=1..709bp; Hit=1..709bp; Blast score=961; Percent Identity=68.0; E value=0; Homolog= yfiQ_1 COG1042
MSQRGLEALLHPKSIAVIGASEKPEKASSMLMRNLLMGHFTGPILPVTPNKTAILGVLAYPSIDKLPLTPDLAVICTHHSRNLSLLEQLAQRGCKTVIILSSPPSQFAELKQFSQKHHIRMLGPNSLGILAPWIGLNASFSPIPILKGKLAFISQSAAISNTILDWANHRNIGFSYFIALGDSVDIDIDDLLDFLARDSKTSAILLHLEHISDARRFLSASRSASRNKPILVVKSSRTRKAQELLGEQQNFDAAYDAAIQRAGLLRVQDTHEMFSAVETLSFMRPLRGERLLIVSNGSAPAAMALDELLRRTGKLAVLGDETSNQLSAILPDTLILRNPLDLGDDSSSEQYIAALKLLLDSYDYDALLLIHSPCAISHSMNTAIKVIQTIKEHPRGKWLTIFTNWCGEYSSLEARRLFSEAGIPTYRTPEGAITAFMHMVEYQRNQKQLKETPAMPISITSNTAHAHECIQQVLDSGNTLLDTHEVQPILEAYGLNTLPTWIAYTSDDAVNIAEKIGYPVALKLRSPDISHKSEVQGVMLYLRNSDEVKTSAQAIIDRVKQNFPQARIHGLFVQSMANRAGAQELRVAIEQDEIFGPLIMLGEGGIDWINETQTAVALPPLNMALARSLVIQAIKGGKIKSGGSLLPLDIPALSQLLVRVSNLLIDCPQISRMNIHPLLASGNEFTLLDVSMELTPVTGDPHSKLAIRPYPNELEETIYLKKDFECLLRPILPEDEPLLKTFISQVTKEDLYYRYFSEISEFTHDDLANMTQIDYDREMAFVAIRHAATTPEIIGVARAMADPDNIEAEFAVLVRSDLKGITLGYQLMTKLIHYTRGHGIQILTAITMPENRNMIQLAKKLGFTIDIQLEDGVVNLVLRL

SEQ ID NO: 7090 - protein, 31 aa, Xenorhabdus bovienii
  Peptide sequence Name=Xb4151_4152.C429.gene123.pep
VLLVFGSFKFRQHHSAFFLLVWMVGVPSSGV

SEQ ID NO: 7091 - protein, 451 aa, Xenorhabdus bovienii
  Peptide sequence Name=Xb4151_4152.C429.gene124.pep
  Gene classification: Gene name=Cls; Function =Phosphatidylserine/phosphatidylglycerophosphate/c ardiolipin synthases and related enzymes; Function class=I Lipid metabolism
  Homolog annotation: Query=1..431bp; Hit=2..432bp; Blast score=581; Percent Identity=65.0; E value=1e-166; Homolog= pssA COG1502
MLSKFKRAKHQQHLAQLPKLPQSVADIKTLYQSKVFRSTLLEHIANAEKYIYIAALYLENDDAGRDIMDALYIAKQKRPKLDIKIFVDWHRAQRGRIGAEAAATNADWYCSMAESYPDANISVLGVPVNTREALGVLHLKGFIFDDTVIYSGASINDVYLHRHEKYRYDRYHLLHNAKLAAIMKQFIDDNILTADAVKNLACHSRPRSLEIKNLIRQFRTSLRSVEYNIENQASNEELAVTPLVGLGKKNLLNKTICHLISSTENKLVICTPYFNLPAVLVRAISRLLRQGKQVEIIIGDKTANDFYIPPEEPFRIIGALPYLYEINLRRFTSRLQYFIDNQQLTIRLWKEADNTYHLKGIWVDNKWQLITGNNLNPRAWGLDLENAILIHDPHQEMQEQRTLELDCIRTHTKIINDYQELESIQLYPVKVRKLIRRLRRIRVDRLISRIL

SEQ ID NO: 7092 - protein, 60 aa, Xenorhabdus bovienii
  Peptide sequence Name=Xb4151_4152.C429.gene125.pep
LEHAIVNRRGEITNTFFIIFMTGFIIVIYAMIYISVNHSLLINKIQKIPSSDSKKGLMSR

SEQ ID NO: 7093 - protein, 117 aa, Xenorhabdus bovienii
  Peptide sequence Name=Xb4151_4152.C429.gene126.pep
  Homolog annotation: Query=9..114bp; Hit=7..110bp; Blast score=114; Percent Identity=50.0; E value=3e-25; Homolog= gi|26248952|ref|NP _754992.1| Hypothetical protein yfiM [Escherichia coli CFT073] gi|26109358|gb|AAN81560.1|AE016764_242 Hypoth
MIKPVINIIKNVLVISPLLFTIACSNMYQANDNWTGKDKAQHFLFSSAMAAAGNAYGERQNWTHQESAQFGLLLSISLGTAKEFYDSRPPGTGWSWQDFVYDIAGAMAGYSLYQSLK

SEQ ID NO: 7094 - protein, 63 aa, Xenorhabdus bovienii; identical to SEQ ID NO: 5466
  Peptide sequence Name=Xb4151_4152.C429.gene127.pep
  Homolog annotation: Query=1..47bp; Hit=68..115bp; Blast score=85; Percent Identity=87.0; E value=2e-16; Homolog= gi|22124244|ref|NP _667667.1| hypothetical [Yersinia pestis KIM] gi|21957009|gb|AAM83918.1|AE013632_6 hypothetical [Yersinia pes

SEQ ID NO: 7095 - protein, 59 aa, Xenorhabdus bovienii
  Peptide sequence Name=Xb4151_4152.C430.gene1.pep
MPRHLPICFSIKNSDNYHSVTTELHIDKNLRTGDIVSFDIVPNAHAVGFSTKTIQLYCS

SEQ ID NO: 7096 - protein, 174 aa, Xenorhabdus bovienii
  Peptide sequence Name=Xb4151_4152.C430.gene2.pep
MLLAFRQKRFNYTAHEVDLDSLGIYFEEDVIPALMTDEVNIPPNGKLYTRAIAMVKNINGYPLSEVPITIIGGYLPNLDKVKIFLSNQDPNTEVSKQSLYGEQSIVLNTDKSGKLEFYIYLSDKSQFVLDFKARVSGKTGFVFSRNKLYIIDDDPGAPSNIAKQTLNSPNYYRL

SEQ ID NO: 7097 - protein, 44 aa, Xenorhabdus bovienii
  Peptide sequence Name=Xb4151_4152.C430.gene3.pep
VSLGEMIVLLHFWFQLIVIIMPKRDDTNLFYCRWESISQKKNCC

SEQ ID NO: 7098 - protein, 185 aa, Xenorhabdus bovienii
  Peptide sequence Name=Xb4151_4152.C430.gene4.pep
MEISNLQLDQYVKYVGGGKNQPLDDLTRVYDMCTVYSSFGPFIPSNLVFKDDIVHYFTISRYMNNKEHDGLFVVITGTNDPTDKTKVPFGSEVTLSFRIDSYKKQVYKTFTKTMPTQPDQGSKNTATLIFGISYEDVSHVESDSNSVAGRIYFDYQINELGKITYGKIWKARIDTVPPSPDGDTD

SEQ ID NO: 7099 - protein, 256 aa, Xenorhabdus bovienii
  Peptide sequence Name=Xb4151_4152.C430.gene5.pep
VQFILLLLKNLRVIFQMDINKKSDNMRIFMSIKEFIYNVRLNSLLIELMNLDHRLKINDSSLKEEIGYKQFKYHFNPVTSKVYFLLGIIGFSLVLSSSMLLAVLISYVIDSGVNKLAIITCMLLVFSILSLIFFGFLSLGKGNKEGIYIHRILYQSTLVISVLLLLFDSSPFLHFFYYALVMVFSLLIKFIMNSYFYFNAVRDMKLFRITHIFLTKDTQEILNMTRKESKKRIKEVEFQRRREIKEKKRVKEAAGK

SEQ ID NO: 7100 - protein, 55 aa, Xenorhabdus bovienii
  Peptide sequence Name=Xb4151_4152.C430.gene6.pep
MVPQCLLYRFYKITFNVPPCSILSLIAWLTLSDLNEKSSISNDDRYINFIFLLLL

SEQ ID NO: 7101 - protein, 51 aa, Xenorhabdus bovienii
  Peptide sequence Name=Xb4151_4152.C430.gene7.pep
LRNHLRDSLIATGGFVGRGMTGTIRNSENILTSGNYMIGSIVSVAYENPVS

SEQ ID NO: 7102 - protein, 33 aa, Xenorhabdus bovienii
  Peptide sequence Name=Xb4151_4152.C430.gene8.pep
LVLLSLLLTKTLLVSYLNNYIDCINTLIVITTI

SEQ ID NO: 7103 - protein, 216 aa, Xenorhabdus bovienii
  Peptide sequence Name=Xb4151_4152.C430.gene9.pep
MNMKDFILNTEFKKLLGKAKDLEAKIKNADPVLKNITLNDLSYNKYFSYPGRFKIGFIIFFIMIVYMAFFSGVAVAIPSLLMENPSYEIKAFSFILSLIISAFISFSHIGLTLSGYYYGPVVQKYTNTVVFFFSLFISYLKGVYDSDFFYFSAIALCCLFIKLMLNSKYYSGFILAKMFIRVERVIFNDELDKIKGFNKKQLREYSRSIKSKNRKK

SEQ ID NO: 7104 - protein, 62 aa, Xenorhabdus bovienii
  Peptide sequence Name=Xb4151_4152.C430.gene10.pep
MDIKHILTNNQFRSILTLYKITDNRIRNSDSLLVDEPDIVRIKDKITSANESAQKSLCYLTH

SEQ ID NO: 7105 - protein, 48 aa, Xenorhabdus bovienii
  Peptide sequence Name=Xb4151_4152.C430.gene11.pep
LICRTRIKCAHMIFIPKKRSFRPILQETYSNRYPEKIKKVNDCGKHNQ

SEQ ID NO: 7106 - protein, 445 aa, Xenorhabdus bovienii
  Peptide sequence Name=Xb4151_4152.C430.gene12.pep
  Gene classification: Function=Permeases; Function class=R General function prediction only
  Homolog annotation: Query=1..445bp; Hit=1..445bp; Blast score=577; Percent Identity=80.0; E value=1e-164; Homolog= ZyieG COG2252
MSTLNSGPANQQGLLQRVFKLEEHGTTVRTEMIAGFTTFLTMVYIVFVNPQILAVAGMDIKAVFVTTCLIAAFGSIMMGLMANLPVAVAPAMGLNAFFAFVVVGAMGISWQVAMGAIFWGAVGLLILTIFRVRYWMIANIPLSLRIGITSGIGLFIAMMGLKNAGIIVPNPDTIVSIGNFASHNVLLGTLGFFIIAILAARNFHAAVLVSIVVTTVIGLMMGYVEYHGIFDLPPSVMSVVGNVDVKGALDIALSGVIFSFMLVNLFDSSGTLIGVTDKAGIADSSGKFPRMKQALYVDSISSVAGSYVGTSSVTAYIESSSGVSVGGRTGLTAIVVGMLFLLVMFASPLASMVPAYATAGALVYVGVLMTSSLTRVKWNDLTESVPAFITAVMMPFSFSITEGIALGFIAYCAMKLGTGKWREISPCVIVVTLLFVLKMAFVDAH

SEQ ID NO: 7107 - protein, 489 aa, Xenorhabdus bovienii
  Peptide sequence Name=Xb4151_4152.C430.gene13.pep
  Homolog annotation: Query=1..489bp; Hit=1..487bp; Blast score=657; Percent Identity=70.0; E value=0; Homolog= Pa|Phot5-548f08.p1k_g196| 167331 - 168794 3665 487 aa, chain -
MRFFDTSSYRMPLFLWITGYALLWVVASYTLDPTVPYDAVEALNWGINGEWGSPKNPWLVGSVMLPAIHISTISLSFYWYLTHFLAIAIGMLGVWRLAFRLTGKVELAWLAMLTLNLSGIINFDIIPYNDNYLLVMLWPWALLFFLRAIDDHPKWWLAFALTTGLATMGKYSSLSIIGSVFLLSLFVPRVRRSYREPLFYLAIALWFMLILPNVWWLVHNDFAAFKWVDSQIQQGFNLHTTRAVLSVFYPLLIVGAFIYLSGGRIGWPKQQSNALANIVILLPLLLIYGWFSFNQGGRMTEWLQPFMTVAPALLVGSLTVLPRKPLKNTLRGLAVFAVLVWIGYVGVMITNVRGAGQKFVGIKTFANQLDQRWNELYPTPLRYVGGEYLHQWLTFYSHYRPETIQPWELGNGEPPNVYNRHIKESSIVKEGALLVGEKGKSCEQENFQSTLKQWPVLVISYKEEFSFRPQPSAKTETVCIGFVTPENNQ

SEQ ID NO: 7108 - protein, 199 aa, Xenorhabdus bovienii
  Peptide sequence Name=Xb4151_4152.C430.gene14.pep
  Gene classification: Function=Uncharacterized BCR; Function class=S Function unknown
  Homolog annotation: Query=31..178bp; Hit=1..145bp; Blast score=108; Percent Identity=53.0; E value=3e-24; Homolog= ZyihI COG3078
VNDIGCYRWFLLDSAKNILIKRVGSQAMNQLKKKSPAKFSAGKQKRKSREELNAEGRERKRQKKHSGHPSGNRNHGNDSNKNRSGDKQGQDPRIGSKVPVPLIIGEKVVVKPVVEKPKASQKPRLSPQEELAMLEQDEYLDELLARLEKGEELSQEENAYVDEKLDRIDELMEELGINLEEDDSEEEKKEDIMQLLKGK

SEQ ID NO: 7109 - protein, 58 aa, Xenorhabdus bovienii
  Peptide sequence Name=Xb4151_4152.C430.gene15.pep
MTGSDILIPSVVFAPRNATLLLNYSAVFRWHESTNFYVSIAAIVYPITTINNILILWL

SEQ ID NO: 7110 - protein, 457 aa, Xenorhabdus bovienii
  Peptide sequence Name=Xb4151_4152.C430.gene16.pep
  Gene classification: Gene name=HemN; Function=Coproporphyrinogen III oxidase and related Fe-S oxidoreductases; Function class=H Coenzyme metabolism
  Homolog annotation: Query=1..457bp; Hit=3..459bp; Blast score=720; Percent Identity=76.0; E value=0; Homolog= hemN COG0635
MSEPVIVWDLPLVQKYNYSGPRYTSYPTALEFNQQYDNTAFAQAAARYPDRPLSLYIHIPFCHKLCYFCGCNKLVTRQKHKADDYLNILEKEITARARLFSQRKVSQMHWGGGTPTYLDKTQISRLMSVLRSHFDFLPESELSIEIDPREIELDVIDHLRHEGFNRLSMGVQDFNKEVQHLVNREQDEDFIFELVNRARETGFISTSIDLIYGLPKQTSESFAFTLQRVLALSPDRLSVFNYAHLPDLFAAQRKIKEHDLPSAEQKLDILQGTIATLTGNGYQFIGMDHFARPDDELAIAQREGVLHRNFQGYTTQGECDLLGMGVSAISMLGDSYSQNQKDLKIYYAAVEEQGHALWRGLVLTQDDCIRRDVIKDLICNFRLTFADIEQRYGLNFANYFAEDLQLLAPLVEDGLVDITEKQIQVLPKGRLLIRNVCMCFDSYLRNQMRQRQFSRVI

SEQ ID NO: 7111 - protein, 476 aa, Xenorhabdus bovienii
  Peptide sequence Name=Xb4151_4152.C430.gene17.pep
  Gene classification: Gene name=AtoC; Function=Response regulator containing CheY-like receiver, AAA-type ATPase, and DNA-binding domains; Function class=T Signal transduction mechanisms
  Homolog annotation: Query=1..475bp; Hit=1..468bp; Blast score=728; Percent Identity=77.0; E value=0; Homolog= ZglnG COG2204
MQRGKVWIVDDDSSIRWVLERALSGAGLECVSFENADSVLTALSQNCPEVLLSDIRMPGLDGLNLLNQIKQSHPQLPVIIMTAHSDLDAAVSAYQQGAFDYLPKPFDIDETVTLVERALSHYREQHQSSRNPQVAASVSEIIGEAPSMQEVYRIIGRLSRSSISVLINGESGTGKELVAHALHRHSPRASSPFIALNMAAIPKDLIESELFGHEKGAFTGANQVRHGRFEQANGGSLFLDEIGDMPLDIQTRLLRVLAEGQFYRVGGYAPVKVDVRIIAATHQNLEQRVTEGKFREDLYHRLNVIRVQLPPLRDRVEDISRLAHHFLQQTAKELGVEAKVLHPDTEIALMRLSWSGNVRQLENVCRWLTVMAASKEVLVQDLPADLIENPPTEQIGNLPSSCSALPEHWPRQLAEWAQNALKEGRTDLLSDALPLLERTLLNCALEYTNGHKQEAARLLGWGRNTITRKLKELGIA

SEQ ID NO: 7112 - protein, 347 aa, Xenorhabdus bovienii
  Peptide sequence Name=Xb4151_4152.C430.gene18.pep
  Gene classification: Function=Signal transduction histidine kinase, nitrogen specific; Function class=T Signal transduction mechanisms
  Homolog annotation: Query=5..347bp; Hit=7..349bp; Blast score=516; Percent Identity=77.0; E value=1e-146; Homolog= ZglnL COG3852
MVDFPKAEHILDSLINSVLVLDNDLIIRYANHSAMQLLAQSTRKLFGTPLPVLFSYLSLDTELMRSSLIRGHGFTDNEVILVINNHSHVMSLSAQPISEQFILLELAPMDSQRRLSQEQIQQAQQAAARELVRGLAHEIKNPLGGLRGAAQLLAKALPDPSLREYTQVIIEQADRLRALVDRLLGPQHPGTRISQSIHYVVERVYQLVSLEMPANVTLIKDYDPSLPELAHYPDQIEQVLLNMTRNALQALGEKGGTIILRTRTAFQITLHGERYRLVARIDIEDNGPGIPPNIQDTLFYPMVSGHEGGTGLGLSIARNLIDQHAGKIEFTSWPGHTEFSIYLPIKK

SEQ ID NO: 7113 - protein, 81 aa, Xenorhabdus bovienii
  Peptide sequence Name=Xb4151_4152.C430.gene19.pep
VHCTLVKHKPGSLSVQSVICLSSVICRRKCAGKGPIRRWVKSFTATKRAIVMLSSITRCNTVQIPADVASCVLVRFHHAVI

SEQ ID NO: 7114 - protein, 469 aa, Xenorhabdus bovienii
  Peptide sequence Name=Xb4151_4152.C430.gene20.pep
  Gene classification: Gene name=GlnA; Function=Glutamine synthase; Function class=E Amino acid transport and metabolism
  Homolog annotation: Query=1..469bp; Hit=1..469bp; Blast score=822; Percent Identity=83.0; E value=0; Homolog= glnA COG0174
MSVEHVLSMIEEHQVKFIDLRFTDTKGKEQHITIPSHQIDEDFFEDGKMFDGSSIGGWKGINESDMVLMPDPTTAMRDPFFDDATLILRCDILEPGTMQGYSRDPRSIAKRAEDFLRASDIADTVLFGPEPEFFLFDDIRFGNSISGSYYHIDDIEAAWNSGTRYEGGNKGHRPGIKGGYFPVPPVDSSQDLRSAMCLTMEKMGLVVEAHHHEVATAGQNEIATRFNTMTKKADETQIYKYVVHNVAHSFGKTATFMPKPLVGDNGSGMHCHMSLSKNGTNLFAGDKYGGLSELALYYIGGVIKHARALNAFTNPTTNSYKRLVPGFEAPVMLAYSARNRSASIRIPVVASAKARRIEVRFPDPAANPYLSFSALLMAGLDGIINKIHPGDAMDKNLYDLPAEEAQEIPTVASSLDDALAALDADREFLTRGGVFTDDAIDAYIKLLHGEIERVRMTPHPLEFELYYSV

SEQ ID NO: 7115 - protein, 54 aa, Xenorhabdus bovienii
  Peptide sequence Name=Xb4151_4152.C430.gene21.pep
LVDVSLIIRRKGHAALSNGLKWADDVCLCIGSMFIKLMLMRRVLREVCQLFKSL

SEQ ID NO: 7116 - protein, 35 aa, Xenorhabdus bovienii
  Peptide sequence Name=Xb4151_4152.C430.gene22.pep
LLTYFTKLVQFYLKLDCDFFRFYPLTHSSADLKDF

SEQ ID NO: 7117 - protein, 35 aa, Xenorhabdus bovienii
  Peptide sequence Name=Xb4151_4152.C430.gene23.pep
MISTRNIALAHIKTLKMLTVGGHSHGFLLIPVAFS

SEQ ID NO: 7118 - protein, 984 aa, Xenorhabdus bovienii
  Peptide sequence Name=Xb4151_4152.C430.gene24.pep
  Gene classification: Function=Predicted outer membrane protein; Function class=M Cell envelope biogenesis, outer membrane
  Homolog annotation: Query=538..893bp; Hit=7..384bp; Blast score=91; Percent Identity=26.0; E value=3e-18; Homolog= Z0402_2 COG3468
MKIYRYAVLPMALKVALFFSGISGNAIAASTCGPTISQNRTTPCYLSNNENLTIDKGVSIIVPTEGFMASQYDKYSGKTSAVNVGNEDIKDPLITVHNIENNGILKGTNGLVVTPSGLVEKLVNRGTISTISGGPALSGVTVAGTLKTLENYGSIIDPAGAGGSIFIIPELVIKNPHYGKIDTIQNQKGGSIQGIIMNGGTLTNLNNYGILSQSSSSNFLPPGALTAAYGADVGIFNNYGTVAVSNKGIIVSQGSTLKGLNNQVGSKGIIAGVNAIEVTGQGPASDSKKIQPSRIKKITNASTIYGNTKGIYVDDKGVIETITNTDTGVIKGIIFSIHNKGTITNGIDNAGTIDGNVELGSARLYLSGPKAILKGDVSGTKDSIVTIGNMNRTDKAKNLDFTYTHNMNVGTVKISSGNKLRLGDGHTTGKISGNIVNDGEFYFNRSDKVIYGHNISGAGSVHQVGSGTTIFQRANNYAGATTVQQGTLLQGAEKSFSPLSSYTIGQRGTLDMGGFNTTIPALNNSGRVVMGGDSNAVGSMLTITGDYRSNNGTVSLSTVLGDDSSKTDRLVVNGKTSGTTHLVIKNVGGKGAKTNEGIKVVDMKGAAGGNFSLAGDYSHKGNPTLVTGAHAYRLYKNSADNSLYLRSSSDNSKPTYQAGVSVYESYGRMLQIMNAPESLRDRTGGRKDRVLGTGEFRSSAAEDSTDDSTSQMPTGVWGRITASYGKLSPRVSTSDANATTYNMVRAQIGMDKRFYENNQGSVTGGGFLQYSKIDADVGSPHGDGNIRANGYTFGATSTWYGKNKFYVDGLAQMTYFDNDLHSKTAGRALGNSKSALGYALGLEAGQEIGLNQKWSMTPQAQLVYSSINMNGFHDPFGAKIRFDRSQSLKLRVGTTIDYRQKATRLYGFFNINQEVLGRNDSAKVADVAFISGNDRTWGDGGAGGSYSWDNGKSFVYAQASASTSLNNFADSYDLKGQVGLRTTW

SEQ ID NO: 7119 - protein, 41 aa, Xenorhabdus bovienii
  Peptide sequence Name=Xb4151_4152.C430.gene25.pep
LSVIQYKIKYYILSSEGSRPYLFRVCVQIQLGRNINKSLLS

SEQ ID NO: 7120 - protein, 608 aa, Xenorhabdus bovienii
  Peptide sequence Name=Xb4151_4152.C430.gene26.pep
  Homolog annotation: Query=246..592bp; Hit=88..444bp; Blast score=70; Percent Identity=25.0; E value=1e-10; Homolog= gi|33866099|ref|NP _897658.1| conserved hypothetical protein [Synechococcus sp. WH 8102] gi|33639074|emb|CAE08080.1| conserve
MIVNRIDINTLSYQQYNREKIMSNKLPAPILPQINNDTLDLKKIEGDIIIKIDNSAQVFFDRDSIMACFNTICGESYTVRNYTESYFEIKIPKNKISPGQYLVHYTVINNDDNISYSPITHIKVIDGTPTTPPSDKEPFIVMGARYADLAVANGLKTPQRLTAWTKEGKPHPVTWTYIGGTPSFTSPFSHINSPFFYDSAPWLPISVQDEQGNKLKINPINVFGNGGTLGLPKADFNDPLEEQYPSAFAVLLNDNTMVGWGGTFGNSYTQSGVKTITTNGPSYAGLNVDSGTLWYHGDSNHSNFPTGSFDDVGAGGNSFFAISHTNQQMEAWGAMTGIFNYPGDGKNVFVGNSFAITIYNPGTEQIQSLWGSSMENWQLDPDPRYSSVSKPRYITSMARGFAVIDESGDLSTWGDSSVFVGFNPSHQDFIQAASITPFLMNFNVPFGNYAVHRDGTLYAWSVPASSSDGDSCSNGVDIATTKQKFLMPGGTPPHGKIYWDGIQNYNDGPVFEEFMALKDVVQITCSANASAALRQDGTVLTWQNAEPSNVNFIPQPEIKNVRAIYSTGTAFLALTADNKVHTWGGSDGGGDSNEVQALLQGKLTYYMD

SEQ ID NO: 7121 - protein, 519 aa, Xenorhabdus bovienii
  Peptide sequence Name=Xb4151_4152.C430.gene27.pep
MSSPVSLSVPYGSSVIIGQRLNLNVTLTSDVKISDNTYIQIINADNKVTLLDSSRSDEDSGLFTLFLEISPDINDGDSINFGLYISSNVSFPNTTVMYTGRTLKNDSLTLSYDKNALEVPTQPNYPPSGNEGKSRTRVMATVRDEQGNPIPKVFVFISSLNPKDIEKVNLYQSDNKTKIGIEKNINDEGIFLSTDWHGNLVFYIYAKELQPISLEFYTRIFGITNEIPADSALNIVNDKPENPNDYLAAPGIEGYDNGGELTNHGQTNFLIDIPPYPGAQKGDMIKIRINNVSTIYEYPLLQLSELGNYSSFSMPYFAFTVGAVSTFSYVVFRQGRDTLYSRSLTLTYTGESWPKPVYYDKCVVYSSFGVNDPNNIIEEADPKDCEHATSHNTVNCKAISKSHDLDDPALFVQITGTNDITDKTKPPLGSMVDLTLHIKSNPRTVIKTYSKQIPSVAGPDGQTTTTTINIARKFVRDCHEFKDCTAGRIEFSYQVRSENTHSQTWIGRIDTASTGEDDC

SEQ ID NO: 7122 - protein, 505 aa, Xenorhabdus bovienii
  Peptide sequence Name=Xb4151_4152.C430.gene28.pep
MIKVSVSVKPNSDVIISQEFIAEIKLTSNIPIDNSISISLENTSYISPVGKISSFTPSYNNTSGSFFVRLLVSDKITSGELVSFDIKSSYFGTKHVEYVAKHIQQETLSLKFYKKYLPTPDQPNFPSQGEICSKVMTTIKSSDGQPLSGTPIFIPYLYNFKDFDIYDSEKNKIEVTSAPMKGFFINSNEKGEVIFYVYPHIGVATKITLDSMIYNATSSIHSMNELYVASSQPQGNDSLLDPPDIENIHGENLTSPNSFIFKTKVDQYDNAKSQDTILFFVNNIFTGYAFTIESIDDLGGYSIKLPYKIFEKYKDVACSFYYIIFSVNENVYYSYPLSIVFKGGVPNTPQPDINRIYNTCVVYNSAGISPDNILQEMDYVDSTEISNYRNNPDNAGLFVQIMGTNDLKDNSNVPLGSEVFLNLYINSSTKTVHHSLKKTMQNLPDGNNNSAKLIFNIPHSCLIDCLAYPDRGGDIYFDYQIGFDNDDDLTYGKVWQGRIDTPIID

SEQ ID NO: 7123 - protein, 88 aa, Xenorhabdus bovienii
  Peptide sequence Name=Xb4151_4152.C430.gene29.pep
MHYVMSHSSFLNKIDLKMNLGLYSIVFSSSIFMVVIIVLFLVIFNLRSFCVNFSLPNFPIIFSSRVSWVRWIISIIVKIDVSSRTIRI

SEQ ID NO: 7124 - protein, 509 aa, Xenorhabdus bovienii
  Peptide sequence Name=Xb4151_4152.C430.gene30.pep
MTITFLKTPEGNFSPNASFDIIKSVNLKPVHPSYTIQTGGSIEIAFTLEKELADRSTVSFDIVPHNASGFLTTSFSYTVVEIDNNSLSLTFGNEYLNAITKVENVSSNIPPTGKIYSKVFATIKAKNGGQSVSGIPITIMSDHNTSLDNVRTFRENKSQSSEITKKTLYNRPVFYLETEQDGMVVFYVYPDNNTEFILNLQARVTDTQSFQLSKNSLFVIDDDPTNPGNLSNINTDFLAPPSILEVSDGALIGDPDSTTFSVEVDPYNHPNRNDTILFYVNGSYSNQKIIVENKNNLGNYFIDLPYSIIPKNENIELSYIVVTHDAKIKKSASLGFTYSGGGKSAPLDDINRIYDPCVVYSSFGASQGTALIHQGDLINYFSISHDSNKKKSTALFIEIEGTNDITDKTKVPLGYNVVVTLYIDSYNKQFQHSFKVITMPATPVPHSSHTATHIFEIPIDYLNNIESYPNSSAGNIYFDYYAYDPSDPGNSGTKYYGKIWQGKIDTERP

SEQ ID NO: 7125 - protein, 45 aa, Xenorhabdus bovienii
  Peptide sequence Name=Xb4151_4152.C430.gene31.pep
MMSNEALGEKFPSGVFKKVIVIFSNWTLAIFDFVGIDEIIVFSTV

SEQ ID NO: 7126 - protein, 40 aa, Xenorhabdus bovienii
  Peptide sequence Name=Xb4151_4152.C430.gene32.pep
MDAFFGLAINQIVQFGLSSLQVIYYLEQLFREFYNELIFN

SEQ ID NO: 7127 - protein, 102 aa, Xenorhabdus bovienii
  Peptide sequence Name=Xb4151_4152.C430.gene33.pep
  Gene classification: Function=Predicted transposase; Function class=L DNA replication, recombination and repair
  Homolog annotation: Query=1..99bp; Hit=1..104bp; Blast score=72; Percent Identity=41.0; E value=8e-14; Homolog= Z4330 COG3335
MQKTIQKTRDKIMPKELSPYSCCIAETPSAMSRARVQSFFWRSLDTLYGLEGLKPLSSGRPRRWPFELICSLLRHLISDSPDVLGYQRSRGVIDIINYKSMR

SEQ ID NO: 7128 - protein, 62 aa, Xenorhabdus bovienii
  Peptide sequence Name=Xb4151_4152.C430.gene34.pep
MKNQASSMTTGIEGINNGQIKIKKPMILQIYDDIYNHPKVHQIMINSLILNIRKYFYYCDER

SEQ ID NO: 7129 - protein, 349 aa, Xenorhabdus bovienii; identical to SEQ ID NO: 5796
  Peptide sequence Name=Xb4151_4152.C430.gene35.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 7130 - protein, 37 aa, Xenorhabdus bovienii
  Peptide sequence Name=Xb4151_4152.C430.gene36.pep
MGRQSIVKNKLSICNHMLSFIFLITHLHIFDIFIRCN

SEQ ID NO: 7131 - protein, 122 aa, Xenorhabdus bovienii
  Peptide sequence Name=Xb4151_4152.C430.gene37.pep
  Homolog annotation: Query=2..121bp; Hit=26..145bp; Blast score=65; Percent Identity=31.0; E value=2e-10; Homolog= gi|22125042|ref|NP _668465.1| hypothetical [Yersinia pestis KIM] gi|21957891|gb|AAM84716.1|AE013716_7 hypothetical [Yersinia pe
MSIIFLFITTLFLYFSWRDFMSFINMNDIIYFSWRVFFACFGLPIVYYMFGLAIKNCLLNKPSPFYGFFLNLCVLIFILSIVASFPVSIYADHKLKKSGYIKCEKTSLIAPNKYVKNMKVCN

SEQ ID NO: 7132 - protein, 57 aa, Xenorhabdus bovienii
  Peptide sequence Name=Xb4151_4152.C430.gene38.pep
LIVFGLVVAGVLYYLDDKYQVSEKLIEALRNEEAKKRFREHLANPKYNMPRPPIFYR

SEQ ID NO: 7133 - protein, 45 aa, Xenorhabdus bovienii
  Peptide sequence Name=Xb4151_4152.C430.gene39.pep
MFLILMIRLCHQKHAYSPHLSELMTIVENKTSSSQPAYPLISPDY

SEQ ID NO: 7134 - protein, 49 aa, Xenorhabdus bovienii
  Peptide sequence Name=Xb4151_4152.C430.gene40.pep
MGLSGAGCGSSASPDFIDSLDTHAVQFVRTIQSVKYKILDLAHRSTYFS

SEQ ID NO: 7135 - protein, 34 aa, Xenorhabdus bovienii
  Peptide sequence Name=Xb4151_4152.C430.gene41.pep
MTSLFYIFATSLTKMQLLNILNHRLYFMHSIHRG

SEQ ID NO: 7136 - protein, 476 aa, Xenorhabdus bovienii
  Peptide sequence Name=Xb4151_4152.C430.gene42.pep
  Gene classification: Gene name=PutA; Function=NAD-dependent aldehyde dehydrogenases; Function class=C Energy production and conversion
  Homolog annotation: Query=7..472bp; Hit=4..471bp; Blast score=432; Percent Identity=47.0; E value=1e-121; Homolog= ydcW COG1012
MPVPTFKHFINGQYIESQGSEYFDLVSPVTGKAYARSPNATVADVDDAYASAKEAFKIWGRSTPSARQQALLALADTVEKNAERLIESQSRNTGQLKHLIASEEIATSVDHIRFFAGAARFLEGKATAEYLSGMTSSIRREPLGVVGQVTPWNYPLMMAVWKIAPALAAGNTVVLKPSDTTPESTLLLAELSAPFFPAGTFNVVLGNASAGSLVVSHKTPAMVSITGSVRAGLQVASSAAANLTRAHLELGGKAPVVIFADADIDKAVGTIVTAGYFNAGQDCTAASRVLVHESVYDIFVTKLVAAAKATRFGDPEDKEALYGPLNNVRQLEQVTGFLARLPAHARIETGGRQADRSGYYFEPTVITGLEQEDEMIQTEIFGPVITVQKFLTEQDAIEKANDVKYGLASSVWTRDHGRALRLSRELDFGTVWINTHIPLTAEAPHGGFKNSGYGKDLSAYGFDEYTRIKHVMSSND

SEQ ID NO: 7137 - protein, 257 aa, Xenorhabdus bovienii
  Peptide sequence Name=Xb4151_4152.C430.gene43.pep
  Homolog annotation: Query=1..257bp; Hit=1..257bp; Blast score=447; Percent Identity=87.0; E value=1e-125; Homolog= gi|37526250|ref|NP _929594.1| hypothetical protein [Photorhabdus luminescens subsp. laumondii TTO1] gi|36785680|emb|CAE14641.1
MVQNRSSRDLVSRAHHELFTDRDVRALERYFAPNFIEHSPLVKEGFAGLRERVQAHPELHHEMYRVLQDGDLVAIHGRFTGLDEQPLVGFDLYRVADGLIVEHWDGLVPQSAPNTSGRTQLDGPTETGYSHDREKNRELVVNFFTRTLIEEHYDEFGNYTNGEEFRQHSPDIPDGTVAVIEFLKQLKDEGQGLHYAKIHHTVADGQFVLSHSEGSIAGVRHSYFELWRIENGKVAELWDAITPVPEDAQALHRHGMF

SEQ ID NO: 7138 - protein, 251 aa, Xenorhabdus bovienii
  Peptide sequence Name=Xb4151_4152.C430.gene44.pep
  Gene classification: Gene name=FadR; Function=Transcriptional regulators; Function class=K Transcription
  Homolog annotation: Query=5..137bp; Hit=2..133bp; Blast score=58; Percent Identity=30.0; E value=8e-09; Homolog= mll6911 COG2186
MTDYSIIYAPLDQATRTEQVVERLSNAIISGILQTDAQLPNENELSRLLGVSPVTVRDALNTLRARQLIDTRRGRHGGSFVCQVPVEAMRKYHPLRLMASGELADFSEFHCAVIGHSARLAAQRSTQGELRKLEQLIDSFAAATQPDARIQTDMRCLLTLASQSQSARLANQELEIQAEWTPLMGLLYQEAAVHSEVVAAWRTLLAALYQGDDLACYQLAQKMITQITDHLLECKLRVDTDAPFLQRSDRE

SEQ ID NO: 7139 - protein, 249 aa, Xenorhabdus bovienii
  Peptide sequence Name=Xb4151_4152.C430.gene45.pep
  Homolog annotation: Query=1..243bp; Hit=32..275bp; Blast score=389; Percent Identity=79.0; E value=1e-107; Homolog= Pa|Phot5-421b03.p1k _g139| 110176 - 111009 930 277 aa, chain -
MYNDIHVERARSILNDILVTAQQATAALADKTARILLELPLCHTVGVRLAREQRGALQKHIHDVLRNNVWCNGAGFASYAVPKTVGKEGYWTLEWWRQEGDTIQYAPLEHNQEQRRRLDFRLFEWFRQPANCHLPVIDGPYVDYVCNGAYTITIAHPVLIGEEFAGVAAVDMLVSTLDRLLLPALGAIGKPALIINDDARVVTSTVPGVRSGSLLKSQGVNRSVDGEVPSLRLVILPSSHTESHRAFVC

SEQ ID NO: 7140 - protein, 427 aa, Xenorhabdus bovienii
  Peptide sequence Name=Xb4151_4152.C430.gene46.pep
  Gene classification: Gene name=ArgD; Function=PLP-dependent aminotransferases; Function class=E Amino acid transport and metabolism
  Homolog annotation: Query=1..422bp; Hit=5..426bp; Blast score=565; Percent Identity=67.0; E value=1e-161; Homolog= mlr5521 COG0160
MTESMLAKRRSAAIAKGVGVTTQVYVERAENAEIWDAQGQRYIDFAAGIAVVNTGHRHPRVIAAAREQLEQFIHTCHQVVPYENYVALAERLNRLVPGNFVKKTVFVTTGAEAVENAVKIARAATGRSGVVAFSGAFHGRTFLGMSLTGKVVPYKMGFGSLVSDVYRVPFPVALHGISVEQTLNALDNLFKTDIEPTRVAAIIIEPVQGEGGFYPAPPELLKSLREIADRYGIVLIADEIQTGFARTGKLFAMEHHEVAADLTTMAKGLAGGFPLAAVTGRAELMDAVAPGGLGGTYGGNPVAIAAGHAVLDVIEEEKLAARATQLGERLKQCLNELRPRVPQIADVRGLGLMIAVEFNRADSQEPDAGFTNAVRQKALERGLILLACGIHGNVIRFLPPLTIQNDVFDEALNVLESVLLDLNRTAV

SEQ ID NO: 7141 - protein, 132 aa, Xenorhabdus bovienii
  Peptide sequence Name=Xb4151_4152.C430.gene47.pep
  Gene classification: Function=Uncharacterized membrane protein; Function class=S Function unknown
  Homolog annotation: Query=1..120bp; Hit=1..119bp; Blast score=92; Percent Identity=40.0; E value=8e-20; Homolog= yhaH COG3152
MHWYLNVLNNYACFRGRAQRKTFWYFVLFQILAVLIISFLERLFAVANPEIYMGWFSAIYLLLTFLPALAVNARRLHDINCSAWWLLLHLIPFVGTVILLILAALKGQAGSNKYSSESRVHSQGNTQSQANG

SEQ ID NO: 7142 - protein, 513 aa, Xenorhabdus bovienii
  Peptide sequence Name=Xb4151_4152.C430.gene48.pep
  Gene classification: Gene name=DadA; Function=Glycine/D-amino acid oxidases (deaminating); Function class=E Amino acid transport and metabolism
  Homolog annotation: Query=102..488bp; Hit=30..412bp; Blast score=191; Percent Identity=33.0; E value=2e-48; Homolog= PA0534 COG0665
MAMNRRDFISTTAALAGAGVLSSLLPTTSLLARTLTAADASAVNIDQLRPTLLKDAQYRTSRLGLDPRIWNWHRDVAATAMPANYYEASLADWPAFGSFPIDQNCEVVVIGGGLLGASTALHLAEAGVDVILVEKDNIGSGASGRNGGQMTPGIARWEAETMLEKLSPDEAKRLWRFASVEAMNLVDELRERYGFECDRKYGHITAAIHPGHMGPLVANADARRQLGDTAVKVIGPHELQERYVRSGIYHGANIDSIGGQVQPLALLRGLIYSFAKLGGRVYDGTKVKGIRQDASSAVIETERGVIRASKAVVLGVHGSTEEFISGPSTTVPFFTYVAVTPPLPVDIKELIPSDLPVYDTQLQIDYYRAVRDNRLLFGGQGTGNSWSSRDVNNYLLERIRTVFPQLEKPELEYSWGGISDLTLNGATDARKSGDSVPVYMVHGWSGHGVAQTVRIGKAISDDLTERNHDFTMLTRIEHSSIPLGSYFSPVAIPLIKGALGVINTVNPADMVSF

SEQ ID NO: 7143 - protein, 60 aa, Xenorhabdus bovienii
  Peptide sequence Name=Xb4151_4152.C430.gene49.pep
LYLGVASENGKNRTIKASPDGQHQFVIFLLAQRSRFRLVKLTFIVSAQSHRNFQFTNNLF

SEQ ID NO: 7144 - protein, 281 aa, Xenorhabdus bovienii
  Peptide sequence Name=Xb4151_4152.C430.gene50.pep
  Homolog annotation: Query=33..268bp; Hit=43..289bp; Blast score=73; Percent Identity=27.0; E value=3e-12; Homolog= Pa|Phot2-44g08.q1ka _g5| 1380 - 2288 1697 302 aa, chain - [Photorhabdus asymbiotica]
MNRILNVCVALCLTMIPVEAVKADITAPIVYLEHVTPSVSLNINGKEVNRLSIDTGASGAFYLPRTVFDSIFSELNHRTTTVQNSIDVFGVEKSAVTARASHITVNGERLSDVNVEIFKTWGNGGMLDDNGQLIINGVLGLGVAKNKTLIINYASKMLTIADHLKALPDGYRWQSIPFTRTRNGIEISVSSGNEKIRRMVIDTGASHTMLFTRSKEGCAKLSQHCPKKAIVTPDGVKLSAFLFQIPDERIDFDGLLGDDFLSNRVLIISNDRLLISLPNNS

SEQ ID NO: 7145 - protein, 32 aa, Xenorhabdus bovienii
  Peptide sequence Name=Xb4151_4152.C430.gene51.pep
LIDFRCNRQIKHVSMSLGLFSYRRLLDHRTKN

SEQ ID NO: 7146 - protein, 75 aa, Xenorhabdus bovienii
  Peptide sequence Name=Xb4151_4152.C430.gene52.pep
MGVEFRMGLRTGTGCCVESIPLHVCNSGNQKDTGCMYYVCSQYLFVLRRKTAWQNSFNQPMSIETLMYRSHPVVK

SEQ ID NO: 7147 - protein, 397 aa, Xenorhabdus bovienii
  Peptide sequence Name=Xb4151_4152.C430.gene53.pep
  Gene classification: Function=Predicted flavoproteins; Function class= R General function prediction only
  Homolog annotation: Query=1..395bp; Hit=1..395bp; Blast score=634; Percent Identity=75.0; E value=0; Homolog= ZyhiN COG2081
MEKFDVVIIGAGAAGLFCAAQAGQEGLNVLVLDNGKKAGRKILMSGGGRCNFTNMYTEPAAYLSANPHFCKSALARYTQWDFIDLVQQHGIAYHEKALGQLFCDDSAQQIIDLLLKECEAGQVTVRLRSEVTQIEKDEQGFVITTAGKKVSAHSLVVASGGLSMPGLGASPLGYRIAEQFGLNILPTHAALVPFTLHKPLLEQLQTLSGVAVPSIVTAKDGTVFRENILFTHRGLSGPAILQISSYWQPGEYVSINLLPDMDLDAFLDKERESHPNQNLKNTLAKLLPKRLVECLQSLEQLPDVSLKQINPAQQKELIATLQYWQVQPNGTEGYRTAEVTMGGIDTNELSSKTMESHKVKGLYFIGEVVDVTGWLGGYNFQWAWSSAWACAQALVVV

SEQ ID NO: 7148 - protein, 30 aa, Xenorhabdus bovienii
  Peptide sequence Name=Xb4151_4152.C430.gene54.pep
MTFFRFNDNEMTANQLFLSIISIDYLVLIF

SEQ ID NO: 7149 - protein, 509 aa, Xenorhabdus bovienii
  Peptide sequence Name=Xb4151_4152.C430.gene55.pep
  Gene classification: Gene name=PitA; Function=Phosphate/sulphate permeases; Function class=P Inorganic ion transport and metabolism
  Homolog annotation: Query=14..509bp; Hit=1..499bp; Blast score=632; Percent Identity=70.0; E value=0; Homolog= pitA COG0306
MRRVHVLLTGLTFMLHLFTGLDFYTSLMLVLALLFVLFYEAINGFHDTANAVATVIYTRAMRSQFAVVMAGVFNFLGVLLGGLSVAYAIVHLLPTDLLLNVSSTHGLAMVFSMLLAAIIWNLGTWYFGIPASSSHTLIGSIIGIGLTNAIVADSSVVDALNISKMIQIFMSLILSPLVGLVIAGAMVFLLRRYWSGTKKRRRIHMTPAEREKQDGKRKPPFWTRTALILSAVGVSFSHGANDGQKGIGLIMLVLIGVAPAGFVVNMNSTSYDITRTHDAVASLQKYYVQHGPALSHAIEQTPAVSSVEDSADQMLHCDSSQAQDVLNTAAVMLGSIQNFSELTPDQRNNMRRMLMCAADTASAVAKLPETSLEDARFLNKLRKDLLNTVEYAPMWIIIAVALALSLGTMVGWKRVAVTIGEKIGKKGMTYAQGVSAQVTAAVSIGVASYTGMPVSTTQVLSSAVAGTMLVDGGGVQSKTIKNIMLAWVLTLPISIGLSGILYWIALQLI

SEQ ID NO: 7150 - protein, 171 aa, Xenorhabdus bovienii
  Peptide sequence Name=Xb4151_4152.C430.gene56.pep
  Gene classification: Gene name=UspA; Function=Universal stress protein UspA and related nucleotide-binding proteins; Function class= T Signal transduction mechanisms
  Homolog annotation: Query=29..171bp; Hit=1..143bp; Blast score=248; Percent Identity=88.0; E value=3e-66; Homolog= uspA COG0589
LSSYSINSKSWRFSVANPFNQHYGRSSLMAYKHILVAVDLSPESQVLVEKAVSMAKPYNAKVSLIHVDVNYSDLYTGLIDVNLGDMQQRIADETRNALKDLSVNADYEIQETLSGCGDLGQVLVDAIKQYDMDLVVCGHHQDFWSKLMSSARQLINTVHVDMLIVPLRDEE

SEQ ID NO: 7151 - protein, 80 aa, Xenorhabdus bovienii
  Peptide sequence Name=Xb4151_4152.C430.gene57.pep
LSFRGDVPQPFSILFFCRKCEVIVVCFLNIPLSYAYISTTIFISFLKNSFDNFQNSFIIFSSDKKIACISRRFYRIKFQL

SEQ ID NO: 7152 - protein, 447 aa, Xenorhabdus bovienii
  Peptide sequence Name=Xb4151_4152.C430.gene58.pep
  Gene classification: Gene name=GdhA; Function=Glutamate dehydrogenase/leucine dehydrogenase; Function class=E Amino acid transport and metabolism
  Homolog annotation: Query=1..447bp; Hit=1..447bp; Blast score=758; Percent Identity=81.0; E value=0; Homolog= ZgdhA COG0334
MNISPSLVSFLDSIQSHNPHQPEYLQAVREVLTSLWPFLQQNPQYREQSLLERLIEPERVIQFRVCWVNDQGKVQVNRAWRVQFNSAIGPFKGGMRFHPSVNLSILKFLGFEQTLKNALTTLPMGGAKGGSDFDPKGKSHGEVMRFCQALMTELYRHLGPDTDVPAGDIGVGGREVAFMAGMMKKLSNNTACVFTGKELSFGGSLIRPEATGYGLVYFTHEMLKRHGMGLEGMRVSVSGAGNVAQYTIEKCIELGAKVVTVSDSGGTVLDEEGFTPEKLAHLEEIKNQRYGRVEEYAKEHGLTFLKGQDPWSIPVDIALPCATQNELDLDAAKTLIKNGVKVVAEGANMPATISATDAFLEAGVLFAPGKAANAGGVATSGLEMAQNAARLSWKAEKVDVRLHHIMLDIHHACVEYGGEGKQTNYVQGANIAGFVKVADAMLSQGIL

SEQ ID NO: 7153 - protein, 44 aa, Xenorhabdus bovienii
  Peptide sequence Name=Xb4151_4152.C430.gene59.pep
LSKWLMRCCRRGFCNSRVIKSMVFWRISPMYKHGACFLNRSRID

SEQ ID NO: 7154 - protein, 247 aa, Xenorhabdus bovienii
  Peptide sequence Name=Xb4151_4152.C430.gene60.pep
  Gene classification: Gene name=SmtA; Function=SAM-dependent methyltransferases; Function class=Q Secondary metabolites biosynthesis, transport and catabolism
  Homolog annotation: Query=1..245bp; Hit=1..245bp; Blast score=374; Percent Identity=77.0; E value=1e-104; Homolog= yhiQ COG0500
VKICLICEQGADSSALSQLAERWNLVHDEDSVMALVLTPERLELRKLDEPKLGGIYVDFVAGTMAHRRRFGGGRGEAVAKAVGIKKGYLPTVVDATAGLGRDAFVLASIGCQVRMLERHPVVAALLDDGLQRGYQNEEIGSWLKERMTLIHTSSITALTDITPPPDVVYLDPMYPHRQKSALVKKEMRVFQSLVGADEDADGLLEPARALAKRRVVVKRPDYAEPLAGAKASAAITTKNHRFDIYPC

SEQ ID NO: 7155 - protein, 546 aa, Xenorhabdus bovienii
  Peptide sequence Name=Xb4151_4152.C430.gene61.pep
  Gene classification: Gene name=Dcp; Function=Zn-dependent oligopeptidases; Function class=E Amino acid transport and metabolism
  Homolog annotation: Query=34..546bp; Hit=168..680bp; Blast score=807; Percent Identity=76.0; E value=0; Homolog= prlC COG0339
VILSCLALVCRRKNRNATVRSPPVYLSLAPSSGNNLLDATMGWTKLITDECDLEGMPDSAKAAAKAAAEAKGLEGWLLTLNGPSYLPVMTYADDSELRQEMYYAYTTRASEQGPNAGQWDNSAVMTEILALRHELALLLGFKNYAENSLATKMAKTPKQVLDFLNDLANRAHAQGKRELEELTDFAESHYWVDELEAWDLAYYSEKQKQHDFSISDEQLRPYFPEQRVIEGLFEVIRRIYAITAKERRDVETWHPDVRFFELYDEKQTLLGSFYLDLYAREHKRGGAWMNSYVGRMRHTSGELQTPVAYLTCNFNKPVGDQPALFTHNEVTTLFHEFGHGLHHMLTQVETLDVAGINGVPWDAVEMPSQFMENWCWEPEALAFISGHYETKEPLPKEMLDNMLAAKNYQAAMAILRQLEFGLFDFRLHVEYDPAKGAQILPTLQSVKKQVAVVPSPEWGRFPNTFSHIFNGGYAAGYYSYMWADVLAADAYSRFAEEGIFNRTTGQSFLDNILTRGGSEDPMTLFVRFRGREPKLDAMLKSSGISG

SEQ ID NO: 7156 - protein, 199 aa, Xenorhabdus bovienii
  Peptide sequence Name=Xb4151_4152.C430.gene62.pep
  Gene classification: Gene name=Dcp; Function=Zn-dependent oligopeptidases; Function class=E Amino acid transport and metabolism
  Homolog annotation: Query=32..197bp; Hit=1..166bp; Blast score=231; Percent Identity=62.0; E value=3e-61; Homolog= ZprlC COG0339
LNSLYLIPILSTTTHWDIAVYIPKHTTKALTMTNPLLTPSVLPKFAAIEPKHVVPAVKETLANYRQVIEKVLAGNVTFTWDNLCQPISEAKDHLSRVWSPVEHLNAVKNSPELREAYEQSLPLISEFETWMGQHEGLYQAYKALKESEAFKALSQPQRKAIENTLRDFELSGIGLPKEKQKRYGEISARLSELGSQFGQ

SEQ ID NO: 7157 - protein, 76 aa, Xenorhabdus bovienii
  Peptide sequence Name=Xb4151_4152.C430.gene63.pep
MLMPHFYADNRGLFISDICEMTNEFRCFVGRAIIPALHYFLWKIIAPGGAAGLQIQTGSPAAPGRLTTFICCCSVI

SEQ ID NO: 7158 - protein, 40 aa, Xenorhabdus bovienii
  Peptide sequence Name=Xb4151_4152.C430.gene64.pep
MARANVAAITSNTLLIWTMLGYSVFVIISRYIIYILLSLA

SEQ ID NO: 7159 - protein, 45 aa, Xenorhabdus bovienii
  Peptide sequence Name=Xb4151_4152.C430.gene65.pep
MQFITQSRSRYSYPLRLSGYSQQSSNLEDGGYKLILPLIQLSQRQ

SEQ ID NO: 7160 - protein, 108 aa, Xenorhabdus bovienii
  Peptide sequence Name=Xb4151_4152.C430.gene66.pep
  Homolog annotation: Query=1..108bp; Hit=1..109bp; Blast score=122; Percent Identity=57.0; E value=2e-27; Homolog= gi|16760111|ref|NP _455728.1| putative secreted protein [Salmonella enterica subsp. enterica serovar Typhi] gi|29142118|ref|NP_
MRYTLFMLLILSPLSLAASFDCAKAKVPDEKAICTDHRLNDLDIEMSVKYHFLRGLFAMGMSGEMYDSQQAWLKQRQKCKGDKTCLLQRYHQRINQLDAIYNSIQKPI

SEQ ID NO: 7161 - protein, 159 aa, Xenorhabdus bovienii
  Peptide sequence Name=Xb4151_4152.C430.gene67.pep
MSYLKCLNYFGASFFLFSVFVQAQSSSSQLSTSQQKYLQQQIDKQMTDKSAVKEVESWSDTKKVAEFICRPLALSVIQQEHKEADKVFLGDESPNSIRLVDSHLIGTGMYRQGFGWKNIRFSCELDPKTGEARSFKLLKALPPQLQTGPEPVILPKKGE

SEQ ID NO: 7162 - protein, 349 aa, Xenorhabdus bovienii; identical to SEQ ID NO: 5796
  Peptide sequence Name=Xb4151_4152.C430.gene68.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 7163 - protein, 131 aa, Xenorhabdus bovienii
  Peptide sequence Name=Xb4151_4152.C430.gene69.pep
  Homolog annotation: Query=7..129bp; Hit=1..124bp; Blast score=162; Percent Identity=66.0; E value=1e-39; Homolog= Pa|Phot3-163e06.p1k _g5| 5346 - 5720 221 124 aa, chain +
MIGGNTMYDWSGAVPAKLEQDQPTGLILKKGDVISIVAKGWVKYGHPDNYWAAPQGTLLRKPTLRDSLIAKIGNKTYGIGNGVLHKTVPEDGELIFVFFDSPGDYGDNSREFLVNVKIESRYSPLEEIKNN

SEQ ID NO: 7164 - protein, 75 aa, Xenorhabdus bovienii
  Peptide sequence Name=Xb4151_4152.C430.gene70.pep
VGISHLLIQSFRFKRNAYFGFILTVKVLGFPQYLLFVQIPRMSKGRFLPYSDSSFLSRRSTISGLSIFWQKAYVS

SEQ ID NO: 7165 - protein, 48 aa, Xenorhabdus bovienii
  Peptide sequence Name=Xb4151_4152.C430.gene71.pep
LPVLGLIYPSDHSLWNSYRRTDIIIYSKNSPPKSLSKLTHFCTHKPCF

SEQ ID NO: 7166 - protein, 53 aa, Xenorhabdus bovienii
  Peptide sequence Name=Xb4151_4152.C430.gene72.pep
MTVKGLKKIRKRYAALFLNASDSPSEVFLFLTNVFPLVKKCNKNTRHFCLFWV

SEQ ID NO: 7167 - protein, 62 aa, Xenorhabdus bovienii
  Peptide sequence Name=Xb4151_4152.C430.gene73.pep
LRLLTRPTAPRHAPWVSRIPSNPESAPSMLKASISEYWMIMPVINALNSSLFLLCLLSTHVL

SEQ ID NO: 7168 - protein, 160 aa, Xenorhabdus bovienii
  Peptide sequence Name=Xb4151_4152.C430.gene74.pep
  Gene classification: Gene name=SmpB; Function=tmRNA-binding protein; Function class=O Posttranslational modification, protein turnover, chaperones
  Homolog annotation: Query=1..160bp; Hit=1..160bp; Blast score=279; Percent Identity=88.0; E value=7e-76; Homolog= smpB COG0691
MTKKKAHKPGSATIAMNKRARHEYFIEEEFEAGLSLQGWEVKSLRAGKANISESYVLLRDGDAYLFGATITPLNVASSHIVCDPTRSRKLLLNKRELDSLYGRVNREGYTIVALSMYWKNAWSKVKIGVAKGKKAHDKRSDIKEREWKVDKARIMKNSGR

SEQ ID NO: 7169 - protein, 33 aa, Xenorhabdus bovienii
  Peptide sequence Name=Xb4151_4152.C430.gene75.pep
MWLNKNLMAFGTINMHLLLNITQKRFISLTHTV

SEQ ID NO: 7170 - protein, 144 aa, Xenorhabdus bovienii
  Peptide sequence Name=Xb4151_4152.C430.gene76.pep
  Gene classification: Function=Oligoketide cyclase/lipid transport protein; Function class=I Lipid metabolism
  Homolog annotation: Query=1..143bp; Hit=14..156bp; Blast score=231; Percent Identity=74.0; E value=2e-61; Homolog= yfjG COG2867
MPQISRSALVPYSVEQMYKLINDVKSYPDFLPGCVGSSVISRSNNEMTAAVEVSKAGISKTFVTRNTLSDNKSISMQLVDGPFRKLMGGWHFTPLSEDACKVELHLDFEFTNKLIELAFGKVFKELAGNMVQAFTQRAREVYSV

SEQ ID NO: 7171 - protein, 121 aa, Xenorhabdus bovienii
  Peptide sequence Name=Xb4151_4152.C430.gene77.pep
  Gene classification: Function=Uncharacterized BCR; Function class=S Function unknown
  Homolog annotation: Query=19..118bp; Hit=1..101bp; Blast score=127; Percent Identity=67.0; E value=3e-30; Homolog= yfjF COG2914
LVRCLRNWPVIWFRLLPNVRVRFTVSDINVEVVYALPERQYLCNVKVPQGSTVEQAIVASGLLTLRSDIDLIKNKIGIYSRPVKLTDTMVEGDRVEIYRPLLADPKEMRRKRAERAKNSTQ

SEQ ID NO: 7172 - protein, 114 aa, Xenorhabdus bovienii
  Peptide sequence Name=Xb4151_4152.C430.gene78.pep
  Gene classification: Gene name=SmpA; Function=Small protein A (tmRNA -binding); Function class=J Translation, ribosomal structure and biogenesis
  Homolog annotation: Query=1..112bp; Hit=53..163bp; Blast score=104; Percent Identity=45.0; E value=2e-23; Homolog= HI0838 COG2913
MRCKLLTAATVSLVMLTAGCSMFERVVYRPDINQGNYLTPAAVSKIHKGMTQQQVAYTLGTPMLTDPFGSQIWYYIFRDQPGHKKATQETLTLTFDSNGVLTDIKNEKAFPEDQ

SEQ ID NO: 7173 - protein, 557 aa, Xenorhabdus bovienii
  Peptide sequence Name=Xb4151_4152.C430.gene79.pep
  Gene classification: Gene name=RecN; Function=ATPases involved in DNA repair; Function class=L DNA replication, recombination and repair
  Homolog annotation: Query=1..557bp; Hit=1..553bp; Blast score=704; Percent Identity=70.0; E value=0; Homolog= recN COG0497
MLTQLTISNFAIVRELEIDFRSGMTAITGETGAGKSIAIDALGLCLGNRGEANMVRAGATRTDICARFSLADAPSARKWLEAHQLDESRDDDNECLLRRTITADGRSRGFINGTAVPLSQLRELGSHLIQIHGQHAHQLLLENRHQRRLLDIYAGEFERQHEMKQAYQQWRQSCQALARFQQQALERRSRQQLLEYHLKELNELAPQVGEYQEQDSEYKRLANCGQFLSVSQNVLQILNDNDEQNIVSLLNYARNELTELASMDHKFNELLNMLEEAAIQINEVSDELRHYSDLLELDPNRLFELEQKISQQISMARKHHVAPEELPALHQQLLEEQHQLSQQEDDCAHLSELVSLHYQQALNVAEKLHQVRQQYAAELSQLITNSMHQLSMPHGRFTIDLTFEPEHLNIDGASKVEFNVTTNPGQPHQSLAKVASGGELSRIALAIQVITAKKMETPALIFDEVDVGISGPTAAIVGRLLRELGESTQVMCVTHLPQVAGCGHQHFYVNKQTDGEETETHMQLLDKKARLQELARLLAGNEVTKNTLANAKELLAA

SEQ ID NO: 7174 - protein, 299 aa, Xenorhabdus bovienii
  Peptide sequence Name=Xb4151_4152.C430.gene80.pep
  Gene classification: Function=Predicted kinase; Function class=R General function prediction only
  Homolog annotation: Query=8..299bp; Hit=1..292bp; Blast score=476; Percent Identity=76.0; E value=1e-134; Homolog= yfjB COG0061
MLKETTAMNNEFKCIGIVGRPRHPEALATHEMLYHWLVSKGYYVIMDRQVARDIGLKGVQTGGLTEIGKIADLVIVVGGDGNMLGAARVLSRYDIKVIGINRGNLGFLTDLDPDNALQQLSEVLNGEYRDEKRFLLEAQVTKKGQKSRRSTALNEVVLHPGKVAHMIDFEVYIDERFAFSQRSDGLIIATPTGSTAYSLSAGGPILTPNLNAIVLVPMFPHTLSARPLVISSESSIRLKFSRNSNDYEVSCDSQIVLPIQDSEEVIIKRSEYNLHLIHPKDYNYFNTLSTKLGWSKKMF

SEQ ID NO: 7175 - protein, 257 aa, Xenorhabdus bovienii
  Peptide sequence Name=Xb4151_4152.C430.gene81.pep
  Gene classification: Gene name=GrpE; Function=Molecular chaperone GrpE (heat shock protein); Function class=O Posttranslational modification, protein turnover, chaperones
  Homolog annotation: Query=65..257bp; Hit=1..194bp; Blast score=199; Percent Identity=57.0; E value=2e-51; Homolog= grpE COG0576
MGGQRFRVTWTADNTDAFEFVIHCCCFLQHMVLPSQYDCSLESLVLIPIISGSSANNTKYAEIFMSSKDQKVPDEQVSENTENVFEQQMDAEKADTPETESIVDPRVAELEEQLKQAQIGERDAMLRARAEVENIRRRTELDIEKAHKFALERFANELLPVIDNLERALEAVDRSNDALLPMIEGVELTLKSFTNAVGKFGIEVVGDTNVPFNPEVHQAMTMMESDQHEPNHVMLVMQKGYTLNGRLLRPAMVAVSK

SEQ ID NO: 7176 - protein, 30 aa, Xenorhabdus bovienii
  Peptide sequence Name=Xb4151_4152.C430.gene82.pep
LIGIPHCLSDNRITTKMPPCVWRHCNHGIA

SEQ ID NO: 7177 - protein, 226 aa, Xenorhabdus bovienii
  Peptide sequence Name=Xb4151_4152.C430.gene83.pep
  Gene classification: Gene name=Ung; Function=Uracil DNA glycosylase; Function class=L DNA replication, recombination and repair
  Homolog annotation: Query=1..225bp; Hit=1..225bp; Blast score=344; Percent Identity=73.0; E value=4e-95; Homolog= ung COG0692
MSASLTWHEVIGHEKTQPYFVDTLTYVANERKAGKTIYPLQQDVFNAFRYTELSDVRVVILGQDPYHGPNQAHGLAFSVQPGIPAPPSLVNMYKELESDITGFSRPNHGCLVSWAKQGVLLLNTVLTVERGNAHSHANLGWETFTDKVIAAINEHRHGVIFLLWGSHAQKKGHFINTQQHYVLKAPHPSPLSAHRGFLGCKHFSQANSLLEAQGLTPIDWYPTLPE

SEQ ID NO: 7178 - protein, 30 aa, Xenorhabdus bovienii
  Peptide sequence Name=Xb4151_4152.C430.gene84.pep
MTSCHVRDADIANPFLYDCQIGLSLPIPFV

SEQ ID NO: 7179 - protein, 383 aa, Xenorhabdus bovienii
  Peptide sequence Name=Xb4151_4152.C430.gene85.pep
  Homolog annotation: Query=52..322bp; Hit=44..314bp; Blast score=293; Percent Identity=53.0; E value=3e-78; Homolog= gi|37527244|ref|NP _930588.1| hypothetical protein [Photorhabdus luminescens subsp. laumondii TTO1] gi|36786678|emb|CAE15744.
MTLSINGSFFSELGIYSLQGSPLQLQSSSPAKSSSDKADVTHSTTQPTTAPLSENTQQNNNLYQSLIRDRHLSAMALPELHANDIAGKHSKRIDYDLSLVTRDVYRMNSMGIGDYVRLTKDEISKAGIDPAILEDSSTGFQAGVYRNKGLYIVSFTGSNEIQDFMASIRQGLGFKEEQYGQAVTLAQAALKAFGENVIFTGHSMGGGLASVAALTTGKPAVIFNAAGVSDSTLRSMGLSPEASREVAENGLIRNYIVEHDWLDNLQKTLPIPQPMGNKILLEYEYEPEGILDSIFAYRYAFHSFKAHFMEAVQELLTVHKPWLNKAGEMIAATEDSMQNKAISMQKQALNTWGMNMNEAEISDQLREERHQLVSQQLEKYYSV

SEQ ID NO: 7180 - protein, 57 aa, Xenorhabdus bovienii
  Peptide sequence Name=Xb4151_4152.C430.gene86.pep
LENAALLPVIPNQKRQNQPTINLTGKSGQTARFIISDKQKQWIQPYSLFHLYEYYTE

SEQ ID NO: 7181 - protein, 447 aa, Xenorhabdus bovienii
  Peptide sequence Name=Xb4151_4152.C430.gene87.pep
  Gene classification: Gene name=SrmB; Function=3 Superfamily II DNA and RNA helicases; Function class=L DNA replication, recombination and repair
  Homolog annotation: Query=1..443bp; Hit=1..443bp; Blast score=622; Percent Identity=77.0; E value=1e-178; Homolog= srmB COG0513
MTATNFSEFELDECLLNALNEKGYERPTAIQAEAIPAAMDGRDVLGSAPTGTGKTAAYLLPVLQHLLDFPRKKSGPPRILILTPTRELAMQVAEQAQSFAAHTNLDVATITGGVAYMNHAEVFSENQDIVVATTGRLLQYIKEENFDCRAVETLILDEADRMLDMGFANDVETIAGETRWRKQTLLFSATLEGETIRDFAERLLTDPVEIDAEPSRRERKKIQQFYYRADNLEHKTALLCHLLQQPDVTKSIVFVRKRERVREIVDYLHKAGIQACFLEGEMVQTKRTDAVKRLNDGRVNVMVATDVASRGLDIENISHVFNFDLPRTADVYLHRIGRTARAGRKGTAIALVESHDHPLLGKVTRYLNEPLKVRVVDELRPQTKAPSEKKSYKPSKKVLEKRKEKKKVEEEAKKTRVKVRHRDSKNIGKRRTPSGDPKPETSEPTND

SEQ ID NO: 7182 - protein, 37 aa, Xenorhabdus bovienii
  Peptide sequence Name=Xb4151_4152.C430.gene88.pep
LSQSSYTSIWVADYKQVGRILHPIKISCGQVAFIRGL

SEQ ID NO: 7183 - protein, 246 aa, Xenorhabdus bovienii
  Peptide sequence Name=Xb4151_4152.C430.gene89.pep
  Gene classification: Gene name=SmtA; Function=SAM-dependent methyltransferases; Function class=Q Secondary metabolites biosynthesis, transport and catabolism
  Homolog annotation: Query=10..245bp; Hit=49..284bp; Blast score=254; Percent Identity=52.0; E value=6e-68; Homolog= yfiC COG0500
MGLIHKPAFRCGGFTFKQFFVGHDKCAMKVGTDGVLLGAWAPVGNRKKCLDIGCGSGLVALMIAQRTDDHSVIDAVELDTHAARQAIENVQESPWADRVKVYQQDIHDFTQQNHLQYDLIVSNPPYFEPANACRNEARSQARYTGSLTHRGLLDCAEHLIKPTGLFCVVLPYNIGETFEQMAAERGWFTHHRVNIRDRQDKPLHRLLLAFSRQGQETQVSELTIRVSNGVYSTEFRQLVTDFYLYY

SEQ ID NO: 7184 - protein, 39 aa, Xenorhabdus bovienii
  Peptide sequence Name=Xb4151_4152.C430.gene90.pep
MMPFFPNKHDFEFLFRVKFNFDRNFILQPPVISYLTFYV

SEQ ID NO: 7185 - protein, 210 aa, Xenorhabdus bovienii
  Peptide sequence Name=Xb4151_4152.C430.gene91.pep
  Gene classification: Gene name=RpoE; Function=DNA-directed RNA polymerase specialized sigma subunits, sigma24 homologs; Function class=K Transcription
  Homolog annotation: Query=20..210bp; Hit=1..191bp; Blast score=322; Percent Identity=84.0; E value=2e-88; Homolog= rpoE COG1595
MTGVIKYKCGVLPQESEPRMSEQLTDQMLVERVQKGDQKAFNLLVIKYQHKVASLVARYVPQGDVPDVAQEVFIKTYRALYSFRGDSAFYTWLYRIAVNTAKNYLVAQGRRPPSNDLDANDAENYDASSSLKEISNPENLMLSEELKEVVFRTIESLPDDLRVAITLRELDGLSYEEIAEIMECPVGTVRSRIFRAREAIDNKVKPLIQQ

SEQ ID NO: 7186 - protein, 216 aa, Xenorhabdus bovienii
  Peptide sequence Name=Xb4151_4152.C430.gene92.pep
  Gene classification: Gene name=RseA; Function=Negative regulator of sigma E activity; Function class=T Signal transduction mechanisms
  Homolog annotation: Query=1..195bp; Hit=1..188bp; Blast score=208; Percent Identity=57.0; E value=4e-54; Homolog= ZrseA COG3073
MQREKLFALMDGEALDSEVVRLIAEDTVMQKQWERYHLIRDTLRGDVGDVLHLDIASRVALALEKEPAHINPAAIPESQPKPETWQKMPFWNKIRPWASQMTQVGIAACVSLAVIVGVQQYNSDGSVDVDTQSDTPVFNTLPVMGSASPVGLAAPVDDEALGSDLNMQVRESNKRIDAMLQQYELSRRIYSEQNQRLPPVDNTQPVAAKIQQAPQQ

SEQ ID NO: 7187 - protein, 319 aa, Xenorhabdus bovienii
  Peptide sequence Name=Xb4151_4152.C430.gene93.pep
  Gene classification: Gene name=RseB; Function=Negative regulator of sigma E activity; Function class=T Signal transduction mechanisms
  Homolog annotation: Query=1..315bp; Hit=1..314bp; Blast score=280; Percent Identity=45.0; E value=2e-75; Homolog= rseB COG3026
MKHICFFIFLLAGSLFNPLKASAQQSDTEALLQDMGNAVHTLNYELAFINLGRELLIPLRYRHAIIDGQPIAQIIQMDGSRREIIQRGNQISYYEPGLDSFSLRGNHIVDYFPPIIFADFSRLQKYYRFIDAGSTHVGDHPVYFVRIISKDETRYNYNLLIDAKSHLPLLIDLLDKDHNIVIEQFRVVSSTVNDSIKKDLIAIVDLKLPPMLAISPSEKVKFDWQVEKIPEGFKEISRNRLKLSETESLESIMYSDGLFQFSVNVTHADKGTVNKQPFRQGRRTVYTLVRGKNTIAIVGELPFATAKQIVASVTFTGDH

SEQ ID NO: 7188 - protein, 154 aa, Xenorhabdus bovienii
  Peptide sequence Name=Xb4151_4152.C430.gene94.pep
  Gene classification: Gene name=RseC; Function=Positive regulator of sigma E activity; Function class=T Signal transduction mechanisms
  Homolog annotation: Query=1..149bp; Hit=1..149bp; Blast score=140; Percent Identity=45.0; E value=6e-34; Homolog= ZrseC COG3086
MVKEWATVVRWQKGRALLRYGSSSGCGSCQANAVCGSYLLEKLGPENIHQLELEIYQPLQPGQKVEVGIPESSLLRSAMLVYLTPLLGLFLGGGLFQYWVTDQLWVVMGGVIGGVTGFFFARKIAKYWDDQQVYQPVVLQIGLPPDTIKVLQQE

SEQ ID NO: 7189 - protein, 52 aa, Xenorhabdus bovienii
  Peptide sequence Name=Xb4151_4152.C430.gene95.pep
MEKFLICFIIKLFCLNISESFAYGHTDGHKATVYRFGHRPKRRILHAKPVKT

SEQ ID NO: 7190 - protein, 598 aa, Xenorhabdus bovienii
  Peptide sequence Name=Xb4151_4152.C430.gene96.pep
  Gene classification: Gene name=LepA; Function=Membrane GTPase LepA; Function class=N Cell motility and secretion
  Homolog annotation: Query=1..598bp; Hit=1..598bp; Blast score=1070; Percent Identity=90.0; E value=0; Homolog= lepA COG0481
MKQIRNFSIIAHIDHGKSTLSDRIIQICGGLSDREMAAQVLDSMDLERERGITIKAQSVTLDYQSIDGQVYQLNFIDTPGHVDFSYEVSRSLAACEGALLVVDAGQGVEAQTLANCYTAIEMDLQVVPVLNKIDLPAAEPERVAEEIEDIVGIDATDAVRCSAKTGVGVQDVIERLVKEIPSPEGDSDAPLQALIIDSWFDNYLGVVSLVRVKNGVLRKGDKIKVMSTGQVYNADRLGIFTPKRIDRDILNCGEVGWLVCAIKDILGAPVGDTLTTARQPADKALPGFQKVKPQVYAGLFPISSEDYEAFRDALGKLSLNDASLFYEPESSTALGFGFRCGFLGLLHMEIIQERLEREYDLDLITTAPTVVYEVETVSDDIIYVDSPSKLPPLNNIKELREPVAECNMLLPQEYLGNVITLCVEKRGVQTNMVYHGNQVALTYEIPMAEVVLDFFDRLKSTSRGYASLDYNFIRFQHSDMVRVDVLINGERVDALALITHRENSQYRGRELVDKMKELIPRQQFDIAIQAAIGAHIIARATVKQLRKNVLAKCYGGDVSRKKKLLQKQKDGKKRMKQVGNVELPQEAFLAILHVGKDN

SEQ ID NO: 7191 - protein, 322 aa, Xenorhabdus bovienii
  Peptide sequence Name=Xb4151_4152.C430.gene97.pep
  Gene classification: Gene name=LepB; Function=Signal peptidase I; Function class=N Cell motility and secretion
  Homolog annotation: Query=1..322bp; Hit=1..324bp; Blast score=398; Percent Identity=61.0; E value=1e-111; Homolog= ZlepB COG0681
MANTFALILTLATLITGIIWCIDRFKFAPERRKKLAQIQEQTAGAESQEALATEINKPSWVETFASVFPVLAIVLLLRSFVYEPFQIPSGSMMPTLLIGDFILVEKFAYGLKDPITQTTLIKTGKPKRGDIAVFKYPVNPSLDFVKRVIGLPGDKIVYDDINKELQVFPGCGWNTVCKNLPVTYRDMFPSEWTIKEDITPEGARVRGVYPIPIEEQLGSNSIRQGERVEHLGNVSHHILIVPGASNIPFFSQPGLPLGTWVVPEGHYFMMGDNRDNSSDSRIWGFVPEKNLVGRATAIWISFEKQEGEWPTGVRLSRIGRIH

SEQ ID NO: 7192 - protein, 35 aa, Xenorhabdus bovienii
  Peptide sequence Name=Xb4151_4152.C430.gene98.pep
MEFMCYQFSQNSSKKHTQQTCGDRSYKTVAFALAS

SEQ ID NO: 7193 - protein, 226 aa, Xenorhabdus bovienii
  Peptide sequence Name=Xb4151_4152.C430.gene99.pep
  Gene classification: Gene name=Rnc; Function=dsRNA-specific ribonuclease; Function class=K Transcription
  Homolog annotation: Query=1..226bp; Hit=1..226bp; Blast score=374; Percent Identity=87.0; E value=1e-104; Homolog= rnc COG0571
MNSIIINRLQRKLGYTFIQHDLLLQALTHRSANSKHNERLEFLGDSILSFVIANALYHRFPRVDEGDMSRMRATLVRGNTLAELAREFELGECLRLGPGELKSGGHRRESILADSIEALIGAIFLDSDIQTIERIILSWYETRLNEISPGDKQKDPKTRLQEYLQGRHLPLPSYLVVQVRGEAHDQEFTIHCQISGFEQPVRGVGSSRRKAEQAAAEQALKQLELE

SEQ ID NO: 7194 - protein, 301 aa, Xenorhabdus bovienii
  Peptide sequence Name=Xb4151_4152.C430.gene100.pep
  Gene classification: Gene name=Era; Function=GTPases; Function class =R General function prediction only
  Homolog annotation: Query=1..301bp; Hit=1..301bp; Blast score=515; Percent Identity=84.0; E value=1e-146; Homolog= era COG1159
MSEEKNYCGFVAIVGRPNVGKSTLLNQLLGQKISITSRKPQTTRHRIMGIHTEGVYQAIYVDTPGLHIEEKRAINRLMNRAASSSIGDVELVIFVVEGTHWTADDEMVVNKLRNLHCPVILAINKVDNVTDKAILLPHIGFLSKQMNFLDVVPISAEKGMNVDTIAKIVRAHIPEAGHHFPDDYITDRSQRFMASEIIREKLMRFLGDELPYSVTVEIEQFVTNERGGYTIHGLILVEREGQKKMVIGNKGSKIKTIGIEARQDMEKLFDNKVHLELWVKVKAGWADDERALRSLGYIDDL

SEQ ID NO: 7195 - protein, 245 aa, Xenorhabdus bovienii
  Peptide sequence Name=Xb4151_4152.C430.gene101.pep
  Gene classification: Gene name=RecO; Function=Recombinational DNA repair protein (RecF pathway); Function class=L DNA replication, recombination and repair
  Homolog annotation: Query=1..236bp; Hit=1..236bp; Blast score=331; Percent Identity=71.0; E value=3e-91; Homolog= recO COG1381
VDGWQRAFVLHGRPYSETSLLLDFFTENEGRVRVLAKGVRRRRSHLKGCLQPFTPLLVRWSGRGEIKILRDAEPISLALPLTGSVLYSGLYVNELLSRVLEQGAAYPALFFDYLQCLQILAASEYTPEYALRRFELALLTNMGYGVDYLHCAGSGEPVSDTMNYRYREEKGFIASLVVDHFSFTGNELKALATGEFTDSLTLKAAKRFTRIALKPYLGGKPLKSRELFRQFVRKKTDIPNKKNEN

SEQ ID NO: 7196 - protein, 250 aa, Xenorhabdus bovienii
  Peptide sequence Name=Xb4151_4152.C430.gene102.pep
  Gene classification: Gene name=PdxJ; Function=Pyridoxal phosphate biosynthesis protein; Function class=H Coenzyme metabolism
  Homolog annotation: Query=8..249bp; Hit=1..242bp; Blast score=340; Percent Identity=75.0; E value=1e-93; Homolog= pdxJ COG0854
MLLQELKMAEVLLGINIDHIATVRNARGTQYPDPVQAAFVAEQAGADGITVHLREDRRHITDRDVQLLAKTIQTRMNLEMAVTDEMIDIACQIKPVFCCLVPEKRQEVTTEGGLDVLGQKVHIAAAVKRLSEAGIFVSLFIDADHQQIAAAAEVGAPFIEIHTGAYADAENDIQQEQEFLRIKEAVTYAAGKGIKVNAGHGLTYHNVQRIAALPEIYELNIGHAIIGRAVFSGLSAAVADMKTLLREARS

SEQ ID NO: 7197 - protein, 31 aa, Xenorhabdus bovienii
  Peptide sequence Name=Xb4151_4152.C430.gene103.pep
MAIVGLGTDIVEIFRIKKIVERSGERLANVF

SEQ ID NO: 7198 - protein, 93 aa, Xenorhabdus bovienii
  Peptide sequence Name=Xb4151_4152.C430.gene104.pep
MKLTQNAVLNASDTMKNQPASPSARSPILLSLTLTIRKVKSNCGISSCSYITQIRYKINFPISPSHRHNAVHPAGILHSVCQPEFLLYYEVLM

SEQ ID NO: 7199 - protein, 36 aa, Xenorhabdus bovienii
  Peptide sequence Name=Xb4151_4152.C430.gene105.pep
MCCGFVLRYTVFQCKPYCIKTQEPDKRNEYGSDLII

SEQ ID NO: 7200 - protein, 53 aa, Xenorhabdus bovienii
  Peptide sequence Name=Xb4151_4152.C430.gene106.pep
MCELLYQRNDITEFLMKNAVTHLPKSHQNDEYLSALASWESCKPLYCQQQISA

SEQ ID NO: 7201 - protein, 78 aa, Xenorhabdus bovienii
  Peptide sequence Name=Xb4151_4152.C430.gene107.pep
  Homolog annotation: Query=1..78bp; Hit=57..135bp; Blast score=87; Percent Identity=51.0; E value=4e-17; Homolog= gi|11877306|emb|CAC19020.1| putative protein L [Neisseria meningitidis phage 2120]
LGAVVTRHQVPEIYLDAVNFPNGNPQADPTREAVSKYLIEQKQDSNADFVTYVLALPSETDGALIPARVIQADICCWQ

SEQ ID NO: 7202 - protein, 30 aa, Xenorhabdus bovienii
  Peptide sequence Name=Xb4151_4152.C430.gene108.pep
MPVLAFENLSCSPSHFMPCYLRFRYYVILI

SEQ ID NO: 7203 - protein, 107 aa, Xenorhabdus bovienii
  Peptide sequence Name=Xb4151_4152.C430.gene109.pep
  Homolog annotation: Query=1..105bp; Hit=1..105bp; Blast score=91; Percent Identity=44.0; E value=3e-18; Homolog= gi|30249526|ref|NP _841596.1| putative transposase [Nitrosomonas europaea ATCC 19718] gi|30138889|emb|CAD85468.1| putative trans
MGYSLDFRKRVLAYKDKHSLTFEQTSAHFEISMRTLFRWCNKIEPCMTRDKPATKIPDEVLIADVQNFPDDYQWERAKRLSVSQSAIHYALKRLNITPKKNAPTPSR

SEQ ID NO: 7204 - protein, 107 aa, Xenorhabdus bovienii
  Peptide sequence Name=Xb4151_4152.C430.gene110.pep
MGKSKTFKCFTIGYSLRLETAEYHPEKKRSNPLALILKLVRHLSSTSAMMNRLADPLFIWMKVVLLNRCHVNRDIRKKGYAVLVRMTGTQKAVSTSLAPFSKRPSSP

SEQ ID NO: 7205 - protein, 75 aa, Xenorhabdus bovienii
  Peptide sequence Name=Xb4151_4152.C430.gene111.pep
  Homolog annotation: Query=1..70bp; Hit=60..129bp; Blast score=86; Percent Identity=55.0; E value=9e-17; Homolog= gi|30249527|ref|NP _841597.1| putative transposase [Nitrosomonas europaea ATCC 19718] gi|30138890|emb|CAD85469.1| putative trans
LLPKLPHGAVIVMDNAPFHKRNDTTQAIADSRCQLEWLPAYSPDLNPIKHKWGGAKAIRRQKRCSVDELFTEHIE

SEQ ID NO: 7206 - protein, 59 aa, Xenorhabdus bovienii
  Peptide sequence Name=Xb4151_4152.C430.gene112.pep
MSCLRSILNRSGYVNSAISQRPKAVTAPPNFPHEQYCEIAPRTIQNPLVVHHCLRLNGF

SEQ ID NO: 7207 - protein, 38 aa, Xenorhabdus bovienii
  Peptide sequence Name=Xb4151_4152.C430.gene113.pep
MNHHSVSESLYNYLNNNSTTTDFSRWLWSLAANERGEE

SEQ ID NO: 7208 - protein, 78 aa, Xenorhabdus bovienii
  Peptide sequence Name=Xb4151_4152.C430.gene114.pep
  Homolog annotation: Query=1..78bp; Hit=411..510bp; Blast score=121; Percent Identity=65.0; E value=3e-27; Homolog= gi|37524153|ref|NP _927497.1| Transposase, IS4 family [Photorhabdus luminescens subsp. laumondii TTO1] gi|36783576|emb|CAE1242
MATLLANYKAQQKPDRIEALLMVMTCCLMVYAALEHKIRRELKKSVPFFPDMRNKRTQSPAAREVFLIIEGINSFEFQ

SEQ ID NO: 7209 - protein, 140 aa, Xenorhabdus bovienii
  Peptide sequence Name=Xb4151_4152.C430.gene115.pep
  Gene classification: Gene name=RimI; Function=Acetyltransferases; Function class=R General function prediction only
  Homolog annotation: Query=1..140bp; Hit=38..175bp; Blast score=197; Percent Identity=69.0; E value=4e-51; Homolog= Z3699 COG0456
MEIRVFRQNDFEAVTTLWERCDLINPGDDPEVDIERKLTHDADLFLVAEVAGEVVGTVMGGYDGHRGHAYYLSVHPEFRGRGIANALISRLEKKLLARGCPSILILVSEENDATICMCEKMEYDYLGQENTIFSKRLIID

SEQ ID NO: 7210 - protein, 140 aa, Xenorhabdus bovienii
  Peptide sequence Name=Xb4151_4152.C430.gene116.pep
MNEKVIIAVFIISLSVSVMARASDQKSVLPSNIHDKLNHITNQEKHQEKTTIFQERKFHIQSPCSFIILEGKSESPIHDHYQLYRNNEGKIQVRIVSSIGDNIPIASKKLFILQNKHQIFLSHLIIKIINLVLYNSIMAE

SEQ ID NO: 7211 - protein, 47 aa, Xenorhabdus bovienii
  Peptide sequence Name=Xb4151_4152.C430.gene117.pep
MKVMLSVIVSIYHQCCIVLVFFAFLLMKFFVFTNECFFKSVFCITRQ

SEQ ID NO: 7212 - protein, 206 aa, Xenorhabdus bovienii
  Peptide sequence Name=Xb4151_4152.C430.gene118.pep
  Homolog annotation: Query=1..205bp; Hit=1..201bp; Blast score=245; Percent Identity=56.0; E value=3e-64; Homolog= gi|37525342|ref|NP _928686.1| hypothetical protein [Photorhabdus luminescens subsp. laumondii TTO1] gi|36784769|emb|CAE13679.1|
MGKFFVFNLLSKQRVVAVSSLLGSSLLLSACAGIPEFSWSSLSPWEWFGSALRVSEQGVGEVNKQTDMDQSAIEQGLKGKYRLRSGMETQNGKFVSIIQGMEGDQVKIELSGLAKGKVNRIDVLDDRVKTVWGTRIGTPFSELYGKAFGVCHRSSDFIMQPTVICIAPQSQHISYVFTGQWDGPEGLMPSDDALKNWKISRIIWKS

SEQ ID NO: 7213 - protein, 67 aa, Xenorhabdus bovienii
  Peptide sequence Name=Xb4151_4152.C430.gene119.pep
LALYALIRPKNAKATNPPNNLLFIATIFIQHLTRHAYSTTISSYCIQNIYNRVVYYPLFYIPSFYEK

SEQ ID NO: 7214 - protein, 345 aa, Xenorhabdus bovienii
  Peptide sequence Name=Xb4151_4152.C430.gene120.pep
  Gene classification: Gene name=Sbp; Function=ABC-type sulfate transport system, periplasmic component; Function class=P Inorganic ion transport and metabolism
  Homolog annotation: Query=27..343bp; Hit=20..336bp; Blast score=461; Percent Identity=70.0; E value=1e-130; Homolog= ZcysP COG1613
MKIVAINNKLLGGLVALAFLGLINAYSANAYAVGLLNSSYDISRELFSTLNPQFEKQWNAQHPQDKLIIKQSHAGSSKQALSILQGLRADVVTYNQVTDVQILHDRGNLIPADWQQRLPNNSSPYYSTMAFLVRKGNPKQIHTWDDLVRHDVKLVFPNPKTSGNGRYTYLAAWGAFQQQNEHDPVKVRQLMRRLLQNVVVFDTGGRGATTSFIERSLGDVLISFESEVNNIRKQYGTDNYEVIVPPVDILAEFPVTWIDKNVRRNGTEAVAKAYLNYLYSPAAQQIIASFNYRVNDKNVMKAQKPRFPETRLFRLEEQFGNWPLVMKTHFNTGGMLDQLLAEGHK

SEQ ID NO: 7215 - protein, 278 aa, Xenorhabdus bovienii
  Peptide sequence Name=Xb4151_4152.C430.gene121.pep
  Gene classification: Gene name=CysU; Function=ABC-type sulfate/molybdate transport systems, permease components; Function class=P Inorganic ion transport and metabolism
  Homolog annotation: Query=2..278bp; Hit=1..277bp; Blast score=352; Percent Identity=80.0; E value=3e-97; Homolog= ZcysU COG0555
MMLVASGKRVLPGFGLSLGSSLFYTCLILLLPLSALAIQLSSMTWTQYWQVIVNPQVVAAYQVTLLAAAAASFFNMVFGMLMAWILTRYHFPGRSLLDGLMDLPFALPTAVAGLTLATLFSATGWYGAWLGNFDIKVVNTWLGIAVAMAFTSLPFVVRTVQPVLEELGPEYEEAAQTLGASRWQTFRRVILPEVSPALMAGTVLSFTRSLGEFGAVIFIAGNIAWQTEVVSLMIFVRLQEFDYPAASAIASVILAASLLLLFSVNILQSRFGKRIGGH

SEQ ID NO: 7216 - protein, 279 aa, Xenorhabdus bovienii
  Peptide sequence Name=Xb4151_4152.C430.gene122.pep
  Gene classification: Gene name=CysU; Function=ABC-type sulfate/molybdate transport systems, permease components; Function class=P Inorganic ion transport and metabolism
  Homolog annotation: Query=1..279bp; Hit=4..279bp; Blast score=384; Percent Identity=77.0; E value=1e-107; Homolog= cysWm COG0555
MTELSAYTVAQRSPINWGKWVLIGTGILVSTLLLVIPIMWIFLTAFSKGFDLVKQNLLDPDMLHAIWLTVMIALITVPINLIFGVMTAWLVTRFQFPGRQLLLTLIDIPFAVSPVVAGLLYLLFYGVNGWMGGWLGSYDMQLMFSWPGMVLVTVFVTCPFVVRELVPVMLSQGSQEDEAAILLGASGWKMFWRVTLPNIRWALLYGIVLTNARAIGEFGAVSVVSGAIRGETYTLPLQVELLYQDYNTVGAFTAAALLAVMAIITLMVKSAVQWRLSHQ

SEQ ID NO: 7217 - protein, 362 aa, Xenorhabdus bovienii
  Peptide sequence Name=Xb4151_4152.C430.gene123.pep
  Gene classification: Gene name=CysA; Function=ABC-type sulfate/molybdate transport systems, ATPase component; Function class=P Inorganic ion transport and metabolism
  Homolog annotation: Query=1..362bp; Hit=1..365bp; Blast score=492; Percent Identity=68.0; E value=1e-139; Homolog= cysA COG1118
MSIEISKISKSFGRVQILSEISLGIESGEMVALLGPSGSGKTTLLRIIAGLEQQSAGQLKFNGQDVSRVHAKDRRVGFVFQHYALFRHMNVFDNVAFGLTVLPRRQRLSGEALRSKVMVLLDMVQLSHLADRYPSQLSGGQKQRVALARALAVEPQILLLDEPFGALDAQVRMELRRWLRQLHEELKFTSVFVTHDQEEAMEVADRVVVMNQGCIEQVGTPQQVWREPESRFVLEFMGEVNQLHGEIKGSQLWVGGKIFPLNVTPLHQGNVDVFLRPWEMTLSTQQTASCPLPVQIVEISPRGHFSLLSVLPVGWGKDLLSVIWQGDSPVPVRGNQYFMGGTGARLYAGDLPLKVLRLAESA

SEQ ID NO: 7218 - protein, 42 aa, Xenorhabdus bovienii
  Peptide sequence Name=Xb4151_4152.C430.gene124.pep
VSRCNLTSGVLPIKSSKLATALPNSYESGQQNNHIQKTVARS

SEQ ID NO: 7219 - protein, 293 aa, Xenorhabdus bovienii
  Peptide sequence Name=Xb4151_4152.C430.gene125.pep
  Gene classification: Gene name=CysK; Function=Cysteine synthase; Function class=E Amino acid transport and metabolism
  Homolog annotation: Query=1..292bp; Hit=1..292bp; Blast score=430; Percent Identity=73.0; E value=1e-121; Homolog= cysM COG0031
VASLEDFIGNTPLVKLQRLTESVDAEIWVKLEGNNPAGSVKDRAAFSMIQQAELRGEIAPGDVLIEATSGNTGIALAMIAAVKNYKLKLLMPENMSLERQASMRAYGAELILVSKESGMEGARDLAQKMEQEGEGKVLDQFNNMDNALAHFNTTGPEIWQQTQGRITHFVSSMGTTGTITGVSRYLKSQSDKVHTTGLQPAENSQIPGIRRWSPAYMPGIYKKELVDQLLDITQMEAETTMRLLAQKEGIFCGVSSGGAVSGALRIAAKNPGAVIVAIVCDRGDRYLSTGVFN

SEQ ID NO: 7220 - protein, 33 aa, Xenorhabdus bovienii
  Peptide sequence Name=Xb4151_4152.C430.gene126.pep
LSVIVVTGICLLGYLIKRLSPLGICYLALNVAF

SEQ ID NO: 7221 - protein, 37 aa, Xenorhabdus bovienii
  Peptide sequence Name=Xb4151_4152.C430.gene127.pep
LINRPCIIRHFTGLSLIIQGRFFCGLLLSQKATFNAK

SEQ ID NO: 7222 - protein, 34 aa, Xenorhabdus bovienii
  Peptide sequence Name=Xb4151_4152.C430.gene128.pep
VNLSSCVSKDNRKIIGNTFSALFLFTDPSYFSDG

SEQ ID NO: 7223 - protein, 169 aa, Xenorhabdus bovienii
  Peptide sequence Name=Xb4151_4152.C430.gene129.pep
  Gene classification: Gene name=NagE; Function=Phosphotransferase system IIA components; Function class=G Carbohydrate transport and metabolism
  Homolog annotation: Query=1..169bp; Hit=1..169bp; Blast score=258; Percent Identity=86.0; E value=2e-69; Homolog= crr COG2190
MGLLDKLKSLVSDDKKNSGSIEIIAPLSGEIVNIEDVPDVVFAEKIVGDGIAIKPAGNKIVAPVDGTIGKIFETNHAFSIESDSGVELFVHFGIDTVELKGAGFKRIAEEGQRVQKGDLVLEFDLAFLEERAKSTLTPVVISNMDEIKELSKVSGSVVVGESVIMRIKR

SEQ ID NO: 7224 - protein, 575 aa, Xenorhabdus bovienii
  Peptide sequence Name=Xb4151_4152.C430.gene130.pep
  Gene classification: Gene name=PtsA; Function=Phosphoenolpyruvate -protein kinase (PTS system EI component in bacteria); Function class= G Carbohydrate transport and metabolism
  Homolog annotation: Query=1..575bp; Hit=1..575bp; Blast score=853; Percent Identity=79.0; E value=0; Homolog= ZptsI COG1080
MISGILVSPGIAFGKALLLKEDPIIINQKKITTEQTEQEISRFKQGRDKSSVQLEIIRKTAEKNLGAEKAEIFEGHIMLLEDEELEQEIVTLIKKNLATADAAVYSVIEDQAKALEELDDEYLKERAADVRDIGKRLLKNILGMPIIDLGTIEEEAILIANDLTPSETAQLNLDKVLGFITDLGGRTSHTSIMARSLELPAIVGTTNATTQIKNGSYLILDAVNNQIYVNPSNAEIDQLKKAKHEYLSEKTELAKLKDLPAITLDGHQVEVCANIGTVRDVMGAERNGAEGVGLYRTEFLFMDRDTLPTEDEQFEAYKAVAEAVGNQAIIIRTMDIGGDKDLPYMNLPKEENPFLGWRAIRICLDRKEILHSQLRAILRASAFGKLRIMFPMIISVEEIRELKAELALLKNQLRDEDKAFDESIEVGIMVETPAAATIAHHLAKEVDFFSIGTNDLTQYTLAVDRGNELISHLYNPMSPAVLSLIKQVIDASHAEGKWTGMCGELAGDERAALLLLGMGLDEFSMSAISIPRIKKIIRNANYDDAKALAEQALSQPTAKELMDLVDTFTREKTLC

SEQ ID NO: 7225 - protein, 58 aa, Xenorhabdus bovienii
  Peptide sequence Name=Xb4151_4152.C430.gene131.pep
MGSSFSNNALPKAMPGDTKMPEIILYDLTAGDYLPLSLQGGGYKYPQILFIWGWNSVK

SEQ ID NO: 7226 - protein, 85 aa, Xenorhabdus bovienii
  Peptide sequence Name=Xb4151_4152.C430.gene132.pep
  Gene classification: Gene name=FruB; Function=Phosphotransferase system, HPr-related proteins; Function class=G Carbohydrate transport and metabolism
  Homolog annotation: Query=1..85bp; Hit=1..85bp; Blast score=127; Percent Identity=91.0; E value=2e-30; Homolog= ptsH COG1925
MFQQEVTITAPNGLHTRPAAQFVKEAKGFSSDITLTSGGKSASAKSLFKLQTLGLTQGTAVTISAEGEDEQHAVEHLVKLMGELE

SEQ ID NO: 7227 - protein, 47 aa, Xenorhabdus bovienii
  Peptide sequence Name=Xb4151_4152.C430.gene133.pep
VFINIKSTIECIEYVNFLIMPKYTLFHYQFNGCTSQNGFSYTSFRIF

SEQ ID NO: 7228 - protein, 56 aa, Xenorhabdus bovienii
  Peptide sequence Name=Xb4151_4152.C430.gene134.pep
VYLGIIKKLTYSMHSIVDFMLINTIRVFVELDGAFHSGSAINFVHQNNYWLNTKAT

SEQ ID NO: 7229 - protein, 35 aa, Xenorhabdus bovienii
  Peptide sequence Name=Xb4151_4152.C430.gene135.pep
LNKSSRKVLNFDLMHKKAPLRCFFVNEIAKTQSDF

SEQ ID NO: 7230 - protein, 317 aa, Xenorhabdus bovienii
  Peptide sequence Name=Xb4151_4152.C430.gene136.pep
  Gene classification: Gene name=CysK; Function=Cysteine synthase; Function class=E Amino acid transport and metabolism
  Homolog annotation: Query=1..314bp; Hit=1..315bp; Blast score=464; Percent Identity=79.0; E value=1e-131; Homolog= cysK COG0031
MSKIYEDNSLTIGHTPLVRLKHFGNGRILAKIESRNPSFSVKCRIGANMIWDAEKRGILTKDKELIEPTSGNTGIALAYVAAARGYKLTLTMPETMSLERRKLLKALGASLVLTEGAKGMKGAIDKADEIRDSDPDHYILLQQFSNPANPEIHEKTTGPEIWEATDGNIGAFVAGVGTGGTITGVARYLKNTQAAQVTIVAVEPEDSPVISQKLAGEELKPGPHKIQGIGAGFIPDNLDLTLVDRVFKVSNEEAIKIAREVTEKEGILAGISSGAAVAAAVRLSQEDEYKDKNIVVILPSSAERYLSTALFADLAND

SEQ ID NO: 7231 - protein, 258 aa, Xenorhabdus bovienii
  Peptide sequence Name=Xb4151_4152.C430.gene137.pep
  Gene classification: Gene name=CysZ; Function=Uncharacterized protein involved in cysteine biosynthesis; Function class=E Amino acid transport and metabolism
  Homolog annotation: Query=1..252bp; Hit=2..251bp; Blast score=318; Percent Identity=66.0; E value=5e-87; Homolog= cysZ COG2981
MTNSTKLPKHLSGFHYIVQGWHLITRSGIKRFVLLPLLANILLLGGSFWWLYHKLDGWILWALDKIPDWMQWLSYLLWPLAVVSILLIFTYFFSILANFIASPFNGLLAEKLEAELTGIPAPDTGMVDLIKDTPRILKREIVKILYYIPRALVLLLLYFIPGIGQTVAPVLWLIFSAWMLTIQYCDYPFDNHKISFSTMRSTLRQNKIDNLQFGAAVSVLTMIPVVNLFIMPVAVCGATAMWVDRYRAQHALHHNPSH

SEQ ID NO: 7232 - protein, 101 aa, Xenorhabdus bovienii
  Peptide sequence Name=Xb4151_4152.C430.gene138.pep
VTNALCGWSTTHVIAKLLWLSHQQRLISDANPASLLSLLFKLIATTAEYSLDKSICQIAQVQVSTYFSYHKGDIPCFFGYFLRTKLLVSRKSCLYHTVSII

SEQ ID NO: 7233 - protein, 308 aa, Xenorhabdus bovienii
  Peptide sequence Name=Xb4151_4152.C430.gene139.pep
  Gene classification: Gene name=ZipA; Function=Cell division protein; Function class=D Cell division and chromosome partitioning
  Homolog annotation: Query=1..306bp; Hit=2..326bp; Blast score=223; Percent Identity=46.0; E value=2e-58; Homolog= zipA COG3115
MQDLRLILIVVGAIAIIALLLHGLWTSRKERSSLFRDRPVKRHKQERQEELDDNDGDKLFDNSSKSHVQESVKPRNEHREEPVIKRSVPELSAEAPDEAFDPLLSNQQSEASAAKVKTAEEYQEEPQLGLFESTEQSAEAAESVVNTAVVEEQLNVLENEAVGEVEQVKKETVLVLHVSAHHGQELDGEALLQSILQSGFRFGDMNIFHRHLNPAGSGAVLFSLANMVKPGSFNPELMDDFSTPGVSMFMLVPSYGDANQNFKLMLQAAQRIASDVGGVVLDGERKMLTPQMIEHYKARIRNTLNACE

SEQ ID NO: 7234 - protein, 672 aa, Xenorhabdus bovienii
  Peptide sequence Name=Xb4151_4152.C430.gene140.pep
  Gene classification: Gene name=Lig; Function=NAD-dependent DNA ligase (contains BRCT domain type II); Function class=L DNA replication, recombination and repair
  Homolog annotation: Query=1..671bp; Hit=1..670bp; Blast score=1023; Percent Identity=75.0; E value=0; Homolog= lig COG0272
MESIIEKINKLRATLRHHEYLYHVMDAPEIPDAEYDRLLRELKVLEEQHPELITADSPTQRVGAAPLTAFGQVRHEIPMLSLDNVFDEESYLAFDKRVRDRLKDSRDLVFCCELKLDGLAVSLLYEDGELVQAATRGDGTTGENITVNVRTIHAIPLRLKGNNIPARVEIRGEVFMKQGGFEKLNDEARRKGNKVFANPRNAAAGSLRQLDPRITAKRPLTFYCYGVGVLEGGELPASHYERLMQFKQWGLPVSDNVKLCQGTQQVIDFYHNIEQQRPILGFDIDGIVIKVDSLELQETLGFVAKAPRWATAFKFAAQEQMTIVRDVEFQVGRTGAITPVARLKPVQVAGVIVSNATLHNADEIERLGLRIGDTVVIRRAGDVIPKVVGVVQDKRPAESQEVIFPEYCPVCRSDIERVEGESVARCTGGLFCGAQRKEALKHFVSRRAMDVDGMGEKIIEQLVDKEYVKTPADLFRLSAGKLTGLERMGPKSAQNTIDALEKSKKTTFARFIYSLGIREVGEATAANLVAHFVTLEKLRAADTEALIAVQDVGGVVASHVVNFFNEPHNQTVIDDLIDNIGIYWESVETLQSDTVGNSFAGKTVVLTGSLNRLSRDEAKDKLTALGAKVTGSVSKKTDLVIAGEAAGSKLAKATELGIEVIDEEEMLRLLGE

SEQ ID NO: 7235 - protein, 84 aa, Xenorhabdus bovienii
  Peptide sequence Name=Xb4151_4152.C430.gene141.pep
VNYCDNNNSLLCGNKFPFSKLVHTLVRNVLAGYAKRNIKYRVLSRSILSSPPYFYLINHFYPLHLSSHPLYWLQLEIYWVYLFT

SEQ ID NO: 7236 - protein, 39 aa, Xenorhabdus bovienii
  Peptide sequence Name=Xb4151_4152.C430.gene142.pep
MRYIKCNYKFVLRHVWDSLYVSYKYYQLSFVRLVLCCPK

SEQ ID NO: 7237 - protein, 76 aa, Xenorhabdus bovienii
  Peptide sequence Name=Xb4151_4152.C430.gene143.pep
  Gene classification: Gene name=NupC; Function=Nucleoside permease; Function class=F Nucleotide transport and metabolism
  Homolog annotation: Query=1..76bp; Hit=131..219bp; Blast score=89; Percent Identity=69.0; E value=9e-19; Homolog= ZnupC COG1972
MGKLESFNAVGSLILGQSENFVAYKNVLDRMSECRMYTMAAAMSTVSMFIVVAALVLNMFSSFIVLSLINPYSVES

SEQ ID NO: 7238 - protein, 92 aa, Xenorhabdus bovienii
  Peptide sequence Name=Xb4151_4152.C430.gene144.pep
  Gene classification: Function=Uncharacterized BCR; Function class=S Function unknown
  Homolog annotation: Query=21..89bp; Hit=1..69bp; Blast score=102; Percent Identity=79.0; E value=9e-23; Homolog= Z3676 COG3530
MNNLHEWQSLIRIQIKKADMMNKENLLEIANTAMPFGKYKGRMLIDLPEEYLLWFARKGEFPQGKLGALMEITLAIKIEGLDSLVKPLKNRD

SEQ ID NO: 7239 - protein, 66 aa, Xenorhabdus bovienii
  Peptide sequence Name=Xb4151_4152.C430.gene145.pep
VTKTLFVSGICPSQTYSTITYRAKHTRDRHIRKIPENLRLQGFRILVELSGIEPLTSCMPCKRSPS

SEQ ID NO: 7240 - protein, 55 aa, Xenorhabdus bovienii
  Peptide sequence Name=Xb4151_4152.C430.gene146.pep
MQALSQLSYSPTNVVQVLNSKYRLSFFITKKDKYLVELSGIEPLTSCMPCKRSPS

SEQ ID NO: 7241 - protein, 54 aa, Xenorhabdus bovienii
  Peptide sequence Name=Xb4151_4152.C430.gene147.pep
MTQNSKGTQLIAVPLLLLSQANIDDFFSAYTENINESIDRILWVSYYAPRSTGF

SEQ ID NO: 7242 - protein, 464 aa, Xenorhabdus bovienii
  Peptide sequence Name=Xb4151_4152.C430.gene148.pep
  Gene classification: Gene name=GlnS; Function=Glutamyl- and glutaminyl-tRNA synthetases; Function class=J Translation, ribosomal structure and biogenesis
  Homolog annotation: Query=10..464bp; Hit=16..470bp; Blast score=798; Percent Identity=82.0; E value=0; Homolog= ZgltX COG0008
VCTKSYWLSHVGGARTALYSWLYSRHNKGEFVLRIEDTDLERSTQEAIDAIMDGMNWLNLNWDEGPYYQTKRFDRYNHVIDEMLEQGTAYRCYCSKEHLEQLRETQMANGEKPRYDGCCRDSECQHSHDEPHVVRFRNPQEGSVIFNDSIRGPIEFSNQELDDLIIRRTDGAPTYNFCVVIDDWDMEITHVVRGEDHINNTPRQINILKALGAPVPEYAHVSMILGDDGKKLSKRHGAVSVMQYRDDGYLPEALLNYLVRLGWSHGDQEIFSVEEMVNLFSLDAISKSASAFNTEKLQWLNHHYINTLPAEQVAVHLAWHIEQQGIDTRTGPELVALIKLLGERCKTLKEMAGSCRYFYEEFAEFDADAAKKHLRPVARQPLEVARAKLAAVTEWTPENIHHAIQATADELEVGMGKVGMPLRVAVTGAGQSPSVDVTIHAINQARSLSRIDKALAYITQREVQ

SEQ ID NO: 7243 - protein, 65 aa, Xenorhabdus bovienii
  Peptide sequence Name=Xb4151_4152.C431.gene1.pep
MPADYHLCLTEESRSVAVCRSDYPDREEGEVRQFLTERGMSLSETPADQFGSSIAGCVMVGRSGS

SEQ ID NO: 7244 - protein, 62 aa, Xenorhabdus bovienii
  Peptide sequence Name=Xb4151_4152.C431.gene2.pep
  Gene classification: Gene name=TorD; Function=Uncharacterized component of anaerobic dehydrogenases; Function class=R General function prediction only
  Homolog annotation: Query=1..62bp; Hit=120..181bp; Blast score=80; Percent Identity=64.0; E value=4e-16; Homolog= ycdY COG3381
LEDQAAEDEVQAQIMLFDEYLLPWCGQFLGKVEAHATSGFYRTLAIVTREALQALRDELESE

SEQ ID NO: 7245 - protein, 187 aa, Xenorhabdus bovienii
  Peptide sequence Name=Xb4151_4152.C431.gene3.pep
  Homolog annotation: Query=1..187bp; Hit=1..187bp; Blast score=226; Percent Identity=65.0; E value=1e-58; Homolog= gi|37526005|ref|NP _929349.1| hypothetical protein [Photorhabdus luminescens subsp. laumondii TTO1] gi|36785435|emb|CAE14381.1|
MKRFFLGAALVLVGLVSGCDQFKDFSINEGLMNDYLLKKVHYQKKISIPGIANANITLGDLSSQIGRHDPEKIELSTQAKIQLATLLGTIQADMKLTIKAKPVFDAEKGAIFVKGLEIVDYQTTPEKAAAPVKALIPYLNTSLSEFFDTHPVYVLNPEKSKAEAAASQFAKRLEIKPGKLVIGLTDK

SEQ ID NO: 7246 - protein, 401 aa, Xenorhabdus bovienii
  Peptide sequence Name=Xb4151_4152.C431.gene4.pep
  Gene classification: Gene name=ProP; Function=77 Permeases of the major facilitator superfamily; Function class=G Carbohydrate transport and metabolism
  Homolog annotation: Query=1..400bp; Hit=11..410bp; Blast score=509; Percent Identity=71.0; E value=1e-144; Homolog= yceL COG0477
MSLVSQARSLGKYFLLFDNLLVVLGFFVVFPLISIRFVEQLGWTALIVGFALGLRQLVQQGLGIFGGAIADRFGAKPMIVTGMLLRALGFALMAMAHEPWILLLSCVLSGLGGTLFDPPRAALVIKLTRPHERGRFYSILMMQDSAGAVVGALLGSWLLQYDFNIVCWIGASIFVLAALFNAWLLPAYRISTIRTPIKEGIMRVIRDRRFFYYVLTLTGYFVLSVQVMLMFPIIIHEITGTPTAVKWMYAIETVISLTLLYPIARWSEKHFRLEQRLMAGLFLMSICMFPIGWVNQLHTLFGLLCLFYLGLVTADPARETLSASLSDPRARGSYMGFSRLGLALGGAIGYTGGGWLYDTGRVLNMPQLPWILLGLSGLITIYALHHQFNKKKIDPVMLGRH

SEQ ID NO: 7247 - protein, 66 aa, Xenorhabdus bovienii
  Peptide sequence Name=Xb4151_4152.C431.gene5.pep
MPSPDVCLEKFWIIYLLLKLLPITHDKKISSITLYLKEEIRVRIIRTLYLFSHISMVRNVVGFTST

SEQ ID NO: 7248 - protein, 195 aa, Xenorhabdus bovienii
  Peptide sequence Name=Xb4151_4152.C431.gene6.pep
  Gene classification: Gene name=RimL; Function=Acetyltransferases, including N-acetylases of ribosomal proteins; Function class=J Translation, ribosomal structure and biogenesis
  Homolog annotation: Query=1..190bp; Hit=1..190bp; Blast score=268; Percent Identity=66.0; E value=2e-72; Homolog= rimJ COG1670
MFGYRSASPKIRFITDRMVIRLVYERDAYRLAEYYSDNKNFLKPWEPTRDGSFYQPSGWTNRLNYIAELQRQNATFNFVLLDSDEREIMGMANFTNVVRGAFHSCYLGYSLAGKLQGQGLMYEALQPAIRYMQRYQKMHRIMANYMPHNHRSGNLLKKLGFEQEGYAKNYLMIDGIWQDHVLTALTDDAWGKVDL

SEQ ID NO: 7249 - protein, 512 aa, Xenorhabdus bovienii
  Peptide sequence Name=Xb4151_4152.C431.gene7.pep
  Gene classification: Gene name=MviN; Function=Uncharacterized membrane protein, putative virulence factor; Function class=R General function prediction only
  Homolog annotation: Query=1..509bp; Hit=1..509bp; Blast score=694; Percent Identity=80.0; E value=0; Homolog= mviN COG0728
MNLLKSLAAVSSMTMFSRVLGFIRDAIIARIFGAGMATDAFFVAFKLPNLLRRIFAEGAFSQAFVPILAEYKNQQGDEATRTFIAYISGMLTLILAIVSVIGVIAAPWIIYVTAPGFTDTPDKFVLTRDLLRITFPYIFLISLASLAGAILNTWNRFSVPAFAPTLLNVSMIFFALFVAPYCNPPVLALGWAVVAGGILQLAYQLPHLKKIGMLVLPRVSFRDSAVWRVIRQMGPAILGVSVSQISLIINTIFASFLVSGSVSWMYYADRLMELPSGVLGVALGTILLPSLAKSFSSGNHEEYRKLMDWGLRLCFLLALPCAVALGILAEPLTVSLFQYGHFSAFDAEMTQRALIAYCFGLMGLIVVKVLAPGFYSRQDIKTPVKIAIATLILTQLMNLAFIGPLKHAGLALSIGLAACFNASMLYWQLRKRDIFTPLAGWGIFLFKLVVAIAVMVGVLLAVLWVMPAWEQGNMAMRLLRLMGVVIAGAGSYFAALALMGFRLKDFAQRGLQ

SEQ ID NO: 7250 - protein, 217 aa, Xenorhabdus bovienii
  Peptide sequence Name=Xb4151_4152.C431.gene8.pep
  Gene classification: Function=Transposase; Function class=L DNA replication, recombination and repair
  Homolog annotation: Query=13..211bp; Hit=1..200bp; Blast score=147; Percent Identity=39.0; E value=1e-35; Homolog= mll6112 COG3547
MLAGCFFQEKTIMQNVTLIGIDLGKHSFHVHCQDKSGKALLRKKFTRARLMEFLAGSPSATVVMEACAGAHFMARRIAAFGHEAKLISPQFVRPFVKSNKNDFVDAEAICEAASRPSMRFVQPRTEAQQAMRALHRVRESLVRDRVKTTNQMHAFLLEFGISMPIGTAVIKRLSTVLAENELPPYLAQLLMRLHAHYLYLVEQLTELETALEQELST

SEQ ID NO: 7251 - protein, 84 aa, Xenorhabdus bovienii
  Peptide sequence Name=Xb4151_4152.C431.gene9.pep
LSPRLLIPKSVFLPPVLYWRGTRPVEAAKSRLQPYCLPSPSCDDKTLGRLSDPRPGLSEDAVLFHHVLSSCSSAVSSSVSCSTR

SEQ ID NO: 7252 - protein, 68 aa, Xenorhabdus bovienii; identical to SEQ ID NO: 6354
  Peptide sequence Name=Xb4151_4152.C431.gene10.pep

SEQ ID NO: 7253 - protein, 91 aa, Xenorhabdus bovienii
  Peptide sequence Name=Xb4151_4152.C431.gene11.pep
  Homolog annotation: Query=1..79bp; Hit=32..110bp; Blast score=93; Percent Identity=65.0; E value=7e-19; Homolog= gi|37526432|ref|NP _929776.1| Transposase, IS5 ssgr, IS427 family [Photorhabdus luminescens subsp. laumondii TTO1] gi|37527200|r
MKRRGKAVLADKGYSGGKLRGYLRKLRIKSIIPYKINEKGSTDGRTQFDKQAYRDRNVVERCFGFLKGNRRIATRYEKSMVPTFFATLIFD

SEQ ID NO: 7254 - protein, 44 aa, Xenorhabdus bovienii
  Peptide sequence Name=Xb4151_4152.C431.gene12.pep
LDANAIEQRNGGLTFMSLPSGHYQVEGKSLSVGCQVDFGAITTA

SEQ ID NO: 7255 - protein, 151 aa, Xenorhabdus bovienii; identical to SEQ ID NO: 6609
  Peptide sequence Name=Xb4151_4152.C431.gene13.pep
  Gene classification: Function=Predicted transposase; Function class=L DNA replication, recombination and repair
  Homolog annotation: Query=2..127bp; Hit=1..117bp; Blast score=105; Percent Identity=45.0; E value=2e-23; Homolog= mll8100 COG3293

SEQ ID NO: 7256 - protein, 32 aa, Xenorhabdus bovienii
  Peptide sequence Name=Xb4151_4152.C431.gene14.pep
MLRWLYFLYSNFSHSYMLYTNPFALFRCPYTK

SEQ ID NO: 7257 - protein, 35 aa, Xenorhabdus bovienii
  Peptide sequence Name=Xb4151_4152.C431.gene15.pep
MAWVYLTPDLINCGFLAIKISFPLGESCSLNGESG

SEQ ID NO: 7258 - protein, 100 aa, Xenorhabdus bovienii
  Peptide sequence Name=Xb4151_4152.C431.gene16.pep
MIKASRIAEQIINDSETLENNSGRLSSLFARTLPPIRPAARFPSALAQNHNPITCPRMREGGSTVMVASPIGLRQSSPSASKRIQNAGWKWLPFDEMTAG

SEQ ID NO: 7259 - protein, 313 aa, Xenorhabdus bovienii
  Peptide sequence Name=Xb4151_4152.C431.gene17.pep
  Gene classification: Gene name=HtrB; Function=Lauroyl/myristoyl acyltransferase involved in lipid A biosynthesis; Function class=N Cell motility and secretion
  Homolog annotation: Query=1..306bp; Hit=1..306bp; Blast score=421; Percent Identity=66.0; E value=1e-118; Homolog= htrB COG1560
MIQAPSFERSFLHPRYWLTWLGIGILYLLVLLPYPVIYWIGTRLGRLSQRFLKKRAKIAERNLALCFPDMSPEKRNELLVKNFESVGMGLVETGMAWFWPDWRIKRWFKITGEENLQKVLSSNQGFIVIGIHFLTLELGARILGLLNPGIGVYRPNDNPVMDWLQTWGRLRSNKYMLDRKDVKGMIRCLKNGEMVWYAPDHDYGPRKSVFAPLFAVEHAATTMGTSILVRLSDPALLPFTPRRLPDGKGYELMIQPAVEGFPKNDEVEAAAFMNKVVEREIMQAPDQYMWLHRRFKTRPEGMPSLYDDNKNIH

SEQ ID NO: 7260 - protein, 67 aa, Xenorhabdus bovienii
  Peptide sequence Name=Xb4151_4152.C431.gene18.pep
MSNRCKTAFEYNAQEYHNHGLAQHYPIVDMVFDLSTIKHLMYQYFDIPLKNVTIHQYYFLEPGEFGF

SEQ ID NO: 7261 - protein, 35 aa, Xenorhabdus bovienii
  Peptide sequence Name=Xb4151_4152.C431.gene19.pep
MRSKHELLSQNSKVKNHYSLKAIFVMISSYQWDSH

SEQ ID NO: 7262 - protein, 352 aa, Xenorhabdus bovienii
  Peptide sequence Name=Xb4151_4152.C431.gene20.pep
  Gene classification: Function=Uncharacterized enzyme related to sulfurtransferases; Function class=R General function prediction only
  Homolog annotation: Query=1..345bp; Hit=1..345bp; Blast score=556; Percent Identity=76.0; E value=1e-158; Homolog= yceA COG1054
MPVLHNRISNKELKERMLAEIEPRTTISFYKYFTISELQAFRDSLYQKFTELSVFGRVYIAKEGINAQISVPSKNVDALKALLDATDPALCHLRLNIALEDDGKSFWVLRMKLRERIVADGIEDETFNPSNTGEYLKAEQVNQMLDDPDTLFVDMRNHYEYEVGHFENAIEIPSDTFREQLPMAVEMLKDNKDKNIVMYCTGGIRCEKASAYMLHNGFDKVYHVEGGVIEYARKAKEQGLPVRFMGKNFVFDERMGERISEDIIAHCHQCGTACDSHINCKNDGCHLLFIQCLSCAEQFEGCCSDICREEMKLPEEEQRFRRAGRENGTKIFNKSRYRLNDGLNITSLQSIK

SEQ ID NO: 7263 - protein, 197 aa, Xenorhabdus bovienii
  Peptide sequence Name=Xb4151_4152.C431.gene21.pep
  Homolog annotation: Query=1..196bp; Hit=1..199bp; Blast score=191; Percent Identity=53.0; E value=8e-48; Homolog= Pa|Phot5-451c10.q1k _g152| 118584 - 119186 1389 200 aa, chain +
MKLLVIDKCHYTRLGIIESLKENIDILSIGAVSIHDAINILPIFPPDIILVNLTSYGHHKEYCEQLKLFISLVNDARIYTYIDKPYPLCDTSIQLTNKDFILPKKNLSTLLVRIQEMTAHDIQRYFANFNTQSSIFSLQENRIIHYWMQETDTHKIAKMLKISNSTVYSHKRHIIEKIGISNKIELLFIYNIFKYIC

SEQ ID NO: 7264 - protein, 84 aa, Xenorhabdus bovienii
  Peptide sequence Name=Xb4151_4152.C431.gene22.pep
  Homolog annotation: Query=1..84bp; Hit=1..84bp; Blast score=120; Percent Identity=73.0; E value=7e-27; Homolog= Pa|Phot5-451c10.q1k _g151| 118130 - 118384 913 84 aa, chain +
MEQKNEIIQTHPVVGWDISTVDAYDAMMIRLHYLSSQDQASGNVNIDKTLWLTTGVAKQLILILQAGIEKIEASEYSQLDHIKH

SEQ ID NO: 7265 - protein, 31 aa, Xenorhabdus bovienii
  Peptide sequence Name=Xb4151_4152.C431.gene23.pep
VIIQKISLFPLLRLLKRVILLLLILDEIFCS

SEQ ID NO: 7266 - protein, 46 aa, Xenorhabdus bovienii
  Peptide sequence Name=Xb4151_4152.C431.gene24.pep
VTNFFITTRAENIFISARLRLPNKSLASLTIIPISDNTKNLALSPS

SEQ ID NO: 7267 - protein, 350 aa, Xenorhabdus bovienii
  Peptide sequence Name=Xb4151_4152.C431.gene25.pep
  Gene classification: Gene name=PyrC; Function=Dihydroorotase; Function class=F Nucleotide transport and metabolism
  Homolog annotation: Query=1..347bp; Hit=1..347bp; Blast score=526; Percent Identity=70.0; E value=1e-149; Homolog= pyrC COG0418
MTTESYTIKIRRPDDWHVHFRDDDMLKIIVPHTSRFFGRAIVMPNLAPPVTDVASAKAYRDRIIAAIPSGHHFHPLMTCYLTDSTDSSQIEIGYEEGVFTACKLYPANATTNSSHGVSDTKKIYPLLETMEKLGVPLLIHGEVTASHIDIFDREARFIEQVMEPLRKQFPELKVVFEHITTKEAAEYILAGNDKLAATLTPQHLMFNRNHMLVGGIRPHLYCLPVLKRNIHQEALRSAVASGCNRFFLGTDSAPHLQHRKESSCGCAGVFNAPTALAAYATVFDEIDAIAHFEAFCSLNGPKFYGLPVNEGFVELTRKPTPVTEYIECGDEKLIPFLAGEDAKWEVKVCD

SEQ ID NO: 7268 - protein, 38 aa, Xenorhabdus bovienii
  Peptide sequence Name=Xb4151_4152.C431.gene26.pep
MIKLYEFRKVSLLNIICRVFRGNLSYQKTEKIEVITRG

SEQ ID NO: 7269 - protein, 93 aa, Xenorhabdus bovienii
  Peptide sequence Name=Xb4151_4152.C431.gene27.pep
MYFWTLQDSCYHPLLLVPLLIHIMLAVLLVPPLRTQTSSIKATEVQIICEQIVLYFFFYKSEATVKCIRSEGFLHSSVVERRIVIRMSLFESS

SEQ ID NO: 7270 - protein, 79 aa, Xenorhabdus bovienii
  Peptide sequence Name=Xb4151_4152.C431.gene28.pep
MLESPTSRAKSGFLKLGSSNWTRTSDIRINSPPFYRLNYGGIASFLRTKRILTILFSFVKAENSNNCLFAENIDLLWYF

SEQ ID NO: 7271 - protein, 75 aa, Xenorhabdus bovienii
  Peptide sequence Name=Xb4151_4152.C431.gene29.pep
MSLVRVQLEEPNSRKPGLVPLTGLFVIYFLQTYLLQMYFFPSKYKFRLKIPQQVYILSKQTVIAIFCFDKRKQYR

SEQ ID NO: 7272 - protein, 54 aa, Xenorhabdus bovienii
  Peptide sequence Name=Xb4151_4152.C431.gene30.pep
MENKFKCLTDVQGDDILLFFTAKYDHIVIFHTLLNLLLLLCYHLDKNSANRCKE

SEQ ID NO: 7273 - protein, 38 aa, Xenorhabdus bovienii
  Peptide sequence Name=Xb4151_4152.C431.gene31.pep
LLLILSISYPPYSDVLLTDCIQVFCRSDRYQSALFSRW

SEQ ID NO: 7274 - protein, 196 aa, Xenorhabdus bovienii
  Peptide sequence Name=Xb4151_4152.C431.gene32.pep
  Homolog annotation: Query=28..194bp; Hit=1..167bp; Blast score=214; Percent Identity=64.0; E value=5e-55; Homolog= Pa|Phot5-451c10.q1k _g147| 113607 - 114125 1637 172 aa, chain +
MSSEHASLKNGITFNSITRFYNNRVSIMNIIKQILIQDLKRINLEEHRDGKVHFNSTFIHHHPYLCLAMVIAYAFLVMLMGYSPYFGTWSLILFTVLFVAMAAVLLFDIKPVYHFEDIDVLDLRVCYNGEWFVNEKVSHKAINKILTHPKVPSEMKDEIKRIMRKKDGICFYDVFIVAFSEQSPYFHPSEMVNKSA

SEQ ID NO: 7275 - protein, 35 aa, Xenorhabdus bovienii
  Peptide sequence Name=Xb4151_4152.C431.gene33.pep
MPFLRLACSEDISVYQLPYFIYKIVIVWKQYRYFC

SEQ ID NO: 7276 - protein, 80 aa, Xenorhabdus bovienii
  Peptide sequence Name=Xb4151_4152.C431.gene34.pep
LNGREVNEYVFATISWSDETKAFRLVEPLHLTFHFVRHLTFLYIKKNSPPRACVGQYQLLLMEALRRKRSTKATGDSTYT

SEQ ID NO: 7277 - protein, 70 aa, Xenorhabdus bovienii
  Peptide sequence Name=Xb4151_4152.C431.gene35.pep
  Gene classification: Gene name=CspC; Function=Cold shock proteins; Function class=K Transcription
  Homolog annotation: Query=4..70bp; Hit=3..69bp; Blast score=110; Percent Identity=91.0; E value=4e-25; Homolog= cspC COG1278
MSDKMKGQVKWFNESKGFGFITPADGSKDVFVHFSAIQGNGFKTLAEGQNVEFTIENGAKGPAAANVTAI

SEQ ID NO: 7278 - protein, 45 aa, Xenorhabdus bovienii
  Peptide sequence Name=Xb4151_4152.C431.gene36.pep
MSWRAFCFFILVTFMPIYLDEKNNRMKNAFVTYPPDSDKNESHAI

SEQ ID NO: 7279 - protein, 49 aa, Xenorhabdus bovienii
  Peptide sequence Name=Xb4151_4152.C431.gene37.pep
MRLSPIPQTQIKMSHTLFKTYDFLMKKAISSRIKYSALYSMCKINRLSL

SEQ ID NO: 7280 - protein, 48 aa, Xenorhabdus bovienii
  Peptide sequence Name=Xb4151_4152.C431.gene38.pep
  Homolog annotation: Query=1..36bp; Hit=97..132bp; Blast score=63; Percent Identity=86.0; E value=6e-10; Homolog= gi|37525774|ref|NP _929118.1| hypothetical protein [Photorhabdus luminescens subsp. laumondii TTO1] gi|36785203|emb|CAE14136.1|
MWCSAGIGVLCRLGQYWSASIATSIILCANILLREAHNGLMPNLINKL

SEQ ID NO: 7281 - protein, 36 aa, Xenorhabdus bovienii
  Peptide sequence Name=Xb4151_4152.C431.gene39.pep
LLVGSVSLLGFHHEYHKQYRSYSVVLNLKLVNKVGH

SEQ ID NO: 7282 - protein, 48 aa, Xenorhabdus bovienii
  Peptide sequence Name=Xb4151_4152.C431.gene40.pep
LINQIYSATYLAMLNEVLRYLPCQNKNKPLNEIIINIIIISVIFIPFS

SEQ ID NO: 7283 - protein, 57 aa, Xenorhabdus bovienii
  Peptide sequence Name=Xb4151_4152.C431.gene41.pep
MGTKNLVFVSSAAPEKLMSYLLILLDLACQFLFKNSRKSTNRRAMGRLSKFHQYALI

SEQ ID NO: 7284 - protein, 72 aa, Xenorhabdus bovienii
  Peptide sequence Name=Xb4151_4152.C431.gene42.pep
MTGLSPLSALAETSFSLNAVIAIAALTFGKSKNVNKTCSTISFSSATENRCFTSSRLNSPVTKINPLKPYSL

SEQ ID NO: 7285 - protein, 32 aa, Xenorhabdus bovienii
  Peptide sequence Name=Xb4151_4152.C431.gene43.pep
MRDFSVGLTYKMLFLIPLLLKGLHHSQIQYQN

SEQ ID NO: 7286 - protein, 30 aa, Xenorhabdus bovienii
  Peptide sequence Name=Xb4151_4152.C431.gene44.pep
VSIEISISAYRNVDISFIPLQKKLTVCQLF

SEQ ID NO: 7287 - protein, 60 aa, Xenorhabdus bovienii
  Peptide sequence Name=Xb4151_4152.C431.gene45.pep
  Gene classification: Gene name=MgtA; Function=Cation transport ATPases; Function class=P Inorganic ion transport and metabolism
  Homolog annotation: Query=4..57bp; Hit=653..708bp; Blast score=71; Percent Identity=69.0; E value=2e-13; Homolog= PA4825 COG0474
MSTLRYADIDISIDTRTDTAKGSEDIILFDKNLMVLGERVIKSRETFGNKYLNMTASRIS

SEQ ID NO: 7288 - protein, 38 aa, Xenorhabdus bovienii
  Peptide sequence Name=Xb4151_4152.C431.gene46.pep
MSYILYIYLRKILNKFLSILSYAKDSCEISYIRFCTSK

SEQ ID NO: 7289 - protein, 87 aa, Xenorhabdus bovienii
  Peptide sequence Name=Xb4151_4152.C431.gene47.pep
MIGLGAIFSILDITIFAMILCVFIVSCVEHQLYSNRLIYGRSVVSGTGCTYVAYIKSSVCPKYRRIICVINGINNYDTRYIPAIFTI

SEQ ID NO: 7290 - protein, 32 aa, Xenorhabdus bovienii
  Peptide sequence Name=Xb4151_4152.C431.gene48.pep
VFLFTKKNIFKAMTVIQLVHQMVKMAGIYLVS

SEQ ID NO: 7291 - protein, 30 aa, Xenorhabdus bovienii
  Peptide sequence Name=Xb4151_4152.C431.gene49.pep
MLINENYLQLSTNVMNVKLLHHLDDNEIAY

SEQ ID NO: 7292 - protein, 47 aa, Xenorhabdus bovienii
  Peptide sequence Name=Xb4151_4152.C431.gene50.pep
MFYCYLYFKLSKIISFFMFIYSVYISCFLFKVFFLLLIVFYVIRIYC

SEQ ID NO: 7293 - protein, 45 aa, Xenorhabdus bovienii
  Peptide sequence Name=Xb4151_4152.C431.gene51.pep
LLNLYLGVILFLFFMLFKEINFLLMGDFSFAYTVSHSVLYKWHKH

SEQ ID NO: 7294 - protein, 38 aa, Xenorhabdus bovienii
  Peptide sequence Name=Xb4151_4152.C431.gene52.pep
LVYDRILFTQRKRWHSSHFTHKYHTDHKNKIKYSMMLK

SEQ ID NO: 7295 - protein, 39 aa, Xenorhabdus bovienii
  Peptide sequence Name=Xb4151_4152.C431.gene53.pep
MLINFTPESSTYTTENICHFKYYVTCITKLTLFIMILAH

SEQ ID NO: 7296 - protein, 116 aa, Xenorhabdus bovienii
  Peptide sequence Name=Xb4151_4152.C431.gene54.pep
  Homolog annotation: Query=1..116bp; Hit=1..116bp; Blast score=176; Percent Identity=96.0; E value=5e-44; Homolog= gi|7387668|sp|Q9X9F2|FLHD_XENNE Flagellar transcriptional activator flhD gi|4689057|emb|CAB41407.1| FlhD protein [Xenorhabdus
MSTVELLKHIYDINLSYLLLAQRLINHEKASAMFRLGISESMADTLAELTLPQLVKLAETNQLICHFRLEDHETVLQLTKESRVDDLQQIHTGILLSTHLFQQLSALDDISIKKRA

SEQ ID NO: 7297 - protein, 193 aa, Xenorhabdus bovienii
  Peptide sequence Name=Xb4151_4152.C431.gene55.pep
  Homolog annotation: Query=1..193bp; Hit=1..194bp; Blast score=367; Percent Identity=92.0; E value=1e-101; Homolog= gi|7387669|sp|Q9X9F3|FLHC_XENNE Flagellar transcriptional activator flhC gi|4689058|emb|CAB41408.1| FlhC protein [Xenorhabdus
MVEKSIVQEAKDIHLAMELITLGARLQMLESETQLSRGRLIRLYKELRGSPPPKGMLPFSTDWFMTWEQNIHSSMFYNAYRFLMKSGHCDGVEAVVKAYRLYLEQCPPSSEGGSVLALTRAWTLVRFVDSGMLQPTECRCCGGTFITHAHQPVNSFVCSLCQPPSRAVKKRKLSVLPADTNSQLLDGFAQQAM

SEQ ID NO: 7298 - protein, 43 aa, Xenorhabdus bovienii
  Peptide sequence Name=Xb4151_4152.C431.gene56.pep
VNLNGKLKSRLQVFYVQTCNLLCHTVLRLLIRPVQIPSAHQLS

SEQ ID NO: 7299 - protein, 293 aa, Xenorhabdus bovienii
  Peptide sequence Name=Xb4151_4152.C431.gene57.pep
  Gene classification: Gene name=MotA; Function=Flagellar motor component; Function class=N Cell motility and secretion
  Homolog annotation: Query=1..293bp; Hit=1..293bp; Blast score=432; Percent Identity=75.0; E value=1e-121; Homolog= motA COG1291
VLVLLGYIVVFGAVIGGYLLVGGHMGALYQPAEFLIIAGAGIGAFIVGNNGKAIKATLRVLPKILRRSKYNKAMYMDLMALLFRLLSKSRQNGLLALERDIENPHQSDIFTQYPRLLKDPYLMDFTTDYMRLIISGNMNPHEIEALMDEEIETYEQESEVPATSLAMVGDSLPAFGIVAAVMGVVHALGSADRPAGELGALIAHAMVGTFLGILLAYGFVSPLATLLRQRSSEQVKMMQCIKITLLSSLNGYAPQIAVEFGRKTLFLTDRPSFTELEEHVRRVKSPVQQEVEE

SEQ ID NO: 7300 - protein, 333 aa, Xenorhabdus bovienii
  Peptide sequence Name=Xb4151_4152.C431.gene58.pep
  Gene classification: Gene name=MotB; Function=Flagellar motor protein; Function class=N Cell motility and secretion
  Homolog annotation: Query=2..277bp; Hit=4..278bp; Blast score=331; Percent Identity=61.0; E value=7e-91; Homolog= motB COG1360
MRANNVTVIRVKKRKKHGEKHCGGSWKIAYADFMTAMMAFFLVMWLLSIASPQELTSIADYFRTPLQVAINQGPQSSDSTNPIPGGGDEVFQQDGEVFRESKLVESNKEKRRLNRLHQQLDQLIITDPRLKELRPHLLIDMMDEGLRIQIIDRENRPMFMIGSAKVESYMRDILQAIAPILNEIPNKVSLSGHTDNLQYANGQRGYSNWELSADRANASRRELLNGGLDEVKILRVVGMASTVSMQKGIDPNAPVNRRISIVVLNKDAEKRIEQENSGGDAMTANNSMDMQEVIRTDSNKGAPSQQSTEQSNEITISVQTQIEPSSDTNKVTE

SEQ ID NO: 7301 - protein, 722 aa, Xenorhabdus bovienii
  Peptide sequence Name=Xb4151_4152.C431.gene59.pep
  Gene classification: Gene name=CheA; Function=Chemotaxis protein histidine kinase and related kinases; Function class=N Cell motility and secretion
  Homolog annotation: Query=1..707bp; Hit=3..647bp; Blast score=809; Percent Identity=63.0; E value=0; Homolog= ZcheA COG0643
MDITAFYQTFFDEADELLDDMEQHLLLLDADEPDHEQLNAIFRSAHSIKGGAATFGFAKLQQTTHVLENLLDSARRDEIRLTTDIINLFLEAKDIMQQQLDAYKSSQEPDEDTFNYICETLRQLALELQDDKQDKSADAAAPAIQSEPALKETVLEAEEEQTIVINQPEEKNLPAGKADQGRIRVHLSGLKEREVSLMKDELGHLGDVYDVEQTADSLEASLITSATEDDITAVMCFVIEPEQITFLPVADSHPAEETEADTQSEKKPAAEGVAIESRVAASTISTDKPQPADVPQKSEGHGVGRPASRPVAGSPRQRAESSSIRVAVEKVDQLINLVGELVITQSMLAQHCDGLEQTKHSELLSCMAQLQRNSRDLQESVMSIRMMPMEYVFSRYPRLVRDLAGKLNKKVELTLIGSSTELDKSLIERIIDPLTHLVRNSLDHGIENPEKRIAAGKSETGNLTLSAEHQGGNICIEVIDDGAGLNREKILAKARSQGLNISENMSNEEVAMLIFAPGFSTAEVVTDVSGRGVGMDVVKRNIQDMGGQIQISFQEGKGTIIRILLPLTLAILDGMSVKVNSEVFILPLSAVVSSLQPQEEDIYPLAGDEKLLQVRGEYLPLLELYRIFDISSGETSPTKGIAVIVQSAGRRYALLVDKLVGQHQVVVKNIESNYRKVPGISAATIMGDGSVALIIDIPALQKLNHEQLATRKAELVNKKITQ

SEQ ID NO: 7302 - protein, 165 aa, Xenorhabdus bovienii
  Peptide sequence Name=Xb4151_4152.C431.gene60.pep
  Gene classification: Gene name=CheW; Function=Chemotaxis signal transduction protein; Function class=N Cell motility and secretion
  Homolog annotation: Query=1..163bp; Hit=1..163bp; Blast score=234; Percent Identity=79.0; E value=2e-62; Homolog= cheW COG0835
MSAIEEFSKLSGETTGKEYLVFTLGDEEYGIEILKVQEIRGYDQVTRIANTPSFIKGITNLRGVIVPIIDLRIKFSQENVTYNDNTVVIVLNLLNRVVGIVVDGVSDVLSLKDDQICPAPEFAVTLSTEYLTGLGSIDERMLILVDIEKLLNSEEMALVDSVAKS

SEQ ID NO: 7303 - protein, 48 aa, Xenorhabdus bovienii
  Peptide sequence Name=Xb4151_4152.C431.gene61.pep
MPVLSAPLKGTLCVIQKIEFLHYFFDLKQVRLPFCSTGYNEWQQSRQP

SEQ ID NO: 7304 - protein, 567 aa, Xenorhabdus bovienii
  Peptide sequence Name=Xb4151_4152.C431.gene62.pep
  Gene classification: Gene name=Tar; Function=Methyl-accepting chemotaxis protein; Function class=N Cell motility and secretion
  Homolog annotation: Query=1..567bp; Hit=1..551bp; Blast score=518; Percent Identity=55.0; E value=1e-147; Homolog= tsr COG0840
MFNRMKIVTGLISVIILFGALQFISGGLFFNGLKNDTEAFDLLDKMRQQQKLLDESWINLLQARNNLNRVGIIYIMKERDLDGTYQIDDVLAESKVSLARGERRFEQFEQLKKLPIHDPDHLQRLKQTHHEYLNALKELDGFLAKKQYKEFFAQKTTDYQNAFNVEYDYYLNQNQKLYDEVAREADIAYRNIIISLISVFVLLISVMTVSWIGLRKALINPLNKLLENIKAFSKGDLTQTINVSGTNEMGMLAVGLRHMQDELIHTVRSVHQSTETIYTGTSEIAAGNNDLSSRTEQQVASLEETAASMEQLTATVKQNADNARQASNLADNASDIARQGGKVVANVVQTMHDIADSSRKISDITGVIDAIAFQTNILALNAAVEAARAGEHGRGFAVVAGEVRNLAQRSAEAAKEIKSLIEDSVDRTDTGSVLVESAGETMNKIVDSVTRVTDIMGEIASASDEQSRGITQVGVAISEMDRVTQQNASLVEQSAAAAAALEEQAMILTKAVALFQLPEQAERKQSEKRKHEVLSTIKSPTPPANKTNPPVLKKGSNVEDPSNWETF

SEQ ID NO: 7305 - protein, 543 aa, Xenorhabdus bovienii
  Peptide sequence Name=Xb4151_4152.C431.gene63.pep
  Gene classification: Gene name=Tar; Function=Methyl-accepting chemotaxis protein; Function class=N Cell motility and secretion
  Homolog annotation: Query=1..515bp; Hit=1..517bp; Blast score=389; Percent Identity=50.0; E value=1e-108; Homolog= Ztsr COG0840
MLGRLRISTSLYLLLMMFCVMQIISSGLSLGIIHTDQSYIERIDLGTKRRDTLGLSWAAMLQTRNTLNKIAIGQKVGQSQDQIDAMEALLKSSLNEAERNFAQFSALPQIEKNDQSVALLAAVERSYQEYINALKELKIYLYEGNFQAFLDQPTENYQRQLEVAYNNYMQYLGHNISTAVSDGAFYYKVSIAMFFGSILMVFVVSASAHWWMRRNLLRPFDNMRACFQDVAEGRLNKEIAVTTSDEIGDIFRKLRDMQQSLIKSIASVRDNTNQMYAGIQEITQGNTDLSSRTEEQAASLEETAASMEELTVTVKQNAENARQASELAVSASQTASKGGELTVSVVATMDEIANSSKKISAIISVIDGIAFQTNILALNAAVEAARAGEQGRGFSVVAGEVRDLAQRSAEAAKEIKTLIDESVHRVNQGSELVNHAGNTMDELVKSVNQVTELMAEIAAASDEQSRGIHQVAQAVSQMDQVTQQNAALVEQSAAAAAALEDKADTLVKTVALFELSESLDNEYDHQTSSASKMTDEYIASQVR

SEQ ID NO: 7306 - protein, 296 aa, Xenorhabdus bovienii
  Peptide sequence Name=Xb4151_4152.C431.gene64.pep
  Gene classification: Gene name=CheR; Function=Methylase of chemotaxis methyl-accepting proteins; Function class=N Cell motility and secretion
  Homolog annotation: Query=1..289bp; Hit=1..285bp; Blast score=348; Percent Identity=63.0; E value=3e-96; Homolog= cheR COG1352
MKSNLAASDTDAISPLNFMFQRHILSDAQFERICQFIYQRAGIVLAKNKREMVYNRLVRRLRVLGINDFGQYLSILEQNIHSKEWELFINALTTNLTAFFREAHHFPILAAHASRKNAGTYRVWSAAASTGEEPYSIAMTLCDALGHRTNRIKIIGSDIDTHVLEKARQGVYRLEELQHMSNSQKKKYFFKGIGSFEGYARVRPTLAELVSFQHLNLLDSDWALEGKFDAIFCRNVMIYFDKKTQERILRRFANYLKPDGLLFAGHSENVTQISREFYLQGQTVYGVGRRAGRGHE

SEQ ID NO: 7307 - protein, 350 aa, Xenorhabdus bovienii
  Peptide sequence Name=Xb4151_4152.C431.gene65.pep
  Gene classification: Gene name=CheB; Function=Chemotaxis response regulator containing a CheY-like receiver domain and a methylesterase domain; Function class=N Cell motility and secretion
  Homolog annotation: Query=1..350bp; Hit=1..349bp; Blast score=511; Percent Identity=77.0; E value=1e-145; Homolog= cheB COG2201
MNKITVLCVDDSALMRQIMREIINSHPDMEVVDCAPDPFVARDLIKKHNPQVLTLDVEMPRMDGIDFLEKLMRLRPMPVVMVSSLTAKGSEITLKALELGAVDFVTKPQLGLREGMLAYSELIAEKIRAAAQAKISTMPSSPVIATPLNFKPLLSSEKLIAVGASTGGTEAIKNLLQPLPVTSPALLITQHMPPGFTRSFAERLNKLSQITVKEAENGERVLPGHAYIAPGDHHMELCRSGANYQIMTTRAPPVNRHRPSVDVLFRSVAKHAGRNAVGVILTGMGSDGAAGLLEMKQAGAYTLAQSEASCVVFGMPRAAIQLGAIDDIMDIQKISKAMLAKISAGQSIRI

SEQ ID NO: 7308 - protein, 136 aa, Xenorhabdus bovienii
  Peptide sequence Name=Xb4151_4152.C431.gene66.pep
  Gene classification: Gene name=CheY; Function=CheY-like receiver domain; Function class=T Signal transduction mechanisms
  Homolog annotation: Query=8..136bp; Hit=1..129bp; Blast score=192; Percent Identity=81.0; E value=1e-49; Homolog= cheY COG0784
MKFQGVFMASKDLRFLVVDDFATMRRIVRNLLKELGFNNVDEAQDGAEALAKLRAAEFDFVISDWNMPNIDGLELLKIIRGEEKLAALPVLMVTAEAKKENIIAAAQAGASGYVVKPFTAAILEEKLNKIFEKLGL

SEQ ID NO: 7309 - protein, 218 aa, Xenorhabdus bovienii
  Peptide sequence Name=Xb4151_4152.C431.gene67.pep
  Gene classification: Gene name=CheZ; Function=Chemotaxis protein; Function class=N Cell motility and secretion
  Homolog annotation: Query=1..218bp; Hit=1..214bp; Blast score=255; Percent Identity=70.0; E value=3e-68; Homolog= ZcheZ COG3143
MSENPVMPRDEAVTTSEIISRIGQLTRMLRDSLRELGLDQTIAQAAEAIPDARERLNYVVQMTAQAAERVLNCVEEAQPHQNELESSAKSLTQRWDEWFANPNNLELTEARSLVTDTRDYLNLVPEHVSFTNTQLLEIMMAQDFQDLTGQVIKRMMEVIQELEKQLVMVLMENMPSDQMAKAKKENDSLLNGPQVNQNGAGVIANQAQVDDLLDSLGF

SEQ ID NO: 7310 - protein, 53 aa, Xenorhabdus bovienii
  Peptide sequence Name=Xb4151_4152.C431.gene68.pep
MCHVKKLNELIKPQLQVVETPYFAFCTIRYKVPSFVIKNLNYPINHQPVLGWQ

SEQ ID NO: 7311 - protein, 95 aa, Xenorhabdus bovienii
  Peptide sequence Name=Xb4151_4152.C431.gene69.pep
MAHRHTLVEMMCCVDVITVHVPCDEPVSALCLKNSPLFRVIFGILLLATIPLVFIEGYLPTFFKVKQGKSAMSVVVEVLLSSLLKYFQFLEGCIE

SEQ ID NO: 7312 - protein, 34 aa, Xenorhabdus bovienii
  Peptide sequence Name=Xb4151_4152.C431.gene70.pep
LNQHDFTLIKNHLFISLAAMNELQYINKISKLYF

SEQ ID NO: 7313 - protein, 33 aa, Xenorhabdus bovienii
  Peptide sequence Name=Xb4151_4152.C431.gene71.pep
MYSIKLYIIYLINNYFVRFLRIIIHGGVFRRLI

SEQ ID NO: 7314 - protein, 78 aa, Xenorhabdus bovienii
  Peptide sequence Name=Xb4151_4152.C431.gene72.pep
MYNTENILFRLNRNNPQKPMTLIHIMSMSFSAFRKEAKDTLNWGENHHLYLTAKKAEKENRIFDARLLSRTNSQLPAI

SEQ ID NO: 7315 - protein, 75 aa, Xenorhabdus bovienii
  Peptide sequence Name=Xb4151_4152.C431.gene73.pep
VNLVSYHRAPSVSSVGSLFAVSKQLFANGVANVKQKTMPFKLRNIVFCLTFTLGKLSTSALVSLSFGILIPSNGR

SEQ ID NO: 7316 - protein, 1532 aa, Xenorhabdus bovienii
  Peptide sequence Name=Xb4151_4152.C431.gene74.pep
  Homolog annotation: Query=29..1529bp; Hit=2..1483bp; Blast score =1808; Percent Identity=60.0; E value=0; Homolog= gi|37524524|ref|NP _927868.1| Insecticidal toxin complex protein TcaC [Photorhabdus luminescens subsp. laumondii TTO1] gi|36783
LLHHLQIIAYLLQTGSLRRRLKEHDDMTQDSQDMTVTQLSLPKGGGAISGMGDAISNAGPDGMASLSVPLPISAGRGSAPNLSLNYSSGAGNGPFGIGWQSSTMAISRRTQHGVPQYHGEDTFLCPMGEVMAVAVNPSGQPDVRQTDKLLGGQLPVTYTVTRHQPRNIQHFSKLEYWQSLTDVETTPFWLMYSPDGQIHIFGKTEQAQIANPAETSQIAQWLLEETVTPTGEHIYYQYRAEDDIGCDDSEKNAHPNASAQRYLAQVNYGNITPESSLLVLKNTPPADHEWLFHLVFDYGERTQEINTVPPFKAPSNNWRIRPDRFSRFEYGFEVRTRRLCQQILMFHRLKSLTGEQIDGEETPALVARLLLSYDLNDSVATLTAIRQMAYETDATLIALPPLEFDYQRFEAKVTQKWQEMPQLAGLNAQQPYQLVDLYGEGISGILYQDRPGAWWYQAPIRQKSVEDINAVTYSPVKPLPKIPSQQDRATLMDIDGDGHLDWVITGAGIQGRHSMQPNGEWTHFIPISALPTEYFHPQAQLADLVGAGLSDLALIGPRSVRLYANDRGNWKAGINVMPPDGVNLPTFGGDASSLVAFSDMLGSGQQHLVEIAAQSVKCWPNLGHGRFGEAILLPGFSQPSGIFNANQVFLADLDGSGTADIIYAHSKYLEIYLNESGNRFSAPVRLDLPKGVMFDNTCQLQVSDIQGLGAASIVLTVPHMAPRHWRYDFTYNKPWLLNVINNNSGAETTLFYRSSAQFWLDEKSQIEESGKFAASYLPFPIHLLWRNEVLDEITGNRLTKGMSYAHGAWDGREREFCGFGRVTQIDTDEFAKGTTEKTPDENIYPSRSISWFSTGLPEVDSQLPAEYWRGDDQAFAGFTPRFTRYEKADAGQAGQDIPIKEPTETEAYWLNRAMKGQLLRSEVYGDDKTENAKIPYTVTEARCQVRLIPSNDEAAPSSWASIIENRSYHYERIVVDPSCKQQVVLNADEYGFPQAKVDIAYPRRNKPTQNPYPDSLPDTLFADSYDDQQKQLYLTKQQQSYYHLTHQDDWVLGLTDTRYSEVYHYAQTDAQSDIPKAGLTLEDLLKVDGLIGKDKTFSYLGQQRVAYVGGDAEKPTRQVRVAYTETAAFDDNALHAFDGVMTSAELTQQLLAGGYLYVPQVSDAAGSSGKVWVARQGYTEYGDASQFYRPLTQRKSLLTGKYTLSWDTHYCVVVKTEDGAGMTTQAKYDYRFLLPAQLTDINDNQHIVTFNALGQVTSSRFWGTENGKMSGYSTPENKPFTVPDTVEKAFALQPAIPVSQCNIYVPDSWMRLLPQQSLTGRLKEGETLWNVLYRAGVVTEDGLLCELACRRWLNRQTTSSMAAVTLQQILAQTPRQPPHAMTITTDRYDSDSQQQLRQSIALSDGFGRVLQSAQRHEAGKAWQRAEDGSLVVDSTGKPVVADTTTRWAVSGRTEYDGKGQTIRAYLPYYLNDWRYVSDDSARDDLYADTHFYDPLGREYQVKTAKGFWRENRFMPWFVVNEDENDTAARLTS

SEQ ID NO: 7317 - protein, 48 aa, Xenorhabdus bovienii
  Peptide sequence Name=Xb4151_4152.C431.gene75.pep
MKAYRELTKTKLQLATLLTDTGDLPTTGTRIIDVKRSLNLPRIYNREG

SEQ ID NO: 7318 - protein, 184 aa, Xenorhabdus bovienii
  Peptide sequence Name=Xb4151_4152.C431.gene76.pep
  Gene classification: Gene name=PinR; Function=Site-specific recombinases, DNA invertase Pin homologs; Function class=L DNA replication, recombination and repair
  Homolog annotation: Query=4..183bp; Hit=3..182bp; Blast score=234; Percent Identity=66.0; E value=3e-62; Homolog= pin COG1961
VARVGYIRVSTNDQNSDLQKNALVNIDCERIFEDKISGKTANRPGLKRALKYLQSGDTLVVWKLDRLGRSVKNLVTLISELHDRGIHFQSLTDSIDTSTAMGRFFFHVMSALAEMERELIVERTNAGLAAAREQGRIGGRPVIFTEEDRQQAARLLDKGHTRKQLSLIYHVSLSTIYKYLPVGL

SEQ ID NO: 7319 - protein, 66 aa, Xenorhabdus bovienii
  Peptide sequence Name=Xb4151_4152.C431.gene77.pep
MPMPRIPTSIGIPHTIPFIAFNHCVISSIYTPIILHNKLATKLFQLNKEHFGKISEDNWLSLVRKN

SEQ ID NO: 7320 - protein, 462 aa, Xenorhabdus bovienii
  Peptide sequence Name=Xb4151_4152.C431.gene78.pep
  Gene classification: Gene name=AlsT (BS); Function=Na+/alanine symporter; Function class=E Amino acid transport and metabolism
  Homolog annotation: Query=5..444bp; Hit=1..443bp; Blast score=452; Percent Identity=60.0; E value=1e-127; Homolog= PA2533 COG1115
MGVYMELITQWLNAINGIVWGIPMLVGILGIGIFMQIRLSFLPIRKLGTGFKLLFQKNEQRGEGQISPFNALMTALSATIGTGNIAGVATAVVMGGPGALFWMWMTALLGMATKYSEAVLAVRFRETDKNGNYVGGPMYYIKNGLGKKWIWLGTLFAFFGSIAGFGIGNTVQANSVADVLQSNFGIEKTATAGILVILVGAVLIGGIKRISDVAGKLVPVMTVGYFGAGIIVLALNITAIPEAFVLIIKSAFTPVAAQGGFAGAAVWAAIRFGVARGVFSNEAGLGSAPIAHAAAKTQNPIRQGLIAMLGTFIDTIIVCSVTGLTIVITGGWLTGETGATLTASSFSTVIPGGNYIVAVALAIFAFTTILGWSFYGEKCIQYLLGPKAIVPFRIAWIIALPIGATQSLNFVWLLADTLNAMMAIPNLIALALLSPIVYRLTRDHIRDVNADSIEVKTAAKTD

SEQ ID NO: 7321 - protein, 43 aa, Xenorhabdus bovienii
  Peptide sequence Name=Xb4151_4152.C431.gene79.pep
MTKTKKFNGGNTAKFAEVFGGSHDAGAWEAPASCDWCYLSLII

SEQ ID NO: 7322 - protein, 411 aa, Xenorhabdus bovienii
  Peptide sequence Name=Xb4151_4152.C431.gene80.pep
  Gene classification: Gene name=FlhB; Function=Flagellar biosynthesis/type III secretory pathway protein; Function class=N Cell motility and secretion
  Homolog annotation: Query=29..410bp; Hit=1..381bp; Blast score=419; Percent Identity=58.0; E value=1e-117; Homolog= flhB COG1377
LSCLTQFYLLFPKSNFSACNNERSPRKVVAEDSDLEKTEEPTPHKREKARKDGQIARSKELTSILMLVGGVSLLWMSGNSITHELSLMVFEGFNFDHNMVSNDKQMIQQVGRLLKQAVWALLPVFVGLVLVALSAPTLMGGLIFSSKSIKFDLAKLSPISGLKKIFSMNALAELFKAILKASLVGGGTALFIWLNWPAMLNLTAQPPLMALSDAMMMLIFAGYIVLFMLIPMVAFDVLYQIRSHLKKLRMTRQEIKDEFKEQEGDPHVKARIRQQQRAAARKRMMSDVPKADVIVTNPTHYAVALQYDSKKMGAPKVLAKGAGLIALRIKEIGAENRIPLLEAPPLARALFRHAEVGGFIPATLYAAVAEVLAWVYQLKRWKREGGLKPKTPENLPVPSALDFAGENNRHG

SEQ ID NO: 7323 - protein, 695 aa, Xenorhabdus bovienii
  Peptide sequence Name=Xb4151_4152.C431.gene81.pep
  Gene classification: Gene name=FlhA; Function=Flagellar biosynthesis/type III secretory pathway protein; Function class=N Cell motility and secretion
  Homolog annotation: Query=1..693bp; Hit=1..691bp; Blast score=1020; Percent Identity=79.0; E value=0; Homolog= flhA COG1298
MANLASLLRLPGNIKGSQWQMLAGPVLILMILSMMVLPLPPFLLDLLFTFNIALSIMVLLVAMFTRRTLDFAAFPTILLFSTLLRLSLNVASTRIILMEGHTGSAAAGQVVEAFGHFLVGGNFAIGIVVFVILILINFMVITKGAGRIAEVGARFVLDGMPGKQMAIDADLNAGLIGEDDAKKRRAEVTQEADFYGSMDGASKFVRGDAIAGLMILVINIIGGLIVGVAQHNMNLGDAAEAYTLLTIGDGLVAQLPALIISTAAGVIVTRVATDEDVGQQMVTQLFNNPRVLMLSAGVLGLLGLVPGMPNLVFLLFTAALAGLGYFLLRKDKNPLAAQHEEMKAVEEQQQTAEASWSDVQLEDPLGMEVGYRLIPMVDFRQNGELLGRISGIRKKFAQEVGYLPPVVHICDNLELAPASYRILMKGVEIGRGEAHPGRWLAINPGGAVGELQGDLTQDPAFGLSAVWIDDSLREQAQVQGYTVVAASTVVATHLNHLLSQHSSELFGRQEAQQLFERVSQEMPKLTEDFIPDVVSLTTLHKVLQNLLAEQVPIRDMRTIIETLAEHAPTQADPYELTATIRIALGRAIAQQWFPGADEIKVIGLDAGLERLLLQALQSGGGLEPGLAESLERQAAEALERQEMLGAPPVLLVNHALRPLLSRFLRRILPRLVVLSNLEITDNRQIRMTATIGGAR

SEQ ID NO: 7324 - protein, 69 aa, Xenorhabdus bovienii
  Peptide sequence Name=Xb4151_4152.C431.gene82.pep
VGRPSYQIRAELIYETLFFGLKSGSRYRIFTIRRVQSLFFIPLSIYFHLVATLGYGGVFSKLDSLTQCI

SEQ ID NO: 7325 - protein, 273 aa, Xenorhabdus bovienii
  Peptide sequence Name=Xb4151_4152.C431.gene83.pep
  Homolog annotation: Query=3..273bp; Hit=12..277bp; Blast score=256; Percent Identity=47.0; E value=2e-67; Homolog= gi|37528247|ref|NP _931592.1| hypothetical protein [Photorhabdus luminescens subsp. laumondii TTO1] gi|36787684|emb|CAE16791.1
MKNERRHFLKQASVTGAIFSLLPLLPAGAFASSPSQPEKGDGIGIGVCELTPEEMSGPYFINNKLLRRNITEDEQGIPLLLTMKIIDSVTCKPLDDILIDIWHCNSMGKYSGWKYINPDLEAPSSDIGTISRTDESIFLRGAQRTDKEGIVRFTTIFPGFYAGRAIHIHLSARSANVQKRQEDKFYFVGQLYFPENISKEVMINDMYSPRDINRLKNEDDSIFSGVKNRAAILTVKKIGDNPLDGLHGKIVLSINKDHVSKKITPKDLAKYTV

SEQ ID NO: 7326 - protein, 35 aa, Xenorhabdus bovienii
  Peptide sequence Name=Xb4151_4152.C431.gene84.pep
MLKLNKINSLFNFLLFLIRWIYYYQKYLSVSSIYF

SEQ ID NO: 7327 - protein, 55 aa, Xenorhabdus bovienii
  Peptide sequence Name=Xb4151_4152.C431.gene85.pep
MVFIFEISHKKPLFIILCCFFIIIFISIIISVPKLKLLITMKSSNLRFLIWGSFF

SEQ ID NO: 7328 - protein, 40 aa, Xenorhabdus bovienii
  Peptide sequence Name=Xb4151_4152.C431.gene86.pep
MGIIFLMINIDRSAQTIDADKGLEKRIYMLKRIMRAHVCG

SEQ ID NO: 7329 - protein, 32 aa, Xenorhabdus bovienii
  Peptide sequence Name=Xb4151_4152.C431.gene87.pep
MSADEVFEQNSWIKGTENLLTGKSMGTFRVFI

SEQ ID NO: 7330 - protein, 33 aa, Xenorhabdus bovienii
  Peptide sequence Name=Xb4151_4152.C431.gene88.pep
MLIYLILSAFIWLMSDDLKNYIYMLSILWHRTS

SEQ ID NO: 7331 - protein, 31 aa, Xenorhabdus bovienii
  Peptide sequence Name=Xb4151_4152.C431.gene89.pep
LFTYKFYPLELHTNNFVRGSYEVRCHKMDSI

SEQ ID NO: 7332 - protein, 40 aa, Xenorhabdus bovienii
  Peptide sequence Name=Xb4151_4152.C431.gene90.pep
LTHHLYVIGISHQVKLRIPDQMFRGLQKLFVRIKAALISF

SEQ ID NO: 7333 - protein, 182 aa, Xenorhabdus bovienii
  Peptide sequence Name=Xb4151_4152.C431.gene91.pep
  Gene classification: Gene name=FimA; Function=Pilin; Function class=N Cell motility and secretion
  Homolog annotation: Query=7..182bp; Hit=5..178bp; Blast score=80; Percent Identity=35.0; E value=7e-16; Homolog= Z4971 COG3539
MFVIKGIKMKLLKLFIAAVISGSMAAPAFAADGTINFNGRITKATCTVSALTDNSVNLPEVGATALAGKGTTGGETLFRIGLENCGIVGGSANVQVKFGGVKDSIDGNLLRINSESGGAKGVGIGIYEKDGSTPINMGALSKGIPVVSPATTLEFKAKYVATEATVTPGTVKASTDFTLDYE

SEQ ID NO: 7334 - protein, 246 aa, Xenorhabdus bovienii
  Peptide sequence Name=Xb4151_4152.C431.gene92.pep
  Gene classification: Gene name=FimC; Function=PapD-like chaperone involved in fimbrial biogenesis; Function class=N Cell motility and secretion
  Homolog annotation: Query=19..243bp; Hit=6..230bp; Blast score=174; Percent Identity=41.0; E value=6e-44; Homolog= yraI COG3121
MSLIFSLCRDIVMLKRFLFGLLLSLPVVFAAPVHAGIALSSTRVIYEASQREATISVINDSKEHVYLIQSWVDTFTTTTELSDRKAPFLVTPPLFRLDGEQENRLRIILTDDSLPRDRESVFWLNVKAIPAVEKNDANRLLISVKNRIKLFYRPAGLTEQLADNAYQKLTFSRQNGQLVVQNPTPFHISFHNITVGNNPVPEAGMVAPFSRRQWPLPAGSGNTVTWWAINDFGGTTEPQHQTLSSS

SEQ ID NO: 7335 - protein, 829 aa, Xenorhabdus bovienii
  Peptide sequence Name=Xb4151_4152.C431.gene93.pep
  Gene classification: Gene name=FimD; Function=PapC-like porin protein involved in fimbrial biogenesis; Function class=N Cell motility and secretion
  Homolog annotation: Query=47..828bp; Hit=49..857bp; Blast score=615; Percent Identity=42.0; E value=1e-176; Homolog= Z4968m COG3188
MSLITPSIRAQLILLLLAGFLPVAGYASDYFDLDALEIHDPSAPPPDLSYFAEKGGSAPGTYHVDIRVNGQNKGAQDIQFVLGAGRKLQPDLSVQQLADWGVNVAAFPVLNSKMQVTDLADIIPYASTSLQLGQQTLIISIPQAAMTAEARGAIDSSLWQQGESALWMNYDFNGAETRSKSGSKTNSIYMNLRSGLNWDAWRLRNYSTYHRVSSGESRWENLNTYLQRDVHLLKSQLVIGETNTRGELFSGFAFRGITLMSDDNMLPDSQRGFAPIVRGIAESNAQVTIRQNGFMIYQAYVPPGAFVIDDLYPASSGGDLNVTIQEADGRERHFVQPFSSVPIMLREGGFKYSLTAGEYRTSHEQIRQPLFMQSEVYYGLPHATTVYGGTLLSPNYQAYVVGVGYSLGRWGSLSFDITRSQADIINEGQQHGRVYRSQYTKDFEQTGTRLSLTSYHYSSPHFYDFQDVNNRAAHDELSYQRKHKFQLNLSQNLSDYGSIYVSGYLQDDWGSRSTTRSLNVGYSVNYADINYTLNYTQNMSSGNSTADNQLAFNIQVPLDRWLPNSWATYSLNHNRQGDMNQSAGLSGTALDGNVLGYSLQQRYGNNGQNSSGNINLNYKARYGELSGGYNYNNSSQQINYGLRGGLVAHRHGITLSQSLGETIVLVKTPGAAGVKVNGYNGVETDGRGHAVLPYVSPYHHNRIALSPDSFGDGVEIESNIQTVIPTQGAMVVADFRTRIGHRVLFTLTHLDKPIPFGAIATLNEENTISFLTENQSIVGNGGEIYFGGVPERGQLSVQWGNGQFEQCKARFILPKSEAAVISMKADCQL

SEQ ID NO: 7336 - protein, 338 aa, Xenorhabdus bovienii
  Peptide sequence Name=Xb4151_4152.C431.gene94.pep
MKVFVYPWLLLASVFFSSGKVYADCSGGSGIISTVAVSIPQHISRDEIYRSLNSQSRASMAITCTNMPIRATHITVGIKAYGDDSGMTSISRKIFKLGDSGIGYVVIGVDDTHDEKPVTTTADRFWGGNARELYTTEIRSDSTINLNAALRLEFYKIGPIKPGRYSQSVAAAIVAPRGSRIPSVTQEFRFTTGMITINAPTCSVDNSTIPVTLGRITTMQLPYVGSTAAETLFNIPLTCEPKANVFMTLEAGRQGAYNLMQGIIELKRGLNERARDGVGVQILDGKTNRPIHLGEKKYYTTTGMGGPVNIPLKARYYRYGDVRAGVANATATFTMSYE

SEQ ID NO: 7337 - protein, 45 aa, Xenorhabdus bovienii
  Peptide sequence Name=Xb4151_4152.C431.gene95.pep
MVLMGKPITTQHCLVTRSVFDFEWCDFKSSYVQTSLFISEIKGLF

SEQ ID NO: 7338 - protein, 146 aa, Xenorhabdus bovienii
  Peptide sequence Name=Xb4151_4152.C431.gene96.pep
  Gene classification: Function=Flagellar biosynthesis/type III secretory pathway chaperone; Function class=N Cell motility and secretion
  Homolog annotation: Query=1..146bp; Hit=1..138bp; Blast score=78; Percent Identity=37.0; E value=2e-15; Homolog= flgN COG3418
MEEIQLLLEQQNVHLNSLSNTMAEEQRILSEGFIEANHLHRVTEQKTFFLSALDHAERRRQQLNETLKVSAPYSSHEILAILWDQISQTVERIRDLNVHNGFLLDQHIELNSQAIAFLKSHHSPSLYGADGQAHHNTALSGHKISV

SEQ ID NO: 7339 - protein, 99 aa, Xenorhabdus bovienii
  Peptide sequence Name=Xb4151_4152.C431.gene97.pep
  Gene classification: Gene name=FlgM; Function=Negative regulator of flagellin synthesis (anti-sigma-28 factor); Function class=K Transcription
  Homolog annotation: Query=1..96bp; Hit=1..95bp; Blast score=58; Percent Identity=46.0; E value=9e-10; Homolog= flgM COG2747
MSIECTQPLLAIAAVQQRNANEGAQSTRRTVAVAEKSADTQVKLSEAQKKLVQPSSQDINIQKVQQLKEAIAKGTLTMDSGKIADALFREALENMEYDK

SEQ ID NO: 7340 - protein, 223 aa, Xenorhabdus bovienii
  Peptide sequence Name=Xb4151_4152.C431.gene98.pep
  Gene classification: Gene name=FlgA; Function=Flagellar basal body P -ring biosynthesis protein; Function class=N Cell motility and secretion
  Homolog annotation: Query=16..223bp; Hit=12..219bp; Blast score=112; Percent Identity=33.0; E value=3e-25; Homolog= flgA COG1261
MPALKFIGFITFFLSSFLHSTLALAGNLPQSINNYFTQLHHNADQKVTVKIKTPEQQWPVCEFPEIQPSLSNRNWGSLSIPVTCGQQRRFIQVYVGVTGSYLMSNRAIQRNTVLTEKDFQVKTGALDKLPNDIIRNRKVIQNGIAIRNIPAGQFITRNMIRRPWAIRAGQNVVVIVDGHHFQVRYEGKAINNAASFDNIRVRLASGQVITGETQENGSVKMML

SEQ ID NO: 7341 - protein, 138 aa, Xenorhabdus bovienii
  Peptide sequence Name=Xb4151_4152.C431.gene99.pep
  Gene classification: Gene name=FlgB; Function=Flagellar basal body protein; Function class=N Cell motility and secretion
  Homolog annotation: Query=1..136bp; Hit=1..136bp; Blast score=145; Percent Identity=61.0; E value=1e-35; Homolog= ZflgB COG1815
MLDKLDAAFHFRQEALALRNQRQEILSANIANADTPGYQARDIDFAAQLKQVMAEGRVTGNGMKLRLASDRHIPAQSQNRLEMDLLYRVPYQTAMDGNTVDMDVERSHFADNSLKYQAELTMTNSQLKSMMSVLQSQG

SEQ ID NO: 7342 - protein, 170 aa, Xenorhabdus bovienii
  Peptide sequence Name=Xb4151_4152.C431.gene100.pep
LISPLFCGCCLFRVASSPTVELSNESLIEEVTAIMEFLLLTQSQRFQHDGFGGVKHFNVCLITAGSRDGIDHFPDDIHIWHTDITFFIRQWIARPVFKAERSGIIHNFTDTHATDLLPCRSRNAEDDLFSTVRLAIRPYNAIGIRHIAGADVQSLGLSRKCGASNIKNTE

SEQ ID NO: 7343 - protein, 231 aa, Xenorhabdus bovienii
  Peptide sequence Name=Xb4151_4152.C431.gene101.pep
  Gene classification: Gene name=FlgD; Function=Flagellar hook capping protein; Function class=N Cell motility and secretion
  Homolog annotation: Query=30..231bp; Hit=28..231bp; Blast score=198; Percent Identity=53.0; E value=4e-51; Homolog= ZflgD COG1843
MAVTSSINDSLDNSTVGELATLNKQQPQKSGDIKDNFLNLLVAQLKNQDPTNPMQNNELTTQLAQISTVQGVEKLNKTLGAVVGQMEGNQAMQTTMLIGRTVMIPGDKILVGSGEENGISTSPFGFELTRPADNIKITIRDKEGVVVREVEAEKVNVGVHKVQWDGKDADGKEVINGAYNFTVSASYQDQALVTLPLTSAEVNGVTRGEDGTKLDLGLAGTVTMDQVRQIL

SEQ ID NO: 7344 - protein, 416 aa, Xenorhabdus bovienii
  Peptide sequence Name=Xb4151_4152.C431.gene102.pep
  Gene classification: Gene name=FlgE; Function=Flagellar basal body and hook proteins; Function class=N Cell motility and secretion
  Homolog annotation: Query=1..416bp; Hit=1..402bp; Blast score=392; Percent Identity=56.0; E value=1e-109; Homolog= flgE COG1749
MAFSQAVSGLNAAASNLDVIGNNIANSATFGFKSSSAAFADVFSGSDVGLGVKVSGMVKNFKDGSTTTTSRQLDMAITQGGFFRMLDSNGSTFYSRNGQFNMDSDRNLINMQGMKLTGYPAVQGANGPEIQKGAAPGPISIPRDMLDAKATTNVTMTANLNSMNKKVDINPFNPSNKDSFNYSSGLSVYDSLGNEHNINVFFVKTNDNEWDIYAQDTSVPGSDHQKLNDKKVVEKEGESKSVLFSGNGKIIGNNNAFAFDMPGLNGSIGAPITIDFNNSKQQSISQDSISNQQQNGYAAGSFTNYRVDSDGKIHGLYSNQQTQVLGQVVLANFSNPEGLAAQGDNVWVETGASGSPIVGTAGSGNFGKLISGALEASNVDMSQELVNMIVAQRNYQSNAQTIKTQDQILQTLVSMR

SEQ ID NO: 7345 - protein, 251 aa, Xenorhabdus bovienii
  Peptide sequence Name=Xb4151_4152.C431.gene103.pep
  Gene classification: Gene name=FlgE; Function=Flagellar basal body and hook proteins; Function class=N Cell motility and secretion
  Homolog annotation: Query=1..251bp; Hit=1..251bp; Blast score=279; Percent Identity=62.0; E value=2e-75; Homolog= ZflgF COG1749
MDHVIYTAMGAARQTLEHQAVTANNLANASTPGFKAQLAALRSVPIEGETLPTRTLTVASTPGMDSRQGPMNYTSRPLDVAVGQGGFLAVQLDDGTEAYTRNGGIQMSPEGQLMVQGRMLMGENGPIDVPPQAELTIAADGAISALIASDPPTLLGQIGKLKIVKPEAGQVVRGDDGLFHLTPQAREQQGNELAASTEVKIMPGVLEGSNVNPVESMVNMIANARRFEMQMKVIHSSDENAQRANQILAMS

SEQ ID NO: 7346 - protein, 260 aa, Xenorhabdus bovienii
  Peptide sequence Name=Xb4151_4152.C431.gene104.pep
  Gene classification: Gene name=FlgE; Function=Flagellar basal body and hook proteins; Function class=N Cell motility and secretion
  Homolog annotation: Query=1..260bp; Hit=1..260bp; Blast score=390; Percent Identity=85.0; E value=1e-108; Homolog= flgG COG1749
MIRSLWIAKTGLDAQQTNMDVIANNLANVSTNGFKRQRAVFEDLLYQTERQPGAMSSEQTNLPSGLQIGTGVRPVATERLHSQGNLAQTNNSNDVAIKGQGFFQIQMPDGTTGYTRDGSFQKDQNGQLVTAGGFQVVPAIIIPDNATKMSIARDGIVSINVQGQNAPQQVGQLTLTTFINESGLESIGENLYLETNSSGVPVENAPGINGAGLLYQGYVETSNVNVAEELVNMIQVQRAYEINSKAVSTSDQMLQKLTQL

SEQ ID NO: 7347 - protein, 277 aa, Xenorhabdus bovienii
  Peptide sequence Name=Xb4151_4152.C431.gene105.pep
  Gene classification: Gene name=FlgH; Function=Flagellar basal body L -ring protein; Function class=N Cell motility and secretion
  Homolog annotation: Query=45..276bp; Hit=1..231bp; Blast score=302; Percent Identity=70.0; E value=3e-82; Homolog= flgH COG2063
MKGIIINQDSRGGNSPAISAINLRASKMDTMPVAENNVAYDSPGLRKNRGYKWRISMALAVLSLAGCAYMPHKPLVKGATTANPAEAPAPTPNGSIFQVSQPVYYGYQPLFEDRRPRNIGDTLTIILQENVSASKNSSANASRSGKTGFTAALTPRFLKGLMGGDKTDLSMEGDSEFGGKGGANANNTFRGTITVTVDRLLANGNLHAVGEKQIAINQGTEFIRFSGVVNPRTITGTNTVSSNQVADARIEYVGDGYINEAQTMGWLQRFFMNISPF

SEQ ID NO: 7348 - protein, 372 aa, Xenorhabdus bovienii
  Peptide sequence Name=Xb4151_4152.C431.gene106.pep
  Gene classification: Gene name=FlgI; Function=Flagellar basal-body P -ring protein; Function class=N Cell motility and secretion
  Homolog annotation: Query=8..372bp; Hit=1..365bp; Blast score=422; Percent Identity=71.0; E value=1e-118; Homolog= ZflgI COG1706
MEKLVASLFTLLLALSSIFVSGTASAERIRDLVTIEGVRDNALIGYGLVVGLDGTGDQTMQTPFTTQSLSNMLSQLGITVPPGTNMQLKNVAAVMVTAKLPPFARSGQNIDVVVSSLGNAKSLRGGTLLMTPLKGIDNQVYALAQGNILVGGAGVSAGGNSIKINQLAGGRISNGAVIERELPTQFGQKGTLNLQLNNDDFSLAEQISDAVNRLQGKGTATPLDSRTVQLRLPRENSEQVRFLSQIQNLNIRVDAGDAKVIFNSRTGSVVMNRNVTLDSCAIAHGSLSVTVERQTAVNQPNTPLAGGNTVVTRNTGVGIQEQGGALQQVNASANLTQVVRALNVLGATPTDLMSILQAMETAGCLRAKLEII

SEQ ID NO: 7349 - protein, 321 aa, Xenorhabdus bovienii
  Peptide sequence Name=Xb4151_4152.C431.gene107.pep
  Gene classification: Gene name=FlgJ; Function=Flagellum-specific muramidase; Function class=N Cell motility and secretion
  Homolog annotation: Query=1..321bp; Hit=2..313bp; Blast score=307; Percent Identity=53.0; E value=9e-84; Homolog= ZflgJ COG1705
MSDFLTTPTAAYDVNSLHSLKAKLSQEPQQGLRQVAQELEGVFVQMMLKSMRSSLPQDGILSSDQTRFYTSMYDQQIAQDLSQKGLGFADMIVKQFSNANNVASEQAGTVPMPLDKEFLQTLPKQALEQFMRRTMTAPFSSAASKGSVQSKSLPVSSTDFVSMLSLPAQIASQQSGIPHLLIIAQAALESGWGQREILTEEGKPSHNLFGIKAGKHWKGAVTNIMTTEYIEGEPKKMHDSFRVYGSYREAITDYVKLLTENPRYAKVAQSTTAEQGAYSLQSAGYATDPGYAKKLVSLIQQLKSTGNQMVKAYTDDFDNLF

SEQ ID NO: 7350 - protein, 60 aa, Xenorhabdus bovienii
  Peptide sequence Name=Xb4151_4152.C431.gene108.pep
MLLPTTPIATCAALIPLMAVFIRLLDMCRSFYVFVMPPSWEVIHCYSYRQYSLILEQKRR

SEQ ID NO: 7351 - protein, 546 aa, Xenorhabdus bovienii
  Peptide sequence Name=Xb4151_4152.C431.gene109.pep
  Gene classification: Gene name=FlgK; Function=Flagellar hook -associated protein; Function class=N Cell motility and secretion
  Homolog annotation: Query=3..546bp; Hit=2..547bp; Blast score=420; Percent Identity=44.0; E value=1e-117; Homolog= flgK COG1256
MSNSLMNTAMSGINAAQVAMGVVGNNIANSKNVGYNRQTTVLTQNNGTLSPAGFIGNGVAVSSINREYSEFINQQHSSAQTKHAALTAYNQQITKINDLLADKDTSLSNSIEEFFKSLGAAESNAEDSAARTTVLGKAEGLVSRFKEADEFLRQIDNSINSQIEQNAREINKYAEEVATLNNEITRMRGTGTGEPLALLDKRDEAVNKLNQLVDVNVTQQDGGVYNVSFGGGMSLVSGSKSYRLEAISSSTDSSRITLGYNNGTVGTKEIDERFISQGTLGGALQVRREVVDSSRNQLNQLALVMADQFNQVQNGGFDLKGKPGVDFFNFTKPDVISNSNNKGTADIKVEYADTTKVKNSDYTLKYEGGDWKVQRVSDKAAVPVTKNGNALEFDGLKVEIDAAHSQDHDTYTLKTVSNVVATLEVNLQDSSQLATAGDKDAGPSDNRNAKKFLALQDQRLIDGKSSFAGAYASLVSQVGSKANEAQVSVETQGHIVDKLYATRESISGVNMDEEYGAMQRLQQYYLANARVIQTAATLFDAILGIR

SEQ ID NO: 7352 - protein, 320 aa, Xenorhabdus bovienii
  Peptide sequence Name=Xb4151_4152.C431.gene110.pep
  Gene classification: Gene name=FlgL; Function=Flagellin and related hook-associated proteins; Function class=N Cell motility and secretion
  Homolog annotation: Query=1..318bp; Hit=1..315bp; Blast score=300; Percent Identity=52.0; E value=1e-81; Homolog= flgL COG1344
VRVSTNLLYSQKMDGILGAQSKWMRYGEQLSTGKRVINPSDDPLAASQSIMVSQSESKNQQFMTARIFARNSMSAQLSITSNIVSVATNVFETLVAAADEQSDQDRESYAQQLEGFKQQLLNLGNKTDGNGRYIFGGYKTDVPPFKADESGKIHYKGGHEEITQQVDDNRSMIIAHTGKQVFLSTTTNPIKEPGGGTGEADVFATLDLAIKALRTPYSTASESEKNDAMELINKANRGIRNSLDNFSSVEAVLGLQLQELEQLDSLGSERSISNKVRTGELVDVDWASSISSYYQQQAALQASYKAFTDLKGLSLFEMYR

SEQ ID NO: 7353 - protein, 47 aa, Xenorhabdus bovienii
  Peptide sequence Name=Xb4151_4152.C431.gene111.pep
MGKWVLDALWSVYCLSIGDVLMHLIFLWYFFSRIQPVITNHIQDLKQ

SEQ ID NO: 7354 - protein, 48 aa, Xenorhabdus bovienii
  Peptide sequence Name=Xb4151_4152.C431.gene112.pep
MRFINAHWKAICCKEMSLKNCINWCFIAIIVTGFIRGFDMSLATIIRS

SEQ ID NO: 7355 - protein, 261 aa, Xenorhabdus bovienii
  Peptide sequence Name=Xb4151_4152.C431.gene113.pep
  Gene classification: Function=Predicted transposase; Function class=L DNA replication, recombination and repair
  Homolog annotation: Query=9..242bp; Hit=13..240bp; Blast score=69; Percent Identity=23.0; E value=4e-12; Homolog= VNG7059 COG3385
MQFFSDISLQHIAFQCAFMKRIRNIEPHVLILSLIAALSTGKITSIAQLHQKFNGLCPDKKQPVSYRPFYNQLRKAAFVEFVKILVRFAMAQWVEKQVSSPQKLMKFKQVILQDGSSFKVHSALADVFPYRFRTTGAAVECHMTMSLLTQSPVKMTVTADTAPERAYLPVPAMLRDQLLLADAGYVDFAYFEQVSLSGGSFIVRGSKSLNPQIVVARNGQGKLLPKLLNKPLKSITRRTNRSEGQCRVNGGKLAKVVLPVI

SEQ ID NO: 7356 - protein, 200 aa, Xenorhabdus bovienii
  Peptide sequence Name=Xb4151_4152.C431.gene114.pep
MLILPFAYHVNQFDAGQERLCPAKRFEPQHLSYPTFDIAVILLNQIIQVFILPDFNPLLRRSFRIEESERGSIGPTFIDSHDGGSAVLAYRFTEKTLGSHCIAASGQQEVNRLTVGIDRPVKVFPLTFHFDIRFIHSPPGATGSQRAFCEVGKPCRAGAPDVTPNDVLWHGRPQCRALPSSLRDCADSRHKRGTNGHIGP

SEQ ID NO: 7357 - protein, 77 aa, Xenorhabdus bovienii
  Peptide sequence Name=Xb4151_4152.C431.gene115.pep
MYCGMVDLNAALCHHLFEIAQTQGISEVPTDTLGHDIDRIMEAFKRVSDQGHHSGLAQKQGSLPDDRLMRQNRQTSM

SEQ ID NO: 7358 - protein, 49 aa, Xenorhabdus bovienii
  Peptide sequence Name=Xb4151_4152.C431.gene116.pep
VRAVPVPRCWSVSALNTSRIFSKKCQGLSCHNGAYGCSTREVSTSTDKY

SEQ ID NO: 7359 - protein, 49 aa, Xenorhabdus bovienii
  Peptide sequence Name=Xb4151_4152.C431.gene117.pep
MGRTAVVLGRFPPLLTSTDSFILPTKSVRFYLSEPNRRPWVVRVIQFLP

SEQ ID NO: 7360 - protein, 8103 aa, Xenorhabdus bovienii
  Peptide sequence Name=Xb4151_4152.C431.gene118.pep
  Gene classification: Gene name=EntF; Function=Non-ribosomal peptide synthetase modules and related proteins; Function class=Q Secondary metabolites biosynthesis, transport and catabolism
  Homolog annotation: Query=1929..3221bp; Hit=1..1285bp; Blast score =901; Percent Identity=43.0; E value=0; Homolog= PA2400 COG1020
MIRNDMNLDNLKRAVLKKKIKQQLQTQQQQRPSIKQVDRNLPLPLSFAQQRLWFLAQLDPAASLAYHIPVALRLTGQLDRPSLTTALDHLIARHESLRTRFVLVEGQPCQHIDPADIGFTLSCQDLRPLEPAMHNNRIAELASLEAQIPFDFTQGPLIRGQLLQLTEETHVLLLTQHHIIADGWSIGVLVHELGTLYRAALDGHDDPLPPLPIQYADYAVWQRNWLQGDILTEQRDFWCSQLQGAPALLALPSDRPRPPVQRYAGGQIPFQLDATLLASLKELGQRHNTTLFMTVLTAWSIVLTRLSGQDDIVIGTPVANRPRHELENQIGFFVNTLALRVTPGDTSRVTDLLAQVRERALAAYAHQDLPFEQVVEALQPDRSLSYSPVFQVMLTLNNTPAQNWALPGLQLTPVEQVRYGAHFDLTLSLTETEMGLIGDLEYAADLFDPATVERMVSYLENVLAAMAADATQVLANLPMLPFSERQQLLVDFNATRADFPQNALIHQLFEAQAVHNPDVTAVVCGEHTLSYDELNHRANRLAHYLIALGVRPDDRVAICLERSPDMIVSLLAILKAGGAYVPLDPTYPAERLAYMLNDAAPVALLTQTTWIDMLSSAIPTVVLDAPESSMTTRSAYNPEPQVLGLTSRHLAYVIYTSGSTGQPKGVAITHRNTVNFLTWAQRTFSPEELAHTLFATSLNFDLAVYECFVPLIAGGTVHLVPDALSLITTAQPVSLINTVPSAIAHLIEAKAVPMTARTVNLAGEALKPHVIEHLFADTSVQDVCNLYGPSETTTYSTWIRMNRTEGFASHIGRPIANTRIYILDAYSQPVPLGVTGEIHIAGAGVARGYLNRPELTAERFLADPFSADPDARMYKTGDLGRWRPDGNIDYLGRNDFQVKLRGFRIELGEIEAQLMQCSGVREAVVLAREDQPGHKRLVAYLRPQNSVELVPAELRQQLARHLAEYMLPSAFMTLDAFPLTPNGKLDRQALPVPDLSAVVARGYEAPLGEMETALAQIWQDLLQLEQVGRHDHFFELGGHSLMIVNLIERLHGLGWRLDVRSVFATPILTEMAQAIQGDTNAFVVPPNRIPEDCTALTPDMLSLVSLSQAEIDAIVDAIPGGASNVQDIYPLAPLQEGILFHYLLQTQGDAYLLQSLLAFDSRERLDTFLTALQQIIDRHDILRTAVCWQGLAQPVQVVWRQAPLCVNRFTPTTADDVPAQLLSHTDPRRHRLDLSRAPLFAGDIAHNPAQDEWLLALRFHHLVSDHMTLELIFAEVAQVLQGQAGTLPTALPYRNFVAQTLSVPAAVHEAYFRAQLADVDTPTAPFGVLTMPGDNEPVTENRLSLTPALAEAIRTQSRRLGVSPGVLFHVAWAQVLAQTSGHDDVVFGSVLLGRLLGVAGADRILGMFINTLPVRVSLAGRSVQEVVQATYRDLMTLLEHEQAPLALAQRCSGVTQSMPLFSTLLNYRHSQTSTADAVNTSWAGMHVVAVEEQSNYPLTLSVDDLGIGFHLTAQAVAGIDPARVTAYLVTAISGLVDALIREPQRLIQDVPILPPSERQQLLVEFNATQTDFPQDALIHQLFEAQAARNPDATAVVYEDQILSYGELNRRANRLAHHLIALGVCPDDRVAICVERSPELVVGLFAILKAGGAYVPLDPAYPAERLTYMLDDAAPVVLLTQTTLIDTLTSPVPTIILDGQEPFLMTQSAHNPDAQALGLTSRHLAYIIYTSGSTGLPKGVMVEHRGLSNLIATQQDTLAIKPDSRILQFASNSFDAGIWECGMALLAGASLHLAQRTHLLPGAALLNTLETHAITHVLLSPTALAALDSVPVTLQTLIVGGEACSPALVKRWAEGRRMVNAYGPTESTVCAAIYLCDNQEEGAPPIGQPIANTRIYILDSYGQPVPLGVAGEIHIAGAGIARGYLNRPELTAERFLADPFSADPDARMYKTGDLGRWRPDGNIDYLGRNDFQVKLRGFRIEPGEIEAQLVQCSGVREAVVLTREDEPDHKRLIAYLLPQSDVKLVPAELRQQLSQHLAEYMLPSAFVTLDAFPLSPNGKLDRQALPAPDPSAIVTRGYETPVGKVEITLSQIWQDLLRLEQVGRHDHFFELGGHSLLAVQLVARVRQDLARELPLQQIFAHPLLAELAQTLTGTSATTQVAIPAADHSRPLPLSFAQQRLWFLGQLDPAASLAYHIPLALRLTGQLDRHALITALNRLVVRQESLRTRFILIDGQPCLHIDPADIGFTLSCQDLRPLESAAQTHRVAELANLEAQTPFDFTQGPLIRGQLLQLADEEHVLLLTQHHIMADGWSISVLVHELGALYRAVLDGHSDLLPPLPIQYADYAVWQRDWLQGTVLAEQRDFWCAQLRDAPTFLELPTDRPRPSVQTYAGDRVPFRLDATLLTSLKGLGQRHNTTLFMTVLTAWSIVLARLSGQDDIVIGTPVANRPHRELENLIGFFVNTLALRVTPDDGLRVADLLAQVRERALAAYAHQDLPFEQVVEALQPDRSLSYSPVFQVMLTLNNTPPQDLSLPGLQLTPLEQVRHSAHFDLTLSLTETEAGLVGELEYATDLFDPATVERIVGYLKNVLTEMVVDATQTIADLPMLSASERQQLLTGFNAIQVDFPQSTLIHQRFEIQAAHSPDATAVVFEDQTLSYGELNRRANRLAHRLITLGVRPDDRVAICVERGLELVVGLLAILKAGGAYVPLDPAYPAERLAYMLHDATPVALLTQTTQVDMLTSYSPALLPTIVFDAQDASLMAQPDHNPDTQALGLTSRHLAYVIYTSGSTGLPKGVMVEHAHVTRLLAATQERFRFDSNDVWTLFHSFAFDFSVWELWGALSHGGRLIVVPTDCTRSPQAFYALLCREQVTVLNQTPSAFRPLISAQNATPHSLRCIIFGGEALELHTLAPWVTRNPTRQTRLVNMYGITEITVHATYRELTESDITLGRGSLIGQPLPDLRVYILNPHGQPVPLGVTGEIHITGAGVARGYLNRPELTAERFLADPFSSDPDVRMYKTGDLGRWLPDGHLEYLGRNDFQVKLRGFRIELGEIESRLVQCHGVREAVVLAREDEPGNKRLVAYLLPQTDAELMPAELRQQLAQHLAEYMLPSAFVTLDAFPLTPNGKLDRQALPVPDASAVVVRGYEAPLGEMETALAQIWQNLLGLEQVGRHDHFFELGGHSLMIVSLIEELRGLGWRLEVRSVFAAPVLAEMAQTIRSDTDAFVVPTNRIPEGCTALTPDMLPLVTLSQAEIDAITDVIPGGATNVQDIYPLAPLQEGILFHHLLQTQGDDYLLQSLLAFDSCERLDTFLAALQQVIDRHDILRTAACWQGLVQPVQVVWRQAPLWVNHFTPDTADDVPAQLRAHTDPRLHRLDLSRAPLFAADIAHDPAQDEWLLALRFHHLVSDHMTLELIFAEIALLLQGHAEKLTTALPYRNFIAQTLSIPTAVHEAYFRDQLADVDEPTVPFGVLKVQADGEPVTEARLPLVPALAEAIRVQARRLGVSPGVLFHVAWAQVLAQTSGRDDVVFGSVLLGRLQGGAGADRILGMFINTLPVRVSLADHSVQAVVQATYRSLTMLLEHEQAPLALAQRCSGMAQSIPLFSTLLNYRHNQAGKADTAETTWAGMRILTTEERTNYPVTLSVDDLGTGFHLTAQTVTGIDPTRVTAYLATAISGLIDALTHNPQQLIRDVPILPPAERQQLLVNFNATQTHFPQNALIHQLFESQVAYKPDATAVVFEDQTLSYGELNCRANQLAHHLIALGVRPDDRVAICLERSLELVVGLLAILKAGGAYVPLDPAYPAERLAYMLDDAAPVVLLTQTAWVDTLVSPVTTSVPIIVLDAQEPAVAAQPTHNPEPQTLGLTSRHLAYVIYTSGSTGLSKGVMVEHRNVLRLIINNGFADIGSDDCIAHCANIAFDASTWEIWSALLNGGRLYVVPPSVLLDPVRFCDSLIKGQVTALWLTAGLFNEYLSDLNPLLGRLRYLLIGGDVLDPRKIQRAQLAESQPAHLINGYGPTETTTFATTYRIASPVDVAHSIPIGRPIANTRIYILDCHNQPVPLGVAGEIYIAGAGVARGYLNRPELTAERFVPDTFSADPDERMYKTGDLGRWLFDGNIDYLGRNDYQVKLRGFRIEPGEVEARLVQCHGVREAVVLAREDEPGYKRLVAYLLPQTGVELVPAELRQQLSQHLAEYMLPSAFMTLDVFPLTPNGKLDRQSLPVPDSSAVVIRGYEPPQGRIETALAQIWQDLLGLEQVGRHDHFFELGGHSLLAVQLAARVRQDLARELPLQQLFAQPILTDLAHALTGASVTTQVIIPVADRSQLLPLSFAQQRLWFLGQLDPAASQAYHIPAALRLTGSLNRHALTTALDHLVARQESLRTRFILVEGQPCQHIDPADSGFALSCQDLRPLDSAVRNNRVTELAALEAQTPFDFIRGPLIRGQLLQLTDEEHVLLLTQHHIIADGWSIGVLVHELVALYRAALDGHSDPLPPLPIQYADYAVWQRNGLQGAILTEQHDFWSSQLQGAPALLTLPTDRPRPPVQSYAGGRVPLHLDATLLASLKGLGQRHNTTLFMTVLTAWGIVLARLSGQDDIVVGTPVANRQHREFEGLIGFFVNTLALRVTPGDTPRVSDLLAQVRERALAAYAHQDLPFEQVVEALQPDRSLSYSPVFQVMLALNNTPSQDLSLPGLQLTPVEQVRYGAHFDLMLSLTETEAGLVGDLEYAADLFDPATVERMVGYLTHVLVAMAADTTQTIASLPMLPPAERQQLLVNFNATQTDLPQDTLIHPLFETQAALHPTDTAVVYGDQALSYDELNRRANQLAHHLINLGVRPDDRVAICVERSLEMVVGLLAILKAGGAYVPLDPAYPTERLTYMLDDAAPVVLLTQMAWVDTLNSAIPTVVLDTQEPFMESQPTHNPEAQTLGLTSHHLAYVIYTSGSTGQPKGVMSSHHALCNRLLWFVRDIVTPPLVAALKTSISFVDSVTETLGVLLAGGKLVVFDNHEVKDLTRFGEGLRRAEVNYMVVVPSLLKLLIEGSGDSLKSIRTLICSGERLAPELARQVVTDYPCIHLLNFYGSSEINGDATWYEYSATVGVPDVSVIGRPIANTQSYILDPHGQPVPLGVTGEIHIAGAGVARGYLNRPELTAERFLADPFSSDPDARMYKTGDLGRWLPDGHIEYLGRNDFQVKLRGFRIELGEIEAKLVQCHGVCEAVVLAREDEPGHKRLVAYLLPQTGVELVPAELRLQLSRQLAEYMLPSAFMTLKAFPLTQNGKLDRQALPAPDPSAVVTRNYEAPVGEVENALAQIWQNLLGLERVGRHDHFFELGGHSLMIVSLIGRLRGFGWRLDVRSVFAAPVLAELAQTILIHQDAADAFVVPPNRIPAGCTALTPDMLALVSLSQAEIDVIVSMIPGGASNVQDIYPLAPLQEGILFHHLLQTQGDAYLLQTLLAFETRQHLDAFLAALQQVIDRHDILRTAACWQGLTEPVQVVWRQAPLWVNHFTPTTADDVPAQLRAHTDPHQHRLDLNRAPLFAADIAHDPAQDEWLLALRFHHLVSDQMTLALIFAEIALLLQGHAQKLPAALPYRDFIAQILSVPDTVHEAYFLSQLADVDEPTAPFGVLKVQGDGEPVTEARLLLPPNLAEAIRAQARRLGVSPSVLFHLAWGQVLAQTSSRDDVIFGSVLLGRLQGGAGADRVLGMFINTLPMRISLADCSVQEAVQATYRSLTMLLEHEQAPLALAQRCSGVAQPMPLFSALLNYRHSQADEAGALDTIWAGMRIVATEGRTNYPVTLSVDDQGVGFRLTAQTVTSIDPARVTTYLATALSGLVKALASDPQQPILQVPILPASERQQLLTGFNAIQVDFPQSALIHQRFETQAAHSPDATAVVFENQTLSYGELNRRANRLAHRLITLGVRPDDRVAICVERGPELVVGLLAILKAGGAYVPLDPAYPAERLAYMLHDATPVALLTQTTQVDMLTSYFPALLPTIVFDAQDASLMAQPDHNPDTQALGLTSRHLAYVIYTSGSTGLPKGVMVEHAHVTRLLAATQERFRFGGNDVWTLFHSFAFDFSVWELWGALSHGGRLIVVPTDCLRSPQAFYALLCRERVTVLNQTPSAFRPLISAQNATPHSLRCIIFGGEALELHTLAPWVARNPTRQTRLVNMYGITEITVHATYRELTESDITLGRGSLIGQPLPDLRAYILGTHGQPVPLGVTGEIYITGAGVARGYLNRPELTAERFLADPFSSDPDARMYKTGDLGRWLPDGHLEYLGRNDFQVKLRGFRIEPGEIETQLVQCPGVREAVVLAREDEPGQKRLVAYLRPQDGVELVPAELHQQLTQHLAEYMLPSAFMTLDAFPLTPNGKLDRQALPAPDASAVVTRGYEAPVGEVETALAQIWQNLLGLERIGRHDHFFELGGHSLMIVSLIERLRGLGWQLDVRSVFSVPVLTDMAQAILKSQSGADTFVVPPNRIPEDCTALTPDMLPLVSLSQAEIDAIADAIPGGVTHVQDIYPLAPLQEGILFHHLLQPNRDPYVISSLLSVENQTKLDAFIAALQAVIDRHDILRTSIHWLGLSQPVQVVHRHAPLPVNVLTFDDDSDVVASMQARMALSHQHMDLSHAPLIRLQVATEPHSAKLYVLFQLHHIIDDNLSLRCLLAETTAFLMGLGADLQPSVPYRNFVAYARQEGKTQEAEAFFRTFLADIDEATAPFGLADVQGNGEHNAAARKVLDVELSQAIRKTARRFGTNPAILFHAAWALVIARTSGRDDIVFGTVLSGRMSGVDGSARALGMFINTLPLRLKLKGSSVDELVKMTNDACASLLLYEQTPLSLAQRCSGLGGISLFSALLNFRHGNDKNTRTPSLDLFGLASLDSCERTNYPFEMSIDDDGEYFVLSAQTVNNIDPNRINTYLTRAIEQLISILVEAPDTPALDLDVLPEDERQQLLVNFNATQADFPQDALIHQLFEVQAAYNPDATAVVCGEQALSYGELNHRANRLAHHLIALGVRPDDRVAICLTRSPEMVVGLLAILKAGGAYVPLDPAYPTERLAYMLNDAAPVALLTQTAWVNMLVSPVPTVVLDAQEPVMAAQPIHNPEPQTLGLTSRHLAYVIYTSGSTGLPKGVTIAHCNTVNFLIWAQRTFSPEELANTLFATSLNFDLAVYECFAPLVSGGTVHLVPDALSLVTTEQPVSLINTVPSAIAHLIEANAIPLTARTVNLAGEALKPQVVEHLFAHSSVQNVCNLYGPSETTTYSTWIRMNRTEGFVSHIGRPIANTQIYILNPHGQPVPLGVAGEIHIAGAGVARGYLNRPELTTERFLIDPFSSAPDARMYKTGDLGRWLSDGNIEYLGRNDFQVKLRGFRIELGEIEAQLMQCHGVREAVVLAREDEPSQKRLVAYVRPQASVELVPAELRQQLARHLAEYMLPSAFMTLDAFPLTPNGKLDRQALPAPDSSAVVARGYQAPVGAAETTLAQIWQDLLGLERVGRHDHFFELGGHSLLAVQLLNRMREQDMAVPLTVLFVHPTLSDLAIAIGERFAQSTSPFDANPVPLNPTGGLPPLFLIHETSGDPLVYSPLAALLPSELPVYALQALGIHTLEHPPASLEALAACHIQAIRRVQPQGPYHLAGWSIGGLIAYEMAQQFMSCGETVGFLGMIDSYNSINGLQISTDQPIDKEAKRIEIIIDSLRAQIGTSDEQVLEELHDLSDVNQILDRCIEHQWLPASITREDILLRLYTAEIITQLGQDYIAPKSPLPIHLYTADEALNGEIWHGWRNIVGTDSTLHAIGGTHFSIMRPPSLNQIVDSLTEHLLPAPPYDPRVIIQSGSRSVPPLFCMPGAGASASSLLGLALSLPQQLPVYALQTRGLGLTDKHNFPYVSVEGAAHAYIQIIRQTQPHGPYHLLGHSFGGWIAFEMALQLQAEGEQVSDLILVDTDEPDPQGSIPKSVNRTETIMKLIEIYNMILDRPLPLTKPDFDDLTPNEQFQYLLSALVNAGLFLAKTPISLLQGVVRVMQANLNTCYTPRARYEGLVHLISAEEGDVEETKTREALWSTHAAQLSTMHVPGNHMTMLSSPQIEHFVTGLWQKLDYANNPRSTVWFG

SEQ ID NO: 7361 - protein, 2210 aa, Xenorhabdus bovienii
  Peptide sequence Name=Xb4151_4152.C431.gene119.pep
  Gene classification: Gene name=EntF; Function=Non-ribosomal peptide synthetase modules and related proteins; Function class=Q Secondary metabolites biosynthesis, transport and catabolism
  Homolog annotation: Query=43..1061bp; Hit=2..1020bp; Blast score=763; Percent Identity=44.0; E value=0; Homolog= PA2399_2 COG1020
MTRINMNLDDLKRAVLEKKIEEQLKARGGQQQRPLIEQVNRHQPLPLSFAQQRLWFLSQLDPAASLAYHMSVVLRLTGQLNRDALTTALNHLVVRHESLRTRFVLVEGQPCQHIDPTDVNFALSCQDLRPLNPAMHTRRIAELSALEAQTPFDFVRGPLIRGQLLQLTDESHMLLLTQHHIIADAWSVGVLVHELGALYRAALNGHSDPLPPLPIQYADYAVWQRNGLQETVLTEQRGFWCTQLQGAPTLLTLPTDRPRPSVQTYVGDQVSFQLDSTLLASLKELGQRHHTTLFMTVLTAWSIVLTRLSGQDDIVIGTPVANRPHQELEGLIGFFVNTLALRVTPGDAFRVSDLLAQIRERALAAYAHQDLPFEQVVEALQPERSLSYSPIFQVMLTLNNTPAQDLALPGLQLSLVEQARYSAHFDLTLSLTETETGLTGDLEYASDLFDPTTAERMIEYFKQVLTAMAADATQTIARLPILPASERQQLLNDFNATQADFPQDALIHQLFEAQAAHSPDATAVVFEDQTLSYGELNRRANRLAHHLIALGVRPDDRVAICIERSPELVVGLLAILKAGGAYVPLDPDYPAERLAYMLDDAAPVALLSLTAQVGKLASPVPTVVLDAQKLSLTAQPSHNPDAQALGLTSRHLAYVIYTSGSTGLPKGVMVEHRNVLRLIINNGFADIGPDDCIAHCANVSFDAATWEVWTGLVHGARILLIPEKTLLQPDYFGQCLSSEGVSALFLTTALFNQYASLIAPSLSGLRYVLFGGEQADIRPAIRLRTDYPPQHLLHVYGPTETTTFATAYEIPLTESEYGKIPIGQPIANTRIYILDTQGQPVPLGVAGEIYIAGAGVARGYLNRPELTAECFLTDPFSADPDARMYKTGDLGRWLSDGNIEYLSRNDFQVKLRGFRIELGEIEARLVQCHGVREAVVLVREDELSHKRLVAYLRPLGGVELVPAELRQQLARHLAEYMLPSAFMTLDAFPLTPNGKLDRQALPAPDSSAVVARGYKAPVGEVEAALTQIWQDLLGLTQVGRHDHFFELGGHSLMIVSLIERLRGLGWRLDVRSVFAAPVLAEMAKTILAHQDDTDTFVVPPNHIPEGCTSLTPDMLSLISLSQAEIDSLISSIPGGASNVQDIYPLAPLQEGILFHHLMQAQGDTYLLQSLIAFGTRERLDTFLTALQQVIDRHDILRTAACWQGLSQPVQVVWRQAPLCINRFTPTMADDVPAQLLAHTDPRRHRLDLNRAPLFAADIAHDPAQNEWLLVLRFHHLVSDHMTLELIFAEIAQILQGQTETLPTALPYRDFIAQTLNVPAAVHEAYFSAQLADVDAPTAPFGMLTITDDSESIAEARLPLPPDLAEAVRTRARRLGVSPSVLFHVAWAQVLAQTSGRDDVVFGSVLLGRLQGSAGADRVLGMFINTLPVRIPLASRNVQAVVQATYHNLMTLLEHEQAPLTLAQRCSGVAQPMPLFSALLNYRHSQIGEAEAVDTTWAGMRIIATKERTNYPLTLSVDDLGADFYLTAQAVAGIDPARVIAYLVNAIRGLVDALAHDPQQLILDVPLLPPAERQQLLVDFNATETDFPQDALIHQLFEAQAAIRPAATAVVYEDRTMSYDELNRRANRLAHHLIALGVRPDDRVAICLERCPELVVGLLAILKAGGAYVPLDPTYPADRLVYMLNDAAPVALLTQAAWIDRLDSPVPAVVLDTQESSLAAQPDYNPDAQALGLTSRHLAYVIYTSGSTGLPKGVMVEHRNVLRLIINNGFADIGPDDCIAHCANVSFDAATWEVWTGLVHGARILLIPEKTLLQPDSFGQQLASESVSALFLTTALFNQYASLIAPSLSGLRYVLFGGEQADIRPVINLRADYPPQHLLHVYGPTETTTFATAYEIPFTKGEYGKIPIGHPIANTRIYILDTQGQPVPLGVTGEIHIAGAGVARGYLNRPELTAECFLTDPFAADPGTRMYKTGDLGRWLPDGNIEYFGRNDFQVKLRGFRIELGEIEARLVQCHGVREAVVLVREDEPDNKRLVAYLRPLDGVELVPAELRQQLAQHLAEYMLPSAFMVLDAFPLTPNGKLNRQALPAPDASAVVVRGYEAPLGEEEITLAQIWQDLLGLERVGRHDHFFELGGHSLMAVQLTTRIQTEFLVDIPIASLFLSPKLAEQANIILSAQMDAIGENDIESIQNSLDLMSTEELMAILGGDSNQ

SEQ ID NO: 7362 - protein, 3537 aa, Xenorhabdus bovienii
  Peptide sequence Name=Xb4151_4152.C431.gene120.pep
  Gene classification: Gene name=EntF; Function=Non-ribosomal peptide synthetase modules and related proteins; Function class=Q Secondary metabolites biosynthesis, transport and catabolism
  Homolog annotation: Query=1137..2422bp; Hit=1..1285bp; Blast score =890; Percent Identity=42.0; E value=0; Homolog= PA2400 COG1020
MSRAEGFVSHIGRPIANTQIYILDGYGQPVPLGVTGEIYIAGAGVARGYLNRPELTAEHFLTDPFSADPDARMYKTGDLGRWRSDGNLDYLGRNDFQVKLRGFRIELGEIEAQLMQCYGVREAVVLAREDEPGQKRLIAYLRPLDGAELLPAELRQQLARHLAEYMLPSAFVMLEAFPLTPNGKLDRQALPAPDLSAVVARGYEVPIGEAETILAQIWQDLLGLEQIGRHDHFFELGGHSLMIVSLIERLRGFGWWLGVRSVFAAPILAEMAQAVQGDASAFVIPPNRIPENCTTLTPDMLSLVSLSQAEIKVIVEATPGGAGNVQDIYPLAPLQEGILFHHLLQTQGDTYLLQSLLAFNSHEHLDTFLAALQQVIDRHDILRTAACWQGLAQPVQVVWRQAPLCVNRFTPATEDDIPAQLSAHTDPRRHRLDLSRAPLFAADIAHDPVQDEWLLALRFHHLVSDHMTLEHIFAEIAQIQQGQAESLPAALPYRNFIAQTLSVPVAAHEAYFRAQLADVDAPTAPFGVLTIRNDRESITEARLPLTSTLAEAIRAAARRLGVSPGVLFHVAWAQVLAQISGRDDVVFGSVLLGRLQGGAGADRILGMFINTLPVRISLAGRSVQAVVQSTYRSLTTLLEHEQAPLALAQRCSGMAQSIPLFSTLLNYRHSQTSESDAVETSRAGMRIVATEERTNYPLILSVDDLGAGFHLTAQAVAGIDPTRVTAYLVTAISGLVDALILDPQRWIQDVPILPPSERQQLLMDFNATQTDFPQDALIHQLFEVQAARYPDAIAVVFEDQRLSYGELNRRANRLAHHLIALGVRPDDRVAICLERSLELVVGLLGILKSGGAYVPLDPTYPAERLAYMLDDAAPVALLTQTTQADMLVHSVPTVVLDGSEPAMAVQPTHNPDVQALGLTSRHLAYVIYTSGSTGLPKGVMVEHRNVLRLIINNGFADIGPDDCIAHCANVSFDAATWEVWTGLVHGARILLIPEKTLLQPDYFGQCLASEGVSALFLTTALFNQYASLIASSLSGLRYVLFGGEQIDIRPAIHLRADYPPQHLLHVYGPTETTTFATAYEIPFTESEWKTIPIGQPIANTRIYILDTQGQPVPLGVAGEIHIAGAGVARGYLNRPELTAERFLTDPFSSDLDARMYKTGDLGYWRPDGNIEYLGRNDLQVKLRGFRIELGEIEARLVQCHGVREAVVLAREDEPGHKRLVAYLLPQAGVELVPAELRQQLSRHIAEYMLPSAFMMLDAFPLTPNGKIDRPAFPVPDQSAIVMRGYANPIGETETALAQIWQDLLGLEQVGRHDHFFELGGHSLLAVQLVARVRQDLARELPLQQLFDLPILTDLAQALSGAATTTQVVIPAADRNRPLPLSFAQQRLWFLGQLDPAASLAYHIPVALRLTGQLDRHALTTALERLIARHESLRTGFVLIEGQPCQHIAPADIGFALLYQDLRPLEPAMHTPRIAELASLEAQTLFDFAQGSLIRGQLLQLTDEAHLLLLTLHHIISDGWSIGVLIHELNALYRAALDGHDDPLPPLSLQYADYAVWQRDWLQGAALTEQRDFWYSQLQDAPALLTLPTDRPRPSVQTYAGGRVSFQFDAALLASLKGLGQRHNTTLFMTVLTAWGIVLARLSGQDDIVIGTPVANRPHRELENLIGFFVNTLALRVTFSDTTRVAGLLAQVRECALDAYAHQDLPFEQVVEALQPERNLSYSPVFQVMLALNNTPAQNLILPGLQLASIEQTHHSAHFDLTLSLTETESGLAGDLEYAADLFDSATVERMVGYLENVLTAMASDATQTIAGLPMLSTPERQQLLVDFNTTQTDFPQDALIHQLFEAQAAQRPDATAVVFEDQVLSYDELNRRANRLAHHLITLGVRPDDRVAICLERSLELVVGLLAILKAGGAYVPLDPAYPTERLAYMLNDAAPVALLTQAAQVGTLASTVPTVVLDGQDASLMAQPTHNPDTQALGLTSRHLAYVIYTSGSTGLPKGVMVEHRNVLRLIINNGFADIGSDDCIAHCANIAFDASTWEIWSALLNGGRLHVVSPSVLFDPVRFRDSLIKGQVTALWLTVGLFNEYLSDIQPLFGQLRYLLIGGDVLDPQKIRRTQLSEFQPAHLINGYGPTETTTFAVTYTIASPVDVTRSIPIGRPIANTRIYILDSLGQPVPFGVAGEIHIAGAGVARGYLNRPELTAERFLADPFSSDPDARMYRTGDLGRWRPDGNIDYLGRNDFQVKLRGFRIELGEIESRLTQCHGVREAVVLAHEDETGHKRLVAYLLPQTGIELVPAELRQQLAQHLAEYMLPSTFMVLEAFPLTLNGKLDRQALPAPDASAVVTRGYAAPTGEIETALTQIWQDLLGLARVGRHDHFFELGGHSLMIVSLIERLRDLGWRLDVRNVFAAPVLAEMAQAVQSDADAFVVPPNRIPEGCTALTPDMLPLISLSQAEIESIVGTIPGGASNVQDIYPLAPLQEGILFHHLLQAQGDTYLLQSLIAFDTRERLDIFLAALQQVIDRHDILRTAACWQDLTQPVQVVWRQAPLCINRFTPATADDIPAQLRAHTDPHLHRLDLSRAPLFAADIVHDPAQNEWLLALRFHHLVSDHMTLELIFAEIAQIQQGHTETLPTALPYRNFIAQTLNVPTTAHEAYFRTQLADVEAPTAPFGVLAMPGDSQPVAEARLSLAPDLAEAIRVQARRLGVSPSVLFHVAWAQVLAQTSGRDDVVFGSVLLGRLQGVAGADRILGMFINTLPMRVSLADRSVQEVVQATYLSLTTLLEHEQAPLALAQRSSGVAQPMPLFSALLNYRHSQTNESEAIDTTWAGMRIVAIEERTNYPLTLSVDDLGLGFHLTAQTVAGIDPARVTTYLATALNGLVDALIRDPQQPILQVSILPASERQQIVVDFNATQADFPQDALIHQLFEIQAAHSPAATAVVCGNQTLSYDELNRRANRLAHHLIALGLRPDDRVAICLERSPEIVVGLLAILKAGGAYVPLDPAYPTERLAYMMDDAAPVALLTQTVWVDRLISPVLTVVLDGQKSAIAAQPAHNPEPQKLGLTSHHLAYVIYTSGSTGLPKGVAITHRNTVNFLTWTQRTFSPEELAHTLFATSLNFDLAVFECFAPLLSGGTVHLVPDVLSLITTEQPVSLINTVPSAITHLIEVNAVPITARTVNLAGEALKPQVVEHLFARSSVQDVCNLYGPSETTTYSTWIRMNRTEGFISHIGRPIANTRIYILNSHSQPVPLGVAGEIHIAGAGVARGYLNRPELTAERFLADPFSADPDARMYKTGDLGRWRPDGNIDYLGRNDFQVKLRGFRIELGEIESQLMQCHGVREAIVLTREDEPGHKRLVAYLRPLDGVELVPAELRQRLAQHLAEYMLPSAFMTLDAFPLTPNGKLDRQALPAPDASAVVTHGYESPQGRIETALAQIWQDLLELVRIGRHDHFFELGGHSLMVVQLITRIKAKFLVDIPLTSLFLSPKLAEQANIIFSAQMSAVGENDIESLQNSLDLMSTEELLAMLNGDNNRGDNNQ

SEQ ID NO: 7363 - protein, 6108 aa, Xenorhabdus bovienii
  Peptide sequence Name=Xb4151_4152.C431.gene121.pep
  Gene classification: Gene name=EntF; Function=Non-ribosomal peptide synthetase modules and related proteins; Function class=Q Secondary metabolites biosynthesis, transport and catabolism
  Homolog annotation: Query=2982..4257bp; Hit=1..1284bp; Blast score =891; Percent Identity=43.0; E value=0; Homolog= PA2400 COG1020
MSCNRINKDQLAFESSSESSSCKFSLSSTQQVVWLDQILHPDSPSYNLASLVVIDGKLDETLLVRAFEAIVYRHDALRLRLINTQKLPLQELMDTLPVSVTTHDFSHHADAEAQAAQHIRATFMRPFELYGELWRCELLQVSDTRWYWHFCCHHLIGDATSLGLIPEDLANTYRHLIREEALPETPPSYLDFIAEDRAYLDSQRYVHDRQFWLERYVNLPPALLQPPNPDRTADHGQTEPVLWQLDKGLFQRIEDTVTEHGLSVLHFMYAVLACYFARTTQAEEIVIGIPVRNRKNVRQKRTLGMFSSVIPVGITITPHDTFLDVMHKAATELRHCYKRQRLPIAEINRHIQIQQKTGRAQLFDIMLSFESFQANADLPGATIKYSKIQRGTPFPFFIAIYQYTFANNEDINQPVTIEFNYSTHYLNCTEVMVLQSRLAMLMEAALTSPETQIRSLPVLPPAERQQLLVNFNATQTDLPQDGFIHSLFEAQATHNPDATAVVYEDQTLSYDELNHRANRLAHHLIALGVRPDDRVAICVERSLEMVVGLLGILKAGGAYVPLDPAYPAERLAYMLNDAAPVVLLTQTGLTSHVSTPVPKIVLDTQDASLMAQPDHNPDTQALGLTSRHLAYVIYTSGSTGLPKGVGMPLAALSNLLQWHRQDPSHLSGTGKTLQFAALGFDVAFQEIFTTLCEGGCLVLINEETRRDPQQFLRLIQQKQIDRIFLPYIALQHLAEAASHIEGDFSCLAHIITAGEQLRITPAIRRFLQRSGSCQLHNHYGPTESHVVTAYTLDKNMDQWPTFPPIGRPIANTQIYLLDPQGQPVPLGVTGEIHIAGADVARGYLNRPELTAERFLADPFSFDPDARMYKTGDLGRWLSDGNIEYLGRNDFQVKLRGFRIELGEIEAQLMQCHGVCEAIVLAREDEPGHKRLVAYLRPQAGVELVPAELRQQLARHLAEYMLPSAFMTLDVFPLTPNGKLDRQALPAPDSSAVVTRGYAAPVGETETTLAQIWQDLLGLERVGRHDHFFELGGHSLLAVQLAARVRQDLARELPLQQLFALPLLADLAQALSAASAIAQVIIPAADRNQPLALSFAQQRLWFLSQLDPAASLAYHIPVTLRLTGQLNLHALSTALDHLIARHESLRTRFVLVEGQPCQHIDPADVGFALSCQDLRALNPVMHTHRITELADLEAQTPFDFTQGPLIRGQLLQLADEMHVLLLTQHHIISDGWSIGVLVHELGTLYHAVLDGHSDPLPPLSLQYADYALWQRDWLQGTVLTEQRDFWCAQLQNAPALLALPTDRPRPSIQRYTGGQVPFRLDSALLTSLKALGQRHNTTLFMTVLTAWSIVLTRLSGQDDIVIGTPVANRPHRELEGMIGFFVNTLALRVTPGDAPRVVDLLAQVRERALAAYAHQDLPFEQVVEALQPERSLSYSPVFQVMLSLNNTPAQDQTLPSLQISQVEQESHSAHFDLMLLLTETEAGLVGGLEYATDLFDTTTVERMVGYLQQVLAAMVADATQTLACLPMLPDSERQQLLVDFNATQVDFPQDALIHQLFETQAAHSPDATAVVCGEQILSYGELNRRANRLAHHLIALGVRPDDRVAICMTRSPEMVVGLLAILKAGGAYVPLDPAYPAERLAYMLDDAAPVALLTQTAWVDTLISPVPTVVLDPQASFLAAQSIHNPEAQALGLTSHHLAYMIYTSGSTGLPKGVAIAHRNTVNFLTWAQRTFNPEELAHTLFATSLNFDLAVYECFTPLVSGGTVHLVPDALSLVTTEQPVSLINTVPSAIAHLIEANAVPATARTVNLAGEALKPHVVEHLFTRTSIQNVCNLYGPSETTTYSTWIRMNRTEGFVSHIGRPIANTRIYILDTYGQPVPLGVAGEIHIAGAGVARGYLNRPELTAERFFTDPFSTDPDARMYKTGDLGRWRPDGNIEYLGRNDFQVKLRGFRIELGEIEAQLMQCRGVREAVVLAREDEPGQKRLIAYLRPLDGVELVPAELRQQLAQHLAEYMLPSAFMTLESFPLTPNGKLDRQALPAPDLSAVVARGYEAPIGETETALAQIWQNLLGLERVGRHDHFFELGGHSLMIVGLIEQLYDLGWRLDVRSVFATPILSGMAQAVQGDADAFVVPPNRIPEGCTALTPDMLSLVSLSQAEIDAIVKVTPGGASNVQDIYPLAPLQEGILFHHLLQTQGDTYLLQSLIAFNNREHLDTFLSALQQVIDRHDILRTAACWQDLAQPVQVVWRQAPLCVNHFIPATADDIPAQLSAHTDPRRHRLDLSRAPLFTADITHDPAQDEWLLALRFHHLVSDHMTLELIFAEIAQIQQGHAESLPAALPYRNFVAQTLSVPAATHEAYFRTQLADVDAPTAPFGVLTMPGDNESIAEAHLPLDPALADAIHAQARRLGVSPGVLFHVAWAQVLAQTSGRDDVVFGSVLLGRLQGIAGAARILGMFINTLPVRVSLAGRNVQEVVQATYRSLTTLLEHEQAPLALAQRCSNVTQPMPLFSTLLNYRHSQTSGTNAVETGMRIVATEERTNYPLTLSVDDLGTGFRLTAQTVAGIDPTRITAYLATAINGLVDALARDPQQLIRNVPILPPTERQQLLVAFNATQSDFPQDALIHQLFESQVAHHPDAPAVVFEGQSLSYHELNHRANRLAHHLIALGVLPDDRVAICVERSPELLIGLLGILKAGGAYVPLDPTYPAERLAYMLDDAAPVALLTQAAWVDTLDSPVPTVVLDAQESAMAAQPTHNPDAQALGLTSRHLAYVIYTSGSTGLPKGVMVEHRSINRLVINNPYADISSDDCVAHCANIAFDASTWEIWSALLNGGRLHVVSSSALLDPVRFRDSLVKGQVTALWLTAGLFNEYLGDLEPLFGQLRYLLVGGDVLDPRKIRRTQLAECQPAHLINGYGPTETTTFAATYRISSPVDVNRPIPIGCPIANTQIYLLDPYGQPVPLGVAGEIHIAGAGVARGYLNRPELTAERFLTDPFSSDPDARMYKTGDLGRWLPDGNLEYLGRNDFQVKLRGFRIELGEIEARLVQCHGVREAVVVAREDEPGHKRLVAYLLPQTGVELVPAELRQQLARHLAEYMQPSAFMTLDTFPLTPNGKLDRQALPAPDLSAIVTRGYEAPIGEIEIALAQIWQDLLKLEQVGRHDHFFELGGHSLLAVQLAARVRQQLARKLSLQQLFTQPLLTDLAKTLTDASAIAQVVIPVADRSQPLALSFAQQRLWFLGQLDPAASLAYHIPMALRLTGSLNHNALTTALNHLVIRHESLRTRFVLIEGQPCQHIDPADIGFTLSCQDLRPLDLTARANRVAELTALETQIPFDFVRGSLIRGQLLQLTDAEHVLLLTQHHITADGWSIGVLMHELGVLYRAALDGHDDPLPPLSIQYADYAVWQRDWLQGAVLTEQRDFWYSQLQNAPSLLTLPTDRPRPSVQRYAGNRIPLQLNADLLASLKELGQRHHTTLFMTLLTAWSIVLSRLSGQDDIVIGTPVANRPHRELEDMIGFFVNTLALRVTPGDASRVADLLAQVRERALAAYAHQDLPFEQVVEALQPDRSLSYSPVFQVMLALNNTPSQNLALSGLQLAPVEQVRHSAHFDLTLSLTETEAGLVGDLEYSTDLFDSTTIERIVGYLENVLAAMAADATQTVAGLSMLPDSERQLLLTDFNATQADFPQDALIHQLFEAQAAHAPDATAVVFEDQTLSYSELNHRANRLAHHLITLGVRPDDRVAICVERSPELVVGLLAILKAGGAYVPLDPTYPAERLAYMLDDAAPVALLTQKAQADTLISPVPIIMLDALASSLAVQPTHNPDTQILGLTSRHLAYVIYTSGSTGQPKGVMVEHRGLSNLIATQQDTLAINSGSRILQFASNSFDAGIWECGMALLAGASLHLAQRTHLLPGAALLETLETHAITHVLLSPTALAALDSVPVTLQTLIVGGEACSPSLVKRWATSRRMVNAYGPTESTVCAAIYLCDNQEEGAPPIGRPIANTRIYILDTYGQPVPLGVAGEIHIAGAGTARGYLNRPELTAERFPADPFSSDPNARMYKTGDLGRWRPDGNLEYLGRNDFQVKLRGFRIELGEIEAQLMQCEGVREAVVLAREDEPNHPRLVAYVQPQSGAELIPAELRQQLARHLAEYMLPSAFMTLDAFPLTPNGKLDRQALPAPDASSVVTRGYEAPVGEAETILAQIWQDLLGLEQVGRHDHFFELGGHSLMIVSLIERLRGFGRRLEVRSVFATPVLAEMTQAIQDDADAFVVPPNRIPENCAALTPDMLSLVSLSQAEIEAIVEAIPGGAGNVQDIYPLAPLQEGILYHHLLQTQGDTYLLQSLLAFDSRVHLDTFLAALQQVIDRHDILRTAACWQGLTKPVQVVWRQAPLCVNHLLPATADDVPAQLSAHTDPRRHRLDLSRAPLFAADIAHDPAQDEWLLALRFHHLVSDHMTLELIFAEIAQIQQGQAETLPAALPYRNFIAQTLSVPAATHEAYFRTQLADVDAPTAPFGVLTMPDDNESIAEARLPLPPALAEAIRAQARRLRVSPGVLFHVAWAQVLAQTSGHDNVVFGSVLLGRLQGVAGADQILGMFINTLPVRVSLAGRSVQEVVQTTYRNLTTLLEHEQAPLALAQRCSGVAQSLPLFSTLLNYRHSQSRGADAVDILRTGMRIVATGERTNYPLTLSVDDLGTGFHLTAQAVTGIVPSRITAYLVTAISGLVDALTRDPQQLIRDVSILPPTERQQLLVEFNATQTDFPQDALIHQLFEAQAAHNPDAIAVVFEGQSLSYHELNRRANRLAHYLIALGVRPDDRVAICVERSLDLVVGLFGILKAGGAYVPLDPAYPAERLAYMLDDAAPVALLTQTALTDTLVSAIPTILLDGSEPLLMTQPTHNPDAQSLGLTSRHLAYVIYTSGSTGLPKGVMVEHRGLSNLITTQQDTLAINSGSRILQFASNSFDAGIWECGMALLAGASLHLTQRTHLLPGAALLNTLETHAITHVLLSPTALAALDSVPVTLQTLIVGGEACSPSLVKRWATGRRMVNAYGPTESTVCAAIYLCDSREEGAPPIGRPIANTQIYLLDDDGQPVPLGVAGEIHIAGAGIARGYLNRPELTAERFLADPFSPDPDARMYKTGDLGRWLPDGNIEYLGRNDFQVKLRGFRIELGEIEARLVQCHGVREAVVLAREDELSHPRLIAYLLPQTGVELVPAELRQQLAQHLAEYMLPSAFMVLDAFPLTPNGKLNRQALPAPDTSAVVARGYEAPIGKIEIALVQIWQDLLGLERVGRHDHFFELGGHSLLAVQLVARVRQDLARELLLQQLFDLPLLADLAQALSGTLTTAQVVIPAADRNRPLPLSFAQQRLWFLGQLDPAASLAYHIPVALRLTGQLDRHALTTALDRLVARHESLRTRFVLIEGQPCQHIDPADIGFTLSYQDLRRLEPAAHTNRIADLIAREAQASFDFIQGPLIRGQLLQLTGEAHVLLLTQHHIISDGWSIGVLVHELGTLYRAVLDGHDDPLPPLSLQYADYAVWQRDWLQATALTEQRNFWCTQLQNIPALLVLPTDRPRPPVQTYTGGRVSFQLDTTLLASLKGLGQRHHTTLFMTVLAAWSIVLSRLSGQDDIVIGTPVANRPHRELEDMIGFFVNTLALRVTLGDTPRVADLLAQVRERALAAYAHQDLPFEQVVEALQPERSLSYSPVFQVMLALNNMPAENLVLPDLQLSWVEQAHHSAHFDLTLSLTETEAGLAGDLVYAAELFDPATVERMVGYLENVLAAMAADATQAITSLPILPASERQQLLVDFNATQTDFPQDALIHQLFEVRAAHNPGATAVICGEKTLSYDELNRRANRLAHHLLDHGVRPDDRVAICLERSPDMVVGLLAILKAGGAYVPLDPAYPAERLAYMLDDAAPVVLLTQAAQVATLGSPVPTVVLDAQDASLMAQPDHNPDTQALGLTSRHLAYVIYTSGSTGLPKGVAITHRNTVNFLTWAQRAFSPEELAHTLFATSLNFDLAVYECFTPLLSGGTVHLTPNVLSLLTAEQSVSLINTVPSAIAYLTESDAIPMTTRTVNLAGEALKPHIIEHLFARKSIQNVCNLYGPSETTTYSPVYG

SEQ ID NO: 7364 - protein, 53 aa, Xenorhabdus bovienii
  Peptide sequence Name=Xb4151_4152.C431.gene122.pep
LKNELFHKQILYFFNPTYKRVRIHLFLISIIKITGGLVVMDWILRYHCCQYVW

SEQ ID NO: 7365 - protein, 72 aa, Xenorhabdus bovienii
  Peptide sequence Name=Xb4151_4152.C431.gene123.pep
  Homolog annotation: Query=10..69bp; Hit=323..382bp; Blast score=64; Percent Identity=60.0; E value=4e-10; Homolog= gi|25154798|ref|NP _741676.1| aspartic protease family member (5T521) [Caenorhabditis elegans] gi|21038843|emb|CAD31818.1| Hyp
MANFYNKIIIYYLLFIIYYLLFIIYYLLFIICYLLFVICYLLFVICYLLFVICYLLFVICYLLFVICYLPLV

SEQ ID NO: 7366 - protein, 34 aa, Xenorhabdus bovienii
  Peptide sequence Name=Xb4151_4152.C431.gene124.pep
LLFVICYLLFVICPWFNILFNIFKGNFFVFIYSY

SEQ ID NO: 7367 - protein, 271 aa, Xenorhabdus bovienii
  Peptide sequence Name=Xb4151_4152.C431.gene125.pep
  Gene classification: Gene name=SmtA; Function=SAM-dependent methyltransferases; Function class=Q Secondary metabolites biosynthesis, transport and catabolism
  Homolog annotation: Query=37..271bp; Hit=29..258bp; Blast score=67; Percent Identity=24.0; E value=2e-11; Homolog= mlr6226 COG0500
MSDIIVTQSNKEKMWWEEDAGFFGELYKEADDSTRTFFGGENNLVQRTNKEVDGVINLCGLKSGQYLIDCPCGYGRHSVALREKGINVIGIDVNDEHLSIARRHAEVHNSDVIFRKDDMRTFKLERQVDVLINMFYSFGFFSDEENVNAARNFYDALKEGGKFLMHTMITVPAFGDGRIPLEEKRKLQSGRTLVSKRRFNHITKREEGIWSLLNENNEEISLRPYDVRIYTDIEFKALCLEAGFSKVELYGDWDGSPYNDNSTYLIVVAEK

SEQ ID NO: 7368 - protein, 53 aa, Xenorhabdus bovienii
  Peptide sequence Name=Xb4151_4152.C431.gene126.pep
LRSGKNKVTQTKEKSYPHRTCIRKYFLNFIFIFLLNIFQIKYDKKHHQCSKKP

SEQ ID NO: 7369 - protein, 32 aa, Xenorhabdus bovienii
  Peptide sequence Name=Xb4151_4152.C431.gene127.pep
LPERKLVVVISSRGRSPDWKDVYSAYSSKKTE

SEQ ID NO: 7370 - protein, 84 aa, Xenorhabdus bovienii
  Peptide sequence Name=Xb4151_4152.C431.gene128.pep
MFNLAHQTPYGCAGRVATVLTLHTDRMCAFFDKAGFIHNEHPLFIAQMLCHIAPQNIAGDVDIPVNALQQMLNPIPLVLRILNN

SEQ ID NO: 7371 - protein, 84 aa, Xenorhabdus bovienii
  Peptide sequence Name=Xb4151_4152.C431.gene129.pep
MMSKIGIYPKFSYPTSPSSKYYSRTFHCGMIVSDILRQNHLIVHRRQPIPLSKKLTSPPRIALKRRGNRSLTTSYAATEKRDLN

SEQ ID NO: 7372 - protein, 74 aa, Xenorhabdus bovienii
  Peptide sequence Name=Xb4151_4152.C431.gene130.pep
MKGCSSARGSVDGSACAPNETKQARPIECVFRFPIFVISPCDPKNQTRPNANAHKMGCSCLMQYIFQAKNSAMS

SEQ ID NO: 7373 - protein, 512 aa, Xenorhabdus bovienii
  Peptide sequence Name=Xb4151_4152.C431.gene131.pep
  Gene classification: Gene name=FhaC; Function=Hemolysin activation/secretion protein; Function class=N Cell motility and secretion
  Homolog annotation: Query=16..512bp; Hit=102..597bp; Blast score=373; Percent Identity=43.0; E value=1e-103; Homolog= XF2550 COG2831
LSSPLSSPFSLAFPKETPCFLIQKVTVSGREGLPHWVPVQRLADLAKDHCLGVRGINQVMSNLQNRLIAHGWVTTRVLAPEQDLSQGELKLRVLPGTVRHIRYTDDSDKYATLYTAMPAREGKLLDLRDIEQGMENLQRLPNVQASMEIVPGEQPGESDIVIKRQQPRFWHMGAWVDNSGTKATGRTQGGLMLALDNPTSLSDLFYLSMTRDLAFSNRKNSTNYSAHYSVPLGYSQFAITGSSYTYAQTVPQLNEEAKYRGRSQSLNAQLSRVLHRNARSKTTLTYGINLRQTRNFTKDTEIEGQKRRTSSWNLGLGHRHYIGAAVLDTGIRYQKGTRWFGALPAYEERNDRDSADYATAQSEIIQLSASLNTPFTLGDQQFQHRVEYQRQWSNTPLTPQDQFSIGNRWSVRGFDGERTLSADKGWTLRNTLSWQTPLPDQQLYLGADYGRVGGRGADIIIGRTLAGGVLGFRGNIRPANLSYDVSVGTPFSKPDGFKTDNAHIGFSLNWQY

SEQ ID NO: 7374 - protein, 179 aa, Xenorhabdus bovienii
  Peptide sequence Name=Xb4151_4152.C431.gene132.pep
  Gene classification: Gene name=HlyC; Function=ACP; Function class=O Posttranslational modification, protein turnover, chaperones
  Homolog annotation: Query=7..150bp; Hit=8..151bp; Blast score=117; Percent Identity=41.0; E value=5e-27; Homolog= NMB1763 COG2994
MLIGQYDVRAPLILGSEENETEMLGAATWLWMHSPLHRNAPLIALSTLLLPMIKAGQYVLVSHHGQPIFYLSWALFTEETELRYLTKRHEHNRDPQLHGGDRLWILDWIAPFGHSREMSSLVRQELFLHHCYRALYHKGTQRGAQVIRFRGKGVSREQAAHWWNTHPLTQSLPERGFSR

SEQ ID NO: 7375 - protein, 642 aa, Xenorhabdus bovienii
  Peptide sequence Name=Xb4151_4152.C431.gene133.pep
  Gene classification: Gene name=FhaB; Function=Putative hemagglutinin/hemolysin; Function class=M Cell envelope biogenesis, outer membrane
  Homolog annotation: Query=1..528bp; Hit=1..533bp; Blast score=308; Percent Identity=36.0; E value=9e-84; Homolog= NMB1214 COG3210
MNKHCYRVIFNKTRQMLMVVSDLARSHTPGQARRGMHSCSSQTANVSLIPLVWGISLALGLVSQTAQAGIVADNNAPGTQQPTVISAANGVPQVNIQTPNSDGVSRNQYSQFDVEQRGAILNNSGVNTRTDLGGLITANPWLAQGEANIILNEVNSRDPSQLNGFIEVAGKRADVIIANPAGITCNGCGFINASQTTLAAGQTILENGRLKGFEVGDGTLTVDGKGLNDTTSDYTRLIARAVNINAKLHAQDLTVTTGRNRVDAQGNVEKVHAKDTEKREFSLDVAAVGGMYANKIKLVGTEQGVGVRNAGQLGAQAGNLTLDTQGNLTNSGMMTTSAEVAIQNQGTLTNQGDIKAGQSIKIQTRDALENQGRMLAGRHLDIQSASLENKEKGVLAAGVDKDGKLTQQGNLTIHSRGALANQGMMAASDNMIIQNKSGLANQGQILAGSNKHGNLTLHSEGKLDNSGTINASVDVFLQNQGELDNVGEITSGRDVTIKARDHLTNQGKISAGRNLDITSASLNNQKNGVLAAGIGRHDKLTPPGNVVLRSDGHLINRGVITATGNITLPTHDNLVQGNLVNQGDITAGQDISIENRNHLDNQGQMLAGRQLDIHSASLENQQKGILARQSHLNLMRFAQYCK

SEQ ID NO: 7376 - protein, 373 aa, Xenorhabdus bovienii
  Peptide sequence Name=Xb4151_4152.C431.gene134.pep
  Homolog annotation: Query=7..367bp; Hit=6..372bp; Blast score=262; Percent Identity=40.0; E value=8e-69; Homolog= gi|16129419|ref|NP _415977.1| putative receptor [Escherichia coli K12] gi|140581|sp|P28917|YDCC_ECOLI H repeat-associated prote
MSSVSPLLPHFASLEDPRVQRTQLHSLENILTIAICAVICGAEGWVEIEEFGESKQDFFTQLLDLTNGIPSHDTFGRVFAALDAQAFADCFTSWISTLAQGVDQDIIAIDGKTMRRSLDKANGKAAIHLVSAFACTNRLVLGQVKVESKSNEITAIPELLRRLVLSGSLVTIDAMGCQKAIAHQLHEAGADYVLSLKENHPGLYNDVSHYFDYVSSQPERLSEYEDVDAGHGRIERRTVQMTHVDWLPEKACWCGLHSIIRVIRERYVGNEVSRESCYFISTLRPTEAQRAATAIRSHWQIETQLHWCLDIAFNEDQQRMREGNAAANMALLNKIALNLLRLAPTKAGIKARRKRAGWDGEYLLTVLGKAHQI

SEQ ID NO: 7377 - protein, 2663 aa, Xenorhabdus bovienii
  Peptide sequence Name=Xb4151_4152.C431.gene135.pep
  Gene classification: Gene name=FhaB; Function=Putative hemagglutinin/hemolysin; Function class=M Cell envelope biogenesis, outer membrane
  Homolog annotation: Query=742..2220bp; Hit=321..1710bp; Blast score =638; Percent Identity=33.0; E value=0; Homolog= NMB1214 COG3210
VITASDDVILQNQGDLTNQGDITVGQDVTIKTRDHFDNQGRILAGRHLDSQSASLHSGTDSVLSAGVDKYGKLTQNGNLTLKAREAAQLYGQNLAHDNLSVDAKNIALQGSQTAAGNLQLTSGTQLNLQDAKVRARQNLTLSAPELIDNQRGELEAETLSLTSRKLKNNQGKITQTGQLSLVLDHHAGIDNTEGVIASSGQDLMLRASTLTSEKGVLTHAGTGVMSIDTQQFQGKKSRLISDGELKLTGGNYHLVKSRTSAQQITAHIQSLDHRLGDMTQHGKRSLTLDVQQELDNGSGTIAANGTVEITADRLNNNTLTENQLNNDKDQQNKGVLDKAELNNQPGKIIAAEDGHLQVTVKNPLNNQAGQLLASKSLVVSASAIDNRQGKITSSGGDITLTTGQLDNLSGKIAGQHHLQLNTQSINNEKGHMSADTVDINTHQQGLNNTAGLIVAERNMILRTGELLNRQGSVRSGQDLTLNTHGNQLDNRDSGLQGGLFSQGAMHLNTGYLNNQSGHIESRESLSVTGKNVANQQGQILGGKGTRLTVADLNNDQGLLQSGGKLTLKTTALSNRQNRDKQGITSKQALELETGTLNNENGVIISADSLHIQVNAAGVNNQQGLLAAHTMLTLVGLGLSNQSGRIQSHQALWVDTQGQTLNNTGGVIDSQDALDVRSGDLLNQNGTLHGKSAVTLTAKHLDNRHQGKILSENGLVIEADDLSNEQGRMLALGDFQAKVKNHIDNKAGLIRSGGDLRLNAQHLSNQATRQQDKGIDGRNIVVTAETLHNRQGQLTATENADLTLSSRLDNTQGLLQANQKLTAQGQTLAVTNTGGDIKTGQALGMEADSLTGDGKLRSLGDMTLTLLKDFTHTGETIANGRLVLDSRGDIINNSLISAGTLEGRAANLTNEVTGKILANHHQWTIKDNLNNTGLLDGAQTYLKAAHLTNQGTGRIYGDHIAIEAVSLDNLAENNKSAVIAARNRLDIGTDELNNKTHSLIYSDGDLSIGGQLDSQRHASGQGKTLNNHSASIEATGDMRLAMANINNLNDHFETELRPISQESVEEYQVWGQRYNVKNHKITIDNDEVDHACIDNIGCEDEFQIYKYTRTTEESRVKTTDPAKILAGKNLTVDTTVLTNDKSQVVAGGLLTVTGGQINNTDVQGERQTTDKGHIEYFWRINKKGSDDQGWDSDKYEPPTEIQAITLKPSTVQAQQNRVVLKGQRPGAYQGADIQITPVNNGQIDAGFASSEASIPEIAQRPGQRLEVVSQQPAAIGEKPSVIRTEVPNYRLPDNSLFKLNLPAEIKPHPANSQLKPYPVQGNDLLKSPPDNHPPAPDNSVLIETDPQFTQLKKWLGTDYMQQSMLSDHNNMHKRLGGGFYEQRLIREQIINLTGKRYLPGHQNDEEQFKSLMNAGLRARKAFDLAPGIALSAEQMSTLTEDMVWLVNIPVTLPDGRQQTVLVPQVYVRTQAGSLDGSGALLSGSQVNLQLTGDLLNQGRVVGQDIHVLADNIRNQGSHLQGDTLSLQARTDMVQRGGTVRAKDFLAIQAGNNIDIASTTRSGENQAGNGRFSSTYVDNVAGIYVQGADGKLHLQAGNDISLSAAQLATQGKNSDIRLAAGRNIQLGSVKTARYEHTAIGDDHRITRSQSGGVGSGVNSAGQIQVAAGRDVNAKAAEVTAGSALQVSAGRDVNILADEQQQSHDEYHRVEGSNSLVSSKTTITQYQFDHKQALSSTLSGDTVNVQAGKDITVAGSNVVGTHDITMSAGDNLTATTARETHHETHRKEEKQSGLMGTGGIGFTVGAAEFKQSNDSDEVRYKGSTVGSSGGNVTLTAKNQAILHGSDVMAGKDIDIEAKDVAITAAKNSHTYLSKTEQKQSGFTLGLSGAVGSAIDTAVKTANEAKETTGDSRLQALKGTQAVLSGAQGYQAYQLSEANSAKADAINQAGGDAKKPNDTIGIQLSYGSQSAKSETRHDASESQGSSLNAGRDIRITATGDNVTDSRGDIRIEGSGLKAGRDVELDAKRDVVLTSAENTQTTRGENSSKGGSVGVGLTVGQGGYGIKFSASVNAGKGHEKGDGVTHSETLIDAGNQVNIKSGQDTLLKGAQVSGESVTANIGRNLHLQSEQDKDSYDSKQENISAGASFTYGSMSGSASVNAGRDKMHSQFDSVNEQTGIFAGKGGFDVKVGEHTQLDGAVIASTADKDKNRLETGTLGFSDIENKAEYQTEHQSVGISTGGSMGSQMGTNMASNMLAGTHKSDSQSSTTHAAVGDGTIIVRDADKQKQAVSDLSRDTDNAANGLNPIFDKEKEQQRLAQAIANIGTQVLDIYNTQEAITATKKATEKLKDRQEQQALKQQAEAQLKAEAERKNDSRPVTEADIADRAYKIAYDTALTKQGAAIGGSQRQAVTAVVTALQGLAGGDIKAAIASGAAPYLANAVKVLTYGNKKYGQLTAEEKATNLVAHAILGGVIAEMKGGSAMAASAIASALYPAKNLSELSPDEKEKVSNLSTLAGGIAAGLATDSMAGGVAGAQTAKNAVENNFLGDISRDALEKNREALGENKYTEKQLRELLALEARDQVNDDLLNQYRKNPASLTPEQQQLFQRELQQYAYETTQLYGAEMAVQLVTLLLKEGDSPLIPNKGFPYAGGSEAKNAWADRERQQ

SEQ ID NO: 7378 - protein, 286 aa, Xenorhabdus bovienii
  Peptide sequence Name=Xb4151_4152.C431.gene136.pep
  Gene classification: Function=Transposase; Function class=L DNA replication, recombination and repair
  Homolog annotation: Query=15..231bp; Hit=46..262bp; Blast score=140; Percent Identity=34.0; E value=2e-33; Homolog= CC2740 COG3547
MSFKFVSGWKTVLLLRTEKFLDTLRTFPPETLIAMEACATSHFWGRTLQSMGYHVRIVPTQHVKAFSHHQKNDANNALAIGETACRPGLHFVPIKTVEQQDIKALRRARQLMVEQRTAIANQIRAFLAEQGIIVPVGIQKLQQHLPDILEEGDNALSCVLRRLLHTLWEDLQNLNVSIHEMDNEITALSRQQAGYGHLLTIPGVGPLIAAAFVSDVNASQFTNGRQVVSLVWCDYCCLSRSAQAFFASEPPAYGKPLFGISGESPSFNNNVTNCTAISAPYSWVVS

SEQ ID NO: 7379 - protein, 35 aa, Xenorhabdus bovienii
  Peptide sequence Name=Xb4151_4152.C431.gene137.pep
LKDIFSEVNTHHFDRTHKMFSRNSVHRIKDGTIFH

SEQ ID NO: 7380 - protein, 159 aa, Xenorhabdus bovienii
  Peptide sequence Name=Xb4151_4152.C431.gene138.pep
  Homolog annotation: Query=1..144bp; Hit=1..144bp; Blast score=223; Percent Identity=74.0; E value=6e-58; Homolog= gi|37524409|ref|NP _927753.1| Transposase, IS982 family [Photorhabdus luminescens subsp. laumondii TTO1] gi|37524578|ref|NP_927
MDKLVELFCDVDDFCRIFIPQWEQQCIENGHRQRRRHGRMSVSEIMTILIFFHMSNHRSFKTFYLGLIWQYHRNDFPVLLSYTRFIGMAASVLVPLCSYLTHLKGKPTGLAFIDSTHLRVCHNIRIPCHKVFDGVAKRGKSTMGLRWVDVMDAPFFSGK

SEQ ID NO: 7381 - protein, 35 aa, Xenorhabdus bovienii
  Peptide sequence Name=Xb4151_4152.C431.gene139.pep
LPLFVSFCPCSFLVVADSFTCHCVQIEYIIHLNSG

SEQ ID NO: 7382 - protein, 32 aa, Xenorhabdus bovienii
  Peptide sequence Name=Xb4151_4152.C431.gene140.pep
LFRTVCILSLSACFNQVFCLYLFRFVPVRFWL

SEQ ID NO: 7383 - protein, 45 aa, Xenorhabdus bovienii
  Peptide sequence Name=Xb4151_4152.C431.gene141.pep
VAITAIDINFGHTSSLKSRKHITATNHLIHDPTPDNTPAMGFIPV

SEQ ID NO: 7384 - protein, 56 aa, Xenorhabdus bovienii
  Peptide sequence Name=Xb4151_4152.C431.gene142.pep
MSIAVIATNQNRSKDMGKEMADILVIAVIAAVRSFSWRIPIRPANPALKNRLSISR

SEQ ID NO: 7385 - protein, 92 aa, Xenorhabdus bovienii; identical to SEQ ID NO: 6203
  Peptide sequence Name=Xb4151_4152.C431.gene143.pep

SEQ ID NO: 7386 - protein, 52 aa, Xenorhabdus bovienii
  Peptide sequence Name=Xb4151_4152.C431.gene144.pep
  Homolog annotation: Query=1..51bp; Hit=116..166bp; Blast score=80; Percent Identity=76.0; E value=6e-15; Homolog= gi|12484147|gb|AAG53990.1|AF327446_2 putative transposase B [Pantoea agglomerans]
LTGKAFTQRIERTNLTHRTRIKRLNRKTIGYSKSEEMHDKVIGTFIEREHYF

SEQ ID NO: 7387 - protein, 37 aa, Xenorhabdus bovienii
  Peptide sequence Name=Xb4151_4152.C431.gene145.pep
VAITAIDINFGHTSSLKSRKHITATNHLIHDQSRVMY

SEQ ID NO: 7388 - protein, 124 aa, Xenorhabdus bovienii
  Peptide sequence Name=Xb4151_4152.C431.gene146.pep
MSHYSLQAGFPSIPKPALVFLIADKRPLLVDFTDNLDATFRKGKCRYVSESEVFNVFMTVAVATFRIRAVSRIPPFIHRDIDNLFFNAGFAGLIGIRQLKDLTAAITAITRMSAISFPMSFDLF

SEQ ID NO: 7389 - protein, 52 aa, Xenorhabdus bovienii; identical to SEQ ID NO: 7386
  Peptide sequence Name=Xb4151_4152.C431.gene147.pep
  Homolog annotation: Query=1..51bp; Hit=116..166bp; Blast score=80; Percent Identity=76.0; E value=6e-15; Homolog= gi|12484147|gb|AAG53990.1|AF327446_2 putative transposase B [Pantoea agglomerans]

SEQ ID NO: 7390 - protein, 73 aa, Xenorhabdus bovienii
  Peptide sequence Name=Xb4151_4152.C431.gene148.pep
MSKINKLDNIGKKCSFNPDQYKKKIEVDDVAPVGSFPWAVIQVYLNKPVRRSDWNSNIYLIPKYDNSGHVLND

SEQ ID NO: 7391 - protein, 225 aa, Xenorhabdus bovienii
  Peptide sequence Name=Xb4151_4152.C431.gene149.pep
  Homolog annotation: Query=6..221bp; Hit=3..218bp; Blast score=129; Percent Identity=34.0; E value=3e-29; Homolog= gi|15801973|ref|NP _287994.1| putative Q antiterminator encoded by prophage CP-933P [Escherichia coli O157:H7 EDL933] gi|158315
MTKWYSHDLQYVRSQIIPALFDIAGETKGQLAAFEDSPLTCTDHYKRNKARIRVGNHWVVQDTDPVFCLETRMRKQPKPPINPITYRGSSWRRAVLAMDKPKLAWVLYCYAHSLDYRYQVEICEYLWGGFLAGQTNRRLSIKVSTRLKGLVWLAVQQRAKGCRSENFLSYTRSELASLTGVSLYNWKNNYAAHWIALVELCENMDREALQDIIRLRIKQKSDHDL

SEQ ID NO: 7392 - protein, 120 aa, Xenorhabdus bovienii
  Peptide sequence Name=Xb4151_4152.C431.gene150.pep
  Homolog annotation: Query=16..119bp; Hit=256..359bp; Blast score=155; Percent Identity=66.0; E value=1e-37; Homolog= gi|15831449|ref|NP _310222.1| hypothetical protein [Escherichia coli O157:H7] gi|25371448|pir||C90903 hypothetical protein E
MSNTILKSVFPGWSEVDAEPPASFMRLPKLQRWRNTQWLQWVKSQPCAACQRPADDPHHIIGHGQGGMGTKAHDLFCLPLCRECHDDLHRDRLAWEEKHGSQVDLLFRFLDRSLGIGAIK

SEQ ID NO: 7393 - protein, 37 aa, Xenorhabdus bovienii
  Peptide sequence Name=Xb4151_4152.C431.gene151.pep
MTLLILFHMSHYRDFKTFYIQHVKHYLKVGFPRLVRG

SEQ ID NO: 7394 - protein, 39 aa, Xenorhabdus bovienii
  Peptide sequence Name=Xb4151_4152.C431.gene152.pep
MTGIQGINSLHSTRSSLFHLFKRDRLIGITVYPTAKITI

SEQ ID NO: 7395 - protein, 61 aa, Xenorhabdus bovienii
  Peptide sequence Name=Xb4151_4152.C431.gene153.pep
MGFSLLPITFSEWGQLYSQTTEIVIPFIDNQAPPMTLICMPVLTFENPNCISSRFIPCHLN

SEQ ID NO: 7396 - protein, 53 aa, Xenorhabdus bovienii
  Peptide sequence Name=Xb4151_4152.C431.gene154.pep
MTISVVWLYNCPHSENVIGNNEKPIQGMNNIAKTMTLLILFHCIIFSLSKDKV

SEQ ID NO: 7397 - protein, 48 aa, Xenorhabdus bovienii
  Peptide sequence Name=Xb4151_4152.C431.gene155.pep
LVVSFICFHFRWCHLVTIAFLVNLIRHFILFIICKQSRKPIQNYLTKN

SEQ ID NO: 7398 - protein, 140 aa, Xenorhabdus bovienii
  Peptide sequence Name=Xb4151_4152.C431.gene156.pep
  Homolog annotation: Query=17..130bp; Hit=1..114bp; Blast score=122; Percent Identity=71.0; E value=7e-28; Homolog= Pa|Phot5-451c10.q1k _g7| 3757 - 4122 1047 121 aa, chain +
LAANRSSLQRQSGYCLMKNDLDLLSAYQRILSLSEQMLDLAKNEQWDELVDMEITYLKAVEVVTLLSENSDAPLSLQQKLTQILQTVLDNEKETKRLLQKRLSELSDLIKQESCKQLLHDTYGQFPVSDYEMELTTTEPK

SEQ ID NO: 7399 - protein, 136 aa, Xenorhabdus bovienii
  Peptide sequence Name=Xb4151_4152.C431.gene157.pep
  Gene classification: Gene name=FliS; Function=Flagellar protein; Function class=N Cell motility and secretion
  Homolog annotation: Query=1..124bp; Hit=1..124bp; Blast score=119; Percent Identity=52.0; E value=8e-28; Homolog= fliS COG1516
MYQRSASQLYAQVDLESEIMNASPYQLIQILFNGALSALRRAIILMQQGNIPEKGLAISKAINIIDNGLKEGLDFEKGGEIAQNLFALYDYMNRRLLHANFRNDEKAITEVIDLLTEISDSWRQIGPHYNASQDIV

SEQ ID NO: 7400 - protein, 488 aa, Xenorhabdus bovienii
  Peptide sequence Name=Xb4151_4152.C431.gene158.pep
  Gene classification: Gene name=FliD; Function=Flagellar capping protein; Function class=N Cell motility and secretion
  Homolog annotation: Query=1..485bp; Hit=1..456bp; Blast score=253; Percent Identity=39.0; E value=2e-67; Homolog= ZfliD COG1345
MASISSLGAGSGMDLGSILDKLQAAERKRLEPLAQQQTSYKAKLTGFGTLKGSLEKLKSASEELKKFDKLNTTKVSEDHKTFTPTTDSKASPGNYIIEINQLAKAQSLQSPAVSDVKFPQGEKLGEGKTRTIVITQPGEEKPLRISLKDDETSLIEIRDAINKQEGNVNASIIKATDNKDNKDNKGENKNYLILTSKKAGIQSVMTIKVEGDDKLSKWLNYTSGSESVPKSGSGAMTQTVEAADAKLKVNGIEIERQTNEIKDAPEGITLNLKKLTEKDESGKPKPETLVVSRDIEPTKEAIKKWVEAYNGVQTTFESLTKFKPVAKGESASKDNGALLGDGTLKSIQSQLRHQIFSPQDVADIATLNKLGIKQKLDGTLEISNEKLEKNLKEKPANVKAFFMGDGEKTGFATQTYNILKQTLDSHEGTIATATEGINKRLKTLERQVEQTNKNIDATIERYKRQFTELDKLVNSLKSTSSSLFQLLR

SEQ ID NO: 7401 - protein, 33 aa, Xenorhabdus bovienii
  Peptide sequence Name=Xb4151_4152.C431.gene159.pep
MIFLMDGIIDENRRCLGYRQEKCEKRKKFFNKN

SEQ ID NO: 7402 - protein, 345 aa, Xenorhabdus bovienii
  Peptide sequence Name=Xb4151_4152.C431.gene160.pep
  Gene classification: Gene name=FlgL; Function=Flagellin and related hook-associated proteins; Function class=N Cell motility and secretion
  Homolog annotation: Query=23..247bp; Hit=1..222bp; Blast score=212; Percent Identity=63.0; E value=4e-55; Homolog= ZfliC COG1344
MNTVSEKAQTNYIDLILKRNSTMASVINTNYSSLLAQNNLSKSQGVLGTAIERLSSGLRINSAKDDAAGQAIANRFTANVKGLTQAARNANDGISIAQTTEGSLNEINNNLQRIRELAVQAQNGTNSESDRKSIQEEVTKRLDEINRISEQTQFNGVKVLSKDTTLNIQVGANDGEKIAIDLKKIDKETLKLGDFSVELQRTSEEKTKITEAEGKVKKAEEDAKKATGAAKTAAEATLKTEQAALEKAKEAGALPADTLAKLDGALSTVDSLRSSLGAVQNRLESTVNNLNNTVNNLSAAKSRIEDADYATEVSNMSRGQILQQAGTSVLAQANQVPQSVLSLLR

SEQ ID NO: 7403 - protein, 83 aa, Xenorhabdus bovienii
  Peptide sequence Name=Xb4151_4152.C431.gene161.pep
MLHGELVVHSASRGYFCPSRLRRYTNRSQQQTPLDKRLATIIQSPNRYNRLNNEVKALLFHLCEIFLSSAQMHRKFQSVPDKG

SEQ ID NO: 7404 - protein, 230 aa, Xenorhabdus bovienii
  Peptide sequence Name=Xb4151_4152.C431.gene162.pep
  Gene classification: Gene name=FliA; Function=DNA-directed RNA polymerase specialized sigma subunit; Function class=K Transcription
  Homolog annotation: Query=1..226bp; Hit=11..236bp; Blast score=329; Percent Identity=81.0; E value=2e-90; Homolog= fliA COG1191
MDKNSLWKRYVPLVRHEALRLQVRLPASVELDDLLQAGGIGLLNAVERFDSLQGTAFTTYAVQRIRGAMLDELRSRDWAPRSVRRNAREVTQTIRKLEQELGRPASEQEVAKELKINLIEYRQILLDTNNSQLFSYDEWHEIHGESCEPVIEDEHETNPLQQLLEGDLRQRVIDVIESLPEREKMVLTLYYQEELNLKEIGAVLNVGESRVSQLHSQAIKRLRARLNPEK

SEQ ID NO: 7405 - protein, 170 aa, Xenorhabdus bovienii
  Peptide sequence Name=Xb4151_4152.C431.gene163.pep
  Homolog annotation: Query=1..170bp; Hit=1..170bp; Blast score=293; Percent Identity=94.0; E value=5e-79; Homolog= gi|37525879|ref|NP _929223.1| FliZ protein [Photorhabdus luminescens subsp. laumondii TTO1] gi|36785308|emb|CAE14249.1| FliZ pr
MSVTTQKKRPLSRYIKDYKHSQTHCLHCHKTLDRISLVFNGQVINKEAISEMTELVDDKTWDELQGKFVALCRFCSEIYCNSQTDYFDIMSFKQYLFEQTEMSHSTVREYVVRLRRLDELLTSSNYPAQEFTPEKIQEKLSEKLSQSAFSNYNIALRKYEQYLSWQQNGY

SEQ ID NO: 7406 - protein, 362 aa, Xenorhabdus bovienii
  Peptide sequence Name=Xb4151_4152.C431.gene164.pep
  Gene classification: Gene name=PutA; Function=NAD-dependent aldehyde dehydrogenases; Function class=C Energy production and conversion
  Homolog annotation: Query=5..362bp; Hit=440..795bp; Blast score=479; Percent Identity=68.0; E value=1e-135; Homolog= ZputA_2 COG1012
MPKRRAGIERHIQTMRTKGRPVYQAVHKNEADSQESSQGTFVKPTLIELENFDELKKEVFGPVLHVVRFNRNELDKLLEQINASGYGLTLGVHTRIDETIAQVTANAKVGNLYVNRNMVGAVVGVQPFGGEGLSGTGPKAGGPLYLYRLLSQRPVNAASQTLERQDEEYQLDARARVALRSPFNKLAEWVTAQHNDALSKLIQKYSLLAQGGTIRLLPGPTGERNTYTLLPRGEVLCLADNEQDTLVQLSAVLSVGCQAIWEKDDLHQQLLRQLPDEVRHSIRLINDWQNEETEMEAVIYHGDCDQLRHVCGIIAQRKGPIVSVQGFARGETNLLLERLLHERSLSINTAAAGGNASLMTIG

SEQ ID NO: 7407 - protein, 972 aa, Xenorhabdus bovienii
  Peptide sequence Name=Xb4151_4152.C431.gene165.pep
  Gene classification: Gene name=PutA; Function=Proline dehydrogenase; Function class=E Amino acid transport and metabolism
  Homolog annotation: Query=1..524bp; Hit=1..524bp; Blast score=871; Percent Identity=83.0; E value=0; Homolog= putA_1 COG0506
MGSTTMGVKLDEATRNRIKSAAQRIERTPHWLIKQAIFNYLERLENEEKIPEISVFQDNKEEKISEEESQIEATSQPFLDFAEHILPQSVKRSAITSAYRLPETQAVPMLLQRAQLSGEQAKATHKLAYSIAEKLRQQKHGTGRAGLVQGLLQEFSLSSQEGVALMCLAEALLRIPDKATRDALIRDKISNGNWHSHLGQSPSMFVNAATWGLLFTGKLVSTHNEAKLSKSLNRIISKSGEPLVRKGVDMAMRLMGEQFVTGETIAQALANARKLEEKGFRYSYDMLGEAALTEEDAQAYMVSYQQAIHAIGKASNGRGIYEGPGISIKLSALHPRYSRAQYERVIDELYPRLLSLTLQACQYDIGINIDAEEADRLEISLDLLEKLCFEPKLEGWNGIGFVIQAYQKRCPFVIDSIIDLAQRSRHRLMIRLVKGAYWDSEIKRAQIDGLEGYPVYTRKVYTDVSYIACARKLLSVPNLIYPQFATHNAHTLSAVYHLAGQNYYPGQYEFQCLHGMGEPLYEQVVGKIADGRLNRPCRIYAPVGTHETLLAYLVRRLLENGANTSFVNRIADTSLPLDELVADPVKVVQELAQSEGQIGLPHPKIPLPHDLYGKNRVNSSGLDLSNEHRLASLSSALLSSSMETWNSEPLLGGDYAHTGELPTAKSVNNPARPSDIVGYVREATEQEVSHALDVAIDAGTIWFATPPSERAAILVRAAELMENNLQSLLGILVRESGKTFNNAIAEVREAVDFLYYYANQVRQDFANDTHRPLGPVVCISPWNFPMAIFTGQIAAALAAGNSVLAKPAEQTPLIAAVAVKMLHQAGIPRDVLQLLPGQGETVGALLVGDERVRGVMFTGSTEVASLLQRNIAGRLDAQGRPTPLIAETGGLNAMIVDSSALTEQVVTDVVASAFDSAGQRCSALRILCVQDDVAERTLTMLKGAMAECRIANPEHLSTDIGPVIDAEAKGWH

SEQ ID NO: 7408 - protein, 30 aa, Xenorhabdus bovienii
  Peptide sequence Name=Xb4151_4152.C431.gene166.pep
LIFNGFYCCNYGGVTDSLMKGTTSEVINVT

SEQ ID NO: 7409 - protein, 69 aa, Xenorhabdus bovienii
  Peptide sequence Name=Xb4151_4152.C431.gene167.pep
MLSVLKATLVQHDMFSVQYICSTRHLPTRLHLKIISPKAALILVCIIYVCNYFKITFYPRLAKTFLTTN

SEQ ID NO: 7410 - protein, 494 aa, Xenorhabdus bovienii
  Peptide sequence Name=Xb4151_4152.C431.gene168.pep
  Gene classification: Gene name=PutP; Function=1 Na+/proline, Na+/panthothenate symporters and related permeases; Function class=E Amino acid transport and metabolism
  Homolog annotation: Query=1..491bp; Hit=1..491bp; Blast score=645; Percent Identity=74.0; E value=0; Homolog= ZputP COG0591
MTVNSPMLITFIVYISAMLVIGYMAYRSTKNFDDYILGGRRLGSVVTALSAGASDMSGWLLMGLPGLIFLSGISGGWIAIGCLMGAYLNWLWVAGRLRVHTEVNNNALTLPDYFTHRFEDSSKILRIISALVILVFFTIYCASGVVAGGLLFESTFGISYEKAIWLGALATIGYTFLGGFLAVSWTDTVQATLMIFALILVPVLILFNVGGFENAIAVIEAKHTFYLDMFKGLNAIAIISLLGWGFGYFGQPHILARFMAADSHKTIHKARRISMTWMFLCLAGTVAVGFFGIAYFELYPEQAAPVLQKNERIFIELGTLLFNPWITGILLSAVLAAVMSTLSCQLLVCSSALTEDLYKAFVRTKASQNELVWVGRLMVLLVAAIAIVIATNPNNKVLALASNAWAGFGAAFGPVVLISVLWKRMTRNGALIGMLVGAITVLVWMQYKWFGLYEIIPGFIFASIAIIGVSLLGKAPSQATQQRFDEAEAHYKTK

SEQ ID NO: 7411 - protein, 44 aa, Xenorhabdus bovienii
  Peptide sequence Name=Xb4151_4152.C431.gene169.pep
MDSNSDGSEPPSYIQATFNSEPIPIIPLSIRYNYRASTYERTNL

SEQ ID NO: 7412 - protein, 33 aa, Xenorhabdus bovienii
  Peptide sequence Name=Xb4151_4152.C431.gene170.pep
MEVLSHLNYYPFDLNVLDNIVWYKKSIKIRRIK

SEQ ID NO: 7413 - protein, 34 aa, Xenorhabdus bovienii
  Peptide sequence Name=Xb4151_4152.C431.gene171.pep
LSGLITDSQRISSCVMTSMYISVYINYIKSCIVF

SEQ ID NO: 7414 - protein, 411 aa, Xenorhabdus bovienii
  Peptide sequence Name=Xb4151_4152.C431.gene172.pep
  Gene classification: Gene name=XerC; Function=Integrase; Function class=L DNA replication, recombination and repair
  Homolog annotation: Query=3..394bp; Hit=15..397bp; Blast score=174; Percent Identity=29.0; E value=2e-43; Homolog= Z1835 COG0582
MAITDSWLRSTSGKPQEKMVTKSDRDGLSIRVTPKGKVIFQFRYRWDGKGDRIDIGTYPATSLKDARDAVIFYRGELEQHHNPKMVKRVLRESVLKAVTVERLIRDWWETAMKGVLVKANEILRSFELYVFPKIGKLPHDEVTLHIWLALIEDVTKQHPSIGVRILNNTKNAHRWAVRRGMTKITPLSDVLISDLGRKKTNKDDSTLSEERLIVLFKIIDSPSYNPRNALIIKLCLLFGCRIGELLKAKVTDFDYEKNIWIIPPENHKTGAKSQKPIIRPIVLEARELIKQAKTLNRGSEHLFIVSSGKPFAEGSHLQIINSLNKKMSSYFEHYTPWSIHDLRKTMRTGISDLTSPHVAEIMLGHKLPGVWQVYDKHTYLNEQREAYERWWDKLTKIVSRPPSQEYPAVEN

SEQ ID NO: 7415 - protein, 64 aa, Xenorhabdus bovienii
  Peptide sequence Name=Xb4151_4152.C431.gene173.pep
MMAESPYIKTQELAARYSVKPHTIRLWCGNGKQRRKGFPKPKFLSDQLNFLRQDILDWEGGKQF

SEQ ID NO: 7416 - protein, 65 aa, Xenorhabdus bovienii
  Peptide sequence Name=Xb4151_4152.C431.gene174.pep
ILTTKLNNIFFMRHGRKGDTAGVAKMVWRAVIRKEVHDGGVTVYQNSGTGSSIQCKTTYYQVVVW

SEQ ID NO: 7417 - protein, 33 aa, Xenorhabdus bovienii
  Peptide sequence Name=Xb4151_4152.C432.gene1.pep
MILWRSTIRGCWQRDEEGREVIPYLTHYLTRFV

SEQ ID NO: 7418 - protein, 277 aa, Xenorhabdus bovienii
  Peptide sequence Name=Xb4151_4152.C432.gene2.pep
  Homolog annotation: Query=1..277bp; Hit=1..277bp; Blast score=431; Percent Identity=76.0; E value=1e-120; Homolog= gi|37524162|ref|NP _927506.1| hypothetical protein [Photorhabdus luminescens subsp. laumondii TTO1] gi|36783585|emb|CAE12431.1
MQTEPDVLTDHNELILSTNIERVVTGRDAALKQIEQLIQQLDAISRLTSEIGGGTAQDWAMKSVHRYDSWLTEKVDKAMPAVTRNIDRSIWCDLMLKSGMMALMDAQARDQWHKNLEEGDLPAISEANILSTFEQLHLNKMDVFERGIINVFKGLSWDYKTNSPCNFGKKIIINNLVSHNRWGFSLNWGWRRDQLADLERMLFLLDGKPIPDNRGDVTTRLMEHIRDNPSKDVYEDGFFSIRYFQKGTAHITFKRCDLTEKMNDIVAKHYPGMLAAR

SEQ ID NO: 7419 - protein, 106 aa, Xenorhabdus bovienii
  Peptide sequence Name=Xb4151_4152.C432.gene3.pep
  Homolog annotation: Query=4..106bp; Hit=2..106bp; Blast score=147; Percent Identity=67.0; E value=3e-35; Homolog= gi|16130561|ref|NP _417133.1| hypothetical protein [Escherichia coli K12] gi|3025278|sp|Q46953|YPJF_ECOLI Hypothetical protein
MQTSTVPATVPVSSRLSPVQVWQQLLTYLLEHHYGLTLNDTPFHDDSAIQEHIEAGITLADAVNFLVERYELVRIDRKGFTWQEQTPFLTAADILRARRATGLINT

SEQ ID NO: 7420 - protein, 43 aa, Xenorhabdus bovienii
  Peptide sequence Name=Xb4151_4152.C432.gene4.pep
  Homolog annotation: Query=1..41bp; Hit=1..41bp; Blast score=73; Percent Identity=85.0; E value=1e-12; Homolog= Pa|Phot4-370d04.q1k _g31| 27631 - 27954 182 107 aa, chain +
MSLSDSPQWGLQSDITPRFGARLVQEGKRLHYLADRAGFTGEL

SEQ ID NO: 7421 - protein, 156 aa, Xenorhabdus bovienii
  Peptide sequence Name=Xb4151_4152.C432.gene5.pep
  Gene classification: Gene name=RadC; Function=DNA repair proteins; Function class=L DNA replication, recombination and repair
  Homolog annotation: Query=2..156bp; Hit=5..160bp; Blast score=169; Percent Identity=58.0; E value=1e-42; Homolog= yfjY COG2003
MSEIALSPVFPVNEQRIIRRALRLLEKYQRQPGESFTSTSVTKTWLQLQMAGLEREIFIVLYLDNQHRLLERETLFTGTLSHTEVHPREVVKAALRHNAAAVILAHNHPSGEMEPSQADRHITKRVVSALALVEVRVLDHLVVGDDVMSFAERGWL

SEQ ID NO: 7422 - protein, 143 aa, Xenorhabdus bovienii
  Peptide sequence Name=Xb4151_4152.C432.gene6.pep
  Homolog annotation: Query=6..143bp; Hit=136..273bp; Blast score=270; Percent Identity=96.0; E value=4e-72; Homolog= Pa|Phot4-370d04.q1k _g29| 26261 - 27082 614 273 aa, chain +
LPKWTDLRVPHKGNVVEKVIEGAYEVLGIFDRVEEKRDAMQSLMLSPPAQQAMAKAALTYRFGEEHQPVTESQILSPRRWQDESNDLWTTYQRIQENLIKGGLSGRTTKGKRAHTRAVKGIDGDVKLNRALWVMAENMLQLAS

SEQ ID NO: 7423 - protein, 155 aa, Xenorhabdus bovienii
  Peptide sequence Name=Xb4151_4152.C432.gene7.pep
  Homolog annotation: Query=1..131bp; Hit=1..131bp; Blast score=256; Percent Identity=96.0; E value=6e-68; Homolog= Pa|Phot4-370d04.q1k _g29| 26261 - 27082 614 273 aa, chain +
MTRLASRFGAVNVVRRDRPLTHDELAHYVPSVFSEEKHESRSDRYTYIPTITLLDNLQREGFQPFFACQTRVRDQSKREHTKHMLRLRREGQITGKQVPEIILLNSHDGSSSYQMLPGLFRSVCQNGLICGCRIKAMWWRKSLKGLTKYWGYLTE

SEQ ID NO: 7424 - protein, 50 aa, Xenorhabdus bovienii
  Peptide sequence Name=Xb4151_4152.C432.gene8.pep
LQKYRWLTFLISNHPTILRAMPPLGSMASSFLISKKGINHDPISQPLWCG

SEQ ID NO: 7425 - protein, 152 aa, Xenorhabdus bovienii
  Peptide sequence Name=Xb4151_4152.C432.gene9.pep
  Homolog annotation: Query=1..149bp; Hit=6..154bp; Blast score=147; Percent Identity=47.0; E value=6e-35; Homolog= gi|16128235|ref|NP _414784.1| hypothetical protein [Escherichia coli K12] gi|2495489|sp|P77162|YKFB_ECOLI Hypothetical protein
MKRLSIFTILLFPITSFAVPNMWASGFGQGITEYLIISPENVVFNLNCTMNPDEQNILQHNVLIDLPDGTRLDSRDDKTTITVVTDDQQFPLPASLGWRNGDNAWIQFIDALGHAATFDVYVNDKKVGSFTPGIKNTEKELDDLSGCRNIAG

SEQ ID NO: 7426 - protein, 157 aa, Xenorhabdus bovienii
  Peptide sequence Name=Xb4151_4152.C432.gene10.pep
MKKTKLLLLISGIAAGIITSKLAEASSLYKGVLPAAVNNKDGNRFWCNAYQQVRKMCKATEIDASGGFILIRSAPLKDCEAGVWGWINPGDKNILTDYIATGYTITADAKLNVTVKELCSPGMKVTFRPNSKRPQFDDMVGPYNGKEVFRYKWPDSK

SEQ ID NO: 7427 - protein, 229 aa, Xenorhabdus bovienii
  Peptide sequence Name=Xb4151_4152.C432.gene11.pep
  Gene classification: Function=Predicted transcriptional regulator; Function class=K Transcription
  Homolog annotation: Query=1..224bp; Hit=1..225bp; Blast score=209; Percent Identity=52.0; E value=2e-54; Homolog= yfjR COG2378
MTQAERRHDRLAVRLSLIISRLVAGETLDLRKLATEFGVSVRTLRRDFRERLMYLDLEYRKGQCRLLSGGRQRELAVMTFARQSGVEALFPDMDNHLVSSLLSGPGESPCLIWNGDSLLQSPDLGVFTRLVSAVSEHRRVTLLGNGCRCTGLAPYRLVLRDREWYLTGEHQARIAVFPLADIRAVTLNKDSFAPDMAVREILSRPDFLQALPHFQCIEDVISSFSTNNI

SEQ ID NO: 7428 - protein, 294 aa, Xenorhabdus bovienii
  Peptide sequence Name=Xb4151_4152.C432.gene12.pep
  Homolog annotation: Query=1..293bp; Hit=1..293bp; Blast score=453; Percent Identity=73.0; E value=1e-126; Homolog= gi|37524409|ref|NP _927753.1| Transposase, IS982 family [Photorhabdus luminescens subsp. laumondii TTO1] gi|37524578|ref|NP_92
MDKFVELFCDVDDFCRIFIPQWEQQCIENGHRQRRRYGRMSVSEIMTILIFFHMSNHRNFKTFYLGLIWQYHRNDFPVLLSYTRFIGMASSVLVPLCSYLTHLKGKPTGLAFIDSTHLRVCHNIRIPRHKVFDGVAKRGKSTMGWFYGFKLHLIVNHQGEIMAAKLTPGNVDDREPVHELAKGLTGSLYGDKGYISQSLVDTLAETGVTFITKKRHNMKAKALSAWDNMMLSKRFIIETINDQLKNISQIEHSRHRSLQGLMLTVLGGLIAYCLKKNKPSLNIIHSEKDVLVTA

SEQ ID NO: 7429 - protein, 291 aa, Xenorhabdus bovienii
  Peptide sequence Name=Xb4151_4152.C432.gene13.pep
  Gene classification: Function=Predicted GTPase; Function class=R General function prediction only
  Homolog annotation: Query=1..291bp; Hit=1..290bp; Blast score=353; Percent Identity=59.0; E value=1e-97; Homolog= Z1650 COG3596
MKKSEGLQAIEKPLASLPHAIGKHILDHIQKLTHYEPVIGIMGKTGAGKSSLCNALFQGEVTPISDVHACTRDVLRFRLRKGEHSLILIDLPGVGESEQRDKEYESLYRNILPELDLILWVIKADDRAFSVDERFYRRVMTGYQQRVLFVVNQVDKIEPSHEWYVTGNAPSPHQWVNIEARLASIRQLFSPLHPVCAVSARTEWNLPSMVETMMCYLPDRATSPLATQLHGRLCGELVKKQAREGFGNAIGEVFDSAEAASFIPVPLKTVIRTIREAVVSVARAVWDWFFF

SEQ ID NO: 7430 - protein, 41 aa, Xenorhabdus bovienii
  Peptide sequence Name=Xb4151_4152.C432.gene14.pep
MAWGSEASGFSMACRPSDFFMKRPQTEKQNPRARKASGVIR

SEQ ID NO: 7431 - protein, 32 aa, Xenorhabdus bovienii
  Peptide sequence Name=Xb4151_4152.C432.gene15.pep
VSEIILNVGISESVSRRLNRYSWLVALVAGAR

SEQ ID NO: 7432 - protein, 186 aa, Xenorhabdus bovienii
  Peptide sequence Name=Xb4151_4152.C432.gene16.pep
  Homolog annotation: Query=76..181bp; Hit=1..106bp; Blast score=116; Percent Identity=46.0; E value=2e-25; Homolog= gi|26990388|ref|NP _745813.1| hypothetical protein [Pseudomonas putida KT2440] gi|24985350|gb|AAN69277.1|AE016562_7 hypothetic
MRKSEVYISVDVETSGPVPGVFSLLSIGACLVHQAEVAIYLELQPDSPEHDPESLAVTGLDLMQLEQDGLPPSAAMHQFKVWIESVIDPGQKAIFVGLNTPFDWSFINYYFYKYVGINPFGFTAIDIKAYFMGAYGYSWSETKSSHMSAILKPCTKPNHNALEDARFQAELFALMLARQTGDIRSG

SEQ ID NO: 7433 - protein, 163 aa, Xenorhabdus bovienii
  Peptide sequence Name=Xb4151_4152.C432.gene17.pep
MSGPVWHWIWPGIETELMVSRSVSDVFSSYRQNNSSTEKGGQLFVDPTYPSGMLLSFATVPHYADRAGRTWLELDAKRCREEIENANDQGLRLVGYWHTHPQVIPQISSTDILSFARFAQRYAQELPYPIAVIVGTSLSPEGVKAWSIRAGTCIEALRINGAD

SEQ ID NO: 7434 - protein, 591 aa, Xenorhabdus bovienii
  Peptide sequence Name=Xb4151_4152.C432.gene18.pep
  Homolog annotation: Query=336..459bp; Hit=295..426bp; Blast score=68; Percent Identity=36.0; E value=4e-10; Homolog= gi|28558897|ref|NP _788157.1| RC170 [Ruegeria sp. PR1b] gi|22726448|gb|AAN05243.1| RC170 [Ruegeria sp. PR1b]
LAELTDTPLQQGIAALREILGNGDTSGMLQPASVRAGEAAAFCFPLPIDCAGEERKLYIGFPNNFPSESLRLHVEPSPWLLWPHAMESGLCLHGFKERPITGSPASIVRDSISRLTSILSLSLMGSDAERRKAEFQNEITSYWIRQHGKSLQDLILLGRPIEASELFAVSDPRYLIPSGKETVWLSSDVEAIKKHFKRMTGRTVTVRSPMAAGFYIKLESYPDIKFPTPKGLIAWLLPHISEGDAQKLSDWFEKSSSMVARWIILELPGNNGSPVYTLNLYARRHNTDRGPKLGLRASRRKPVRASGELPECIRSSGLNVIDRADIHSRDLSNEIKGLETAHVVFVGVGSLGGAVASQLVRAGLKQLTLIDPDNLESANLGRHILGADDLGKPKAQALQYRLTRDLPTIDVAAFNTYAQFIMELKPEIFEKADLIIVTTADWESEVALWTKKAEGATWGLLQGWSEPHTLVGHALIAPQGAHDGRYLFSDNGDFIHRYTNWPEGGVIPLPACGESFIPGGSAGMTNIAAMVAQAAIRFLNTHQHGPAWVTSLYRPQDAVLSGGKYLGPELPEGTILSVLERGWPESEKNNI

SEQ ID NO: 7435 - protein, 415 aa, Xenorhabdus bovienii
  Peptide sequence Name=Xb4151_4152.C432.gene19.pep
  Homolog annotation: Query=22..358bp; Hit=9..345bp; Blast score=108; Percent Identity=28.0; E value=2e-22; Homolog= gi|27365367|ref|NP _760895.1| Conserved hypothetical protein [Vibrio vulnificus CMCP6] gi|27361514|gb|AAO10422.1|AE016803_209
MNNEQTKRSSWEYFLLRAARKISLSEPQYEKINGRYDQLQSILSASDDPLLAEAHIFPQGSMRLKTTINPVPDAPADLGTIDADAIVWLPHAKGVDAGRVLNAIEKRFKEGSRVQGDIQQLRRGVRIVYADQNPGFHIDVTPARACFWNEQDNGLGMLEVPDRELGWKASSPIPYSDWLHHASSLEVMLESYVALNKSFATADSATQEPLPEYGDYQKEDPLRASIKLLKRHRDEWAIRTKNEKNRPISAVITTLATHAYLDVVKQSQQRPFTPLEAIIEIVRIMPQFIRLNGHEYMICNPRDSGENFAEKWNRPGEGPFYRRAFYDWHENASQAVNLGLQNYSSTDSFALAVKENFGIGRAFVDEINSQVPASWTMPGRAAGVTRNAASMGALFGSATGSSRSQVNVKPVGRLG

SEQ ID NO: 7436 - protein, 404 aa, Xenorhabdus bovienii
  Peptide sequence Name=Xb4151_4152.C432.gene20.pep
  Homolog annotation: Query=34..368bp; Hit=12..349bp; Blast score=73; Percent Identity=25.0; E value=9e-12; Homolog= gi|27375185|ref|NP _766714.1| blr0074 [Bradyrhizobium japonicum] gi|27348321|dbj|BAC45339.1| blr0074 [Bradyrhizobium japonicum
LHGLPQTEEFRRDSALNTKEQTSTSGGRFNTTDEVKRIVWIRTAGHCELCGVDLTHDYRVGTPMRWGEVAHILPASPKGPRGNVDHSGDRALALTNDFANLMLLCPGCHDRIDRDEDGYPENDLSGLHQACLERIRLAASSPREGRAIPVIVQSQHFATTNNIPVGDLLMVMSSEGLTAFGHPINIIFPAPGPRGRDLYYWQNVKDDIHYKLAGELARRGGMYGDLPALAVIGVADIPALMLLGQAIGDRTKRFLFSMSRSHGLRWPDKSAEPPDFLFSSAPEGKGPLALVISISAKIPPRDVMTAIPDVRIAEFTIPEPGYAIVSCREVIHAFRDELQKRLSQLEASTDEAIHVFAAIPAALAIEFGALLTTQHQHPYVIFDRENMSQNQFRPMLTIGHSQEL

SEQ ID NO: 7437 - protein, 96 aa, Xenorhabdus bovienii; identical to SEQ ID NO: 5468
  Peptide sequence Name=Xb4151_4152.C432.gene21.pep
  Gene classification: Gene name=InsB; Function=Insertion element IS1 protein InsB, putative transposase; Function class=L DNA replication, recombination and repair
  Homolog annotation: Query=1..95bp; Hit=71..166bp; Blast score=87; Percent Identity=46.0; E value=2e-18; Homolog= insB_g3 COG1662

SEQ ID NO: 7438 - protein, 92 aa, Xenorhabdus bovienii; identical to SEQ ID NO: 6203
  Peptide sequence Name=Xb4151_4152.C432.gene22.pep

SEQ ID NO: 7439 - protein, 89 aa, Xenorhabdus bovienii
  Peptide sequence Name=Xb4151_4152.C432.gene23.pep
MTTPRMGYCRSCIKWLVAVICFRLFKDEVWPKLMSIAVIATNQNRSKDMGKEMADILVIAVIAAVRSFSWRIPIRPANPALKNRLSISR

SEQ ID NO: 7440 - protein, 32 aa, Xenorhabdus bovienii
  Peptide sequence Name=Xb4151_4152.C432.gene24.pep
MTGSSPFVAWSYTTPCVARSVISPEAGLSATQ

SEQ ID NO: 7441 - protein, 64 aa, Xenorhabdus bovienii
  Peptide sequence Name=Xb4151_4152.C432.gene25.pep
MTFRRVFVFLVKDCLQTVLHRPLRNNPARPTTSPERTFLNYHVDMITFSTESILSHCLKQCNMK

SEQ ID NO: 7442 - protein, 308 aa, Xenorhabdus bovienii
  Peptide sequence Name=Xb4151_4152.C432.gene26.pep
  Gene classification: Function=Predicted transcriptional regulator; Function class=K Transcription
  Homolog annotation: Query=43..308bp; Hit=1..263bp; Blast score=72; Percent Identity=24.0; E value=7e-13; Homolog= NMA1157 COG2378
MTKFHDVYLELLVDAYSLPQAERLAYIDLCIRYLGSISRAEIMAEFKVAQAAASKDLALYRELKPDNCSIDTATKRTTILADSYTPLVRIGVHTALNLIQYGFTRSELMQKRPMLPIDEVDPLYQPERLKEEQVAAVTRAIKERCAIRCSYGSKSGDHRERILFPSALFVDRKNWYFRAYDRNNGEPNRSGFKNFKFSRLFNAHKEPSVSPTLAEKTDIEWNEEITFIIEFKKNLPKETINEISREFSINGSVHSVTCRAALACYVKTNWKIDLTNNENNQWLYFDVLNAEALWEVQCLAPLFEQKNS

SEQ ID NO: 7443 - protein, 54 aa, Xenorhabdus bovienii
  Peptide sequence Name=Xb4151_4152.C432.gene27.pep
LQPPLDLFRAVPILTNMPLLAYLLLSSFAIKLIHHIPLSVSCRKIYRKNQYCYS

SEQ ID NO: 7444 - protein, 69 aa, Xenorhabdus bovienii
  Peptide sequence Name=Xb4151_4152.C432.gene28.pep
MFRMVMRSNFERFSAAIYPSKLQTDNSLILNKRATSKGDADYKSVFITNNSTDSCGIFSGRRLIEGCDG

SEQ ID NO: 7445 - protein, 665 aa, Xenorhabdus bovienii
  Peptide sequence Name=Xb4151_4152.C432.gene29.pep
  Homolog annotation: Query=166..660bp; Hit=1..482bp; Blast score=435; Percent Identity=47.0; E value=1e-120; Homolog= gi|26251019|ref|NP _757059.1| Hypothetical protein [Escherichia coli CFT073] gi|26111451|gb|AAN83633.1|AE016771_144 Hypothet
LFRMRLLSVCNLEGYMAAENRSKLLRMTIRNIGCIGNEGIDIALDNIVCLVGKNNAGKSTVLRAYELAKGPTAFDASSDRHQHASEDEHSEILLEVHIPDGIGNVDAKWKQERDGFLVVKSRWQWKAPDFLKVRTTWDPTAGEHGEGDWAEDTKAGGADSVFNSRLPRPLRIGSLDDAGKTEDVLLSFALAPLQKELENARLNPESSLAKAIESVSGSINLLSEQHQEHFNGIAGRVSEGFKGIFPGLDVSLSIGAAPLAPKVADLIKNGSSLKITDGRANTSLSQQGTGARRALFWSMLQVHNELNRDKEVRAEFRKRLEKEVTELEKKLKKPPKNADLNALNDELIQVRAQLDAHDSGAPIPDSPDDPAFPGYLLLIDEPENALHPMAARAAQRHLYQLAKNPDWQVIMTTHSPCFINPFEDHTTIERLERDNSEENSAVTPRTYRSDHIAFEGDEKQRLQALQHIEPSFSEVFFGSHPILVEGDTEHAAFMTSIIERDNALMDQIAVIRARGKAILVPLIKVLTHFKIHFSLVHDSDSPNRSDGVKNGMWTENRKIHEALCQARNAGLTVRHRVSVPDFERFLGHREAYKDKPLNAYLQIKLDDGLAKRVQRLMDSLLNSDEHCSFGNEIDHDRYMEKLLGVVSGWAEANGYAEDLRFKSQR

SEQ ID NO: 7446 - protein, 39 aa, Xenorhabdus bovienii
  Peptide sequence Name=Xb4151_4152.C432.gene30.pep
MDYVRNVVTHTVATITLLGTCKQSLDIPNMHFRMVSIQS

SEQ ID NO: 7447 - protein, 760 aa, Xenorhabdus bovienii
  Peptide sequence Name=Xb4151_4152.C432.gene31.pep
  Homolog annotation: Query=4..612bp; Hit=21..619bp; Blast score=443; Percent Identity=38.0; E value=1e-123; Homolog= gi|20803924|emb|CAD31502.1| HYPOTHETICAL PROTEIN [Mesorhizobium loti]
MQSIQFDLHKLGWKAFEDLVSCILKETFGQTFQVFSDGVDGGRDGAFYGTWSGTGFGDGISNSFTTQCKHTSKQGMKLSKGVVSDELPKIERLVSKGLADVYLLFTNCSVSAETAAVMEEDMRKAGVKFAKIYGAEWINHSISLYPSLRRMVPRIYGLGDLSQIITNQAFRQAKSVLDSIAPDLACFVPTEAYRRCAHALRDYGFVMLIGEPASGKTMIANLLALSAADEWGLQTLILSSPEDLDRQWNPDDPGQFFWVDDAFGSNHCDFNRVQEWNQRLPKLKAAIHKGARVIFTSRSYIFRAAQNRLNTNKFELFRDSRVTIEVEKLSDPEKAMILYNHLKLGKQTKAFRRAIKSFLPSVVSVPKFLPEIARRFANPQFTNKLVPNEAAVVGFFSNPTGIMADIIGGLAPAERAALALIFSNGGELPIPLRFENPQTTNIITSMQSNLGDVKAALSALDDSLIRISKTQDEHYWKFRHPTIRDAFATDVSGNPELIDIYLSGVTKERLIEEISCGDMGIEGIKLVVPHSMFKSVLNIIDPSGNRALISRPILTFLASRCSIEFLGLYFNSGEAKTYLLDLISSARTYDNSLTILSRLNVNGLLGDDLRRKALDKLSALAAINHSDCFIDADFVGVLLSKEENEARLSVQKVEFYSNMNEIIQDIEDSWATDDDVDEAFYDVTRLLERFRDENNELYCEDFYDKDEWQKSEQFTREIEAKKNRMKQKQSEAVDYEELETEEAQSANLSSGRSIFDDVDE

SEQ ID NO: 7448 - protein, 54 aa, Xenorhabdus bovienii
  Peptide sequence Name=Xb4151_4152.C432.gene32.pep
VLLVRPRFLGGPDYHLPLSIVWQDFEVSSSGQALYLTRDGAKILFVNIIENTPT

SEQ ID NO: 7449 - protein, 351 aa, Xenorhabdus bovienii
  Peptide sequence Name=Xb4151_4152.C432.gene33.pep
MSSVMIWLSRLESTANKHRFAAGKAVRTVKANAILDEILETHSQEALRQDVPSLLSQAVTQLLEGDWRAQPKHKASWHRYWRGMSLPNTFVYEGAIVPTKTASEIAWHPWLAERITGQLPLPIKARLQQLNTYLFRQTKGDKPLFPGLLGHRERSLLIFGDEKALDSMPPDGWKHVTLTLADMGAFRRAPPLPYESSGCRDLPAIIVENSDVYYRLCQLNRVQTHWSLVIYGAGNKVSGQAECVSQLLKVEQVKQLLYFGDLDVAGLKIAHQLYCKLLSDYDISLQLDRWLYDELILNCWVTPEGNANSERFDFESLCGWMPRFVLRQMKMLLATHQRLPQEGVASLGLVI

SEQ ID NO: 7450 - protein, 1478 aa, Xenorhabdus bovienii
  Peptide sequence Name=Xb4151_4152.C432.gene34.pep
MWLIKRVYIDGAGHEEAFYKDLTLDYIGLSQAVDSPAIERQRSPVRNAKVVTSTYQQLVNGGGKSTYIALLLSIFEPSVSDFTQYLANRRQSEYHYRNYFYKELSVILVEMVNESGQTLLLGHAHQRNGDDVDRTLFICDAPDSLLGAPFDEVPSYSRAERDSELRSYANSLHSFESWLNLKAGGEGGMHWRKTSRQSEWRTFLLEQQINVDLIKTMVTFNSEEGGLTRFIEYKTEHDFLGAFFACTMSKDAAERLRELVAHEVERQGELEGIRRNESFLKDVLANWQTFLEPAKQLESTQTQLQLLDDGFRESMRDLTAFIGEAQIEQIQLEEDTGNLQKYIDQKRFLLEQLGKRRTLLEYDFAQHQLNKQKTKVDALKDEADANQRQIDITRTAIDYKAYAKVRDAYRQADEDLKVFQSETERPLQVIFERTAGEALGVLEWAINRHRQQEAKLVEEQGQISKESNALRQSYDELQKKLGGLEVGRDRYKIDKRQGELQREKLCEVGLIQKGETPSVAQYRLELTLHDAQQSEELANTDHYQKEQALEAQQNVVTNALVEQSKAQQTCTQADLNHQLAMDSAQGLVKTYQTLPASTQHDLDVEDISWHNERCGLQLEKVLNANAQTLNEMKQRLLQAQHELEELKLTGHELVTKQNNQALEAFYAAGIARDKLWAFPHYLASVFLDEAESIAAVIDHDPGRYLSLVALDDATFELVHKISEKLPWKKAPIAIHLLDEAQDLRRETPELVQVVLSNPDKHGYSKAAYNARLQELEDTVASQETSVKAVEDAFNILESFRGDWRLHYDQYGKHWARLVDHREQARLLLENADVALKQAEHYAQTLRDEKADALARLNSAQQQKIQAEKARDKLNRFVEMEWAKRETAIMKLEQLAEQIQRSEETLVNLREAQERQKELADNKSAEQTCISIQISEWNNLSNEPFYSEITATEGMEGRSPKDAHEKAAQALKQLLEAANGDQVTALKKQRKDAEQAQRYASERLIAQPIYSAYPDEVKAEAINELAVINNRITRLNEQQRQFTQNLINSKVTLQNLSQNCANARNALDEDFVWKEKPVEIEAIQTSLAEIANSLHETEYQLKLQLEKKALLLKKMENVKERLQNAKTAQATIQSITPSSAAGLPSRILSITEYADALSKQCQMYASLKETLKQQSIRVATVWGHFRKRIEEELAKGPDIRASQEYLRQLDSVATYHEVLGDLDRVGTGITQVFEAVQDSLEQFQRSIELTVTHLTAHLEGAIKLLKRAMSVKIPDDCPVLPGRPIIKMTDRLRDVTADLRGFASGRLQQWIARGQVPRAPNRDALTADLVQSVFGEGELEVRLLKTNASRPQWTPVTRLEGSGGQRLTSAFLLFVTVGKVREYDTGISSAGFLLADNPLGKSNADDLMRIQTQMARAYKIQLIYLTGISDENAQSMFDNHLFLNKVQKLRRRDLVTVDKERHALWSASLVAKPKSEPVF

SEQ ID NO: 7451 - protein, 298 aa, Xenorhabdus bovienii
  Peptide sequence Name=Xb4151_4152.C432.gene35.pep
MSDNTHQQAKRYAEIATQAIMNSLGYKMGDEPLQRALDLQGDTLFAEIIRGVAAGMKLRYLGIHESYGVLLAADGRGPFAPSLGWLNKRLLPEITGEQLSKERKEQRLFAGLTLIALLAELFPIPDTVRVEFGQSSAINAASVVARLNDVADQVIVQRKAEGDDTVDGLLTVARFVQEERIPRIHDEKVGRVSSIRSQTEMATRWIQLLQEEGFLAEDSSLSGESDWYPTQKLKHYLRHTGIEETVRFVMSISPATEDRSLDLVESDIAALVGTPRFPPVNERPAPTGTSDTQRLLEI

SEQ ID NO: 7452 - protein, 489 aa, Xenorhabdus bovienii
  Peptide sequence Name=Xb4151_4152.C432.gene36.pep
MSLEFLEQARNESMARRELTIQSHALLVVRTLDSIYRTLQRNPWEGVELDALAAIMHLFDAMLYYADRERQPGMTRKEAELCLVGHLNEAYPGQEASAYAQVASKIFAAIKDPFRLRYYDFTQRTHSEEQIVRLVRYDQLSGSDVILWSLTDEGMLFYTLRLDETPIERAAILAWRTLKTIRRGEIDKAVHQIQSTQRQLEQYLIGMRMKVRAAQSGDLSASYARDIRPVLNDSFDKTGEVLEHIRTTMSAITEMLVDGRSELHPDKLNKLRNAQEIFADVCIFTQRYQDCLHDVNKDFERARLKLIIPRDNTLFRETLEKGALKPLLLHSPDIVEKEIDDLITRVLAPRSQDDDRHILFDLEALLNLYLDRFEQALPHEIQDPTDQPVAIETTLRGIPESVIKKCSDWVSDRLKNRGHVSFRDVFDAYECDELSEQEQQVCLLHIGSVAANSDPTIEVEISGDAIETARWWASNLKLLTVAPVHHFEE

SEQ ID NO: 7453 - protein, 297 aa, Xenorhabdus bovienii
  Peptide sequence Name=Xb4151_4152.C432.gene37.pep
  Gene classification: Function=Predicted transcriptional regulator; Function class=K Transcription
  Homolog annotation: Query=21..270bp; Hit=13..270bp; Blast score=115; Percent Identity=31.0; E value=4e-26; Homolog= VC1772 COG2378
MYYSTFLEKHKTSLSHAQWLRLRYIERQLLWERKVTSRMIAEEFGVSAQQARTDVRTYLEIAPGNAFEQGGGRKGYFPSETFVPVLLGDNDLIWRATAEFQSPQTAHAQEIPLIHRAVHSRTLAIFLSAIELRGQVQVVYASMENPEGTSRTLTPTIIITVNGRQHVRAYDWDSSTFKDFVLARFLGLPELIVPAAAPPREDTSWEIAIPVRFIVNPALSEAQQEVIERDYILEPREFTIRAPMIFYLCPENNLPKTDDEYAQATDPSGQGPFVYPILAVHTQTGEPIHKYRHAGER

SEQ ID NO: 7454 - protein, 212 aa, Xenorhabdus bovienii
  Peptide sequence Name=Xb4151_4152.C432.gene38.pep
  Homolog annotation: Query=5..155bp; Hit=2..154bp; Blast score=120; Percent Identity=43.0; E value=1e-26; Homolog= gi|28897154|ref|NP _796759.1| putative integrase [Vibrio parahaemolyticus RIMD 2210633] gi|28805363|dbj|BAC58643.1| putative in
MAANLTETAIRGLKTKSTAYYVWSNSAQRGTGRLGVKVQPSGSKVFYFRYYVEKGKKEKFIQLGIWPEMKLVMANELAKKYGAWLIEGKEPQQELEQQRLAEQHIMQLHRSQGSFKELVHGYVNKMKLDNKRTWADVLKRMERECYTVIPRDTKATASLMKVCEYFKPTLGAKIDQYCFRSDLQAIIRPVTAHGNKLANRRAISRLHGGICE

SEQ ID NO: 7455 - protein, 45 aa, Xenorhabdus bovienii
  Peptide sequence Name=Xb4151_4152.C432.gene39.pep
LPDILIVSSLPDPLPDPKLASGQVMLILIKVDLWPLILPRLLYVD

SEQ ID NO: 7456 - protein, 51 aa, Xenorhabdus bovienii
  Peptide sequence Name=Xb4151_4152.C432.gene40.pep
LKCSDLALFVFLIVYNQSVMMLILFLFGCLISSLYHPYLTRYLTRNWHRVR

SEQ ID NO: 7457 - protein, 30 aa, Xenorhabdus bovienii
  Peptide sequence Name=Xb4151_4152.C432.gene41.pep
MEGNMRTLHYRSGVNRLYLTLLPEGILWVS

SEQ ID NO: 7458 - protein, 206 aa, Xenorhabdus bovienii
  Peptide sequence Name=Xb4151_4152.C432.gene42.pep
  Homolog annotation: Query=21..193bp; Hit=254..424bp; Blast score=107; Percent Identity=40.0; E value=2e-22; Homolog= gi|29827211|ref|NP _821845.1| putative transposase [Streptomyces avermitilis MA-4680] gi|29604309|dbj|BAC68380.1| putative t
VARANFCQRCQIVYNLTPQRWETHSAGWGAKGERQYDWVRVPLWRLQLSEKEREYGHYLLVRRSRDEKQERAYYIVYARRDQAALKTLAQVAGCRWEIEWGFEETKGECGLDHYEVRQWHSWYRHITLSLLAHAVLAVLRKKTPTGLVALSVAELRRLLSKLMKKAGETVEQVLHWSDWRRRHQYSAQQCHYQSRDNLMITEHLRL

SEQ ID NO: 7459 - protein, 64 aa, Xenorhabdus bovienii
  Peptide sequence Name=Xb4151_4152.C432.gene43.pep
MRERAFEAGMPCRWVTADAVYGQDRRLRCWLESRYQPFVLAIPKNEPLWWQGPTFVRGVRLSTI

SEQ ID NO: 7460 - protein, 195 aa, Xenorhabdus bovienii
  Peptide sequence Name=Xb4151_4152.C432.gene44.pep
  Homolog annotation: Query=8..155bp; Hit=11..158bp; Blast score=175; Percent Identity=58.0; E value=4e-43; Homolog= gi|5579418|gb|AAD45539.1|U70376_1 InsA [Streptomyces netropsis]
MHLPTHAWEQELLSLHTRLAPLFHHPGPQQRSLAYLRGLLSDVERKNGWQLAEWIGERTPDGVQHLLERAHWDVDIARDILRDYVTEHLGDEHGVLIVDETGFIKKGTHSAGVQRQYSGTAGRVENSQIGVFLCYAGQGGHAFIDRALYLPRQWTMIGPAVKLPAFLTPSPLPLNPNSPGRCGNAHSRPGCLVAG

SEQ ID NO: 7461 - protein, 59 aa, Xenorhabdus bovienii
  Peptide sequence Name=Xb4151_4152.C432.gene45.pep
VGRDGETTEPDEYGVRAVPVPRRESVSALNTSPYFRKKCQALSCHNGAYGCSTKLITQT

SEQ ID NO: 7462 - protein, 58 aa, Xenorhabdus bovienii
  Peptide sequence Name=Xb4151_4152.C432.gene46.pep
VTKNFKVAYTDTQGNHTHSVYIGSHHHTVSGVTANTGNGEIIDITNGYIMLMGWCRLK

SEQ ID NO: 7463 - protein, 47 aa, Xenorhabdus bovienii
  Peptide sequence Name=Xb4151_4152.C432.gene47.pep
MGTYIYRMSVIALSICICNFKIFGHVFIPLFLTYNEGKYVRDSDGIS

SEQ ID NO: 7464 - protein, 91 aa, Xenorhabdus bovienii; identical to SEQ ID NO: 6511
  Peptide sequence Name=Xb4151_4152.C432.gene48.pep
  Gene classification: Function=Transposase; Function class=L DNA replication, recombination and repair
  Homolog annotation: Query=1..89bp; Hit=1..89bp; Blast score=81; Percent Identity=46.0; E value=1e-16; Homolog= insA_g5 COG3677

SEQ ID NO: 7465 - protein, 121 aa, Xenorhabdus bovienii
  Peptide sequence Name=Xb4151_4152.C432.gene49.pep
  Gene classification: Gene name=InsB; Function=Insertion element IS1 protein InsB, putative transposase; Function class=L DNA replication, recombination and repair
  Homolog annotation: Query=4..120bp; Hit=49..166bp; Blast score=114; Percent Identity=50.0; E value=2e-26; Homolog= insB_g4 COG1662
MGSFISNKKRQRWLWYAWEPRLKRIVAHAFGARSKQTLRTLLEKLSAFDVAFWCTDNFGAYDILADEKHITGKLYTQRIERENLNLRNRLKRLNRKTLGYSKSVEMHDKIIGTFIERKFYY

SEQ ID NO: 7466 - protein, 73 aa, Xenorhabdus bovienii
  Peptide sequence Name=Xb4151_4152.C432.gene50.pep
MDYQFKSYSQGNKKKSLPVYFILVPFGIWIAYMIWSISLGQRVVMFEWFPKWTISITFAAFVGRVFNLLIGHQ

SEQ ID NO: 7467 - protein, 34 aa, Xenorhabdus bovienii
  Peptide sequence Name=Xb4151_4152.C432.gene51.pep
MNDDIYAINLKMQVLGSGNYQSAESPVPVLFLAM

SEQ ID NO: 7468 - protein, 349 aa, Xenorhabdus bovienii
  Peptide sequence Name=Xb4151_4152.C432.gene52.pep
  Gene classification: Function=Predicted transposase; Function class=L DNA replication, recombination and repair
  Homolog annotation: Query=183..336bp; Hit=34..184bp; Blast score=69; Percent Identity=29.0; E value=6e-12; Homolog= BH2520 COG3335
MIAPMKINLTDAQKEALELMHDTTRDGRVRDRIKAVLLASEGWTAQMIAQALRIYESTVSRHLKDYFSEEKLAPENGGSESRLSAEQTTELVEYLMANLMHTTAQIVAYVRARWQVTFTVAGMTKWLHRQGFSYKKPMGAPHKFDADKQQQFIETYNALKEECGQNAPILFIDAVHPTLSTKLSYGWMKSGRKHVKVVETTGSRTRLNIMGALNLQRIEETIVREYPTINAKNVVLFFGSIRETYPLSQKIHIILDGAGYHRSGVVQFFAEVLNIELHYLPPYSPNLNPIERLWKYVNEQVRNNVYFPDTKTFRETLCHFFHVTLPEKAKELTTRLTDNFQILKPASSS

SEQ ID NO: 7469 - protein, 64 aa, Xenorhabdus bovienii
  Peptide sequence Name=Xb4151_4152.C432.gene53.pep
MSLNSHLHIGITHSPIRQVFTNSRQGKLNAVMLIKMEKNRFISKTISVNGTQGRFVVLIFKDED

SEQ ID NO: 7470 - protein, 122 aa, Xenorhabdus bovienii
  Peptide sequence Name=Xb4151_4152.C432.gene54.pep
  Homolog annotation: Query=28..116bp; Hit=1..90bp; Blast score=99; Percent Identity=51.0; E value=7e-21; Homolog= Pa|Phot5-387a07.q1k _g23| 27702 - 27986 118 94 aa, chain - [Photorhabdus asymbiotica]
MGNSNMKVAVKGHVDKLNSKDIFVTEQIGMYLKDTYDFVGANEPLGIWSKNGILDKISSVDYAALYATGSWLALWIKYNGYIPVNNDSFRKWQKKHNEGSDFIVFSDILWMNPLPQYKTIHL

SEQ ID NO: 7471 - protein, 132 aa, Xenorhabdus bovienii
  Peptide sequence Name=Xb4151_4152.C432.gene55.pep
MKNKYKFFFRKPWLVLFFIIIFIIWMLFPSTLFFGNWNKYFEDRGEDGQYTAVVYKKLPISPYAMWKYVILGDKYFIVLYDNKNRDIWKSSPFTSISYGAFSASFSLPTANKDAFIYPTNDGYEVIYVNKLK

SEQ ID NO: 7472 - protein, 96 aa, Xenorhabdus bovienii
  Peptide sequence Name=Xb4151_4152.C432.gene56.pep
MPKYGIQANPHHSCCRPTSRSIHSHIDDLLMGTKTTSGISELQLPGVTAGLAKITLVTRTRAPIAMDPFHCGTRGASYINLCHLNVFQIDRLYMIQ

SEQ ID NO: 7473 - protein, 107 aa, Xenorhabdus bovienii
  Peptide sequence Name=Xb4151_4152.C432.gene57.pep
  Gene classification: Gene name=InsB; Function=Insertion element IS1 protein InsB, putative transposase; Function class=L DNA replication, recombination and repair
  Homolog annotation: Query=1..86bp; Hit=1..86bp; Blast score=111; Percent Identity=61.0; E value=1e-25; Homolog= Z1192 COG1662
MSGDSTSDGDWPEYRTSAFKKLKPKSVTEAIKPGTEVIVCCEMDEQWSYVKSKKPPRWLFYAYDRIRRKVIAHVFGPRTKKTLMRLFIYRLLSIKPFKTRIQCFVFT

SEQ ID NO: 7474 - protein, 424 aa, Xenorhabdus bovienii
  Peptide sequence Name=Xb4151_4152.C432.gene58.pep
  Gene classification: Function=Predicted transposase; Function class=L DNA replication, recombination and repair
  Homolog annotation: Query=77..354bp; Hit=7..292bp; Blast score=112; Percent Identity=28.0; E value=8e-25; Homolog= VNG6148H COG3385
MKPVTIIAIKHQLMQFFSDISLQHIAFQCAFMKRIRNIEPHVLILSLIAALSTGKITSIAQLHQKFNGLCPDKKQPVSYRPFYNQLRKAAFVEFVKILVRFAMAQWVEKQVSSPQKLMKFKQVILQDGSSFKVHSALADVFPYRFRTTGAAVECHMTMSLLTQSPVKMTVTADTAPERAYLPVPAMLRDQLLLADAGYVDFAYFEQVSLSGGSFIVRGSKSLNPQIVVTRNGQGKLLPKLLNKPLKSITRRTNRSEVLDLICRRNGYEFRLIRRWFAEEKRFCLWLSNLSVEEFTANDIMDIYRCRWQVELLFKELKSHTNWHRFATRKETLVTGLIWLSLLALLLRRSLASRLFPAVSLLKAAQNTEVWLWPIIENLLQRAWSETGFWLEKAQAYLCQNAFKTPQRKSCKYKTLDACFERLNA

SEQ ID NO: 7475 - protein, 91 aa, Xenorhabdus bovienii
  Peptide sequence Name=Xb4151_4152.C432.gene59.pep
  Gene classification: Gene name=InsB; Function=Insertion element IS1 protein InsB, putative transposase; Function class=L DNA replication, recombination and repair
  Homolog annotation: Query=2..69bp; Hit=85..152bp; Blast score=103; Percent Identity=73.0; E value=3e-23; Homolog= insB_g4 COG1662
VRLLALLAPFNIIIYMTDGWKSYEKALAGKRHVASKRYTQRIERHNLNLRQHLARLTRKTLSFSKSIEIMGWTPHSSGISVPKWKCINTVI

SEQ ID NO: 7476 - protein, 91 aa, Xenorhabdus bovienii
  Peptide sequence Name=Xb4151_4152.C432.gene60.pep
  Gene classification: Function=Transposase; Function class=L DNA replication, recombination and repair
  Homolog annotation: Query=30..91bp; Hit=26..87bp; Blast score=87; Percent Identity=53.0; E value=2e-18; Homolog= CC2740 COG3547
VCQNGSVLTQLFNNGSVHHEDDNGWYRSGKNVFQIHGVDAQGKTVLKKQLPRAKMLTFFVNLPPCLIGMEACGGAHYWARKLRSFGHDTHL

SEQ ID NO: 7477 - protein, 46 aa, Xenorhabdus bovienii
  Peptide sequence Name=Xb4151_4152.C432.gene61.pep
  Homolog annotation: Query=16..46bp; Hit=125..155bp; Blast score=62; Percent Identity=93.0; E value=2e-09; Homolog= gi|37527364|ref|NP _930708.1| hypothetical protein [Photorhabdus luminescens subsp. laumondii TTO1] gi|36786798|emb|CAE15864.1
VGRIIGHASCEVLVTTRIFDLRHSTKIDTVGKVATAIGHQLTVSIE

SEQ ID NO: 7478 - protein, 260 aa, Xenorhabdus bovienii
  Peptide sequence Name=Xb4151_4152.C432.gene62.pep
  Homolog annotation: Query=Organism:..Escherichiabp; Hit=coli..O157bp; Blast score=; Percent Identity=; E value=; Homolog= Pa|Phot5 -451c10.q1k_g195| 149072 - 151501 2582 809 aa, chain -
LLTACGVDVPAKGKHGACPICGGTDRFHFIDDNHHGDWHCRQCDQPNHGDGLDLVARAKGITILTAAKQVADVLAIPFPEPKPVKEQPRTVKPIAERIAELVAKSIRGESPYLARKGLQCPNQRLLQNSLLLVTQTLDGTITGAQTIKPNGEKRLVSGTQKKGSFILASEIIGTPDTIIITEGYATALTVSQLHHDGTVLSAIDESNLLNVAELVRTQWPESKIILAADNDWHKQGEKDKSGKLKKNVGKIAADKLTELL

SEQ ID NO: 7479 - protein, 37 aa, Xenorhabdus bovienii
  Peptide sequence Name=Xb4151_4152.C432.gene63.pep
MCYLLSDCCRYIIITRSPFVAIFIVWPSCIWSSSNAS

SEQ ID NO: 7480 - protein, 373 aa, Xenorhabdus bovienii
  Peptide sequence Name=Xb4151_4152.C432.gene64.pep
  Homolog annotation: Query=9..367bp; Hit=8..366bp; Blast score=258; Percent Identity=38.0; E value=1e-67; Homolog= gi|37524157|ref|NP _927501.1| hypothetical protein [Photorhabdus luminescens subsp. laumondii TTO1] gi|36783580|emb|CAE12426.1|
MSSVSPLLQHFASLEDPRVQRTQLHSLENILTIAICAVICGAEGWVEIEEFGESKQDFFTQLLALTNGIPSHDTFGRVFAALDAQAFADCFTSWISTLAQGVDQDIIAIDGKTMRRSLDKANGKAAIHLVSAFACTNRLVLGQVKVESKSNEITAIPKLLRRLVLSGSLVTIDAMGCQKAIAHQLHEAGADYVLSLKENHPGLYNDVSHYFDYVSSQPERLSEYEDVDAGHGRIERRTVQMTHVDWLPEKACWCGLHSIIRVIRERYVGNEVSRESCYFISTLRPTEAQRAATAIRSHWQIETQLHWCLDIAFNEDQQRMREGNAAANMALLNKIALNLLRLAPTKAGIKARRKRAGWDGEYLLTVLGKAHQI

SEQ ID NO: 7481 - protein, 37 aa, Xenorhabdus bovienii
  Peptide sequence Name=Xb4151_4152.C432.gene65.pep
MVNIYLQYWAKRIKFRCDCLGWQEPSCLLFDCYYKQY

SEQ ID NO: 7482 - protein, 81 aa, Xenorhabdus bovienii
  Peptide sequence Name=Xb4151_4152.C432.gene66.pep
LFSIIRLLLGGDGFIRFTRLCDNNVVKDVENDYEKISSSLPSSRHDSFSFNADLCFFLLTFGSVTPIICRVYSYLSFVKFG

SEQ ID NO: 7483 - protein, 84 aa, Xenorhabdus bovienii
  Peptide sequence Name=Xb4151_4152.C432.gene67.pep
MPSVNTGGIFVSAFHRAPQRNSNVEPLFRNEPLRNQLKLMLLYIQRLTHQTGRLAEWVKNQLQKNTLVWLLVHSRTSSLGLLGQ

SEQ ID NO: 7484 - protein, 31 aa, Xenorhabdus bovienii
  Peptide sequence Name=Xb4151_4152.C432.gene68.pep
MTERPDGLVINLTKKMAHRSRAVNEMVPTTL

SEQ ID NO: 7485 - protein, 346 aa, Xenorhabdus bovienii; identical to SEQ ID NO: 6355
  Peptide sequence Name=Xb4151_4152.C432.gene69.pep
  Gene classification: Function=Transposase; Function class=L DNA replication, recombination and repair
  Homolog annotation: Query=15..344bp; Hit=2..335bp; Blast score=241; Percent Identity=43.0; E value=7e-64; Homolog= PA2319 COG3547

SEQ ID NO: 7486 - protein, 68 aa, Xenorhabdus bovienii; identical to SEQ ID NO: 6354
  Peptide sequence Name=Xb4151_4152.C432.gene70.pep

SEQ ID NO: 7487 - protein, 55 aa, Xenorhabdus bovienii
  Peptide sequence Name=Xb4151_4152.C432.gene71.pep
VAYGLCTMPVDNLFHRSVAQTHCSARANHLCLASQPGRKYPYKIYGPHLFCNTDF

SEQ ID NO: 7488 - protein, 271 aa, Xenorhabdus bovienii
  Peptide sequence Name=Xb4151_4152.C432.gene72.pep
  Gene classification: Gene name=McrB; Function=GTPase subunit of restriction endonuclease; Function class=L DNA replication, recombination and repair
  Homolog annotation: Query=1..125bp; Hit=460..590bp; Blast score=63; Percent Identity=33.0; E value=2e-10; Homolog= PH0873 COG1401
LLGHYNAFERRFYEKDCLQALYKARTPRWEDTCNVILLDEMNLSRPEQYFAEFLSALEKNNADERLISLSETALPNAPQMLREGRKILVPGNVWFIGTANHDETTNEFADKTYDRAHVMTLPKQDSQFKIKPMGKRHYSFSSLRKAFEAARQKHKGEVTELLQALTRDSFTDCLDREFNLGWGNRFEKQALDFIPVMLASGAMKGIALDHLLSTRVMRSGKVTGRYNVSVDAVKALKGALESFWSREKLVGEPVKSLEFLNADIRRMEGRN

SEQ ID NO: 7489 - protein, 605 aa, Xenorhabdus bovienii
  Peptide sequence Name=Xb4151_4152.C432.gene73.pep
MWLDRLTGETISQLPSQIEAGRYQLAVSSLVFNSHTTDFSGVLVSDGGERCQLGDEVRTFVMPRQVKSNKSALLFRAVETIYPDMMPSSALISPLMPGAIIDQQSQLLPFEQNLLEVVKKGHLHQISQRPRLDVHYEDEVADIARARRLAKGALVHLASHSECWQRQTLNGVIPRKVLARFSHDDYDIYENRVYARLLDKAERHLRTRLSTLLSLQVTLEQALEFYQTEGTHHLLAYEVCQLWGMTFNEDKTNQALVHLNETVDTLHMLHKTLSGLQQTGLYTLVNRNAQVTGILHPTNILGHDPHYRHLTMLWELLDSTTVEKTTPQERFRHNQYLVEAYSRYAGLVLRHALYPYLQGESEGLWAGKTLQLAQKGLEWHLICRTEKGNSAGNTLLILVPWLTDLAEPINETKLTSERFVAWPSQDLALSPSGYVDNWIALSPSDMYCVERFGLLINRTLYRQVLKSFARPITKIPTKALAVAEKIAHIHVEHQSHCLTVQGEVADIDLEKLKRTLKEANAHEKASDVVQRCREILFLQSCPVCQHKTTIAFQPPGGFKTICGKCGTERYLRQKEEGLFLEQTGTKGVQTSNFMTLGKRSFSMQI

SEQ ID NO: 7490 - protein, 92 aa, Xenorhabdus bovienii
  Peptide sequence Name=Xb4151_4152.C432.gene74.pep
MTSIHSARTIRMRFKIWNYMVICCMWILLRYAVLVAFFACTRISLLADALSTGLAEETYAWGNPGAIKNIVAQARDLIVTITDEQLIWEQVY

SEQ ID NO: 7491 - protein, 108 aa, Xenorhabdus bovienii
  Peptide sequence Name=Xb4151_4152.C432.gene75.pep
LFDFVQLGLLGGLNGFGKYYARSIENEGTRDLLVLGKLLTLIEPQILRHIKEDVARDWPQQQNIAESIQQEDIGMFLVLVRLPRETDGQITERCCRFSIPAPRLIAHR

SEQ ID NO: 7492 - protein, 53 aa, Xenorhabdus bovienii
  Peptide sequence Name=Xb4151_4152.C432.gene76.pep
MKKRQKSSTSQKISTKLSIAYSPRNCVRRSPKLCSRNRLLVNFLSRIRVNKVL

SEQ ID NO: 7493 - protein, 129 aa, Xenorhabdus bovienii
  Peptide sequence Name=Xb4151_4152.C432.gene77.pep
  Homolog annotation: Query=1..102bp; Hit=1..102bp; Blast score=179; Percent Identity=83.0; E value=7e-45; Homolog= gi|37524409|ref|NP _927753.1| Transposase, IS982 family [Photorhabdus luminescens subsp. laumondii TTO1] gi|37524578|ref|NP_927
MDNLVEIFCDVDDFCRFFIPQWERFCLDNGYRFRCRQGHMYLSEIMTILILFHMSHYRDFKAFYLKFLWVYHHKDFPTLLSYTRFVSVAPSVMVSLSSYLSRSYNHATYLDEKKAMMQEWSANLDEWSG

SEQ ID NO: 7494 - protein, 539 aa, Xenorhabdus bovienii
  Peptide sequence Name=Xb4151_4152.C432.gene78.pep
  Homolog annotation: Query=6..534bp; Hit=5..523bp; Blast score=298; Percent Identity=33.0; E value=1e-79; Homolog= gi|37525767|ref|NP _929111.1| hypothetical protein [Photorhabdus luminescens subsp. laumondii TTO1] gi|36785196|emb|CAE14127.1|
MRTVRMLFEYALNDSNTIVHVDSVPNGKRCNCVCKHCGDTLIARNNGKIVTHHFSHTTKEESRDCRMTQLHIAMQLHFSSLSEITLPTNEITIDETDIVVFDLTTEVKKSVLEYRIGPYLADVYLATDTGYVAIEVCVTHKCDEDKERYYIDQQIDSIEYYFPLAKGNSISEWIYLVRNNLVEYKWIYHSELEIKKIEYFKQIEEEKRNKKAEKRNSALTSLRNAISSKRIHLPNIHKEMEHIYAGQSYKERLLIYSKRDVTCDKVLLCHESSDYSVIEGYIDNRVISIIYSFTEEIPTLNYQDDRSIVCCHYSNESNTSTWTWVKHPSLTKKFDKIKLQFRSDCKHIYHKRVRSVYLKDEVTKFASEYLDNRQAYFNRDYQKWRRWMINKELFIPSQNKKNPSFPDILKKREYRMLWPFQAWDIIVLCNLAEMVDAYPVSQKIYYHDLFIELVGKYDLSEQYRYLSKEFKDLNTSTTTFDSLIDEDRIIQNVLSTFDSLIAEDRMIQDALSPFAKMSIISVSKDHLIRKGSLILALVI

SEQ ID NO: 7495 - protein, 70 aa, Xenorhabdus bovienii
  Peptide sequence Name=Xb4151_4152.C432.gene79.pep
LTTSSQITYSIPTKTKNSARKRWQAGLSEEQTDLLIVSNGYQHQNERIINSNASQSIGDRSAWQREQPCP

SEQ ID NO: 7496 - protein, 166 aa, Xenorhabdus bovienii
  Peptide sequence Name=Xb4151_4152.C432.gene80.pep
MLIVALLSILPGMGYVKLGQAVVTKRFRHFSGIIILTMILLISMYVPSFIPVLIDKSLSAAGVADWHIRRYQIDESRMPMALFTRSEWKVSPLVAGKSFTVEGILIYSLNNVKLLCPATIKNDYLNMLHFVPWDKDYDKKQGEVLKKHAARCQSFIQGGVARIVEE

SEQ ID NO: 7497 - protein, 71 aa, Xenorhabdus bovienii
  Peptide sequence Name=Xb4151_4152.C432.gene81.pep
MPKSLRHNGLAQFHVPHSGKDRKQSNNKHRYTRFISVAPSVLVALCSYLNSLSRIQIPSQSLNCKRYFCVK

SEQ ID NO: 7498 - protein, 42 aa, Xenorhabdus bovienii
  Peptide sequence Name=Xb4151_4152.C432.gene82.pep
LHVRFLGGRHLVTGVVYPTLCVSADGVMKSGTLFNAEIPLAV

SEQ ID NO: 7499 - protein, 364 aa, Xenorhabdus bovienii
  Peptide sequence Name=Xb4151_4152.C432.gene83.pep
  Gene classification: Function=Retron-type reverse transcriptase; Function class=L DNA replication, recombination and repair
  Homolog annotation: Query=3..202bp; Hit=103..338bp; Blast score=89; Percent Identity=33.0; E value=5e-18; Homolog= ykfC COG3344
MIDRTQQALHLLALDPISETIADPNSYGFRPNRSTADAIAQCFKCLCQKRSARWVLEEDLKACFDKIGYQWLIENIQIDKRMLKQWLGSDFIDKGLFYRTAEGTPQGGIISPTLMLLTLAGLEKRVKEVARKTDDRINSIEYADNFVMTGASEDVLLNEVKPQLIDFLRERGLTLSEEKTHITHINDGFDFLGFNLRKYRGKLLIKLSKSNVLLFLSHLRELIKRHATTPVNDLIKMLNPKLRGWANYYRHCVAKRTFGYPGHQLFWLLWRWAVRRHPTKSKDWVRRKYYMNRQGEWQFHGWQKIANMDGHFNLVQIAQTPIKRHVKIRSVATLFDPQYQTYLAKSKSKKESRHSWHDPALTAM

SEQ ID NO: 7500 - protein, 104 aa, Xenorhabdus bovienii
  Peptide sequence Name=Xb4151_4152.C432.gene84.pep
  Homolog annotation: Query=14..98bp; Hit=21..105bp; Blast score=93; Percent Identity=54.0; E value=9e-19; Homolog= gi|22298162|ref|NP _681409.1| reverse transcriptase [Thermosynechococcus elongatus BP-1] gi|22294341|dbj|BAC08171.1| reverse tr
MMASTEVSASPNGTQWQSIDWKAIESHVLKLQMRIAKATREGEHGKAKALQWVLTHSILAKLLAVKRVSQNKGSHTLGIDGIIWNTDARRMAAANQLKSERLSS

SEQ ID NO: 7501 - protein, 69 aa, Xenorhabdus bovienii
  Peptide sequence Name=Xb4151_4152.C432.gene85.pep
MRLNRFPVNGLPLCAVRRGTHFCRSHHLRFSLNKVLQIILQWETRQKSARFRARYQSVSASLQRGLRFF

SEQ ID NO: 7502 - protein, 51 aa, Xenorhabdus bovienii
  Peptide sequence Name=Xb4151_4152.C432.gene86.pep
MPTLVRRVYRSRKSTAQLLSNSRCHFGHSVLTTSAVSHITYLTWIHLCSSY

SEQ ID NO: 7503 - protein, 74 aa, Xenorhabdus bovienii
  Peptide sequence Name=Xb4151_4152.C432.gene87.pep
LPFWPQRINHFRCFSYNVPYMDSPMFIILTPWRLPDLWLSGRTSSHDSIPIQPCGRISLHCQIRCFIQNPRVTW

SEQ ID NO: 7504 - protein, 52 aa, Xenorhabdus bovienii
  Peptide sequence Name=Xb4151_4152.C432.gene88.pep
MGNSFPGTKNNVRNTMAFWVNRGVGCQCSFHAVTRSGRLVYNSFMPVRPEVV

SEQ ID NO: 7505 - protein, 61 aa, Xenorhabdus bovienii
  Peptide sequence Name=Xb4151_4152.C432.gene89.pep
LRLRNLHRHQTDDICFQRCADVPHGCVLPCRLQECYCRCPKVILTSDRIIDKSDYANKRKS

SEQ ID NO: 7506 - protein, 68 aa, Xenorhabdus bovienii
  Peptide sequence Name=Xb4151_4152.C432.gene90.pep
VVHLRTFGSRYRQSDDDEGFLISTIMANRPVTQRGTRFLLGQVFPVVLSGEYHATKYNPGNGTHCARV

SEQ ID NO: 7507 - protein, 144 aa, Xenorhabdus bovienii
  Peptide sequence Name=Xb4151_4152.C432.gene91.pep
  Homolog annotation: Query=1..139bp; Hit=1..141bp; Blast score=60; Percent Identity=31.0; E value=6e-09; Homolog= gi|10955198|ref|NP _044227.1| KlcA [Enterobacter aerogenes] gi|32455788|ref|NP_862440.1| KlcA protein [Pseudomonas sp. ADP] gi|1
MQQNTTPATAHTVPASEHSPFAEIFPQTSSLELMLLEHTFIKAAAVLCDDDRCDQWEYRKVSDNIAYVVPARSDSSVVNVNTTGFKGEVSADAFGLMVTLSVLGYLAALMKLDGYAERFCDLREYALQHPQAQCIRAALGLKDA

SEQ ID NO: 7508 - protein, 153 aa, Xenorhabdus bovienii
  Peptide sequence Name=Xb4151_4152.C432.gene92.pep
MPNNELIMLDSLALSVVFPDKTPLERLFLGFLLANTASTLCGDYQPEQWTSRQVSESLTYMVPTRAETYSVYLPDTQLTVTLSADAFGLAVTAIVSARIAVLETPNEEVYRFCALQEYAQQHPESGLITSIMTLKPREDVISPSLIPDKNNHH

SEQ ID NO: 7509 - protein, 51 aa, Xenorhabdus bovienii
  Peptide sequence Name=Xb4151_4152.C432.gene93.pep
VPASSGAGKKMGFMVLFLDFTLNKENTRPIPGRCFRFPGQALKKSVNSLMG

SEQ ID NO: 7510 - protein, 184 aa, Xenorhabdus bovienii
  Peptide sequence Name=Xb4151_4152.C432.gene94.pep
MNPIFLPAPDEAGTTLREELFTAQVTGLRQHPKALQSLQPETLMVCEAATVAEVVQRLKVIHLLGDWPVPERLSAQVSGTFFPLTVMIFDAQDRKVLGGRFDEEIIWAQPVTLTSERLSLEQQQQRLCQAAMLEQSWQNTPTARALWHKAHLLSLHMVSSRYQQCSEVQDILRHGVSVSIPEAA

SEQ ID NO: 7511 - protein, 98 aa, Xenorhabdus bovienii
  Peptide sequence Name=Xb4151_4152.C432.gene95.pep
MTTTRLTVWQVIAAALLKRHFGLNLTDTVLCETGTVAALIARGVRPSEAINELVDKYDLIRLNTQVILRSTPYLDIHDELTVIFDSGLADRLFRQTGQ

SEQ ID NO: 7512 - protein, 307 aa, Xenorhabdus bovienii
  Peptide sequence Name=Xb4151_4152.C432.gene96.pep
  Homolog annotation: Query=1..269bp; Hit=41..311bp; Blast score=204; Percent Identity=40.0; E value=2e-51; Homolog= Pa|Phot3-157a10.p1k _g91| 49883 - 50923 4655 346 aa, chain -
MAEWCTNQLEITGKSVCLDVMQQWVCGEEVPRYRQAVLQSLRLFLAGCAGILKPTKPQTYTPYPALVRGTAVPTAQHLAFEQWLLLLQNNVPLNNDNIKRIDNLYRQSGLSLMSWDKVPEAARDIIARLLTRQYTDWFGMVGWSDTPDIGACWDKLNAYPQAAQPCDMLMMMSTNLATEINGNSTLLKGIATTAQFYEEQYGLEWPFGHHVRWERRNVSSLTVRFDSPWAPPSPELMGELSAMFDCEIRHWYSDASGQLKGYDCYDQGEHVDSGYGQSGRENRPALYLVTGEQAETALALPAIAVGQ

SEQ ID NO: 7513 - protein, 206 aa, Xenorhabdus bovienii
  Peptide sequence Name=Xb4151_4152.C432.gene97.pep
LNIRHHGRQRVNINRINPQTAQRIVPQLPQHFSGGQSYTASTTARLAQGDKRLCLQQPGGILQLHLCHHSGHTPGGKELLKILITQFQPHKHTTQKITGFLRQSEHHMRKQLYDPVNIGPLVLVNGFQIILLQLLTETVFIVDRCHSTIAKIPEDLITGMITGRLLKQRNKFFLMIGSGGHCVFSLLNKKRKKENTPRKGNSSPFG

SEQ ID NO: 7514 - protein, 83 aa, Xenorhabdus bovienii
  Peptide sequence Name=Xb4151_4152.C432.gene98.pep
  Homolog annotation: Query=1..77bp; Hit=155..230bp; Blast score=87; Percent Identity=55.0; E value=6e-17; Homolog= gi|37525131|ref|NP _928475.1| hypothetical protein [Photorhabdus luminescens subsp. laumondii TTO1] gi|36784557|emb|CAE13457.1|
LAAAEVLRELGHDPLCSLWVYAIDIDPLAAVMAYIQLSLTGIPAAVTIGNALHDGGDKRTRYTPAHYLGNWSQRLREAELIAA

SEQ ID NO: 7515 - protein, 40 aa, Xenorhabdus bovienii
  Peptide sequence Name=Xb4151_4152.C432.gene99.pep
MNRVSLIFISEKRVVPCFRQGLTDTEPNLNRKRKSDVSAF

SEQ ID NO: 7516 - protein, 297 aa, Xenorhabdus bovienii
  Peptide sequence Name=Xb4151_4152.C432.gene100.pep
  Homolog annotation: Query=11..280bp; Hit=24..291bp; Blast score=192; Percent Identity=41.0; E value=8e-48; Homolog= gi|37525013|ref|NP _928357.1| hypothetical protein [Photorhabdus luminescens subsp. laumondii TTO1] gi|36784439|emb|CAE13323.
MFQRFKSRFTRQKLPQPKSRPPEDSRFFFQPQSADELLATPLRRQYLQQLWQNSALPEGLYQRFYLAPVKQLLGNVQQVPATPKGEWSASGGFADLTLAFTTCAVRLAKGHMLPPGVPPETQAVQSLLWQAVVFWVALFYHLPLLRQLEGELEDGYHWQPGVCVPDKPFRFRFRTPENTPSIPQEALLAACLLPEKAMMWLVSVPEVWHCLMQHLNGRPSTVPLIDALLQEAAGLVHSPRVKPSVSPAVADTACVSETGATTAPETTPIPPASEMNSSSPFTADDTRTLLSLFQSTD

SEQ ID NO: 7517 - protein, 49 aa, Xenorhabdus bovienii
  Peptide sequence Name=Xb4151_4152.C432.gene101.pep
VTVSDNTSFSRPDRLISFESGWLFFPSGCRQEINQLIEIMTAVSGYRQP

SEQ ID NO: 7518 - protein, 46 aa, Xenorhabdus bovienii
  Peptide sequence Name=Xb4151_4152.C432.gene102.pep
MFLLCTTSSFSLNYHAFMRFPVQKPPSGAQNTHNYLNYLLLNDEVR

SEQ ID NO: 7519 - protein, 342 aa, Xenorhabdus bovienii
  Peptide sequence Name=Xb4151_4152.C432.gene103.pep
  Homolog annotation: Query=6..338bp; Hit=2..328bp; Blast score=334; Percent Identity=54.0; E value=1e-90; Homolog= gi|37525014|ref|NP _928358.1| hypothetical protein [Photorhabdus luminescens subsp. laumondii TTO1] gi|36784440|emb|CAE13324.1|
MLYTAETFSWEALLDEYFFSHILRPDTEWSYRKVVRGFIRFMGEAASPAQVTHRDVLRWRRHLLLEKKQSSHTWNNKVAHLRAIFNFGMEQKLLPHTENPFNNAVVKKEKKKKKILSESQINRINLLMGKFAEDERTQVAPKGGRCALYPTWYWSTVLATLRFTGMRQNQLLHLRLRDINLEGNSIELGLAGSKNHCEWEVPIVHPLKPRLAHLIERATAAGAEAGDPIFDLSRLSVPHPSRLSRYKYDINREKQQLRSFFRRLSRECDFAVSPHRFRHTVASTLMKAPDRNLPLVKRLLGHRNVATTMEYIDLDMEVTGKTLERELGLYTDRADESGGESE

SEQ ID NO: 7520 - protein, 40 aa, Xenorhabdus bovienii
  Peptide sequence Name=Xb4151_4152.C432.gene104.pep
MISVIDSDVKSVKTSRDAGSVIFLFHTINIDAGQLAQTTS

SEQ ID NO: 7521 - protein, 65 aa, Xenorhabdus bovienii
  Peptide sequence Name=Xb4151_4152.C432.gene105.pep
LTSESITEIITFNKKGVTVKTATLQSCLNFFKHHNSVQIVIQHLINYCLFFAPLSGNLTTSDKPA

SEQ ID NO: 7522 - protein, 190 aa, Xenorhabdus bovienii
  Peptide sequence Name=Xb4151_4152.C432.gene106.pep
  Gene classification: Gene name=AcrR; Function=Transcriptional regulator; Function class=K Transcription
  Homolog annotation: Query=1..190bp; Hit=9..199bp; Blast score=202; Percent Identity=54.0; E value=2e-52; Homolog= yjdC COG1309
VQREYVLSHALTLLEQHGLSSTLETLLTPLKVDINQIKHFWPDREALLYDCLRHHGQQIEIWQRQILLDEVLSPEQKLLARYDTLKEKVQKQRYPGCLFIAACSVFPDTEHPIHQLAELQKQNSFHYTVELLQQLEIENSERVAKQMELILEGCLSKLLVKRELEDVITAKLLAQDILTIAKCRKNGAFS

SEQ ID NO: 7523 - protein, 583 aa, Xenorhabdus bovienii
  Peptide sequence Name=Xb4151_4152.C432.gene107.pep
  Gene classification: Gene name=TrxA; Function=Thiol-disulfide isomerase and thioredoxins; Function class=O Posttranslational modification, protein turnover, chaperones
  Homolog annotation: Query=1..582bp; Hit=1..564bp; Blast score=652; Percent Identity=59.0; E value=0; Homolog= ZdsbD COG0526
MMKRILILFLLLGGIAISPVKANALFEQPGQNRYLPVAQAFVFDFQQKGNELTLNWDIKPGYYLYQKQFIITPIKATLGHLNFSESVDHEDEFFGKTKVHFGSAQINAPILSASNDSNLQVTYQGCAEAGFCYAPETITVPLSAIIASAPSANEAAKQPDITTSQKASLPQEESPPNVPDVPFSPLWALLIGIGIAFTPCVLPMYPLISGIILGQRRPDSLKRIFWLAMSYVQGMALTYTVLGLIVAAAGLQFQAALQNPYILVGLSILFILLALSMFGMYSLQLPSSVQTRLVDWSNQQKSGSYIGVFVMGILAGLIASPCTTAPLSAILLYIAQSGNTLLGGLTLYLYALGMGLPLIAVTLFGHKLLPRRGPWMQYVKEAFGFIILALPVFLLERVLGDTWGIRLWSLLAIAFLGWAFALTLNSKKGWLRTLQLILLVLTLIASRPIQDWVWGNSATTQQQPSLKFQQVSNWQELSQILAKNRHQLIMLDLYADWCVACKEFEKYTFPDPQVQAQLSQFLVLQANVTENGSKQKELLDKLKVLGLPTILFFDAHGKELPDSRVSGFMDAGRFSRHLQHLQK

SEQ ID NO: 7524 - protein, 31 aa, Xenorhabdus bovienii
  Peptide sequence Name=Xb4151_4152.C432.gene108.pep
MSFISYSSNSDIMLTLANFMNQDTDRSKIIL

SEQ ID NO: 7525 - protein, 433 aa, Xenorhabdus bovienii
  Peptide sequence Name=Xb4151_4152.C432.gene109.pep
  Gene classification: Gene name=DcuB; Function=Anaerobic C4 -dicarboxylate transporter; Function class=R General function prediction only
  Homolog annotation: Query=1..433bp; Hit=1..433bp; Blast score=570; Percent Identity=81.0; E value=1e-162; Homolog= dcuA COG2704
MLAVELVIVLLAIFLGARLGGIGIGFAGGLGVLILATIGIKPGNIPFDVISIIMGVIAAISVMQVAGGLDYLVQQTEKLLRRNPKYITILAPIVTYCLTLLAGTGNISLATQPVIAEVAKEQGIKPCRPLSTAVVAAQIGLTSSPISAAVVYMSSVMEGQGVSYIQMLMVIIPSSFAAIILMSFIVSWFFDSKLSDDPVYQKRLADGLIELRGSHKVDIKPKAKLSVLLFLLGVVGIVIYAIINSPSLGLVEKPLVNTTSAILIIMLSIATLTTVICSVNTDAILNSSTFKAGMSACICIMGVAWLGDTFVQANMDWIKETAGSLIHAQPWLLAVIFFFCSALLYSQAATAKALMPMVLALHVTPLTALASFPAVSGLFILPTYPTLVAAVQMDDTGTTRIGRFVFNHPFFIPGTIAVALAVTFGFLVGGMIL

SEQ ID NO: 7526 - protein, 36 aa, Xenorhabdus bovienii
  Peptide sequence Name=Xb4151_4152.C432.gene110.pep
MKYNIFSDQFIHSVGSNAFYFHQQYKNLTINFHNIK

SEQ ID NO: 7527 - protein, 47 aa, Xenorhabdus bovienii
  Peptide sequence Name=Xb4151_4152.C432.gene111.pep
LYFIKSSSKRFTLYTGYFSLLSNLIKITSLYFVLTQTFHVFISVNYI

SEQ ID NO: 7528 - protein, 38 aa, Xenorhabdus bovienii
  Peptide sequence Name=Xb4151_4152.C432.gene112.pep
MLSNGKRYEVFLMVIIRYRACKLNCVFTLSLLIKNVVL

SEQ ID NO: 7529 - protein, 189 aa, Xenorhabdus bovienii
  Peptide sequence Name=Xb4151_4152.C432.gene113.pep
  Homolog annotation: Query=1..188bp; Hit=1..212bp; Blast score=176; Percent Identity=45.0; E value=2e-43; Homolog= gi|37524409|ref|NP _927753.1| Transposase, IS982 family [Photorhabdus luminescens subsp. laumondii TTO1] gi|37524578|ref|NP_927
MTTLEELYCCVDDFCQKFSPLWHQQLIENGLCQRRRSFFLSLSEVMTLLILFHMSHYRNFKCFYLEHVILYLHKEFPGLVSYTRMLTLKKRALISLHTFLSSRKSQTAGIAFIDSSKTGWFYGFKLHWLIDDYGALLAVKLTPGNTDDRQSVKTLLNGVIGHVYGIKGYLSQALCDELTAEGNRTFKTP

SEQ ID NO: 7530 - protein, 66 aa, Xenorhabdus bovienii
  Peptide sequence Name=Xb4151_4152.C432.gene114.pep
MYMASKVIFHRHCVMSLPQKGIEHSRHRSVLGFLLEVVSGLMAYTFQPKKPSLNLRSSERALLKRS

SEQ ID NO: 7531 - protein, 183 aa, Xenorhabdus bovienii
  Peptide sequence Name=Xb4151_4152.C432.gene115.pep
  Gene classification: Gene name=LeuD; Function=3-isopropylmalate dehydratase small subunit; Function class=E Amino acid transport and metabolism
  Homolog annotation: Query=3..177bp; Hit=50..213bp; Blast score=114; Percent Identity=40.0; E value=6e-26; Homolog= aq_1398 COG0066
MSVLQENIIRGTVYVLTDNIDTDQILTAEYLKVNPSTPEGYAQLASLAMCGLPEGSLPFIDEEQGKAKYPIIVAGQNFGCGSSREHAVAALGASGVKAVLAQSYARIFFRNCVSTGELLPVAAQERLCDKLVTGDRIEIDIENQTVTLLENSEKYPTDPVGELANIVAAGGLFSYARMTGRIK

SEQ ID NO: 7532 - protein, 432 aa, Xenorhabdus bovienii
  Peptide sequence Name=Xb4151_4152.C432.gene116.pep
  Gene classification: Gene name=LeuC; Function=3-isopropylmalate dehydratase large subunit; Function class=E Amino acid transport and metabolism
  Homolog annotation: Query=1..430bp; Hit=1..420bp; Blast score=338; Percent Identity=41.0; E value=1e-92; Homolog= PAB0891 COG0065
MSQTMTQKILARASGREQVTPGEVVWAKVDILMSHDPCTPGVASVFKKEFGQDARIWDPTRFILIPDHFVYSADPQANQNIRVMREFAAEQNIKYFYDVGTPNYKGVCHIGLAEGGHTRPGEVLLGTDSHTVTAGAFGAFAIGLGITDAAYALGTGEIPLKVPTSIKVNFTGTKPPHVLAKDMILAVLSELTVDGATYEAIEFGGNVIDELSVEERMTICNMVVECGAKNGIMVPNQATLDYLAERNHLPFEIVYPDEDAEYSRVLNIDVSDMQPMIAKPHSPDNVVPIEKIANVAISQAYIGSCTGGKLEDFIAAARVIKGNKVSIPTYAVPATKEVFHKTITTQIDGVSVYQILTDAGVTLSSESGCAACCGGPPDTFGRVNDPISVISTTNRNFVGRMGHKRANIYLASPYSVAAAAITGRITNPGEFL

SEQ ID NO: 7533 - protein, 42 aa, Xenorhabdus bovienii
  Peptide sequence Name=Xb4151_4152.C432.gene117.pep
LSALFLYWNSCSSEGKFLRFYSDTIFAAQFNAWLKYHLYLIE

SEQ ID NO: 7534 - protein, 33 aa, Xenorhabdus bovienii
  Peptide sequence Name=Xb4151_4152.C432.gene118.pep
MIYLGESPPNISQMLWRKANITQSDKGGILTRH

SEQ ID NO: 7535 - protein, 306 aa, Xenorhabdus bovienii
  Peptide sequence Name=Xb4151_4152.C432.gene119.pep
  Gene classification: Gene name=LysR; Function=Transcriptional regulator; Function class=K Transcription
  Homolog annotation: Query=1..295bp; Hit=1..288bp; Blast score=155; Percent Identity=31.0; E value=6e-38; Homolog= PA3630 COG0583
MNNIENLTSMVIFARVVETLSFTEAAKSLRLSKSSVSREIAQLEVRLGTQLLNRTTRKIQVTEVGLSYYQYCSRILNEAKSAERFIRNFHDEPMGNLRLIAPVSFGSQCIVPALNNFIARNIHVSVDLELTDRTINMTDDNYDIAIIVGRETPDHPLVMPLIDITWGLYATPDYMSQFPPIEKPEDLPRYDYLLFRGPAHTISLPFRKERQKLDIEVRSRFRINNSVALMSSALSGAGIAYLPDYIAHESVAEGKLVRLLPGWHMDIYQTWMMFKSENTLSARVQLFADALQQKLQGDLGDSKREE

SEQ ID NO: 7536 - protein, 259 aa, Xenorhabdus bovienii
  Peptide sequence Name=Xb4151_4152.C432.gene120.pep
  Homolog annotation: Query=5..259bp; Hit=8..262bp; Blast score=390; Percent Identity=71.0; E value=1e-107; Homolog= gi|23024361|ref|ZP _00063576.1| hypothetical protein [Leuconostoc mesenteroides subsp. mesenteroides ATCC 8293]
MSNKKIEWNNGLQQEAVEILSNEGGMIVCPTKVGYIIMTSDAQGLERKFEAKQRNRNKPGVVLCGSLEQLKELAQLNPEIEELYQKHWDADVLLGCILPWKEDAVARIPDDGSKALMMDGRGTSCFVIKFGKPGEILAKALWENYGKFSFASSANPSGKGNRGLVECIGERIEERADLIIDANHYVKSIQPNETEQTRYEQGVMISMVDDNGALVPMQNGQRDITPCPVLIRKGLDVHKIMVMMSDIFTTWDYRHGNYY

SEQ ID NO: 7537 - protein, 308 aa, Xenorhabdus bovienii
  Peptide sequence Name=Xb4151_4152.C432.gene121.pep
  Gene classification: Gene name=SpeB; Function =Arginase/agmatinase/formimionoglutamate hydrolase, arginase family; Function class=E Amino acid transport and metabolism
  Homolog annotation: Query=3..306bp; Hit=1..304bp; Blast score=516; Percent Identity=82.0; E value=1e-147; Homolog= speB COG0010
MSISSLGNQIDNSLVSNAFGFLRFPLNFQPYSSDAEWVITGVPFDMATSGRAGSRHGPAAIRQVSTNLAWESCRWPWDFSLRKRLNVVDCGDLVFNFGDAQDMSDKLQAHAEKVLASGKKMLSFGGDHFVTLPLLRAHAKHFGKMALIHFDAHTDTYPNGSKFDHGTMFYHAPNEGLIDPHRSVQIGIRTEHDTDNGFTVLDAAQVNDRSVDAVVEQIKNVVGDLPIYLTFDIDCLDPAFAPGTGTPVIGGLTSDRALKILRGLQPLNIVGMDVVEVAPAYDQSEITALAAATIGLELLYLQASKKAV

SEQ ID NO: 7538 - protein, 41 aa, Xenorhabdus bovienii
  Peptide sequence Name=Xb4151_4152.C432.gene122.pep
MFNTIESVAESGRSGCFFCLSMDVYTFAAFFVCDLCLINCF

SEQ ID NO: 7539 - protein, 40 aa, Xenorhabdus bovienii
  Peptide sequence Name=Xb4151_4152.C432.gene123.pep
VGRNSDVESRARKTVCLNSLMVPTMLTITVLGGYRSWHSM

SEQ ID NO: 7540 - protein, 106 aa, Xenorhabdus bovienii
  Peptide sequence Name=Xb4151_4152.C432.gene124.pep
  Gene classification: Gene name=Tra5; Function=Putative transposase; Function class=L DNA replication, recombination and repair
  Homolog annotation: Query=9..105bp; Hit=227..331bp; Blast score=75; Percent Identity=41.0; E value=6e-15; Homolog= Rv3430c COG2801
LSPAGICQLTPSHSRPRVSNDNAYAESLFRTLKYVPAWPESGFNALTQVRVWGDNFTDWYNEEHRHSGINYVTPGQRHRGEDKVILKQRDAVFKLSSHTRNAGRAA

SEQ ID NO: 7541 - protein, 63 aa, Xenorhabdus bovienii
  Peptide sequence Name=Xb4151_4152.C432.gene125.pep
LLTRGRLCDGVSWHIPAGDKRPISVALLLGLIGLPTWAGQPTAAGLPDSFASAARCAGSKGSL

SEQ ID NO: 7542 - protein, 65 aa, Xenorhabdus bovienii
  Peptide sequence Name=Xb4151_4152.C432.gene126.pep
LPAPLGAQAQRDLFKRDRQPGTRLGRLAHRIPTRFRKSRLYPISLYPLSFELRYSCHINMIYIWN

SEQ ID NO: 7543 - protein, 45 aa, Xenorhabdus bovienii
  Peptide sequence Name=Xb4151_4152.C432.gene127.pep
MVIIPIFIYGCVMCPYFWIKCTLSLYSNRLNESFGYSHARILFTL

SEQ ID NO: 7544 - protein, 348 aa, Xenorhabdus bovienii
  Peptide sequence Name=Xb4151_4152.C432.gene128.pep
  Gene classification: Gene name=FecB; Function=ABC-type cobalamin/Fe3+- siderophores transport systems, periplasmic components; Function class=P Inorganic ion transport and metabolism
  Homolog annotation: Query=50..341bp; Hit=27..318bp; Blast score=343; Percent Identity=60.0; E value=2e-94; Homolog= fepB COG0614
MQCKFTFSYYRLITVLFAFIALILTSGCDKKSTEIKAGHPQPSGETTSMAGWPRTFETVKGPLTLTQPPKRIVSTSVTLSGTLLAINAPLIASGATGPNTDVADSRGFFIQWAKVAYERGVKLLYISEPNAEAVAAMVPDLIVISATGGDSAMKLYEQLSTIAPILVIDYGDKSWQQLALQLGQIIGHEADAGEIIARFEQRLQKVKQDITLPPNPVSAFVYYADGRGVNLWTPSSAQGQLLHQLGFTLATLPTNLKTETSMGKREDIIQLSAEGLADGLNGQSFMLFATNDSTIQVVSANPFLQHLPAVSTQRLYAMGPDTFRLDYYSANNMLDRIEHYFSNQELKN

SEQ ID NO: 7545 - protein, 421 aa, Xenorhabdus bovienii
  Peptide sequence Name=Xb4151_4152.C432.gene129.pep
  Gene classification: Gene name=ProP; Function=77 Permeases of the major facilitator superfamily; Function class=G Carbohydrate transport and metabolism
  Homolog annotation: Query=1..404bp; Hit=1..403bp; Blast score=309; Percent Identity=50.0; E value=4e-84; Homolog= ybdA COG0477
MAKSSILLDFSLLKNNAHFRAIFIARMLSVFALGMLTVGVPVQMQFLTGSTLQVGIVVALDGIGMFIGLMLGGILADRYDRRKLILFARGTCGLGFVALSFNAFLDSPSLFVLYFLSVWDGFFGALGMTALMAAIPNLVGRENLAAAGALSMITVRIGAILSPALGGLIIVASGPGWNFAIAAAGTLATLIPLVRLPKMKPQSTRQEHPLRALVSGVQFVCQHKIVGSVILVGMLISMAGAVRILFPALSQEVYHQGPSATGLMYSAVPLGAMLGAFTSGWIGRSARPGLLLIIFALGSFLALSLLGLMTHIVPALLALVCYGYLNAFASLLQFTLIQSHTPDHLLGRVNSFVTAQDVTGDSLGALGLGVMGRLLSPLITALSFGSFAAITCLLLAALVKPLRHSTLHNNAASLEGGASEK

SEQ ID NO: 7546 - protein, 40 aa, Xenorhabdus bovienii
  Peptide sequence Name=Xb4151_4152.C432.gene130.pep
MFPEKAVLAYRPLMIMAIQMIITINNEWSLSGYACCPNAS

SEQ ID NO: 7547 - protein, 348 aa, Xenorhabdus bovienii
  Peptide sequence Name=Xb4151_4152.C432.gene131.pep
  Gene classification: Gene name=BtuC; Function=ABC-type cobalamin/Fe3+- siderophores transport systems, permease components; Function class=P Inorganic ion transport and metabolism
  Homolog annotation: Query=24..346bp; Hit=8..329bp; Blast score=240; Percent Identity=53.0; E value=2e-63; Homolog= fepD COG0609
MPAAPMHREITSSKPLSQFHTYRTRRLTGPIICLLLLIIFSIASLLLGSKYIAPETVWHSLTGELHNNESIIILESRLPRTLVGILVGMALGGAGALIQALTRNPLADPGILGVNAGASFAIVVAITLFGLSSVMAKVSVACLGAFLASLAVWLISMQSGDKSNPVRLTLSGVAISALLTGITTNIALLNPSTFDQLRIWQAGTLDIRSLQVTLLVAPFILIGCALTLLISRPLNTLSMGEEIAITLGVKILWVKVSAIIAIMLLCGTATALAGPIGFVGLMIPHIARWWCGPDQRWIILHSLLMAPVLLLSADIVGRLLVAGELRVSIVTAFIGAPVLIWQVRKRKY

SEQ ID NO: 7548 - protein, 343 aa, Xenorhabdus bovienii
  Peptide sequence Name=Xb4151_4152.C432.gene132.pep
  Gene classification: Gene name=BtuC; Function=ABC-type cobalamin/Fe3+- siderophores transport systems, permease components; Function class=P Inorganic ion transport and metabolism
  Homolog annotation: Query=18..343bp; Hit=4..329bp; Blast score=236; Percent Identity=49.0; E value=4e-62; Homolog= ZfepG COG0609
MSKMLQVGHPEGWINGRISLRVLLVNTFQLFLIMLLALFAVYYGTLKLSFWQICQAFQGEGDPGIIAVVTQWRAPRVAIALVVGAALAISGAIFQSVIRNPLGSPDIMGFSTGAWTGVLITLIFLNGGYYQMTLGALIGGSLTAVLIYLLAWRQGIHGFRLIIVGIAISAMLTAVNTWLIVTGSLEHVMSAALWGNGSLNGITWQKAASALFVIPLLTFGAFALAKSLKIMEMGDDKASALGCNVETNRMQLILYGILLTAVVTATTGPISFISLAAPQIARRLTGTSYVPLFSAAMTGALLLLTADLVAQHTFSNVQLPVGAVTVSIGGIYLIWLLIREARQ

SEQ ID NO: 7549 - protein, 267 aa, Xenorhabdus bovienii
  Peptide sequence Name=Xb4151_4152.C432.gene133.pep
  Gene classification: Gene name=FepC; Function=ABC-type cobalamin/Fe3+- siderophores transport systems, ATPase components; Function class=P Inorganic ion transport and metabolism
  Homolog annotation: Query=3..257bp; Hit=19..273bp; Blast score=333; Percent Identity=63.0; E value=9e-92; Homolog= VC0779 COG1120
MTYRLSASHLTLGYERKIIAEDLSISIPDKQFSVIIGPNACGKSTLLRALCRLLKPHHGHILLDGKDIQQIPTKALARQLGLLPQQAIVPENITVSELVARGRYPHQSLLRQWSLDDKTAVAQAMKATGIAPLAERYVDELSGGQKQRAWVAMVLAQQTPLLFLDEPTTWLDIAHQIDLLDLFLQLNQESSHTLVAVLHDINQACRYADHLIVMQAGQIVTQGKPQDIISTELIKSVFGLSCVVIEDPVSHTPLIIPCGRYHSVKGI

SEQ ID NO: 7550 - protein, 2864 aa, Xenorhabdus bovienii
  Peptide sequence Name=Xb4151_4152.C432.gene134.pep
  Gene classification: Gene name=EntF; Function=Non-ribosomal peptide synthetase modules and related proteins; Function class=Q Secondary metabolites biosynthesis, transport and catabolism
  Homolog annotation: Query=1574..2625bp; Hit=5..1060bp; Blast score =707; Percent Identity=43.0; E value=0; Homolog= ZentF_1 COG1020
VSSRLQEVGVETINLTLPLVAAQPGIWIADQLADPRNIFTIAHYIEIKGALDQPLFDAAICQGLSEADTIHARYFLNEDGIPVQQIPLCCDPQQVIAPEWIDFSREPAGQAEIASQTLMQEDLSAELPADGERALYRQVVMKIDKQPERWFWYQRFHHLMLDGFSFDALTRRIIQIYNALKAEHPPAETPFCSFTQVVEEYQDWQSSPAKAKAAAFWQEYTREPGACVSLSVEDIAASENTSPLYYHCHFPATQLTSLMAEDSLRQFQPAEIAMAALGIYFYRMCGEKHLSIGFPFMRRLGSAALCSTGPVVNLLPLQIKLQDSMTLADVVKAFVAEIKQVRRHQRYDAEQLRCHLGLSGSSNLLYGPVFNYKIYNETLKLDGKPITTHTLATGPVDDLEFELNFQDDVLHLTFIANRTKYSEQTLHWHSERIRYLLDQLLIQPKQPIAFIPMIPPQEQQRLDEWSRGPCVTPPSDRVSVLDFFLSQVKQQPDTLAVRCGDQQLSYHQLMAKSMQLARLLLAQGIGAEDVVAIGVPRSIDSVVAILGVLASGAAYMPLDLDYPRERLQLMSDDAQPVLLITCINTLPQMPDIPKVICLDDHQIQERCTSLSSLPVTDEERRETLRGEHLAYIIYTSGSTGKPKGVMSTHGGLLNLLASHAARLFGPVIDNFHLQHQRRMRAGHTASFSFDSSWEPLFCMMLGSELYIFDEELRRDAWGVVQQMNQLPVDLMDITPSFLTQLIDSGLLEEGNHQPAFIMIGGEAATPRLWELLKQYPQMNIHNYYGPSEYTIDTLGADIQVADQPVIGRPVANTDVWLLDSHLQPVPVGAVGELYLSGPGIARGYLRRPDLTAARFVANPFKNGEVMYRSGDLMRWRPDGQLSFVGRVDHQIKVRGFRVELGEVENALAALPEVSSAVVIAEPMGVTYRLIGYCSVPDNKLRALADISARLLAELAKQLPDYMVPALLVILEELPLTVNGKVDRKALPKPQQQHFSIGRQAENEKEKYICEAFATLLGIVQVSADDDFFVLGGDSISAMALGTQLRRVGWQLRPRDIFSERTPARMALKMSPVAIGKRTSSANKISKPVQIGEIDHLPILHWFAESHGINTRFAHGVFIRVPAELRPEHLSSALLALSQTHPVLHAVTRNNRLIIGEKPVLADGSYYSVIQNSGHIETSAEQAFHEAVMRLNPATGHLFHACLLQQDEETQGLVWVIHHLATDGVSWRVLLDELQQAIETAIAGKAITLPPEEYTLYDWNLQLGQNLVNRAGELSFWQAMLDEKIPLLGKRPLDAHRDRQVAVREQRTLLTGKQTTALLGVLPQQYHANIEEMLLTILAMACNRHFGVSKFRFQLESHGRMELEDDVDLARTVGWLTAEYPVVLALPQAEHQSTKIADENPSKIVRAVKSALRTIPDRGIGYGLLRYLDQTGRQVLAQQDTPEILFNYLGRFAATDNLWAPQRTENLFRDTFAVYQDPQMSPNHSLEINLFVDEQGSIPQLAINWQWVDGIFSEQDISELQRGMEWATDCLINFARQQPRQAAATLVAAEIVLPRLEESDLTQLTERYGPLATVLPLLPLQQGLLFHAQTATDKGNYNSLTRLSLHGSLDRVKLHRALSALIRHHPQLAARFDTEQSASPLQLIPLLSEDSDIWPLDFYQLPELPEQEEEAALLELERTELARDLFHQPQAMLHALLVCHGEGSRYTLLLNIHHLVVDGWSTPILIQDLLTLLNQGEQALSVPRVSYQEIVHQLAAQETAVARQCWQDVLKGVQPTKLFSDQPHNGKVKELDIALEPEMEQALFSLCQQRGLTLNTLMQGIWSVLLSIHSGSSDVVFGSPVSGRFGQIEGLDQHVGLFSNTLPVRMTLDITLPLLPQLEQLQAQQIQLIEHDNIGLGEIQHIAGTSTLFDTLLVVENYPETDTESDCTQTIICQRINNRGYTHYPLTLLVLPGKRLRLLMEYRECVKQPELLAQRILLLIQQLLEQPDTALQDWVLQSPDEAALITKVNRTHHEIPSGTLHQFVIEQAEKTPDDLALLDNQHHLTYRQMRAQTRLLVDRLIEAGVQPGDIVGVALPRSVRLSLALQAILEAGAAWLPLDTGYPDDRLAMMLEDAQPRLVITESKLQARFAHQAPLLVFDQLADENQQPVHPAAWVTPQHTAYIIYTSGSTGRPKGVMVSHQSIVNRLLWMQDAYPLTQDDVVLQKTPCSFDVSVWEFFWPLMTGAKLVMAPPEVHRDPEALMQLIDDYAVTTLHFVPSMLATLIDSLASRQQSALFCHSLRQVFCSGEALSCELARRYQTFISAPLHNLYGPTEAAVDVTWQPAYGEALDHCTGSGVPIGRPVWNTQLRILDAWLRPVPVGVAGDLYLCGIQLATGYLNRADLTASRFVADPFACGERMYRTGDIACWLPNGEVEYLGRSDDQLKIRGQRIELGEIEQVLLEQSGIAQAAVAACELGKTANTVSDADARQLVAWLIPQPDVSLDTEALHQALTRRLPAYMLPVSYVLQDSFPLSANGKLNRKALPMPQKLTTGRLPVAGMESQMAALFAEILDCDTVWADDDFFALGGHSLLAMRLAAEIRRRFNRSISIGHIMVARSVEKLSALLSDENEQDSAENRGLGEVFPLRDGHGSALFCLHPASGFAWQYSGLLRYLKGDWPIIGLQSPRPLGVIADSDNLEDMCTHHLATLRQIQPHGPYYLLGYSLGGMLAQGMAARLRQEGEKVAFLGLLDTYPPEGQDWTVLSEEEAKEEAAREQAEFMAATEDERDPLLRAEKQAMFADIVANYKDSVRILSSASNQKYDGEAILFSATRTLPADMDVAATWAPWIRQLSIYRQDCEHADILSPASLKQLGPLLNTLLKTHRD

SEQ ID NO: 7551 - protein, 78 aa, Xenorhabdus bovienii
  Peptide sequence Name=Xb4151_4152.C432.gene135.pep
  Gene classification: Function=Uncharacterized BCR; Function class=S Function unknown
  Homolog annotation: Query=7..73bp; Hit=4..70bp; Blast score=89; Percent Identity=56.0; E value=8e-19; Homolog= Rv2377c COG3251
MSQEQKNPFDDDNATFFVLINAQQQYSLWPAFAEQPAGWEQVAGPDSRSTCITYIEEHWVDMRPARLRDLLVKGSTRV

SEQ ID NO: 7552 - protein, 449 aa, Xenorhabdus bovienii
  Peptide sequence Name=Xb4151_4152.C432.gene136.pep
  Gene classification: Gene name=Fes; Function=Enterochelin esterase and related enzymes; Function class=P Inorganic ion transport and metabolism
  Homolog annotation: Query=67..441bp; Hit=3..362bp; Blast score=318; Percent Identity=46.0; E value=1e-86; Homolog= Zfes COG2382
MPDRGINGTTRWGNYFEEDKGMKLAFQPSGTISNLLSASYSGSELWWEHIAALGTPLVEARPDHQVQLTFFWRDPAGNERNSDIRRVFIDINGITDHHSPQPQSLQRLPESDIWYWSVTIDDDWRGSYSLIPVTHAHLPPDFYGDTQQRNQQQREWWCSLFPLSIPDPLNLQGCHRNGLGMSLSAAHMPHAPEQSAWASIGRNSLAQPDTQQPVLLNWQSHRLGNQRRIWLYATGEETERPRPLVILLDGQNWAERTPVFSALEAATEQQHIPGAVWLLIDVIDMSRREQELPCNRDFWLAVQDELLPLAAQHATFSDSPDNTVVAGQSYGGLAALYAALHWPQRFGCVLTQSGSFWWPYSKMMKSSERQTGWLTQQVIEQKVTPSSLKIFQEAGSREDDIEGVNQQMYEALKNAGYHVSYRVFNGGHDSLCWRGGLIDGLSWLLSENA

SEQ ID NO: 7553 - protein, 33 aa, Xenorhabdus bovienii
  Peptide sequence Name=Xb4151_4152.C432.gene137.pep
MNEVYRFMELIRSSQRKIGLESSYRNLGKIRDI

SEQ ID NO: 7554 - protein, 732 aa, Xenorhabdus bovienii
  Peptide sequence Name=Xb4151_4152.C432.gene138.pep
  Gene classification: Gene name=CirA; Function=Outer membrane receptor proteins, mostly Fe transport; Function class=P Inorganic ion transport and metabolism
  Homolog annotation: Query=10..730bp; Hit=5..745bp; Blast score=447; Percent Identity=35.0; E value=1e-125; Homolog= ZfhuA COG1629
MVMPTKKTLKNKTTKNHNNKVPLILTSVLFLSPHSAIAVETANEKDTIIVTASTQGGSSGFVESESSAGTKSTAPLIKTPQAITVVNRAQIEAQGATTVADALNYSSGVVTNYRGASNRSDEVITRGFRYAPKFLDGLSYGLNGQGATAGQIDPWLLERVELVHGPASVLYGQVSPGGLVSMTSKRPTAQPIHKVQMKAGNQRLGEFAFDFGGAVHDDIPLFYRLNGILSTQQQFVKDYKKERIAIAPALTWIPNSDTTFTLLTSYQYDPKMGFRNFYPKVGTVTPIPNVGYMPYDMNLSEPSFNQARREQTSIGYILEHDINDIFSFQQTLRYSSSDERTKLFVYTKDVTSSIIGRRPQREHNKAQEFGIDNQLKALFSTANIEHNIISGIDYKWGDRHNKTWNDKNPGREPQYRFDWSNPTRNIHIDEKNLSLDSNDKKKLHQLGIYLQDQLNWENWNLVLSGRYDWTEVKQQDLIKHTLKKQNDSAFTGRAGLLYAFDNGISPYISYSTSFEPNLDTGAPGAPEFKPTMGEQTEIGIKFQPKDHDTLLTLSLFDITQKNVTTRDPVTRISEQIGKIGSKGAEAEIHSKITPEINLMASYTYTDTKTKSDRNPARVGKRVPAVPEHAASVWGSYSFKQSVLEGLTLGTGVRYLGTTSGDFTEKFNVPSYTLYDLMAKYDLGEASPQLKGASVQLNVNNLTDKRYVASCSNDGACFYGSGRSIFATVAYSW

SEQ ID NO: 7555 - protein, 39 aa, Xenorhabdus bovienii
  Peptide sequence Name=Xb4151_4152.C432.gene139.pep
MRNSVAKLGTVFSYILLTVILFFLPVTVRIRKTYYTCVV

SEQ ID NO: 7556 - protein, 394 aa, Xenorhabdus bovienii
  Peptide sequence Name=Xb4151_4152.C432.gene140.pep
  Gene classification: Gene name=MenF; Function=Isochorismate synthase; Function class=H Coenzyme metabolism
  Homolog annotation: Query=21..386bp; Hit=21..390bp; Blast score=350; Percent Identity=49.0; E value=1e-96; Homolog= entC COG1169
VPNLATEFRISQLQDFCCDDFVFLSSNKSLHAHGCFTKITTPVGDNTDTDCQLHRDIPELFRQAKNKGIENPIIVGAIPFDKRQPSALFIPEDYSWLEREALSFSSVSSGPKLQQINSLPDKDEFCQMVTHGVDAIHHGLLDKVVLSRLLNIKFDQQPDATQLFMRLNQQNPYSYNFHVPLGNSTLIGASPELLLCKQGSTIISQPLAGSSRRGSNVMQDNELRQSLLRSAKDQHEHQLVITAMRKALAERCTELAIPEIPSLLSTPLLWHLATEIRGELADKQIDALSIACLLHPTPALCGAPRQQAATLISELEPFKRDYFGGIVGWCDARGNGEWVVTIRCGEVFENHIRLFAGAGIVADSKPSAEWHETDVKFGTMLQALGLSYDKERCL

SEQ ID NO: 7557 - protein, 176 aa, Xenorhabdus bovienii
  Peptide sequence Name=Xb4151_4152.C432.gene141.pep
  Gene classification: Gene name=EntE; Function=Peptide arylation enzymes; Function class=Q Secondary metabolites biosynthesis, transport and catabolism
  Homolog annotation: Query=53..158bp; Hit=298..401bp; Blast score=140; Percent Identity=65.0; E value=7e-34; Homolog= ZentE COG1021
MNIEFTHWPEKLAQHYRQCGYWLDLPLSDILSRQVANENIALIADKHQYSYHQLKSLELLQLQVGGARLSESSARRIPSELGCRLQQVFGMAEGLVNYTRLDDDEQTIFTTQGRPISADDEVWIADKQGNSLPHGVTGRLMTRGPLHSTPYFKSEKPNEHPQTKRLSSACCSGITC

SEQ ID NO: 7558 - protein, 295 aa, Xenorhabdus bovienii
  Peptide sequence Name=Xb4151_4152.C432.gene142.pep
  Gene classification: Gene name=EntB; Function=Isochorismate hydrolase; Function class=Q Secondary metabolites biosynthesis, transport and catabolism
  Homolog annotation: Query=1..207bp; Hit=1..207bp; Blast score=299; Percent Identity=68.0; E value=2e-81; Homolog= entB_1 COG1535
MSIPKLNDYLLPAVQELPVNKVNWAFDSKRAALLIHDMQNYFLNFWQPDSQLVTQVIDNIARLKIQCQKLGIPVFYTAQPDHQSDADRGLLNDMWGAGLNKHPEQQSITDALTPESDDTLLVKWRYSAFQRSDLEQLLKNSERDQLIICGIYAHIGCMTTATDAFMRDIKPFFVADALADFSREEHMMSLRYVAGRSGRVLTTATLLNEMSLSSLGEKKWDREHLRAEILPLLDDDCGDIDDHENLLDYGLDSVRIMSLITRWNNQGHQLDFITLVKTPTLSNWLTLLTDKREVK

SEQ ID NO: 7559 - protein, 43 aa, Xenorhabdus bovienii
  Peptide sequence Name=Xb4151_4152.C432.gene143.pep
VAGNLITYSTPSPRDPDIFTAEIKKKRSLFDLPFISQQRKPVR

SEQ ID NO: 7560 - protein, 35 aa, Xenorhabdus bovienii
  Peptide sequence Name=Xb4151_4152.C432.gene144.pep
VINLHTAFDYFFNPKRAAQPAPPYLNSSMGSDPVT

SEQ ID NO: 7561 - protein, 228 aa, Xenorhabdus bovienii
  Peptide sequence Name=Xb4151_4152.C432.gene145.pep
  Homolog annotation: Query=1..197bp; Hit=1..206bp; Blast score=172; Percent Identity=43.0; E value=3e-42; Homolog= gi|16123243|ref|NP _406556.1| hypothetical protein [Yersinia pestis] gi|22125313|ref|NP _668736.1| hypothetical [Yersinia pestis
MTKRADIKNERLVYTEKLGWLDLGHANGDDARKLMISLYLGDNTTEESHFIVRYVQYMGRGRNYGTSIKTRWRVKRGLSLHDTKRVALTIMMYTTHSFESYQDSFPFTWFSDSGYSGEDLISNLFGFYQAVNDINYLPQVGVVSKDEAFKRWDYYGPIGKYKNKTFKPLLFPDPEKYPNNARPYHASLPSFLNTIIPISDIKTSQDVMLIEDASWINVGKEYAGISVE

SEQ ID NO: 7562 - protein, 140 aa, Xenorhabdus bovienii
  Peptide sequence Name=Xb4151_4152.C432.gene146.pep
MLGFRLSNFIRICIVISVLIVGVLFFIASLANVNLSYTKRNFIYYHTFTFDEIKNIPLVSNDYIIYYDSPDGSQIMTNEIVFSNVNLIRKKELIEYVENMGFKKYFDKYWNEDSWRKDNVRISIKQNDTERTILFLVEIS

SEQ ID NO: 7563 - protein, 159 aa, Xenorhabdus bovienii
  Peptide sequence Name=Xb4151_4152.C432.gene147.pep
  Gene classification: Gene name=Hcp; Function=Hemolysin-coregulated protein (uncharacterized); Function class=R General function prediction only
  Homolog annotation: Query=1..159bp; Hit=1..159bp; Blast score=159; Percent Identity=50.0; E value=1e-39; Homolog= Z0248 COG3157
VANIIYMTINGKKQGLISAGCSTYDSIGNKYQEEHKDKILIYAVDHDISREQNVNHQPIVITKPIDKSSPLLGVAISSNESLNCEIDIYRNSSSGGLEKFYSMKLTNATIKNISIHYPNSLNHNDMQPYECITISYDSITWTHHTAGTSGYSIREDNVF

SEQ ID NO: 7564 - protein, 39 aa, Xenorhabdus bovienii
  Peptide sequence Name=Xb4151_4152.C432.gene148.pep
LHNRVLLAFGFEGRGLHLGLLVRPYGVKLMPPSMKADFY

SEQ ID NO: 7565 - protein, 349 aa, Xenorhabdus bovienii; identical to SEQ ID NO: 5796
  Peptide sequence Name=Xb4151_4152.C432.gene149.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 7566 - protein, 58 aa, Xenorhabdus bovienii
  Peptide sequence Name=Xb4151_4152.C432.gene150.pep
MHNFHGYNNARKRRHERRKEQQEAYNKDEAINMALKTALHPEEITIPTRPILSLNIRN

SEQ ID NO: 7567 - protein, 209 aa, Xenorhabdus bovienii
  Peptide sequence Name=Xb4151_4152.C432.gene151.pep
  Gene classification: Gene name=LexA; Function=SOS-response transcriptional repressors (RecA-mediated autopeptidases); Function class=K Transcription
  Homolog annotation: Query=3..201bp; Hit=8..206bp; Blast score=58; Percent Identity=30.0; E value=3e-09; Homolog= Z3358 COG1974
MSLADRVKNRRFELKLTQAEAAMIAGISQQSWAVIEDGKTLRPRNIISIAKALKCDAEWLMTGGDFQPLCDVNIRKVPLISYVQAGKIARGFPMRGYDDLKHIITDMNWSERAFALRIDGDSMEPDFKAGDIVVIDPEVTPNPGEFVVAASYEREATFKKYRPITINIDGTQHFELIPLNNDYPILDNQRIKITIIGTMVEHRIYRRKR

SEQ ID NO: 7568 - protein, 41 aa, Xenorhabdus bovienii
  Peptide sequence Name=Xb4151_4152.C432.gene152.pep
LVFNRLDIVSILANLLYTNLIVFNNTLYCLSNTVFVVRILL

SEQ ID NO: 7569 - protein, 66 aa, Xenorhabdus bovienii
  Peptide sequence Name=Xb4151_4152.C432.gene153.pep
  Homolog annotation: Query=1..65bp; Hit=1..65bp; Blast score=83; Percent Identity=67.0; E value=7e-16; Homolog= gi|37526811|ref|NP _930155.1| hypothetical protein [Photorhabdus luminescens subsp. laumondii TTO1] gi|36786243|emb|CAE15295.1| un
METISKRLKTKRHELNMTQAQLAELSGTRQQSIQRIEAGITKRPRFILEISKALDCDPLWLQYGSK

SEQ ID NO: 7570 - protein, 48 aa, Xenorhabdus bovienii
  Peptide sequence Name=Xb4151_4152.C432.gene154.pep
LNKFGITRLVNVGHYYVVDWMYIHDWNWPFYVPNGRVRYAKITKLNFV

SEQ ID NO: 7571 - protein, 103 aa, Xenorhabdus bovienii
  Peptide sequence Name=Xb4151_4152.C432.gene155.pep
MPDVYQSGDAEFIQKILSAMKPTMREYARDKYAYVYKLRRDEDPVSFRRDNTGAKAANTWLRLYFKKHYRSMQGYTEAPLLAPKAQPEDKPNSGVVSGQGASQ

SEQ ID NO: 7572 - protein, 100 aa, Xenorhabdus bovienii
  Peptide sequence Name=Xb4151_4152.C432.gene156.pep
MAQAVFQKALQIDARLYRSAVVSPESTARGQAQFRSCFRARSQPVAPKMAVSSGCGTELRGSLGLSMKKQPSENDYQSGEKPKNWQSRKVLNMYPPIFFG

SEQ ID NO: 7573 - protein, 276 aa, Xenorhabdus bovienii
  Peptide sequence Name=Xb4151_4152.C432.gene157.pep
MNLIKKAEKIIARRKQLIAWKPAKAVAALVKIGMSESEAKEFVNKNSPERKPHKPHKPHNSHAKPVNLEALSTHYIVVGDYDLLGLKHQDALIAAIRNGKGKSSWRDESMAVTLFGLVKAYPIITTAEVNKFLNRGAFIDSIPLFIDGEMIGGEAMPSADNDSVKDVFRAVKQLKKITEHLADTGALTLNKYLDRVPTDEDVKRAVGIVAPAITNPHFHKIDYARQYSNMPAHEHAEDSKRIINEWKNELKIKGGKKPNSKTLASTTDSDLAEEAK

SEQ ID NO: 7574 - protein, 66 aa, Xenorhabdus bovienii
  Peptide sequence Name=Xb4151_4152.C432.gene158.pep
MNTSSQKDYGTNTDLFATLCGSQQLVDVAITLIREGRNLEAESILRRANVVSVSAIENHKAALLGK

SEQ ID NO: 7575 - protein, 359 aa, Xenorhabdus bovienii
  Peptide sequence Name=Xb4151_4152.C432.gene159.pep
  Gene classification: Gene name=SSL2; Function=DNA or RNA helicases of superfamily II; Function class=L DNA replication, recombination and repair
  Homolog annotation: Query=100..327bp; Hit=134..371bp; Blast score=94; Percent Identity=30.0; E value=2e-19; Homolog= YDR332w COG1061
MLTITPNFAQERALNMLRQDWKRFNSFMVYAPTGAGKTGLSAFITDGFISKGMKVMMICPFTVLINQTAQRFIEYGLPEDEIAYIWRDHPNQDPSKLIQIASADTLIRRDFPEDINLLVIDEAHLKRKKILTEITRLTSETDCKVIGLSGTPFSPFLGHYYQKLIKPTTIKELIQRGDLSPYEFYAPTKPDLSKVKSARNDDYGSDYKEDEIAEIMCGADLVGDVVSSWLKLGENQPTICFCVNVSHANFITVEFNRAGVNAEIMTANTPHDERDLIIHRFEQGATKIIVNIGVLVAGFDSDVRCIIYARPTKSEIRWLQSIGRSLRPVDNFSKLYTEYLSKRSSLLAGREIKEANHGI

SEQ ID NO: 7576 - protein, 269 aa, Xenorhabdus bovienii
  Peptide sequence Name=Xb4151_4152.C432.gene160.pep
  Homolog annotation: Query=92..206bp; Hit=12..119bp; Blast score=67; Percent Identity=34.0; E value=3e-10; Homolog= gi|15923855|ref|NP _371389.1| hypothetical protein [Staphylococcus aureus subsp. aureus Mu50] gi|14246634|dbj|BAB57027.1| hypo
VQQKSSSILAFSWQVLTVMSAALSTPVPPSRKSVGCSQSADRCVQSITFQNCIPNTFPKEAAYLQAGKSRRLIMEFKKAFSWRSDDMPETTEAVVYVSRCGSVVKAGSYRLWNKKNQSYSVRKERIYRQSTNRGKDAKSKNTRYGKYQHVCIRDRSYQVHRLVALAWIPNPDNKPQVNHTNGMKSDNRVENLEWVTNLENRRHSGEKLFRNIPHGEQVGTAKLTAKDVIEIRERLKTPYKGLCRDLAAEFGVVASTITWIKQGEVWKHV

SEQ ID NO: 7577 - protein, 279 aa, Xenorhabdus bovienii
  Peptide sequence Name=Xb4151_4152.C432.gene161.pep
  Homolog annotation: Query=68..250bp; Hit=328..510bp; Blast score=262; Percent Identity=64.0; E value=6e-69; Homolog= gi|37526807|ref|NP _930151.1| hypothetical protein [Photorhabdus luminescens subsp. laumondii TTO1] gi|36786239|emb|CAE15291
LSHQLLHGLNKVRSGNMFRVLFKTACKDDIEHVRDIIMNLHQDNGDTIIVSDNDLPADIVINVPKVQKKAAIILDHSGSVHRLGYPDDIEYDELPSKNDGMKSSSSYREQEKREKLPKECSSCHYMKPAGVYVCPKCGFKPLVGENIDVDTSRTIQKLSKKERIYTQAEKQSFYSQLKYYQNQRASQGKTISDGWVSNTFKDKFDVWPRGLHDTPQEMTPEVSNFIKHKQIAFAKSRKKAEQVQPPSNEQQEMRLEVAHQKVRDIREKLGRSSHQGDRL

SEQ ID NO: 7578 - protein, 326 aa, Xenorhabdus bovienii
  Peptide sequence Name=Xb4151_4152.C432.gene162.pep
  Homolog annotation: Query=4..315bp; Hit=1..313bp; Blast score=358; Percent Identity=55.0; E value=5e-98; Homolog= gi|37526806|ref|NP _930150.1| hypothetical protein [Photorhabdus luminescens subsp. laumondii TTO1] gi|36786238|emb|CAE15290.1|
VNRINTTDAVIGHWPKVFEYYGLPPVTGKKHFKGKCPICKQIGKFRIDDRDGRGTFICTCNAGDGWALLRLTQKKEFKVLADEIDQLLGIQRDKVTPKPKASTVADNRQKIITLYSRMPELKGTSAEKYLQSREIYSHHPIEQIRFCEKQPTYKGDYQAMWALATDSRGQLCYLHRTYLDGDRKAPLDVTKKMMSLQEASYLAHAESVAIRMSPVDSTLGIAEGIETALSCKQLYGVNTWAVLNTALMKRFKAPRGVKHLIIFTDMDWNAAGHAAAMECAHKNLLSHNEVEKVSVRWPDRDDFNDMLQNADEVRQLVFMKKQRETA

SEQ ID NO: 7579 - protein, 139 aa, Xenorhabdus bovienii
  Peptide sequence Name=Xb4151_4152.C432.gene163.pep
  Homolog annotation: Query=1..126bp; Hit=1..126bp; Blast score=197; Percent Identity=71.0; E value=4e-50; Homolog= gi|16122330|ref|NP _405643.1| putative phage antitermination protein [Yersinia pestis] gi|22126106|ref|NP_669529.1| hypothetica
MRDIQMVLERWGAWAADNREDVNWPSIAAGFKGLIPSKIKSRVQCCDDDAIIISNCMAKLNQKNSDAHDLLFDYYVFGKTFMQLARDHNCSDGHIGKKLQKSEGMIEGMLMMLDIPLEMDKCVQKEPININQHQLCSIF

SEQ ID NO: 7580 - protein, 64 aa, Xenorhabdus bovienii
  Peptide sequence Name=Xb4151_4152.C432.gene164.pep
MNTNAYTLIGRAICQLLDDNTPIYKTTIGEAMSDIFNAEYRGVYDERCETFNDALKLLMNKNEN

SEQ ID NO: 7581 - protein, 92 aa, Xenorhabdus bovienii
  Peptide sequence Name=Xb4151_4152.C432.gene165.pep
MRKLTMYALKLITERNGRSVEESWILGDMYRLEFFPKDVADNVIARVEHSQNGNLINHDIKKTDQAYITTLTGDTVRTVCRGRSGLVAGSIQ

SEQ ID NO: 7582 - protein, 37 aa, Xenorhabdus bovienii; identical to SEQ ID NO: 6578
  Peptide sequence Name=Xb4151_4152.C432.gene166.pep

SEQ ID NO: 7583 - protein, 51 aa, Xenorhabdus bovienii; identical to SEQ ID NO: 6579
  Peptide sequence Name=Xb4151_4152.C432.gene167.pep

SEQ ID NO: 7584 - protein, 78 aa, Xenorhabdus bovienii; identical to SEQ ID NO: 6580
  Peptide sequence Name=Xb4151_4152.C432.gene168.pep

SEQ ID NO: 7585 - protein, 110 aa, Xenorhabdus bovienii; identical to SEQ ID NO: 6581
  Peptide sequence Name=Xb4151_4152.C432.gene169.pep
  Homolog annotation: Query=1..110bp; Hit=1..110bp; Blast score=179; Percent Identity=78.0; E value=1e-44; Homolog= gi|6066815|emb|CAB58444.1| hypothetical protein [Xenorhabdus nematophila]

SEQ ID NO: 7586 - protein, 133 aa, Xenorhabdus bovienii
  Peptide sequence Name=Xb4151_4152.C432.gene170.pep
  Homolog annotation: Query=1..133bp; Hit=1..136bp; Blast score=160; Percent Identity=61.0; E value=5e-39; Homolog= gi|37526797|ref|NP _930141.1| hypothetical protein [Photorhabdus luminescens subsp. laumondii TTO1] gi|36786229|emb|CAE15281.1|
MTRGIRNNNPGNIDHNSANKWQGQLPHDPKIESRFCRFESPEYGIRALMKLLCNYHKKGYQTVAKMIDRWAPTNENNTSAYINGVAKALGVDPHQVMTVDKVTLIGLAKSIIRHENGKQPYSEATFEKAFELL

SEQ ID NO: 7587 - protein, 155 aa, Xenorhabdus bovienii
  Peptide sequence Name=Xb4151_4152.C432.gene171.pep
  Homolog annotation: Query=6..153bp; Hit=3..153bp; Blast score=102; Percent Identity=39.0; E value=2e-21; Homolog= gi|15830788|ref|NP _309561.1| putative endopeptidase [Escherichia coli O157:H7] gi|25289635|pir||F90820 probable endopeptidase
MKWKVKAVSVVVGIVLIGSAAYSIYSVYVENGRLTDEKKSLTTQLSEKNAIITNQQARIQNLAELETKHIQELDNAKSEIDTLRADVAAGRRKLRIKAICPSVPNTVASSSMGDATTVELSGETGSTVLDIRESIINDLAKLRYLQDYIKTECSR

SEQ ID NO: 7588 - protein, 74 aa, Xenorhabdus bovienii
  Peptide sequence Name=Xb4151_4152.C432.gene172.pep
MSMTLGQKLVGISFNPGGNILVDAVKQNAADTIDLIQDSMQKATSEEALMIHNEAVRRIMDAQMWAVKAITWKD

SEQ ID NO: 7589 - protein, 58 aa, Xenorhabdus bovienii
  Peptide sequence Name=Xb4151_4152.C432.gene173.pep
MIFFNTYLNLPLRLLDKIIPHHPSLICSGVAVYLCQSFHVIAFTAHIWASIMRRTASL

SEQ ID NO: 7590 - protein, 280 aa, Xenorhabdus bovienii
  Peptide sequence Name=Xb4151_4152.C432.gene174.pep
  Homolog annotation: Query=2..76bp; Hit=530..604bp; Blast score=84; Percent Identity=48.0; E value=1e-15; Homolog= gi|18539217|emb|CAD22532.1| enhancer binding protein [Paracentrotus lividus]
MYTCPICLQKFWKPAKLERHMRAHTGEKPFQCDICEYTSPREDNLKRHMRAHIGEKPFQCDICEYTSTRKDNLKSHLSRMHNMNREYNTPIPVQNYQPSTSGLNTQPPNTFTSSLKQRGASPSNVDNSATFARMRQSMQEPDRRQRAPHLIPAAQSGGPVRELTPSTSQHPTPYQQPATQERFSTLRSLLENSPSPPEPSGLNVRQRSVSPYPYERAPLSIQPPGAPRPQTPLSPPSVRTTSPIGHPVRSRSVSPTAEFLRRNSSSEALPRLDIDDDDFL

SEQ ID NO: 7591 - protein, 37 aa, Xenorhabdus bovienii
  Peptide sequence Name=Xb4151_4152.C432.gene175.pep
LLLRKDGGMDYCKYIIYWRFLCIPAPFAFKSFGSQLS

SEQ ID NO: 7592 - protein, 39 aa, Xenorhabdus bovienii
  Peptide sequence Name=Xb4151_4152.C432.gene176.pep
VLGYSVSCSVLQKEKPPALTDGMGYSFNHSREWVKEYWL

SEQ ID NO: 7593 - protein, 117 aa, Xenorhabdus bovienii
  Peptide sequence Name=Xb4151_4152.C432.gene177.pep
MTQSTLTHTFIIDFKCDTDTLNQLKSQLKNIAEQVGRINGRRYDAGITLAVDTGAKARIAADSFKVFDVTGKVYMKEAVIPQAVIKDNDDHLRQIIREEIRQFVTRERRGGGLFYKR

SEQ ID NO: 7594 - protein, 110 aa, Xenorhabdus bovienii
  Peptide sequence Name=Xb4151_4152.C432.gene178.pep
  Homolog annotation: Query=3..98bp; Hit=6..101bp; Blast score=132; Percent Identity=65.0; E value=1e-30; Homolog= gi|9634183|ref|NP _037756.1| Gp74 [Bacteriophage HK97] gi|6901612|gb|AAF31115.1| Gp74 [Bacteriophage HK97]
MSQIYNSKWSKARLAFLQQHPLCVMCRQQGKLAPATVVDHIVPHKLKDAINANDSEAIKIARRLFWGKANWQSLCASHHNSTKQRIEKCNREIGCDINGIPIDDHSHWNK

SEQ ID NO: 7595 - protein, 55 aa, Xenorhabdus bovienii
  Peptide sequence Name=Xb4151_4152.C432.gene179.pep
MIIHTGINDGIKFISTGMKTNAMTLCVMITRVIIKFHPESIRPPLSLNDIANAVF

SEQ ID NO: 7596 - protein, 157 aa, Xenorhabdus bovienii
  Peptide sequence Name=Xb4151_4152.C432.gene180.pep
  Homolog annotation: Query=3..157bp; Hit=4..160bp; Blast score=137; Percent Identity=54.0; E value=6e-32; Homolog= gi|9634120|ref|NP _037662.1| terminase small subunit [Enterobacteria phage HK022] gi|9634165|ref|NP_037697.1| terminase small s
MTKRTRSDSLKGKMQAIVNAFQDTLEPPAHAGLMPEAIDFYNDNIRTKALNLWTPSDLIEVVSLANNQYALMEVSHYLRKLESDYSETRDEKAIKENRKYKLELTRVIIAQRSGLQIHSRATNGESRDQRNKNQNDADARALLGEVEDDGLLASPWH

SEQ ID NO: 7597 - protein, 508 aa, Xenorhabdus bovienii
  Peptide sequence Name=Xb4151_4152.C432.gene181.pep
  Homolog annotation: Query=5..504bp; Hit=1..502bp; Blast score=691; Percent Identity=67.0; E value=0; Homolog= gi|9634121|ref|NP _037663.1| terminase large subunit [Enterobacteria phage HK022] gi|6863113|gb|AAF30354.1|AF069308_2 terminase lar
MVSQLSRGEKVIAFIERYCIVPEGVLLGQPMRLEAFQKQFIRDIYDNPHGTRTAYLSIARKNGKTGLIAGILLAHLVGTEAVQNSQIVSGAMSREQAAIVFNLAVKMINLNPRLQQLIHIIPSSKRLIGKPCNVEYKALSADGKTTHGLSPVLAILDEVGQVKGAQNDFIDAITTSQGAHENPLLVAISTQAPTDADLLSIWLDDAANSNDPKIVSHVYTAPMDLAITDPAAWRAANPALDTFRSLKDIEEHAKRAARMPSQENSFRNLMLNQRVSLVSPFISRNTWMECAGELEPIVGKCYAGLDLSAAKDLTALVIIGKSASGKWNVHPFFWTPDKTLLDRAKTDRVPYDVWKKQGFLRTTPGATVDYEYIAKELADIVENFDIEILHFDRWRIEIFKKEVRRAGLSLKMAEFGQGYKDMSPAMDKTEQLLLEGQVNHANHPVLTMCAANAVVERDAAGNRKLAKDKSTGRMDGMVALVMAAGALNNAKGSSGLDAFLQNPIMVGV

SEQ ID NO: 7598 - protein, 407 aa, Xenorhabdus bovienii
  Peptide sequence Name=Xb4151_4152.C432.gene182.pep
  Homolog annotation: Query=2..393bp; Hit=17..407bp; Blast score=336; Percent Identity=46.0; E value=4e-91; Homolog= gi|26988297|ref|NP _743722.1| phage portal protein, HK97 family [Pseudomonas putida KT2440] gi|24983043|gb|AAN67186.1|AE016346
MGVPIGLLDGSFWQEWTGMSSSGKTVSADSALQLSTVWACVRLLSETVSTLPLKLYKSHDDGSRELAKNHPVYPILCNRPNLEMTQSRFMLTVVASLCLRGNAFIEKKFIGHKLVALIPLLPQNMNIKRLPGGDIEYTYADNSGEHQGRRRVIPVKNMMHIRGFGIDGLSGLIPVKTGRDVIGAALSTDEAAAKVFENGLQSSGFISASANTDLTEEQINGIRQHIQAFVGSKNAGKMMVLPGDLTYQNITMNPEAAQLLQSRAYNVEEICRWFRVPPVMVGHATKQSSWASSLEGMNMQFLTHTLRPLLVNIEQEIARCLLDSDSDYYAEFNVEGLLRADSRGRASYYATALQNAWMSRNEVRRKENLPPIEGGDVFTVQLNLTPIDLLGEEVEKKLPPEDNNHED

SEQ ID NO: 7599 - protein, 283 aa, Xenorhabdus bovienii
  Peptide sequence Name=Xb4151_4152.C432.gene183.pep
  Gene classification: Gene name=ClpP; Function=Protease subunit of ATP- dependent Clp proteases; Function class=N Cell motility and secretion
  Homolog annotation: Query=27..269bp; Hit=27..271bp; Blast score=186; Percent Identity=47.0; E value=2e-47; Homolog= mlr8523 COG0740
MKIKHMPVAPEGRPFNATVNDIRPLALDKWNGGIRATSTDNTLSILDVIGESFWDEGVTAKRIAGALRAMGDQDVIVNINSPGGDVFEGIAIYNLLRNHSGQVTVNVLGLAASAASVIAMAGDEINMGRGAFLMIHNAWTCCCGNKNELVAVAEALRPFDDSLIDIYAARTGIDKASIAQMMDDETFINHTEAIAQGFADGLLTADVIDDGNDSPQAALRKLDALLAKSHVPRAERRKLFNALNGRTPGAASHNHGMPGATDINIDTLAELEKTINAFAPAHP

SEQ ID NO: 7600 - protein, 403 aa, Xenorhabdus bovienii
  Peptide sequence Name=Xb4151_4152.C432.gene184.pep
  Homolog annotation: Query=1..400bp; Hit=1..395bp; Blast score=300; Percent Identity=43.0; E value=4e-80; Homolog= gi|9635591|ref|NP _061502.1| major head protein [Pseudomonas phage D3] gi|5059252|gb|AAD38957.1| major head protein [Pseudomona
MSDTNELLKNLSAKIEAANSQFNAKAEEALNEAKKVGGLSTETKAAVDKMAAELNTLREAEKSIKAELGELQQHVAQMPLHNAVQVVQTLGQQVISAELMKEVSGNISANRRISVPVQAALTTPQVPDRVIEPHRLPEIDVKPKHRLFIRDLIAGGTTTSNAIFWVQQTGFTNKAAAVPEGTAKPYSDIQFATQITPVATLAHMFKASKQVLDDFGQLKSLIDSEMRYGLKFVEEQQILFGDGANGNIKGIVPQASKYKAEIKVDKATAIDDIRLAMLQAQLALLPPSAIVTHFVDWATVELIKDSLGRYLLSNPQGYTSPTLWGLPVIATDVAAFRGKFLVGAFDSAAQIFDREQVNVVISSENEDDFGKNMISIRCEERLALAVKRPEAFIYGDFTATAKG

SEQ ID NO: 7601 - protein, 106 aa, Xenorhabdus bovienii
  Peptide sequence Name=Xb4151_4152.C432.gene185.pep
MIPLPTIKDHCRIDSPHDDDLLRQYENAALQYALNYTDRKTLHVPEAGVIPPESQALILDEAVIQAILLLIGHWYENRTAVVVGQSVATLPFAVKALLQPYKRYCL

SEQ ID NO: 7602 - protein, 106 aa, Xenorhabdus bovienii
  Peptide sequence Name=Xb4151_4152.C432.gene186.pep
  Homolog annotation: Query=1..104bp; Hit=1..107bp; Blast score=67; Percent Identity=39.0; E value=4e-11; Homolog= gi|9634128|ref|NP _037670.1| gp9 [Enterobacteria phage HK022] gi|6863120|gb|AAF30361.1|AF069308_9 gp9 [Enterobacteria phage HK02
MNIGRLRHRIDIQGIRTRRSPSGGVVNERYTVATVWAEAKFISGRELVAAKTVLSESLVRFWIRYRADIDTTMAVVFQGKTYAIQAAMPDNKLTLLELLCQEGVKQ

SEQ ID NO: 7603 - protein, 147 aa, Xenorhabdus bovienii
  Peptide sequence Name=Xb4151_4152.C432.gene187.pep
  Homolog annotation: Query=2..147bp; Hit=4..148bp; Blast score=146; Percent Identity=51.0; E value=5e-35; Homolog= gi|15800874|ref|NP _286890.1| unknown protein encoded by cryptic prophage CP-933M [Escherichia coli O157:H7 EDL933] gi|15801280
MTTVDFSALKDLSQDLALLSKAESDKVLRRGTYAGAKVLRDETRSRAPKRTGKLKKNIMATNRKKQRDGSVSSGVYVRGSNQSGTNSDPKMKKNDPRNAYYWRFLEKGTSKMAPKPFIDPAFESKSDAAADAVFNAALKAIDEVLAK

SEQ ID NO: 7604 - protein, 111 aa, Xenorhabdus bovienii
  Peptide sequence Name=Xb4151_4152.C432.gene188.pep
  Homolog annotation: Query=1..109bp; Hit=1..112bp; Blast score=70; Percent Identity=38.0; E value=8e-12; Homolog= gi|15801954|ref|NP _287975.1| putative structural component of cryptic prophage CP-933P [Escherichia coli O157:H7 EDL933] gi|158
MTDGDLFTLLDPVLPGRVFPYLIPQTERKTAAPWCVFSTYSIYTDVLSGQSVKMTRVQIDAYAPGLDDADRICGDAFSAIKTLQPFEVERENSYENDTGLYRATVEFKIYS

SEQ ID NO: 7605 - protein, 44 aa, Xenorhabdus bovienii
  Peptide sequence Name=Xb4151_4152.C432.gene189.pep
MTRGCIARPSNLKSIPNPGDNRLSIKNMGKSANRPSAPKHYPAP

SEQ ID NO: 7606 - protein, 63 aa, Xenorhabdus bovienii
  Peptide sequence Name=Xb4151_4152.C433.gene1.pep
  Homolog annotation: Query=1..47bp; Hit=68..115bp; Blast score=87; Percent Identity=87.0; E value=6e-17; Homolog= gi|22124244|ref|NP _667667.1| hypothetical [Yersinia pestis KIM] gi|21957009|gb|AAM83918.1|AE013632_6 hypothetical [Yersinia pes
MSGSALLSHGETPHYHRRYGVSLLSSAWDQVGPPRYGRQTNSVFNPEQAAVFHLKLRLSLIAS

SEQ ID NO: 7607 - protein, 309 aa, Xenorhabdus bovienii
  Peptide sequence Name=Xb4151_4152.C433.gene2.pep
  Gene classification: Gene name=MetA; Function=Homoserine trans -succinylase; Function class=E Amino acid transport and metabolism
  Homolog annotation: Query=1..309bp; Hit=1..309bp; Blast score=488; Percent Identity=76.0; E value=1e-138; Homolog= ZmetA COG1897
MPIRVPDELPAVNILRNENIFVMTSTRANIQDIRPLKVLLLNLMPKKIETENHFIRLLSNSPLQVDIQLLRIDSRQCKNTPEEHLDNFYCDFESIKDQNFDGLIVTGAPLGLVEFEDVTYWAEIEKIVNWAKNHVTSTLFVCWAVQAALNILYNLPKYTRTTKLSGVYSHITLDPFALLTRGFDESFLAPHSRFADFPETVIREHTDLDILACSEDAGAYLFASKDKRLVFVTGHPEYGVDTLATEYWRDLAAGLEPALPVNYFLNNDPENKPVASWRSHGHLLFLNWLNYYVYQITPYDLTYMNPTLD

SEQ ID NO: 7608 - protein, 35 aa, Xenorhabdus bovienii
  Peptide sequence Name=Xb4151_4152.C433.gene3.pep
MRNGSLQLILIFIFIFLQIQSKVGFIYVRSYGVIW

SEQ ID NO: 7609 - protein, 532 aa, Xenorhabdus bovienii
  Peptide sequence Name=Xb4151_4152.C433.gene4.pep
  Gene classification: Gene name=AceB; Function=Malate synthase; Function class=C Energy production and conversion
  Homolog annotation: Query=1..531bp; Hit=1..532bp; Blast score=833; Percent Identity=75.0; E value=0; Homolog= aceB COG2225
MTQQALTTDLTFTKLFGEAENQILLPESIGFIEDLVVEFSDRRKKLLEERIHWQKKIDDGILPDFISETISIRESDWKVQGIPDDLKDRRVEITGPVERKMVINALNSNVKVFMADFEDSLSPSWDKVISGQINLRDAVNGTISYTSEQGKRYELKSEPAVLVARVRGLHLSEKHVLYKKEPISGGLFDFALYFYLNHKNLLANGSGPYFYLPKIQSYHEAQWWSDVFSFTEERFNLPKGTIKATVLIETLSAVFQMDEILYHLRHHIVGLNCGRWDYIFSYIKTLKNHSDRVLPDRQSVTMTQPFLSAYSRLLIKTCHKRGAFAMGGMSAFIPSKDIEQNQWIMDKVRADKELEAKNGHDGTWIAHPGLADIAMTVFNTTLGERPNQLAVSREEDETITAEQLLEPCLGERTEEGLRANIRVAVQYIEAWISGNGCVPIYGLMEDAATAEISRTSIWQWIRHEKLLSNGKKVTKELFRQMLKEELGIIKQEVGEMNFNQGRFMEASNLMERITTQDELIDFLTLPGYQLLD

SEQ ID NO: 7610 - protein, 435 aa, Xenorhabdus bovienii
  Peptide sequence Name=Xb4151_4152.C433.gene5.pep
  Gene classification: Gene name=AceA; Function=Isocitrate lyase; Function class=C Energy production and conversion
  Homolog annotation: Query=4..435bp; Hit=8..439bp; Blast score=759; Percent Identity=86.0; E value=0; Homolog= ZaceA COG2224
MNNSRTQQIAQLEQEWKHSRWEGITRPYSAEDVVKLRGSVNPEHTLAQMGAKKLWELLHGKSKKGYVNALGALTGGQALQQAKAGIEAVYLSGWQVAADANTASSMYPDQSLYPVDSVPNVIKRINNSFRRADQIQWANGIDPDSQEYTDYFLPIVADAEAGFGGVLNAFELMKAMIEAGAAAVHFEDQLAAVKKCGHMGGKVLVPTQEAIQKLVAARLAADVSGVSTLLVARTDADAADLLTSDCDPYDSEFITGKRTAEGFFCTRAGIDQAISRGLAYAPYADVVWCETSTPDLEAARRFAEAIHAEYPGKLLAYNCSPSFNWKKNLDDKTIASFQEQLSAMGYKFQFITLAGIHSMWFNMFDLAYDYARGEGMKHYVEKVQGPEFAALERGYTFSSHQQEVGTGYFDKVTTIIQGGTSSVTALTGSTEEQQF

SEQ ID NO: 7611 - protein, 43 aa, Xenorhabdus bovienii
  Peptide sequence Name=Xb4151_4152.C433.gene6.pep
MRKIYFHHRHLIRRVKGNSSQNPPPDNINEPDKSKIAVLLSSP

SEQ ID NO: 7612 - protein, 574 aa, Xenorhabdus bovienii
  Peptide sequence Name=Xb4151_4152.C433.gene7.pep
  Homolog annotation: Query=2..573bp; Hit=1..572bp; Blast score=993; Percent Identity=86.0; E value=0; Homolog= Pa|Phot5-500d07.p1k_g19| 12019 - 13776 7251 585 aa, chain +
MMEIDLAHLIAQTILQGFDAQYGRFLEVTSGAQQRFEQADWHAVQRAMKKRINLYDHHVGLVVEQLKCIHGTLQYDEDYIAKAKAVYTRLLPDYPRFEIAESFFNSVYCRLFQHSNLKPENLFIFSSQPACRFRHISRPLSRDFSPNSNIASMLRTILNDVPLRLKWEDLDRDIDYIMQYLQKTFSEYDLLHATFQIANELFYRNKAAWLVGKIRLGTTVYPFLLPIHHNESGSIFIDTCLTCRNDASIVFGFARSYFMVYAPLPAALVEWLREILPTKSTAELYMAIGCQKHGKTEYYREYLMFINASQEQFSIAPGVKGMVMLVFASPSFDRVFKVIKDKFAPQKEVSQERVQECYRLVKEHDRVGRMADTQEFENFVIEKRHISQELMEELQKEIPAKLEDLGDKVLIKHLYMERKMIPLNIYMEQVDEVQLKDVIEEYGNAIKQLAAANIFPGDMLFKNFGVTRHGRVIFYDYDEICYMTEVNFRNIPPPRYPEDELASEPWYSVAANDVFPEEFRHFLCGDNLVRRYFAESHSDLFEADYWSALQERIKNGHVEDVFAYRRKQRFSQRN

SEQ ID NO: 7613 - protein, 186 aa, Xenorhabdus bovienii
  Peptide sequence Name=Xb4151_4152.C433.gene8.pep
  Homolog annotation: Query=1..185bp; Hit=1..186bp; Blast score=231; Percent Identity=65.0; E value=5e-60; Homolog= Pa|Phot5-500d07.p1k _g20| 14100 - 14660 2618 186 aa, chain +
MANVILYGDILHIKNRYADGSYLDVYGQSTSLGEKYNVVTSVSPNRDTGSGSWQILSAESKSLGTEIYSGDTVFLVNLYRNNGGYLRVSGYAPSPELYNVYTADRPVNALDTAIWHIFTDTANEFDGKIREGNVIRLLNNFNNVHGGFLDTCWLANQSGAVYKVYTSLLSDRGNGTGTWILSKAIN

SEQ ID NO: 7614 - protein, 213 aa, Xenorhabdus bovienii
  Peptide sequence Name=Xb4151_4152.C433.gene9.pep
  Gene classification: Gene name=Eda; Function=2-keto-3-deoxy-6 -phosphogluconate aldolase; Function class=G Carbohydrate transport and metabolism
  Homolog annotation: Query=1..212bp; Hit=1..212bp; Blast score=302; Percent Identity=77.0; E value=2e-82; Homolog= eda COG0800
MNNWKTTAENILTDGPLVPIIVINEIEHAVPLAKALIAGGIRVLEVTLRTECALEAIRLIAKEVPEAIIGAGTVINPEQLATVTEAGAQFAISPGLTDPLLKAATTGSIPLIPGISTVSELMLGMSYGINCFKFFPAEANGGVKALKAIAGPFPQVRFYPSGGISSDNYRDYLALNSVLSIGGSWLVPSNALKKGDYAQITELAHAVIAGAKA

SEQ ID NO: 7615 - protein, 276 aa, Xenorhabdus bovienii
  Peptide sequence Name=Xb4151_4152.C433.gene10.pep
  Gene classification: Gene name=IclR; Function=Transcriptional regulator; Function class=K Transcription
  Homolog annotation: Query=5..276bp; Hit=15..287bp; Blast score=359; Percent Identity=67.0; E value=2e-99; Homolog= iclR COG1414
MSTAVANKRTKRTKITANSTATSGQVQSLSRGLTLLEYISDSQVGVALTDLAIQAGLPNSTTHRLLTTLQQHGFVRQVGDLGLWVIASHTFVVGSSFLQSRNLMVLVHPILRQLMEDSGETVNLAILNLDEYEAVIVDQVQCNALMRMSAPIGGKLPMHASGAGKALLSTLPEQKRLQLLHKKGLHTYTQHTYTTAAALKENLEQIRKQGFSLDDEEHALGLRCIAACIYDEHHEAFAAISISGSISRISDDRVTELGALVMRAAKEISREYGGIK

SEQ ID NO: 7616 - protein, 39 aa, Xenorhabdus bovienii
  Peptide sequence Name=Xb4151_4152.C433.gene11.pep
MEFIFVFLLWMITRGKTHPMSGTTLRYPIYLHQAEDGSS

SEQ ID NO: 7617 - protein, 457 aa, Xenorhabdus bovienii
  Peptide sequence Name=Xb4151_4152.C433.gene12.pep
  Gene classification: Gene name=LysC; Function=Aspartokinases; Function class=E Amino acid transport and metabolism
  Homolog annotation: Query=10..456bp; Hit=3..449bp; Blast score=625; Percent Identity=76.0; E value=1e-179; Homolog= lysC COG0527
MCAVSSTYPQYVVAKFGGTSVADFDAMNHCADIILANADVRVVVLSASAGVTNLLVALATGCDNDKRKKCLKQIRDIQYAIIDRLNDVNVICEEIDRLLENIEMLSEAASLATSEALTDELVSHGEVMSTLLFVELLRQRNVNAEWFDIRRVMRTNDHFGRAEPDSLQLHISAVELLQPRLNNTVVITQGFIGREEKGRTTTLGRGGSDYTAALLGEALNLQRVDIWTDVPGIYTTDPRVAPTAKRIDKIAFDEAAEMATFGAKILHPATLLPAIRCGIPVFVGSSKDPQAGGTLVCDKTENPPLFRALALRRKQTLLTLHSLKMLHARGFLAEVFTLLLRHNISVDLITTSEVSVALTLDTTGSTSTNGSLLTNALLTELSTLCRVEVEEDLALVAIIGNELSQAKGLGKEIFGTLESFNIRMISYGASSHNVCLLVPGQDAESVIQKLHQNLFKV

SEQ ID NO: 7618 - protein, 548 aa, Xenorhabdus bovienii
  Peptide sequence Name=Xb4151_4152.C433.gene13.pep
  Gene classification: Gene name=Pgi; Function=Glucose-6-phosphate isomerase; Function class=G Carbohydrate transport and metabolism
  Homolog annotation: Query=1..548bp; Hit=1..548bp; Blast score=933; Percent Identity=81.0; E value=0; Homolog= pgi COG0166
MKNINPSQTEAWKALHQHFEQLKNVHLRDLFEQDKARFTAFSATFDEQILVDYSKNRITAETLTKLQTLAKETDLSGAIRSMFSGEKINCTEDRAVLHIALRNRSNTPINVDGEDVMPQVNAVLAKMKSFSERIISGEWKGYTGQAITDVVNIGIGGSDLGPYMVSEALKAYKNHLNMHFVSNVDGTHIAETLQTLNPETTLFLIASKTFTTQETMTNAYSARNWFLQNAEIEAHVAKHFAALSTNEQEVSKFGIDPLNMFEFWDWVGGRYSLWSAIGLSIALSIGYENFEQLLSGAHAMDKHFEQTSPDQNIPILLALIGIWYNNFFGAETEAILPYDQYMHRFAAYFQQGNMESNGKCIDRNGSPVDYQTGPIIWGEPGTNGQHAFYQLIHQGTKLIPCDFIAPAISHNPLSDHHSKLLSNFFAQTEALAFGKNREQVEAEFVAAGKNAQDVANVVPFKVFEGNRPTNSILLREITPFSLGALIAMYEHKIFAQGAILNIFSFDQWGVELGKQLANRILPELHDDEAINSHDSSTNGLINRFKTWR

SEQ ID NO: 7619 - protein, 46 aa, Xenorhabdus bovienii
  Peptide sequence Name=Xb4151_4152.C433.gene14.pep
MKIYINCYQLFILFTCNVISSLPIRCAVGENDVPRNGKMTWQMTQY

SEQ ID NO: 7620 - protein, 175 aa, Xenorhabdus bovienii
  Peptide sequence Name=Xb4151_4152.C433.gene15.pep
  Gene classification: Gene name=UbiC; Function=4-Hydroxybenzoate synthetase (chorismate lyase); Function class=H Coenzyme metabolism
  Homolog annotation: Query=26..166bp; Hit=62..202bp; Blast score=157; Percent Identity=55.0; E value=8e-39; Homolog= ubiC COG3161
MADDTILTPAPIRWFSADDSNIPEDILDWLMEVGSMTRRFEEHCQQVSVVPFRECFITAAELGDESEHLPKSERYWLREIVLYGDNIPWLLGRTVIPEETLTGTDKWLVDVGTVPLGRYLFNGNNLTRDYIQIGQQGQHWARRSLLRLSGKSLLLTEVFLPESPVYKMNKIKGGK

SEQ ID NO: 7621 - protein, 284 aa, Xenorhabdus bovienii
  Peptide sequence Name=Xb4151_4152.C433.gene16.pep
  Gene classification: Gene name=UbiA; Function=4-hydroxybenzoate polyprenyltransferase and related prenyltransferases; Function class= H Coenzyme metabolism
  Homolog annotation: Query=1..283bp; Hit=5..287bp; Blast score=358; Percent Identity=68.0; E value=4e-99; Homolog= ubiA COG0382
MTQNKWLAYCRLMRINKPIGVLLLLWPTYWALWIAAKGMPDLYILLVFTIGVYTMRAAGCCINDFADRKFDGHVERTKSRPLPSGDVSEKESKILFVTLGLISFALVLTLNKMTIALSFIGLALAWVYPFVKRVSNLPQIVLGAAYGWSIPMAFAAVSESLPLECWLLFLVNIIWSVIYDTQYAMVDRDDDLKIGVKSTAVLFGRFDKLILGILQFIMLGILVSVGCIVNLGGMYYWTLLLAGSLFIYQQKLISGRKKALCFQAFMNNNYVGFILFLGILFSYV

SEQ ID NO: 7622 - protein, 822 aa, Xenorhabdus bovienii
  Peptide sequence Name=Xb4151_4152.C433.gene17.pep
  Gene classification: Gene name=PlsB; Function=Glycerol-3-phosphate O -acyltransferase; Function class=I Lipid metabolism
  Homolog annotation: Query=1..806bp; Hit=21..823bp; Blast score=1207; Percent Identity=74.0; E value=0; Homolog= plsB COG2937
MSSWRKIYYKLLNFPLKFLVKSKLIPTDPIAELILDTTRPILYVLPYHSKTDLLTLRQQCLAQDLPDPLNPLEMGDTLLPSYVFIDDGPRVFRCYAPKHESVKIFHSYLDLHRNNPDLDIQMVPVSVMFGRSPGREGQEGNTAPQLRLLNGVQKFFAILWLGRDSFVRFSTPVSLLSMANDHGTDDIIANKLARVARIHYSRQRLAAVGPRLPARQDLFNKLLASKAIEKAIADETRSKKISPEKAKQNAINMLEEIAADFSSETVRLTDRILRWTWNRLYQGINVHNAERVRQLAQDGHELVYVPCHRSHMDYLLLSYVLYHQGLVPPHIAAGINLNFWPAGSIFRRLGAFFIRRTFKGNKLYSTIFREYLGELFSRGYSVEYFVEGGRSRTGRLLDPKTGTLSMTLQAMLRGDSRPITIVPIYVGYEHVMEVATYAKELRGATKEKEGFFQMIRGLRKLRNLGQGYVNFGEPIPLTQYLNHHVPDWRDSIDPIDAQRPTWLTPTVSKLAGNIMVNINNAAAANAINLCTTALLSSRQRALTREQLIEQLNCYLQLLCNVPYADDVTVPNKTAEELLDHALLMNKFEVEKDSLGDIIILPRESAVLMTYYRNNIQHLLILPSLITSIVMHHRRISRSELLSQVELVYPLLKQELFMRYSKESLPEVVNTLIDELVRQCLICNKEQDMLVLNPERIRPMQLLAAGIRETLQRYAITLSLLNATPEISRGVLEKESRMLAQRLSVLHGINAPEFFDKAVFASSVNTLREEGYIHDNSDISTTSAQKLYQMLSELMSPEIRLTIESASMPPEQNDTEQTNKDQH

SEQ ID NO: 7623 - protein, 123 aa, Xenorhabdus bovienii
  Peptide sequence Name=Xb4151_4152.C433.gene18.pep
  Gene classification: Gene name=DgkA; Function=Diacylglycerol kinase; Function class=M Cell envelope biogenesis, outer membrane
  Homolog annotation: Query=1..121bp; Hit=1..121bp; Blast score=137; Percent Identity=69.0; E value=2e-33; Homolog= dgkA COG0818
MENQSTGLIRIIKAAGYSAKGIRAAWQNEAAFRQEVIVAILAIILAFSLDFGMSERLLLIGSVMLVVIVEILNSAIEAVVDRIGSEYHELSGRAKDMGSAAVFLTIILALFIWGMILWSYFMH

SEQ ID NO: 7624 - protein, 31 aa, Xenorhabdus bovienii
  Peptide sequence Name=Xb4151_4152.C433.gene19.pep
MIFVNTRYLAAFMGWQVPNSNLPVYTHRRTV

SEQ ID NO: 7625 - protein, 204 aa, Xenorhabdus bovienii
  Peptide sequence Name=Xb4151_4152.C433.gene20.pep
  Gene classification: Gene name=LexA; Function=SOS-response transcriptional repressors (RecA-mediated autopeptidases); Function class=K Transcription
  Homolog annotation: Query=1..204bp; Hit=1..202bp; Blast score=338; Percent Identity=84.0; E value=3e-93; Homolog= lexA COG1974
MKALTARQQQVYNLVRDHISQTGMPPTRAEIAARLGFRSPNAAEEHLKALARKGVIEIISGASRGLRLLLEEEGAAGLPLIGRVAAGEPLLAQEHIESHYKVDPALFKPNADFLLRVSGMSMKDIGIMDGDLLAVHKTQDVHNGQIIVARIEDEVTVKRFKQVGNKIELIAENPEFEPIVVDLCEQSFTIEGLAVGIIRNGDWI

SEQ ID NO: 7626 - protein, 59 aa, Xenorhabdus bovienii
  Peptide sequence Name=Xb4151_4152.C433.gene21.pep
MADKHIYFQASVKLLLNGYYEKNDRPRMAKCNYPLLQSDPIPVTNNTNCQSFNGKTLLT

SEQ ID NO: 7627 - protein, 177 aa, Xenorhabdus bovienii
  Peptide sequence Name=Xb4151_4152.C433.gene22.pep
  Gene classification: Gene name=Fur; Function=Fe2+/Zn2+ uptake regulation proteins; Function class=P Inorganic ion transport and metabolism
  Homolog annotation: Query=8..176bp; Hit=21..189bp; Blast score=215; Percent Identity=62.0; E value=2e-56; Homolog= zur COG0735
MLSVKGVMKTINPKKLLTQAETICLSRGVRLTPQRLEILRLISTQPSAISAYDLLDLLREVEPQAKPPTVYRGLEFLLEQGFVHKIESTNSYVICHHFEEPSHTSAMFICENCGSVTERDAKNIESAIQQLVQGVGFHLRHSVIEVHGLCSPCHEIDSCTERDTCQHNHKTEENKKK

SEQ ID NO: 7628 - protein, 36 aa, Xenorhabdus bovienii
  Peptide sequence Name=Xb4151_4152.C433.gene23.pep
MFFSLEVGSKQTVTVLMAKRVGEKVINYPDVMSYFV

SEQ ID NO: 7629 - protein, 70 aa, Xenorhabdus bovienii
  Peptide sequence Name=Xb4151_4152.C433.gene24.pep
MMAGIPLKAFSLNNNCLNFPYKIAVSFKKLLLSPYMPFFYRQRIKILFSAYFIVLINGLIFIFILNSHHH

SEQ ID NO: 7630 - protein, 91 aa, Xenorhabdus bovienii
  Peptide sequence Name=Xb4151_4152.C433.gene25.pep
  Homolog annotation: Query=2..88bp; Hit=54..140bp; Blast score=79; Percent Identity=47.0; E value=2e-14; Homolog= gi|23473046|ref|ZP _00128364.1| hypothetical protein [Pseudomonas syringae pv. syringae B728a]
MNFIALFFGIFYYLIIGLWKKGLTLLGLNIAVFSIIVIFSIISGIDISDSILNVMGGAFSLLNGYLANYAYYLKEIKGDDGWNPFKGIFTK

SEQ ID NO: 7631 - protein, 62 aa, Xenorhabdus bovienii
  Peptide sequence Name=Xb4151_4152.C433.gene26.pep
MFILIRFKKGVFLNASLCSCVDGAQFFSKNLKRSCHFSEYLDMSIEFPYLLSLYFLSLITIF

SEQ ID NO: 7632 - protein, 48 aa, Xenorhabdus bovienii
  Peptide sequence Name=Xb4151_4152.C433.gene27.pep
MVYYSTEKFQRADRNPYKLNKKTHSNSKEYSMNIMTYKVYAAKIEYSD

SEQ ID NO: 7633 - protein, 64 aa, Xenorhabdus bovienii
  Peptide sequence Name=Xb4151_4152.C433.gene28.pep
MFSCISIFNFFILLHFCTFKAIFSFSESLAAPSFIRKLIQRIGGNLWSTIAQRSSRGRTGIHTS

SEQ ID NO: 7634 - protein, 38 aa, Xenorhabdus bovienii
  Peptide sequence Name=Xb4151_4152.C433.gene29.pep
MQQNKKIENTDTTKHVSKKEAEFSLNRFSVAPMLDWIY

SEQ ID NO: 7635 - protein, 87 aa, Xenorhabdus bovienii
  Peptide sequence Name=Xb4151_4152.C433.gene30.pep
MNTAFLLMAEFETSQIPLSDIAERYFKMSPGTAERKANEGKLGIPTYKLNDSQKSPRIVHVNDLAAYIDKQREQASKELERIQFKRK

SEQ ID NO: 7636 - protein, 105 aa, Xenorhabdus bovienii
  Peptide sequence Name=Xb4151_4152.C433.gene31.pep
MINNSFHLTQIIASVWGDPSDITDAIWQAGYRKPERGEKEIAALTIDIMEGVPDIVPYNLRPKNLDDILSWELNDIIFDATWSDKVTPAGVAKIILENGYQKGGE

SEQ ID NO: 7637 - protein, 197 aa, Xenorhabdus bovienii
  Peptide sequence Name=Xb4151_4152.C433.gene32.pep
  Homolog annotation: Query=6..176bp; Hit=24..183bp; Blast score=117; Percent Identity=38.0; E value=9e-26; Homolog= gi|125404|sp|P19653|KILA_BPP1 KilA protein gi|75985|pir||KIBPP1 kilA protein - phage P1 gi|15736|emb|CAA33655.1| unnamed prot
MKGKLLPVVVGVEIPLDEFGRYNLNTLHKASGEGEEKAPNRWLRTKYAKELIAELEAKLLKSIQTPDLALAQKAVDSAHGGTSPGTYAHELIAVSYAGWIRPDFQLDVNQAFIDFKSGNSGIGINALPSLDHMVGRFDELRHQLAKDEKNEAELLSVCSQIMNARKKTKGKRHKMISALKEAGQMAIFDDENSGEES

SEQ ID NO: 7638 - protein, 67 aa, Xenorhabdus bovienii
  Peptide sequence Name=Xb4151_4152.C433.gene33.pep
MADINDVLVKATFHIDDGRDHTDQIIHRLRQNFYIHEGDCPPLPPAPKVAEVKLTPVKKAGNKRGKE

SEQ ID NO: 7639 - protein, 75 aa, Xenorhabdus bovienii
  Peptide sequence Name=Xb4151_4152.C433.gene34.pep
  Homolog annotation: Query=1..74bp; Hit=1..75bp; Blast score=63; Percent Identity=45.0; E value=7e-10; Homolog= gi|15831456|ref|NP _310229.1| hypothetical protein [Escherichia coli O157:H7] gi|25390726|pir||B90904 hypothetical protein ECs2202
MKIEYQDKGSTAQIVISSFITERRKHNRCVDAALLATPVRASSSSVFFRRTVITGKSNHMMRAYKILCKEADSDR

SEQ ID NO: 7640 - protein, 197 aa, Xenorhabdus bovienii
  Peptide sequence Name=Xb4151_4152.C433.gene35.pep
  Homolog annotation: Query=1..179bp; Hit=1..174bp; Blast score=122; Percent Identity=40.0; E value=4e-27; Homolog= gi|24113244|ref|NP _707754.1| orf, hypothetical protein [Shigella flexneri 2a str. 301] gi|30063313|ref|NP_837484.1| hypothetic
MIIASDLLRAALVCVAKGEDAEKRPQLSGVHITRKHLEATNGHALVRMELTENVINFDDDTDVDLIIRFCGDIPEQACFTDIQLGDEPKAFHLGEDEVAFSLTRLEIINGRFPDLDKAIPTEKQNVIPYFGAKYLAYPYLMFGRGAVLMEPSGMEAACRFRFGAFTNKLYGNPVFIVLPLYKDAFEAAEQRVRELKL

SEQ ID NO: 7641 - protein, 109 aa, Xenorhabdus bovienii
  Peptide sequence Name=Xb4151_4152.C433.gene36.pep
MLSHGLPNHGWLYTVLISKNCLARSEVMKMEQTKHIVTYLGDYPCGHRHTLRIYTEAHDALDAIEKSQAVFTDDRLISTNHTLFSVMPEEFNENTIAGIDLCPNAEVKS

SEQ ID NO: 7642 - protein, 262 aa, Xenorhabdus bovienii
  Peptide sequence Name=Xb4151_4152.C433.gene37.pep
  Homolog annotation: Query=10..133bp; Hit=5..128bp; Blast score=124; Percent Identity=48.0; E value=1e-27; Homolog= gi|16765936|ref|NP _461551.1| Gifsy-1 prophage: similar to antirepressor protein of phage P22 [Salmonella typhimurium LT2] gi|
MSKKNELVTIDSNKLPVIEWQGVRVVTTETLAAGYGASTKNIQDNLLNNKSRFIDGVHYFKLEGDELRQFKKVPDNIGLVSKHTSQQILWTEKGAARMSKIVDTDEAWSFFEKMESAYFHQQKPATNPPALPGDYIAALEALLTTEKEKVVITQERDEARRTKSQISRSREAQALGKLGAATRKCRELEERLGESTKHATITAVQNATEKKYQYAPLRKWCRENDIEVVKVPDTRYGHVKSWPAESWLAVYGIDLKKLFGKK

SEQ ID NO: 7643 - protein, 163 aa, Xenorhabdus bovienii
  Peptide sequence Name=Xb4151_4152.C433.gene38.pep
MSNAEMTPKEVIEYLKENNKGCPACLLDEERAITNYPPLTDAEKMECAEYMVKRQRTLIAKEYLVSCYERFGLNTNGNFIFIHENGGVELDAEVIETLLIHQIEKTILGFRPDERYIALWSFYFNIEKSEKENNSTWMRDFIDGVFINGIKLFVAEPASLTEH

SEQ ID NO: 7644 - protein, 62 aa, Xenorhabdus bovienii
  Peptide sequence Name=Xb4151_4152.C433.gene39.pep
MTEYEQATESAQSLELKGLFRRAADKWGEALSLSRNKKQEQECIKNNLRCVREAKITIREGL

SEQ ID NO: 7645 - protein, 78 aa, Xenorhabdus bovienii
  Peptide sequence Name=Xb4151_4152.C433.gene40.pep
MKNETYLDFAETAIQKEKEEKYDLAATYWKRAKYLAADLKHRLWAQYNQENNEERHLLHHSHITVLSRYMNKQAANND

SEQ ID NO: 7646 - protein, 112 aa, Xenorhabdus bovienii
  Peptide sequence Name=Xb4151_4152.C433.gene41.pep
MTQLTLLERKRKAFIHAKLDTLQKKHSSHSVIVKVAEINYRLDLDEDVLNIALISLFEKNVILSLKGKLIAEDALVNSYDSFYTKNGDLTAEGNEFMKELLKIIAQKMELMK

SEQ ID NO: 7647 - protein, 134 aa, Xenorhabdus bovienii
  Peptide sequence Name=Xb4151_4152.C433.gene42.pep
MKILKPIETATNQDIQIETREVYVVCGASKAYLSEKGALNKLAYVRAQEQFNAEDRPSNFPAQEVIQEDGTSALRQGEMRPEFMERHAQVLEELKADVRQVREIARLKKECKKAKEKLLTVLDDLENAENKYKN

SEQ ID NO: 7648 - protein, 102 aa, Xenorhabdus bovienii
  Peptide sequence Name=Xb4151_4152.C433.gene43.pep
MNNIFYHTRVNNERLEKMSDSDLQLLASSSEDVIYSITSGMKSIANLANAAVNSEEYSQDDAMTDLDRLSRLFSVLTLIIEAEHENHVNATDEIRKRKKFSK

SEQ ID NO: 7649 - protein, 124 aa, Xenorhabdus bovienii
  Peptide sequence Name=Xb4151_4152.C433.gene44.pep
MMNNKLQAAVEIAEEIEASIFPVVTAIQNEAEPDTYLMCRGVHRQTCDLAQRLRDINKEYIMSGNQAFDELEGVASEIENLRTYISLLVDTDKSLSGAELLSIALVAIFHIGKEIARVRGVEYS

SEQ ID NO: 7650 - protein, 67 aa, Xenorhabdus bovienii
  Peptide sequence Name=Xb4151_4152.C433.gene45.pep
MINRPTHTETLTTQNSLKLAERLQTYLFTWSASEKNKDTVHLIEMAIDTTNKIIDNLIKSTEVNDEQ

SEQ ID NO: 7651 - protein, 247 aa, Xenorhabdus bovienii
  Peptide sequence Name=Xb4151_4152.C433.gene46.pep
  Gene classification: Function=Predicted transcriptional regulator; Function class=K Transcription
  Homolog annotation: Query=14..224bp; Hit=10..204bp; Blast score=85; Percent Identity=32.0; E value=4e-17; Homolog= XF0696 COG2932
METKDIRRNNLRTLMTQHVRQGTSKTAFAELIGIPPSQLSQLTSDNAVRNIGDIIARRIEVNLELPIGWLDIPQQLIDNRDNSHKERNNENYHLQNISHKVTDLSYRIEQLDVEFSCGGGRLNSDYPDIVRSIEVDPEYAKRMFGCRPSTSLKLTTALGDSMLGTINPGELVVLDITVSRFMSDGIYAFTYGDGMHIKRLQLLKDRIVVISDNQIYDRWEIDSENESKFHIHGFVVGKWRMDYARLG

SEQ ID NO: 7652 - protein, 44 aa, Xenorhabdus bovienii
  Peptide sequence Name=Xb4151_4152.C433.gene47.pep
MLCHQGAQIIASYVFSFHITIITLISNLINMHDDKKSCKFLSKR

SEQ ID NO: 7653 - protein, 78 aa, Xenorhabdus bovienii
  Peptide sequence Name=Xb4151_4152.C433.gene48.pep
  Homolog annotation: Query=1..70bp; Hit=1..70bp; Blast score=81; Percent Identity=57.0; E value=4e-15; Homolog= gi|2668758|gb|AAD04645.1| cro protein [Bacteriophage H-19B]
MKNDLHRWKKEADKDDWNNLAQVVGTSVGYLNLIAGGFRRASPSMASRIEDGTKKFNRLSPVKKENLIFMDSPKKNVS

SEQ ID NO: 7654 - protein, 93 aa, Xenorhabdus bovienii
  Peptide sequence Name=Xb4151_4152.C433.gene49.pep
  Homolog annotation: Query=2..88bp; Hit=4..90bp; Blast score=105; Percent Identity=62.0; E value=1e-22; Homolog= gi|37526809|ref|NP _930153.1| hypothetical protein [Photorhabdus luminescens subsp. laumondii TTO1] gi|36786241|emb|CAE15293.1| u
MFPDFTKVTMPSHFYPDDGTWIQETLAKLRASTRAKITAKYSEVYQAAWDEESVSYRKDNAARRAANIRLREFVTKYERAAQGYTAQPLTVNQ

SEQ ID NO: 7655 - protein, 134 aa, Xenorhabdus bovienii
  Peptide sequence Name=Xb4151_4152.C433.gene50.pep
MFRCLDGYICFLGKRGKLSRGGLGGVIFERGVREGTAKRKNSDLNVDHCRGYKMGQVARRLNENKKRACPLAVEIIQVRVSMLTEKESVRGCKKPNRETLASRTDSDLAVGNGELPVQKYCTVTIKNKQGVTSC

SEQ ID NO: 7656 - protein, 543 aa, Xenorhabdus bovienii
  Peptide sequence Name=Xb4151_4152.C433.gene51.pep
  Gene classification: Gene name=SSL2; Function=DNA or RNA helicases of superfamily II; Function class=L DNA replication, recombination and repair
  Homolog annotation: Query=100..357bp; Hit=134..410bp; Blast score =110; Percent Identity=31.0; E value=5e-24; Homolog= YDR332w COG1061
MLEITPNFAQERGLNLLRADWKKYSSFLVYAPTGAGKTALSAFIVDGFVSKNKKVMMICPFTVLINQTAQRFIEYGLPENEIAYIWRDHPNQDPSKLIQIASADTLIRRDFPEDINLLVIDEAHLKRKKILTEITRLTSETDCKVVGLSGTPFSPFLGHYYQKLIKPTTIKELIQRGDLSPYEFYAPTKPDLSKVKSARSDDYGSDYKEDEIAEIMCGADLVGDVVSSWLKLGENQPTICFCVNVSHANFITVEFNRAGVNAEIMTANTPHDERDLIIHRFEQGATKIIVNIGVLVAGFDSDVRCIIYARPTKSEIRWLQSIGRGLRTARGKDRCIILDHSGSVHRLGYPDDIEYDELPSKNDGMKSSSSYREQEKREKLPKECSSCHYMKPAGVYVCPKCGFKPLVGENIDVDTSRTIQKLSKKERIYTQAEKQSFYSQLKYYQNQRASQGKTISDGWVSNTFKDKFDVWPRGLHDTPQEMTPEVSNFIKHKQIAFAKSRKKAEQVQPSSNEQQEMRLEVARQKVSDIREKLGRSSHQGDRL

SEQ ID NO: 7657 - protein, 326 aa, Xenorhabdus bovienii
  Peptide sequence Name=Xb4151_4152.C433.gene52.pep
  Homolog annotation: Query=4..310bp; Hit=1..308bp; Blast score=371; Percent Identity=57.0; E value=1e-102; Homolog= gi|37526806|ref|NP _930150.1| hypothetical protein [Photorhabdus luminescens subsp. laumondii TTO1] gi|36786238|emb|CAE15290.1
VNRINTTDAVIGHWPKVFEYYGLPPVTGKKHFKGKCPICKQIGKFRIDDRDGRGTFICTCNAGDGWALLRLTQKKEFKVLADEIDQLLGIQRDKVTPKPKASTVADNRQKIITLYSRMPELKGTSAEKYLQSREIYSHHPLEQIRFCEKQPTCQGNYQAMWALATDSRGQLCYLHRTYLDGDRKAPLDVTKKMMSLQEDNYLKYAESVAIRMFPVASTLGIAEGIETALSCKQVYGVNTWSTMNAGHMEKFLTPRGVKHLIIFTDMDWSATGHAAAMKCAHKNLLANNDLDKVSVRWPDFGDFNDLLQNGDQARELTFMKKQRETA

SEQ ID NO: 7658 - protein, 284 aa, Xenorhabdus bovienii
  Peptide sequence Name=Xb4151_4152.C433.gene53.pep
  Homolog annotation: Query=3..282bp; Hit=4..283bp; Blast score=280; Percent Identity=52.0; E value=1e-74; Homolog= gi|16764264|ref|NP _459879.1| Fels-1 prophage [Salmonella typhimurium LT2] gi|16419412|gb|AAL19838.1| Fels-1 prophage protein [
MMDNTAHKTLFTIPEPRYSTALATVKPLPVQRKITGNKQVDAYLWVLEVIKTNEPAHLEAAEEGLKKLKITPKAAQQKYSDYLMKSGAHPFQIAFGTLSMDNPQGYINSAKEQIKKASQVRAAFASYEATLELTEPEKLMLVGELADIYEPFYYWNETERAEGCMHGDRICETDKLRQATAKGFAEQLPEPHTLSDVVREFLYWDWLYQMRNVAAEELNPGGYGDSDRYHIYDRQDYLEGKLVTIQAVNRQEAIDVCKWVLEEERFHDRKLTDRIILNLVGETA

SEQ ID NO: 7659 - protein, 259 aa, Xenorhabdus bovienii
  Peptide sequence Name=Xb4151_4152.C433.gene54.pep
  Homolog annotation: Query=1..258bp; Hit=1..269bp; Blast score=216; Percent Identity=42.0; E value=3e-55; Homolog= gi|16764265|ref|NP _459880.1| Fels-1 prophage; putative chaparone [Salmonella typhimurium LT2] gi|16419413|gb|AAL19839.1| putat
MKLESALKHFHPKTPTFSDASTSTAPDRMKGMDTAAALGMAGSQAKFGMAAFFAKNEVSEEDKFSTVEELTRYARRTVPKLISKAAGNKLGPCLVILSKMAFEDYARSAASTCQCSECRGKGLIYGIKEVEKHPGIIRADGEVIMAPWIEKEQVGELCQKCNGKGTLSSRCRCKGRGVVVDEEKTALQGVPVDKICPRCSGRGYSRVPSSVAYTAIKAYLPELNERTWRRNWKPFYRVLVDKCYSEEKRAEAAFNEVTK

SEQ ID NO: 7660 - protein, 92 aa, Xenorhabdus bovienii
  Peptide sequence Name=Xb4151_4152.C433.gene55.pep
MRKLTMYALKLITERNGRSVEESWILGDMYRLEFFPKDVADNVIARVEHSQNGNLINHDIKKTDQAYITTLTGDTVRTVCRGRSGLVAGPIQ

SEQ ID NO: 7661 - protein, 70 aa, Xenorhabdus bovienii
  Peptide sequence Name=Xb4151_4152.C433.gene56.pep
LPFVASGLQTKYADRNRRYGGTGSDCGGKLGNKQYRAPRDRRSVLVTVWGQLQVHFGLDRPCEQCHPSEW

SEQ ID NO: 7662 - protein, 55 aa, Xenorhabdus bovienii
  Peptide sequence Name=Xb4151_4152.C433.gene57.pep
MKVSIELNGETVWYRDEEKGEGMASTGYIKDGTQQKIITALEAALFQAKAEYLCV

SEQ ID NO: 7663 - protein, 112 aa, Xenorhabdus bovienii
  Peptide sequence Name=Xb4151_4152.C433.gene58.pep
  Homolog annotation: Query=25..93bp; Hit=1..69bp; Blast score=76; Percent Identity=37.0; E value=1e-13; Homolog= gi|23063195|ref|ZP _00087937.1| hypothetical protein [Pseudomonas fluorescens PfO-1]
MLLDQPKINQLEGWLMTSYLKEGEMSYIHSREYLKDGNVVSVQCSHQINVLVMDDNQYSNYRNGRQYRYYGGFYKQFPANIIPPHSGYWNVVLAMPPGYSANIKHTISVLNA

SEQ ID NO: 7664 - protein, 114 aa, Xenorhabdus bovienii
  Peptide sequence Name=Xb4151_4152.C433.gene59.pep
  Homolog annotation: Query=7..114bp; Hit=4..111bp; Blast score=130; Percent Identity=62.0; E value=6e-30; Homolog= Pa|Phot5-476a02.p1k _g44| 25675 - 26010 1803 111 aa, chain -
MGWNMKMKENPDVWVHLGEWLISVREQGIWATLAGTMAFFRGRYNGGGWVKVSIDAFMCAMFAWFIRDVLNFMGLNPDLAYIGSVVIGYLGTDFIGQLLRKSAEKRAGVSNDNE

SEQ ID NO: 7665 - protein, 156 aa, Xenorhabdus bovienii
  Peptide sequence Name=Xb4151_4152.C433.gene60.pep
  Homolog annotation: Query=25..156bp; Hit=1..132bp; Blast score=154; Percent Identity=57.0; E value=6e-37; Homolog= gi|24371578|ref|NP _720320.1| 19 [Salmonella typhimurium bacteriophage ST64T] gi|24250805|gb|AAL15518.1| 19 [Salmonella typhim
LATWGQTLLVNCCVSRQRKERGSAMTTNNFKLSQRSENNLKGIHPDLVAVVRRALALSPVDFTVIEGLRTLERQTQLVAEKKSRTMNSRHLTGHAVDLLPVGADWNDYTCWLPVLNAMRQAGEERGIKLRFGITWTNNPNDKPAKFLDAPHIEILA

SEQ ID NO: 7666 - protein, 126 aa, Xenorhabdus bovienii
  Peptide sequence Name=Xb4151_4152.C433.gene61.pep
  Homolog annotation: Query=1..126bp; Hit=1..128bp; Blast score=142; Percent Identity=60.0; E value=1e-33; Homolog= Pa|Phot2-60c06.p1ka _g84| 57323 - 57709 1230 128 aa, chain -
MKFNSQHFTLGALVVVSGLLWFFYSEYQQKAQDYSELDTKYKHQQVMTANTFQTVRIFNDISRINSESRSRSAVDSEQTKAAIKAVVVSHDCANRLVPDGAVIRLQQHTNRIRSGATDTHSGTSAR

SEQ ID NO: 7667 - protein, 86 aa, Xenorhabdus bovienii
  Peptide sequence Name=Xb4151_4152.C433.gene62.pep
  Homolog annotation: Query=1..81bp; Hit=1..81bp; Blast score=111; Percent Identity=74.0; E value=3e-24; Homolog= Pa|Phot2-60c06.p1ka _g83| 57175 - 57435 462 86 aa, chain -
MIVPIALCLMGLLSGCSSIQTEYVPVPPIPIPAHLLADCLPPAISDKMTWSDSLLLNEQLLTVIEQCNLDKQAIREIEESKPPQSK

SEQ ID NO: 7668 - protein, 51 aa, Xenorhabdus bovienii
  Peptide sequence Name=Xb4151_4152.C433.gene63.pep
LNRYKDNKSDYSESHRHYAPIHSCHPRIICSGVACSLLFPVSPVYPDCTAQ

SEQ ID NO: 7669 - protein, 142 aa, Xenorhabdus bovienii
  Peptide sequence Name=Xb4151_4152.C433.gene64.pep
MLFLLEVVMPINPRDPFRTSYPLVRSRRAFHAQVGTTHSQTHFLGADILDVYLEYLIVCRFLSADSTGVLTIKARFLDLTYEPYINLPNVEKYLFLLGFTPTLATSGVKYTQTRYSKVQSLPDYEKNVLPAIKQLWAANPPY

SEQ ID NO: 7670 - protein, 55 aa, Xenorhabdus bovienii
  Peptide sequence Name=Xb4151_4152.C433.gene65.pep
MPSVNAGGFFVSAFHCVGLSPSACISHDMFPLHRAYRSESKIINAPDSHYQQHPL

SEQ ID NO: 7671 - protein, 62 aa, Xenorhabdus bovienii; identical to SEQ ID NO: 6591
  Peptide sequence Name=Xb4151_4152.C433.gene66.pep

SEQ ID NO: 7672 - protein, 121 aa, Xenorhabdus bovienii; identical to SEQ ID NO: 6592
  Peptide sequence Name=Xb4151_4152.C433.gene67.pep
  Homolog annotation: Query=1..94bp; Hit=1..96bp; Blast score=86; Percent Identity=48.0; E value=8e-17; Homolog= gi|23505499|ref|NP _700428.1| hypothetical protein [Salmonella typhimurium phage ST64B] gi|23379246|gb|AAL25933.1| Sb55 [Salmonell

SEQ ID NO: 7673 - protein, 34 aa, Xenorhabdus bovienii; identical to SEQ ID NO: 6593
  Peptide sequence Name=Xb4151_4152.C433.gene68.pep

SEQ ID NO: 7674 - protein, 119 aa, Xenorhabdus bovienii
  Peptide sequence Name=Xb4151_4152.C433.gene69.pep
MTQSTGTATYDITVGIKYDTDTLNQLETQLKRIAEQVDRINGRRYDADMKLSVDTGAKAGIAADSFKVFDVAGKVYMKEAVIPQAVIKDNDDHLRQIIREEIRQFVTRESERGGLFSKW

SEQ ID NO: 7675 - protein, 116 aa, Xenorhabdus bovienii
  Peptide sequence Name=Xb4151_4152.C433.gene70.pep
  Homolog annotation: Query=1..115bp; Hit=1..115bp; Blast score=181; Percent Identity=86.0; E value=2e-45; Homolog= gi|6066821|emb|CAB58450.1| hypothetical protein [Xenorhabdus nematophila]
MPPRIPRACRKQGCPKTTTDRSGYCNDHLHTGWENHQQGKSRHERGYGSKWDKLRATIKARDKHLCQQCLRNGRAVTGVTVDHIKPKAHGGTDALTNLVLLCWSCHRAKTATERLR

SEQ ID NO: 7676 - protein, 67 aa, Xenorhabdus bovienii
  Peptide sequence Name=Xb4151_4152.C433.gene71.pep
MSEKQVKLSRLYKGGHFKGYALSVDGMLLSNQQQVVIETNSEGVHPTLNVTFTVTDEMAGEGVDIYI

SEQ ID NO: 7677 - protein, 97 aa, Xenorhabdus bovienii
  Peptide sequence Name=Xb4151_4152.C433.gene72.pep
LHHIKCNGHGDCYPEMILIPSVTISSVMVTQGEGRVKSLPLSPQGTAALPLFTSPRNANLFLGCPNCAILQEKSHGRTTANPDPPASGEGEPIKTAD

SEQ ID NO: 7678 - protein, 171 aa, Xenorhabdus bovienii
  Peptide sequence Name=Xb4151_4152.C433.gene73.pep
  Homolog annotation: Query=19..171bp; Hit=1..153bp; Blast score=281; Percent Identity=92.0; E value=2e-75; Homolog= gi|6066822|emb|CAB58451.1| hypothetical protein [Xenorhabdus nematophila]
MQTFFWGAPTAPFYRRNHMAGRPPTPTHLRLVRGNPSKRPINANEPMPGKGVPHVPKHFGKMGRYWHERIAGELDKVGVLTSLDAKALELLIEAYVEYRTHCETLETEGYTYRTDQGLIKAHPAAGMKADAWKRIHAMLSAFGMSPSSRSKVNITGEDKADPLTEFLQMRD

SEQ ID NO: 7679 - protein, 578 aa, Xenorhabdus bovienii
  Peptide sequence Name=Xb4151_4152.C433.gene74.pep
  Homolog annotation: Query=9..578bp; Hit=8..570bp; Blast score=361; Percent Identity=37.0; E value=2e-98; Homolog= gi|18249900|ref|NP _543088.1| putative terminase [Bacteriophage P27] gi|18152367|emb|CAC83554.1| putative terminase [Bacterioph
MAKVAEGIRYAERVVAGEIVSGELVTLACQRFLDDLAHGEERGISFSEPRAQHILNFYKFVPHVKGALAGQPIELMDWHVFILINIFGFVRPLIDEQTGEIVLRNDGSGRPVMVRRYRTAYNEVARKNAKSTLSSGIGLYMTGADSEGGAEVYSAATTRDQARIVFEDAKNMIKQARPTLGRLFAFNKLAIYQEQSASKFEPLSSDANNLDGLNIHCGIVDELHAHKTRDVWDVLETATGARLQSLLFGITTAGFNKEGICYELRDYAVKVLRGQVDDDTFFGIIYTLDKEDDPFDETVWQKANPGLGICKRWDDLRRLAKKAREQVSARHNFFTKHMNLWVTAESAWMDMLKWDDSEPLAPPHELKTYPMWVGVDLANKIDICAAVKVWQGNNGHVHADFKFWLPEDRIERCSRQMAELYRKWGEMGALTLTDGEVVDHTQIKEELQHWVAGENLKEIGFDPWSATQFSRALAEEGLPLIEVSQTVRNLSEAMKSLEALVYSGQFHHNGHPVMNWMMSNVTAKPDKNDNIFPNKSTPEAKIDGPVALFTAISRLLVNGGEQPESLSDVLMARGLRAL

SEQ ID NO: 7680 - protein, 58 aa, Xenorhabdus bovienii
  Peptide sequence Name=Xb4151_4152.C433.gene75.pep
MKILIFVALLVGLAGGGLLSYGAWLLLPAAGFMVAGVLCLGWSYLVSRMLGHKPGKGA

SEQ ID NO: 7681 - protein, 412 aa, Xenorhabdus bovienii
  Peptide sequence Name=Xb4151_4152.C433.gene76.pep
  Homolog annotation: Query=1..412bp; Hit=1..412bp; Blast score=640; Percent Identity=74.0; E value=0; Homolog= gi|18249902|ref|NP _543090.1| putative portal protein [Bacteriophage P27] gi|18152369|emb|CAC83556.1| putative portal protein [Bact
MFFPGLFRKSADPMTSRELSELIGLSYDTYTGRRVSPRMAMQLTAVFSCVRVLAESVGMLPCSLYEQLARGNKRATRERLNTLLSVKPNNYMTPQEFWELLIACLCLRGNFYAYKVKALGEVVELLPLEPGSVVPKLNSDWLPEYQVTFPNGDSRTLTQDEIWHVRIFTLDGLIGLSPIAYARQAIGLGLATEEHGSRLFGNGAVTSGVLQTDQSLTDDAFDRLKADFESRHQGLVNAHKPMILEMGLQWKQISLSAEDAQFLETRKFQLEEICRIFRVPLHMVQNTDRATFNNIENLGIGFINYSLVPYLTRIEQRINAGLVKGTKQGQFYAKFNTGALLRGDMKSRFEAYTRGINWGIYSPNECRELEELNPREGGDIYLTPMNMTTDPDSPPKPKTETESHADDDQKTA

SEQ ID NO: 7682 - protein, 219 aa, Xenorhabdus bovienii
  Peptide sequence Name=Xb4151_4152.C433.gene77.pep
  Gene classification: Function=Phage head maturation protease; Function class=R General function prediction only
  Homolog annotation: Query=23..158bp; Hit=6..134bp; Blast score=85; Percent Identity=39.0; E value=4e-17; Homolog= CC2786 COG3740
MPMMTKKRLDVPLKIKSVSDSGEFEGYGSVFGVKDSYDDIVLPGAFENSLKQWGEKGGLPALLWQHRMDEPIGIYTEMKEDEVGLYLKGRLLIDDDPLAKRAHAHLKAGSLSGLSIGYLLKEWEYDRTKEAFLLKELDLWEVSLVTFPANDEARVSEVKSAFARGDIPAPKSIERVLRDVGLSRSQAKAFMAEGYGALSLRDAETDVSILNALKTLTFE

SEQ ID NO: 7683 - protein, 403 aa, Xenorhabdus bovienii
  Peptide sequence Name=Xb4151_4152.C433.gene78.pep
  Homolog annotation: Query=1..397bp; Hit=1..397bp; Blast score=524; Percent Identity=67.0; E value=1e-147; Homolog= gi|23505451|ref|NP _700379.1| Major capsid protein precursor [Salmonella typhimurium phage ST64B] gi|23379198|gb|AAL25885.1| S
MAVELKDVEQIAQEIKGRFDEFKEKNDKRFDAIEAEKGKLAGQVDTLNGKLSELDSLKTALEEELAGLKRPAGGSNNKAASEHKTAFTQFIRKGKDDGLAELEQKAMQTVSDPEGGYAVPEELDRNIISALKDEVVMRAECSVVSVGNPNFKRLVNQGGTNSGWVGETDERPETKTPKLTPIEPTWGEIYGNPAATQTMLDDAFFDVEAFITAELAQEFAEQEEDAFTHGDGVKKPKGLLAYGSDAQTDKERKWGTLQHLLLKKPTEVTADEIMQLIYTLRKPYRNGAKFMMNNKMLFTVRTLKDSQGNYLWQPGLQLGQPSALLGYGIAENEQFADVGADAVPVAFGNFKRCYTILDRMGVRILRDPYTHKPFIHFYTTKRVGSLLVDSNAVKLLKAGGGKS

SEQ ID NO: 7684 - protein, 101 aa, Xenorhabdus bovienii
  Peptide sequence Name=Xb4151_4152.C433.gene79.pep
MPLPTIEELRLQCKIDETQDDDLLLNYLASAREKAENYLNRKLYEDRVPDDDLDGILITPLIKLALMLAVGFWYEHREPNVLASGFKELLNDYRIRPMRGK

SEQ ID NO: 7685 - protein, 106 aa, Xenorhabdus bovienii
  Peptide sequence Name=Xb4151_4152.C433.gene80.pep
  Homolog annotation: Query=1..104bp; Hit=1..107bp; Blast score=74; Percent Identity=42.0; E value=3e-13; Homolog= gi|9634128|ref|NP _037670.1| gp9 [Enterobacteria phage HK022] gi|6863120|gb|AAF30361.1|AF069308_9 gp9 [Enterobacteria phage HK02
MNIGRLRHRITIQGIRTRQTSSGGVVNERYTVATVWAEAKFISGREVVAAKAVLSESVVRFWVRYRADIDTTMAIIFRGKTYAIQAVMPDNKLTLLELLCQEGVKQ

SEQ ID NO: 7686 - protein, 147 aa, Xenorhabdus bovienii
  Peptide sequence Name=Xb4151_4152.C433.gene81.pep
  Homolog annotation: Query=2..147bp; Hit=4..149bp; Blast score=147; Percent Identity=52.0; E value=3e-35; Homolog= gi|9634169|ref|NP _037704.1| Gp10 [Bacteriophage HK97] gi|6901598|gb|AAF31101.1| Gp10 [Bacteriophage HK97]
MTTVDLSALKDLSRDLELLSKAENDKVLRKGMYAGAKVLRDETRSRAPKRTGKLKKNIMAVNRKKQRDGSISSGVYVRGSNQSGTNSDPKMKKNDPRNAYYWRFLEKGTSRMAPKPFIDPAFESKSDAAADAVFNAALKAIDEVLAK

SEQ ID NO: 7687 - protein, 111 aa, Xenorhabdus bovienii
  Peptide sequence Name=Xb4151_4152.C433.gene82.pep
  Homolog annotation: Query=1..109bp; Hit=1..112bp; Blast score=70; Percent Identity=38.0; E value=7e-12; Homolog= gi|15801954|ref|NP _287975.1| putative structural component of cryptic prophage CP-933P [Escherichia coli O157:H7 EDL933] gi|158
MTDGDLFTLLVPVLPGRVFPYLIPQTERKTAAPWCVFSTYSIYTDVLSGQSVKMTRVQIDAYAPGLDDADRICGDAFSAIKTLQPFEVERENSYENDTGLYRATVEFKIYS

SEQ ID NO: 7688 - protein, 176 aa, Xenorhabdus bovienii
  Peptide sequence Name=Xb4151_4152.C433.gene83.pep
  Homolog annotation: Query=23..172bp; Hit=3..151bp; Blast score=138; Percent Identity=47.0; E value=5e-32; Homolog= gi|9634159|ref|NP _037706.1| major tail subunit [Bacteriophage HK97] gi|6901588|gb|AAF31091.1|AF069529_4 major tail subunit [B
MTRGCIARPSNLKSIPNPGDNMAKYEKTLATSLSVSAEAANDATSTLIKWVAIDTSVKEINYTGGQKSDIEVTTLGSREQEMINGLAAPAEITLSGHWTADEEGQDILRLAYSTDQAYAFRVQFPSGNGYTFLAEVRQESWQAAANGIVSASFTLRMKGRPTPLAKKLQTNTQEGQ

SEQ ID NO: 7689 - protein, 163 aa, Xenorhabdus bovienii
  Peptide sequence Name=Xb4151_4152.C433.gene84.pep
  Homolog annotation: Query=41..160bp; Hit=5..124bp; Blast score=129; Percent Identity=54.0; E value=1e-29; Homolog= gi|9634171|ref|NP _037708.1| tail assembly chaperone [Bacteriophage HK97] gi|6901600|gb|AAF31103.1| tail assembly chaperone [B
MAGCRQWHRQRLLHLAHERPPDTAGEKTANQHTGRTIIMNIRQLALTPKLGFRTKTVTVTEWDNATVTLREPSAGAWIRWNEVTSPTDKEGTLSTAEKVLRNTRADVVLFIDVLCDEHGEPVFTPDDMEAVMDIYAPVHSRLLHQALSLVTTGDEAEKKSDLH

SEQ ID NO: 7690 - protein, 88 aa, Xenorhabdus bovienii; identical to SEQ ID NO: 5472
  Peptide sequence Name=Xb4151_4152.C433.gene85.pep
  Homolog annotation: Query=1..88bp; Hit=132..220bp; Blast score=96; Percent Identity=52.0; E value=8e-20; Homolog= gi|9634172|ref|NP _037707.1| Gp14 [Bacteriophage HK97] gi|6901601|gb|AAF31104.1| Gp14 [Bacteriophage HK97]

SEQ ID NO: 7691 - protein, 1124 aa, Xenorhabdus bovienii
  Peptide sequence Name=Xb4151_4152.C433.gene86.pep
  Homolog annotation: Query=1..1057bp; Hit=1..1020bp; Blast score=471; Percent Identity=37.0; E value=1e-131; Homolog= gi|15801950|ref|NP _287971.1| putative tail component of cryptic prophage CP-933P [Escherichia coli O157:H7 EDL933] gi|15831
VAKLRELIIKISANSSSYQAEIARAARLGENYHRVMENGNRGAAAAARGSRAALRDLNSQLVSVKDSAVGMAGAFAGIFATSKLIETADKWTNLNSRLKLATASSIDLANSQRLLMEMSQKTGTSFEANATVFARAAAPMRALQYASQDIVNMTEALSTGLRISGANASESSSVLVQFSQAMSSGVLRGEEFNAMAENGSRIIQALADGMGVARTQLKGMANDGLLTMDKVIPALLSQLEKLKAEGLSMGATVEKSLMRVQNAFMEWIGGANEATGTTRVLAGVLDDLSKNINDVAAAGAVAVGLFGARALGNRVSAIGASTSALIQNSRAEINNADQAYRNSQVQVASARASAYQAQQNVIAARSRLLQTTNTQTFAAAEARLNRTLVAEAAAQARVTQSINARAAAQARLNAVTSLGSRMGGALLGAVGGLPGILIMAAGAAYLLYQNQKQAKEEARAHAKEATKIKEELSKMDPVQLRDTKNQLKEDLAVAKEDVEKFRKEMNKNQISLNLFMKDKSNGKNTDIKITEFSTKLSESRSAYEAALKTVGEITSALTSLGDQQTINGEKEKRFITAINEMRKTGNVTLALQNQKLELTVSLLERIKNLGIDVSGIHVPVPVVKFEPNDKIKSLLKDQEREIDLSKRKGLDKVRREAYYKAVDGGLNPDDRQQKPYVNQVINNAAQVYQNAEALRKQDEAARKAQSEAESATRKAAKTAEDYTNKVAELNTQLATEAIRYKEGNAAAELFANSQNNVSKFTQEQNNHLNQLNKRLEETKQRYQDLQAAIEADPFRNVAKRTQEATEQLERQKNNGQIESPAEYTYRKGDIWKDEVRGNADARQQYAVSARDNLRGEVDPIQDLENQLERKKALYQSYADATVISEQRKNELIAAAETENNTKRIEAAKQLFAAQSTYHAIAVNLFDTVSERMGNMITGLLTGTKSLKEGISEMFASMAQSVVQSLMKIAANKAFEMLASSFGGGAGGAFNGFMSTFVKNAKGGVYNSPSLSSYSGQIVNSPTLFAFAKGAGLMGEAGPEAIMPLTRSADGSLGVRAISPKGLGDQGGTNINVYITDGKTESSSSKGDNDAFGRRFAQAVAQVYYAERDRDLRQGGAINKAIRAK

SEQ ID NO: 7692 - protein, 110 aa, Xenorhabdus bovienii; identical to SEQ ID NO: 5474
  Peptide sequence Name=Xb4151_4152.C433.gene87.pep
  Homolog annotation: Query=1..110bp; Hit=3..112bp; Blast score=132; Percent Identity=52.0; E value=1e-30; Homolog= gi|9634174|ref|NP _037711.1| Gp17 [Bacteriophage HK97] gi|6901603|gb|AAF31106.1| Gp17 [Bacteriophage HK97]

SEQ ID NO: 7693 - protein, 249 aa, Xenorhabdus bovienii; identical to SEQ ID NO: 5475
  Peptide sequence Name=Xb4151_4152.C433.gene88.pep
  Homolog annotation: Query=5..249bp; Hit=6..250bp; Blast score=342; Percent Identity=62.0; E value=5e-93; Homolog= gi|16122357|ref|NP _405670.1| putative phage protein [Yersinia pestis] gi|22126082|ref|NP_669505.1| putative phage tail protein

SEQ ID NO: 7694 - protein, 235 aa, Xenorhabdus bovienii
  Peptide sequence Name=Xb4151_4152.C433.gene89.pep
  Gene classification: Function=Uncharacterized ACR, PAD1/JAB1-related; Function class=S Function unknown
  Homolog annotation: Query=8..123bp; Hit=10..126bp; Blast score=112; Percent Identity=46.0; E value=3e-25; Homolog= PA0639_1 COG1310
MNDKTLTAIFEHAKQMHPNECCGVIAQKSRVEKYFPCKNLAPNPAEQFQLDPGDYLAASIWGTITGIVHSHPDATTMPSDLDEAQCDFTELPWHIVSYPEGDFRTIYPRGELPLLGRPFVLGVYDCYGLIMSYYRQQCGVELNDYRVNYHWWEQGENLYIENFENAGFVEVTGDPQTGDVIIMQVQADVPNHAGVLLEGNLLLHHLYGQLSQKVPYGGYWKDRTVKTLRYNQLNK

SEQ ID NO: 7695 - protein, 120 aa, Xenorhabdus bovienii
  Peptide sequence Name=Xb4151_4152.C433.gene90.pep
MICGLLLSACKPTEKDFINIGESLVRDSLNDPDSAKFDSFYHSSDKIFTPIGRPSGELDGYVCGRVNTKNTYGGYTGGKPYYVHIETKDGKLKKHGPIVIVSDDDQNNLLNFRLVCPKGG

SEQ ID NO: 7696 - protein, 212 aa, Xenorhabdus bovienii
  Peptide sequence Name=Xb4151_4152.C433.gene91.pep
  Homolog annotation: Query=11..198bp; Hit=12..205bp; Blast score=165; Percent Identity=51.0; E value=5e-40; Homolog= gi|16122364|ref|NP _405677.1| putative phage tail assembly protein [Yersinia pestis] gi|22126076|ref|NP_669499.1| putative ph
MAYTDPPLRTIHLHGVLATKFGATFDYAVRDAPHAIRAMSRLVAGFEAFMIHAHQQGFTFSVIVGGRSYHKGELDMTKGNGDIHILPVITGSKRGGLFQTILGVALIAVAWWNPLGWAASTALFVGASGASMAMGGVSQMLAPQPPRLGMRESPDNKPSYAFGGAVNTIAQGNPVPLLYGSREIGGAIISAGVYTEDQYQTEQIENQRKHSR

SEQ ID NO: 7697 - protein, 346 aa, Xenorhabdus bovienii; identical to SEQ ID NO: 6355
  Peptide sequence Name=Xb4151_4152.C433.gene92.pep
  Gene classification: Function=Transposase; Function class=L DNA replication, recombination and repair
  Homolog annotation: Query=15..344bp; Hit=2..335bp; Blast score=241; Percent Identity=43.0; E value=7e-64; Homolog= PA2319 COG3547

SEQ ID NO: 7698 - protein, 68 aa, Xenorhabdus bovienii; identical to SEQ ID NO: 6354
  Peptide sequence Name=Xb4151_4152.C433.gene93.pep

SEQ ID NO: 7699 - protein, 38 aa, Xenorhabdus bovienii; identical to SEQ ID NO: 6606
  Peptide sequence Name=Xb4151_4152.C433.gene94.pep

SEQ ID NO: 7700 - protein, 86 aa, Xenorhabdus bovienii
  Peptide sequence Name=Xb4151_4152.C433.gene95.pep
VGTIDFLSHVTFFKESDTLSEVNSGESDYYAKYYKPEPINLFGIYLTIMEKEPIFVVLYDKEDKYIYAINLKMRVLKSGSYQSTEW

SEQ ID NO: 7701 - protein, 349 aa, Xenorhabdus bovienii; identical to SEQ ID NO: 5796
  Peptide sequence Name=Xb4151_4152.C433.gene96.pep
  Gene classification: Function=Predicted transposase; Function class=L DNA replication, recombination and repair
  Homolog annotation: Query=183..336bp; Hit=34..184bp; Blast score=70; Percent Identity=29.0; E value=3e-12; Homolog= BH2520 COG3335

SEQ ID NO: 7702 - protein, 39 aa, Xenorhabdus bovienii
  Peptide sequence Name=Xb4151_4152.C433.gene97.pep
MKNQASSMTTGIFIFLILNSFYPSIFLYLYLYLYLYLYL

SEQ ID NO: 7703 - protein, 40 aa, Xenorhabdus bovienii
  Peptide sequence Name=Xb4151_4152.C433.gene98.pep
MQLTMNIDAWFCDFIEVMKMKWRRGKKIPPVLKEMAVGTR

SEQ ID NO: 7704 - protein, 179 aa, Xenorhabdus bovienii
  Peptide sequence Name=Xb4151_4152.C433.gene99.pep
  Gene classification: Function=Uncharacterized BCR; Function class=S Function unknown
  Homolog annotation: Query=1..178bp; Hit=1..181bp; Blast score=207; Percent Identity=74.0; E value=5e-54; Homolog= yjgA COG3028
MVKQPEDWLDNYPAEEEDDEIIWVSKSEIKRDSEALKKLGMELVELSKNALERIPLDDDLLAAIELAQRIKREGRRRQLQLIGKMLRSRDPEPITIALDKLNNRHNQQVVLFHKLEELRDKLLEDSDGALAEVVALYPHLDRQQLRTMVRNAKKEKAANKPPKSYRQIFQYLKDLSESA

SEQ ID NO: 7705 - protein, 43 aa, Xenorhabdus bovienii
  Peptide sequence Name=Xb4151_4152.C433.gene100.pep
MPSGNQAIFPVTIHNIRMLTPTGRLVMFQNAPYPAFLEGKKLW

SEQ ID NO: 7706 - protein, 447 aa, Xenorhabdus bovienii
  Peptide sequence Name=Xb4151_4152.C433.gene101.pep
  Gene classification: Gene name=TldD; Function=Predicted Zn-dependent proteases and their inactivated homologs; Function class=R General function prediction only
  Homolog annotation: Query=8..447bp; Hit=11..450bp; Blast score=733; Percent Identity=82.0; E value=0; Homolog= pmbA COG0312
MIVTNQYIAEQRKQLEDAVSHALELAKTGSDAAEVAVNKTTGISVSTRFSEVENVEFNSDGALGITVYHQQRKGSASSTDLSPEAIARTVQAAIDIARYTSPDPYAGPADKDLLAFAAPDLDLFHPADLDTDIAIELAARAEQASLQADQRITNTEGGSFSSHYGIRIFGNSHGMLQSYCSSRHSLSSCVIAEQDGNMERDYAYTVSRRFDELQSPEWVGQECARRTLSRLGARKLPTMKAPVIFSAEVATGLFGHLVGAISGSSIYRKSSFLLDSLGKQILPSWLTIEEQPHLLRGLASTPFDSEGVRTAPRDIIKEGVLQTWLLTSYSARKLGMVNTGHAGGIHNWRIAGQGQDFAALLREMGTGLIVTELMGQGVSAVTGDYSRGASGFWVENGEIQYPVSEITIAGNLKDMWANMVTVGDDIETRSNIQCGSVLLPEMSIAGQ

SEQ ID NO: 7707 - protein, 31 aa, Xenorhabdus bovienii
  Peptide sequence Name=Xb4151_4152.C433.gene102.pep
VWFGIAAGNEYRRSIGILNQQQPVWILLDWL

SEQ ID NO: 7708 - protein, 136 aa, Xenorhabdus bovienii
  Peptide sequence Name=Xb4151_4152.C433.gene103.pep
  Gene classification: Gene name=GreA; Function=Transcription elongation factor; Function class=K Transcription
  Homolog annotation: Query=1..134bp; Hit=1..134bp; Blast score=166; Percent Identity=63.0; E value=6e-42; Homolog= rnk COG0782
MKKPKIIINELDAERLDLLLEQPAFANTHIAEALNSELDRAEIVPPVEIPPDVVTMNSEIRFIDLGSNEERVRTLVYPASLQDSTKHLSVMAPLGAALLGLRVNDEITWQLPNSEKTRIKVLEIIYQPEAAGEYHR

SEQ ID NO: 7709 - protein, 69 aa, Xenorhabdus bovienii
  Peptide sequence Name=Xb4151_4152.C433.gene104.pep
MWVLAKAGCSNSKSKRSASSSLIIIFGFFIPRSKLGSIQNNTPHHKEGGVIFKVIKLILGCSDVKIKRS

SEQ ID NO: 7710 - protein, 41 aa, Xenorhabdus bovienii
  Peptide sequence Name=Xb4151_4152.C433.gene105.pep
LLNSLPSGEKPTQGSPLQAHNPRLKMISGCSSILCGLALFH

SEQ ID NO: 7711 - protein, 410 aa, Xenorhabdus bovienii
  Peptide sequence Name=Xb4151_4152.C433.gene106.pep
  Gene classification: Gene name=Alr; Function=Alanine racemase; Function class=M Cell envelope biogenesis, outer membrane
  Homolog annotation: Query=1..407bp; Hit=22..427bp; Blast score=376; Percent Identity=45.0; E value=1e-104; Homolog= VC1312 COG0787
MRFNKTTLAFLLGVTLCQGTAQAAPTLSLDNTQAEHVAATNNAWVEINTTTFENNIHTLQSKLTKDTKVCVVLKGDAYGHGIDLLMPSVIKTGMPCVGITSNEEARIVRESGFKGQLMRIRAAAVTEIESTLGYDMEEMVGDLEHAKTIDALAKKHGKAIRVHLVLNTGRMSRNGLEMKTEQGKQEALKIAQLPNLKLVGMMSHYALKDLDAIREGVNDFKEQTAWLIKTANLKRNEIILHASSSYASIRVPEAQFDMVRVGSALYGILNPEYPEFKPLIQVKTRVASVKPYPKGNGVSYDNTYILKRDSKLANLPIGFSDGFSSSLSNKAFVLINGHRAPVVGLVSMNTVMVDVTDLPDVKSGDEVVIFGKQGKEEITQSDIQKWGGMHIVEFSSIWGETNPRITITGA

SEQ ID NO: 7712 - protein, 43 aa, Xenorhabdus bovienii
  Peptide sequence Name=Xb4151_4152.C433.gene107.pep
MKLINKKFIITGYLHTDHFFSSNIKPEITSCVLIKLHWHFFLA

SEQ ID NO: 7713 - protein, 90 aa, Xenorhabdus bovienii
  Peptide sequence Name=Xb4151_4152.C433.gene108.pep
  Gene classification: Gene name=FruB; Function=Phosphotransferase system, HPr-related proteins; Function class=G Carbohydrate transport and metabolism
  Homolog annotation: Query=1..90bp; Hit=1..90bp; Blast score=105; Percent Identity=64.0; E value=8e-24; Homolog= ptsO COG1925
MTVKKQLEIKNRLGMHARPAMKLHDLVQQFQSQVILRNSSNIQAEAHSVIAMLMLDSEQGSYIEVEATGSDEQQALAAIIELFNAGFDEE

SEQ ID NO: 7714 - protein, 283 aa, Xenorhabdus bovienii
  Peptide sequence Name=Xb4151_4152.C433.gene109.pep
  Gene classification: Function=Predicted P-loop-containing kinase; Function class=R General function prediction only
  Homolog annotation: Query=1..283bp; Hit=1..283bp; Blast score=531; Percent Identity=95.0; E value=1e-151; Homolog= yhbJ COG1660
MVLMIVSGRSGSGKSVALRALEDMGFYCVDNLPVVLLPELAGTLAERGISAAVSIDVRNMPESPEIFEEALTKLPDTFSPQLLFLDADRNTLIRRYSDTRRLHPLSSKNLSLESAIDQESDLLEPLRSRADLIIDTSEMSVHELAEMLRTRLLGKRERELTMVFESFGFKHGIPIDADYVFDVRFLPNPHWDPKLRPMTGLDRPVAAFLDRHTEVHNFIYQTRSYLELWLPMLETNNRSYLTVAIGCTGGKHRSVYVAEQLADYFRSRGKNVQSRHRTLEKRK

SEQ ID NO: 7715 - protein, 155 aa, Xenorhabdus bovienii
  Peptide sequence Name=Xb4151_4152.C433.gene110.pep
  Gene classification: Gene name=PtsN; Function=Phosphotransferase system mannitol/fructose-specific IIA domain (Ntr-type); Function class=G Carbohydrate transport and metabolism
  Homolog annotation: Query=2..155bp; Hit=3..155bp; Blast score=228; Percent Identity=75.0; E value=2e-60; Homolog= ZptsN COG1762
MNNETDLPLSSVLSPECTRNNVPCSSKKRALEIISELASKQLGLPENAVFEAILSREKVGTTGIGNGIAIPHGKLDKECSHNAVGVFLNLEQPIAFDAIDNQPVDLLFALLVPSDQCQTHLHSLSLIAKRLADKNLCRRLRSAQSDEELYKIITE

SEQ ID NO: 7716 - protein, 30 aa, Xenorhabdus bovienii
  Peptide sequence Name=Xb4151_4152.C433.gene111.pep
MPDWRHPVLMHCLYLSPESIGYVSRTVMSL

SEQ ID NO: 7717 - protein, 95 aa, Xenorhabdus bovienii
  Peptide sequence Name=Xb4151_4152.C433.gene112.pep
  Gene classification: Function=Ribosome-associated protein Y (PSrp-1); Function class=J Translation, ribosomal structure and biogenesis
  Homolog annotation: Query=1..95bp; Hit=1..95bp; Blast score=119; Percent Identity=66.0; E value=5e-28; Homolog= yhbH COG1544
MQLNVTGHNIEITDALRNIVNTKYGKLDQYFDKINLIQVILRVEKVQKIAEATVYVNGGELHASSEHEDMYAAIDALADKLARQLTKHKSKLRQH

SEQ ID NO: 7718 - protein, 479 aa, Xenorhabdus bovienii
  Peptide sequence Name=Xb4151_4152.C433.gene113.pep
  Gene classification: Gene name=RpoN; Function=DNA-directed RNA polymerase specialized sigma subunits, sigma54 homologs; Function class=K Transcription
  Homolog annotation: Query=1..479bp; Hit=1..477bp; Blast score=679; Percent Identity=74.0; E value=0; Homolog= ZrpoN COG1508
MKQSLQLRLSQQLAMTPQLQQAIRLLQLSTLELQQEIQQALEANPLLEQDDPHEEIDSQESPDAVTEVMDTREALEQKNIPEELPLDASWDEIYTAGTPSGTNSDYSAEDFPVYQGETTQTLQDYLMWQAGLTPFTETDSAIATSIIDAIDDSGYLTVSIEEILASIGDNELTLEEVEIVLKRIQHFDPIGIAARDLRECLLIQLSMLPTKTPYLNEAKLVVSKYLELLGNRDFRNVLRQSKLKENALKEAIDIIQSLEPKPGLVVNAGESEYVIPDVLAHKENESWQVKLNTDSIPRLRINQHYAALGQQAHSESDSLFIRNNLQEAKWLIKSLESRNDTLLKVASCIVERQQDFFEYGAEHMKPLVLADIAYQVEMHESTISRVTTQKYLYSPRGIFELKYFFSSHVNTDSGGEASSTAIRALVKKLVAAENPAKPLSDSKLTSILAEQGIQVARRTVAKYRESLSIPPSNQRKKLV

SEQ ID NO: 7719 - protein, 35 aa, Xenorhabdus bovienii
  Peptide sequence Name=Xb4151_4152.C433.gene114.pep
MSRSNAFIWVRVSVFNPDSVRRHSGEIPEKFRRKW

SEQ ID NO: 7720 - protein, 241 aa, Xenorhabdus bovienii
  Peptide sequence Name=Xb4151_4152.C433.gene115.pep
  Gene classification: Function=ABC-type (unclassified) transport system, ATPase component; Function class=R General function prediction only
  Homolog annotation: Query=1..241bp; Hit=1..241bp; Blast score=388; Percent Identity=85.0; E value=1e-108; Homolog= yhbG COG1137
MAILNAENLAKAYKGRRVVEDVSLTVKSGEIVGLLGPNGAGKTTTFYMVVGIVPRDTGTITIDDEDISLLPLHERARRGIGYLPQEPSIFRRLSVFDNLMAVLEIRKDITQEQRKERAEELMEEFHISHLRDNLGQSLSGGERRRVEIARALAANPKFILLDEPFAGVDPISVLDIKKIIQHLRDYGLGVLITDHNVRETLDVCERAYIVSQGQLIAHGSPEDILNNEQVKRVYLGEGFRL

SEQ ID NO: 7721 - protein, 181 aa, Xenorhabdus bovienii
  Peptide sequence Name=Xb4151_4152.C433.gene116.pep
  Gene classification: Function=Uncharacterized BCR; Function class=S Function unknown
  Homolog annotation: Query=1..181bp; Hit=1..177bp; Blast score=216; Percent Identity=63.0; E value=8e-57; Homolog= yhbN COG1934
MRSQMNNLIRNTVIASTLFAVSLPVLALKEDTKQPITLNSDRQSLDLTGNVATFTDNVSVKQGSIDIHADKVVVTRPEGDAKKTVIEAYGNPATFYQLQDDGKPIKGHASKMRYEMDKELMTLTGNAYLEQLDSNIKGDKITYLVPTQQMEAFSDKGKRVTTVLLPSQLQEKGISVNNKSK

SEQ ID NO: 7722 - protein, 232 aa, Xenorhabdus bovienii
  Peptide sequence Name=Xb4151_4152.C433.gene117.pep
  Gene classification: Function=Uncharacterized BCR; Function class=S Function unknown
  Homolog annotation: Query=38..232bp; Hit=1..191bp; Blast score=192; Percent Identity=50.0; E value=2e-49; Homolog= yrbK COG3117
LQVAVVQSGSFVIWYFSLRISWKVPKGYQYKTKIEKRMSRIQSWLIGTLALIALALIGWNLSNLNENASSPIVDDGYPTYQTQEATSFVYDPEGKLAYKLVADDVQNYTESKLTWFTKPILTTFASNSTSETPTWTVRANKAKLTNDKMLYLYGDVQLDSLTDASQLQRITTENATVNLVSQDILSDDQVTLIGVGLKSVGMKMRGNLRNKTAELIEKVTTHYEIPNEQPNP

SEQ ID NO: 7723 - protein, 187 aa, Xenorhabdus bovienii
  Peptide sequence Name=Xb4151_4152.C433.gene118.pep
  Gene classification: Function=Uncharacterized proteins of HAD superfamily, CMP-Neu5Ac homologs; Function class=R General function prediction only
  Homolog annotation: Query=7..187bp; Hit=8..188bp; Blast score=281; Percent Identity=76.0; E value=4e-76; Homolog= yrbI COG1778
MSQKTYLDTCYGPVNEEIIERASKIRLLICDVDGVMSDGLIYMGNQGEELKAFNVRDGYGIRCLITSGIEVAIITGRKAKLLEDRAETLGITHLYQGQSDKVLAYQELLDKLTLQPEQVAYIGDDLIDWPVMAQVGLSVAVSDAHPLLLPRADYVTQIAGGRGAVRELCDLVLFAQNKLEGAKGLSI

SEQ ID NO: 7724 - protein, 328 aa, Xenorhabdus bovienii
  Peptide sequence Name=Xb4151_4152.C433.gene119.pep
  Gene classification: Gene name=GutQ; Function=Predicted sugar phosphate isomerase involved in capsule formation; Function class=M Cell envelope biogenesis, outer membrane
  Homolog annotation: Query=11..210bp; Hit=11..210bp; Blast score=320; Percent Identity=77.0; E value=2e-87; Homolog= yrbH_1 COG0794
MTWEVEMSKIDFQQSGKKVLQVELDGLAELEQYINEDFSRACELMFGCEGKIIVMGMGKSGHIGRKIAATFASTGTPSFFVHPGEASHGDLGMVTSKDIVLTISNSGESNEIVALIPVLKRQKVPLICMTNNPNSSMGKAADIHLCIKTPQEACPLGLAPTTSTTATLVMGDALAVALLQARGFTAEDFALSHPGGTLGRKLLLLTSDLMTIGDDIPRVPYTATLREALVEITRKKLGMTVICDDDMQIKGIFTDGDLRRVFDMGIDLNHANISDVMTIGGVRIKPHTLAVDALNLMQSRHITSLLVTDGDKLLGVLHMHDLLQAGVV

SEQ ID NO: 7725 - protein, 325 aa, Xenorhabdus bovienii
  Peptide sequence Name=Xb4151_4152.C433.gene120.pep
  Gene classification: Gene name=CM27; Function=Ca2+/Na+ antiporter; Function class=P Inorganic ion transport and metabolism
  Homolog annotation: Query=5..319bp; Hit=19..331bp; Blast score=259; Percent Identity=49.0; E value=2e-69; Homolog= VC2522 COG0530
MFLTIALFITGLILLVYGSDRLVYGAAVFARSLKIPPYIVGLTVMGIGTSLPELMVSITAAQDGLPNIAVGNAIGSNITNLLLITGAASLIRPITVKSDILRRELPLMLLITAFVGYILADSYLNRLDGIVLLLTALFFIVIMIKMTTVSQDDGLDSYMQERDAELPVEGNKGIALLWVVLGLIILPISTRMVIDNAAVIARIYSISELIIGLTILAVGTSLPELATSIAAAIKGENDMAMGNIIGSNVFNITLVLGIPGILSPGVISPQAFSRDFWVMMAASVLFTIFCLGRKHRLNRLNGILLLGCFIAYFFVLFVSNYYGTD

SEQ ID NO: 7726 - protein, 267 aa, Xenorhabdus bovienii
  Peptide sequence Name=Xb4151_4152.C433.gene121.pep
  Gene classification: Function=ABC-type exporter of toluene and related compounds, ATPase component; Function class=N Cell motility and secretion
  Homolog annotation: Query=1..266bp; Hit=1..266bp; Blast score=392; Percent Identity=78.0; E value=1e-109; Homolog= yrbF COG1127
MSQQTANLIEICGMYFTRGQRPIFSDINLTVPKGKVTAIMGPSGIGKTTLLRLIGGQIRPERGEIWFDGDNIPALSRQRLYAARKKMSMLFQSGALFTDLNVFDNVAFPLREHTQLPEALIHTTVMMKLEAVGLRGAAHLMPSELSGGMARRAALARAIALDPDLIMFDEPFVGQDPITMGILVKLIDELNHALGVTCVVVSHDVPEVLSIADYAYIVAEKTVIAEGTPEQLRMNQDHRVRQFLDGIADGPVPFRFPAGDYKTELLG

SEQ ID NO: 7727 - protein, 262 aa, Xenorhabdus bovienii
  Peptide sequence Name=Xb4151_4152.C433.gene122.pep
  Gene classification: Function=ABC-type toluene export system, permease component; Function class=R General function prediction only
  Homolog annotation: Query=3..262bp; Hit=1..260bp; Blast score=348; Percent Identity=78.0; E value=4e-96; Homolog= yrbE COG0767
MLMLTRALAALGKRAIEVAASFGRAGFMLFSAIIGKPELAKQWKLLCQQLYSVGVQSLLIIVVSGLFIGMVLSLQGYLVLTTFSAEGSLGMMVALSLLRELGPVVTALLFAGRAGSALTAEIGLMKATEQISSLEMMAIDPLRRVIAPRFWAGFISMPLLSLIFVAVGIIGGAIVGVDWKGIDAGFFWSSMQSAVDWQKDLLNCFLKSVAFAITVTWIALFNGYDAIPTSEGISRATTRTVVHASLAVLGLDFVLTALMFGN

SEQ ID NO: 7728 - protein, 168 aa, Xenorhabdus bovienii
  Peptide sequence Name=Xb4151_4152.C433.gene123.pep
  Gene classification: Function=Permease component of an ABC -transporter; Function class=R General function prediction only
  Homolog annotation: Query=1..167bp; Hit=1..167bp; Blast score=208; Percent Identity=65.0; E value=2e-54; Homolog= yrbD COG1463
MQNKKNEIWVGCFVLIALAAIVFLCLKVADVRSFGSQTTYRVSAAFDNIGGLKVRSPVKIGGVVIGRVERIWLDHKTYTPQVELELFTQYDNIPSTSSLSIRTSGLLGEQYVAMNVGFYDPDMGVSMLKGGDRIEDTKSAMVLEDLIGQFLYKSGDSGQAKSDSAPAH

SEQ ID NO: 7729 - protein, 209 aa, Xenorhabdus bovienii
  Peptide sequence Name=Xb4151_4152.C433.gene124.pep
  Gene classification: Function=ABC-type exporter of toluene and related compounds, periplasmic component; Function class=N Cell motility and secretion
  Homolog annotation: Query=1..209bp; Hit=1..211bp; Blast score=301; Percent Identity=77.0; E value=4e-82; Homolog= yrbC COG2854
MFKRLLMVALLVVAPLASAVDQTNPYALMKDAAEKTFTRLKNDQPQIQANPEVLRQIVREELLPYVQVKYAGALVLGTYYGQATPEQREAYFKAFESYLEQAYGQALAMYHGQNYQIAPEQPLEGKTIVAIRVTITDENGQPPVRLDFQWRKNSKTGYWQAYDMIAEGVSMITTKQNEWADILRQKGIDALTEQLKISAKTPITLEKKK

SEQ ID NO: 7730 - protein, 111 aa, Xenorhabdus bovienii
  Peptide sequence Name=Xb4151_4152.C433.gene125.pep
  Gene classification: Function=STAS domain protein; Function class=R General function prediction only
  Homolog annotation: Query=2..100bp; Hit=24..122bp; Blast score=67; Percent Identity=40.0; E value=3e-12; Homolog= yrbB COG3113
MENREISQSSDDGKISWEQTGSTLFLHGTLDRDSLLPLWQQKGSVMAEIENIDVSRLEHVDSTGLALFVHLKGDMQQRGKRLTFSGISERLETLIALYGLQSLIAADTPDM

SEQ ID NO: 7731 - protein, 49 aa, Xenorhabdus bovienii
  Peptide sequence Name=Xb4151_4152.C433.gene126.pep
METRRLLNQEKRPCKRMTYKGDNYGKRELHIWRVSSNETLQAIKCYQCL

SEQ ID NO: 7732 - protein, 84 aa, Xenorhabdus bovienii
  Peptide sequence Name=Xb4151_4152.C433.gene127.pep
  Gene classification: Gene name=BolA; Function=Stress-induced morphogen (activity unknown); Function class=T Signal transduction mechanisms
  Homolog annotation: Query=1..84bp; Hit=6..89bp; Blast score=134; Percent Identity=77.0; E value=2e-32; Homolog= yrbA COG0271
MDTDEIKEVLMKALALDDVIVSGDGSHFQVIAVGELFDDLSRVKQQQAVYAPLMEYIADNRIHAVSIKTYTPAKWQRDRKLQGF

SEQ ID NO: 7733 - protein, 422 aa, Xenorhabdus bovienii
  Peptide sequence Name=Xb4151_4152.C433.gene128.pep
  Gene classification: Gene name=MurA; Function=UDP-N-acetylglucosamine enolpyruvyl transferase; Function class=M Cell envelope biogenesis, outer membrane
  Homolog annotation: Query=3..419bp; Hit=1..417bp; Blast score=716; Percent Identity=87.0; E value=0; Homolog= ZmurA COG0766
MKMDKFRVKGPTCLSGEVTISGAKNAALPILFAALLAEEPVELQNVPELKDIDTTIKLLNRLGTKVKRNGSVFVDASNVNEYCAPYELVKTMRASIWALGPLVARFGQGQVSLPGGCAIGARPVDLHISGLEQLGAKIVLSEGYVKASVDGRLKGASIVMDKVSVGATVTIMTAATLAEGTTIIENAAREPEIEDTADFLNTLGAKITGAGTDRIVIEGVERLGGGVYRVLPDRIETGTFLVAGAISRGKVICRNTKPNTLDAVLSKLREAGADIQVGDDWISLDMHGKRPKAVTFRTAPHPGFPTDMQAQFSLLNMVAEGVGMITETIFENRFMHIPELIRMGARAEIESNTVVCHGVENLSGAQVMATDLRASASLVLAGCIAEGTTVVDRIYHIDRGYEHIEDKLRGLGANIERIKSTD

SEQ ID NO: 7734 - protein, 49 aa, Xenorhabdus bovienii
  Peptide sequence Name=Xb4151_4152.C433.gene129.pep
VRISSVLSRLIKLNSYHPSPSLGEGLNKRKAAELSAILFILQAAADVKY

SEQ ID NO: 7735 - protein, 352 aa, Xenorhabdus bovienii
  Peptide sequence Name=Xb4151_4152.C433.gene130.pep
  Gene classification: Gene name=DegQ; Function=Trypsin-like serine proteases, typically periplasmic, contain C-terminal PDZ domain; Function class=O Posttranslational modification, protein turnover, chaperones
  Homolog annotation: Query=1..350bp; Hit=1..351bp; Blast score=407; Percent Identity=62.0; E value=1e-114; Homolog= degS COG0265
MLIKLLRSISIGLLIAAILLVTIPSLRPNGLKHLLSDSSRNDKPYSFNQGVRRAAPAVVNIYSSNLGSFSHEGRELLPLGSGVIMNEQGYILTNKHVINEADSIIVALQDGRFYEALLAGSDAPTDLAVLKVNGKNLPVIPINPNRVAHVGDIVLAIGNPYNLGQTITQGIISATGRVSLSPTRRQNFLQTDASINQGSSGGALVNTLGELVGINTLTFDKSEFGVTPEGLGFAIPTELATKIMHKLIRDGRVIRGYIGITVQDLPRIRSSDSNINQMPGLRVFEVAPRSPAQKVGIKVGDIITNFNHQPAISPTETMDQVTDIRPGSMVPITVLRDGQSLTFKVMVEEFDG

SEQ ID NO: 7736 - protein, 32 aa, Xenorhabdus bovienii
  Peptide sequence Name=Xb4151_4152.C433.gene131.pep
VTIISTCYCVINQLNIKTRSSITNRHSISCVC

SEQ ID NO: 7737 - protein, 485 aa, Xenorhabdus bovienii
  Peptide sequence Name=Xb4151_4152.C433.gene132.pep
  Gene classification: Gene name=DegQ; Function=Trypsin-like serine proteases, typically periplasmic, contain C-terminal PDZ domain; Function class=O Posttranslational modification, protein turnover, chaperones
  Homolog annotation: Query=26..484bp; Hit=1..455bp; Blast score=532; Percent Identity=63.0; E value=1e-151; Homolog= degQ COG0265
MKFPDRIGLLSTISLSGLGIKRTYSMKRKNTLLSALAISIGLSLASAPMVGNAALPAAVASQELPSLAPMLEKVLPSVVTVHVSGTEVQNQQQLQLPEDFQFFFGPGFPPQEQRSRPFKGLGSGVIINANKGYVLTNNHVIEKANKIRVQLNDGREYSAKLIGRDPQTDIALLQLQDAKNLTAIKFADSDQLRVGDYSVAIGNPFGLGQTVTSGIISALGRSGLNLEGLENFIQTDASINRGNSGGALINLKGELIGINTAILAPGGGNIGIGFAIPSNMASNLADQLIAHGEVKRGLLGIKGTEMTADVAKALNVDTQQGAFVSEVIPKSAAAKADIKPGDVLVSVDGKKITSFAELRAKVGTTAPGKAIKIGLLRKGRPMEVIVTLENNVAQETKAENLSVALQGAILSNSTVKNTQGVKVDKITQNSPAAMSGLQNDDFIVGANNERIRNINELRKLLEAKPPVIALNILRGDDNIYLLLRN

SEQ ID NO: 7738 - protein, 43 aa, Xenorhabdus bovienii
  Peptide sequence Name=Xb4151_4152.C433.gene133.pep
LGITLIGIGFKHNCFDAVMTLNYSAKFTNNVVLPCFFTGIYVN

SEQ ID NO: 7739 - protein, 154 aa, Xenorhabdus bovienii
  Peptide sequence Name=Xb4151_4152.C433.gene134.pep
  Gene classification: Function=Uncharacterized BCR; Function class=S Function unknown
  Homolog annotation: Query=21..147bp; Hit=3..128bp; Blast score=155; Percent Identity=67.0; E value=1e-38; Homolog= yhcB COG3105
MVLRHSGTLLPNTEVNKGVAMTWEYALIGLIIGFIVGALAVRFGSSRLRQQNAAQAELEKNRAELEEYRKELVSHFAHSAELLDNMARDYRQLYQHMAKSSNELMPNMPIQDNPFNYRLTESEVGKSKITSSMPPRDYSEGASGLFRPIQDKKQ

SEQ ID NO: 7740 - protein, 43 aa, Xenorhabdus bovienii
  Peptide sequence Name=Xb4151_4152.C433.gene135.pep
MPLDVSILYKFAMIRRELLAELREDMEKSMKDGNKYNELRQKR

SEQ ID NO: 7741 - protein, 375 aa, Xenorhabdus bovienii
  Peptide sequence Name=Xb4151_4152.C433.gene136.pep
  Gene classification: Function=Predicted ATPase; Function class=R General function prediction only
  Homolog annotation: Query=1..374bp; Hit=1..373bp; Blast score=498; Percent Identity=65.0; E value=1e-141; Homolog= yhcM COG1485
MSPIIPSSLYQSALSEGQYQPDEVQRNTVARLDIIHHDLGHRSPEQALPSSGLKSLLGRLFGGLSTEQPRPIQGLYMWGGVGRGKTWLMDMFFQSLPTDRKLRLHFHRFMLRVHEELTALQGHENPLDVIADGFKAQTDVLCFDEFFVSDITDAMILGTLLEALFKRGITLVATSNIPPDELYRNGLQRARFLPAIEQIKKYCDVMNVDAGIDYRLRTLTQAHLYLTPLSEDNRQEMHRMFQRLAGRKGEPNPVLEINHRSMPAISSVDGVLAITFKTLCEDPRSPLDYIALSKLYHSVLLHDTPAMTALDESAARRFLALVDEFYERHVKLIINAEAPMEQIYQGELLTFEYRRCLSRLQEMQSEEYLKLPHLP

SEQ ID NO: 7742 - protein, 57 aa, Xenorhabdus bovienii
  Peptide sequence Name=Xb4151_4152.C433.gene137.pep
LPSASTTYQSRFTVSGLAVKVFIKAYPIISYTLVNTRCSETVFEVHTTFVQQTYPFE

SEQ ID NO: 7743 - protein, 142 aa, Xenorhabdus bovienii
  Peptide sequence Name=Xb4151_4152.C433.gene138.pep
  Gene classification: Gene name=RplM; Function=Ribosomal protein L13; Function class=J Translation, ribosomal structure and biogenesis
  Homolog annotation: Query=1..142bp; Hit=1..142bp; Blast score=258; Percent Identity=92.0; E value=2e-69; Homolog= rplM COG0102
MKTFTAKPETVKRDWYVVDADGKTLGRLATEIASRLRGKHKAEYTPHVDTGDYIIIVNAEKVAVTGNKRADKIYYHHTGHIGGIKQATFEEMIARRPERVIEIAVKGMLPKGPLGRAMYRKLKVYAGSEHNHAAQQPQVLDI

SEQ ID NO: 7744 - protein, 130 aa, Xenorhabdus bovienii
  Peptide sequence Name=Xb4151_4152.C433.gene139.pep
  Gene classification: Gene name=RpsI; Function=Ribosomal protein S9; Function class=J Translation, ribosomal structure and biogenesis
  Homolog annotation: Query=1..130bp; Hit=1..130bp; Blast score=199; Percent Identity=92.0; E value=6e-52; Homolog= rpsI COG0103
MAENQYYGTGRRKSSSARVFIKPGSGNIVINQRSLEVYFGRETARMVVRQPLELVDMLGKLDLYITVKGGGISGQAGAIRHGITRALMAYDETLRSDLRKAGFVTRDAREVERKKVGLRKARRRPQFSKR

SEQ ID NO: 7745 - protein, 86 aa, Xenorhabdus bovienii
  Peptide sequence Name=Xb4151_4152.C433.gene140.pep
MTRLCVLIFAKLASLLAMLVKLNVKKWVCAKHVVVHSSPNVNLLPRLWRWVKVETRHLYGGFFYHLIFLSLVNSLFSQKIAYYRNK

SEQ ID NO: 7746 - protein, 92 aa, Xenorhabdus bovienii
  Peptide sequence Name=Xb4151_4152.C433.gene141.pep
MAKNVGRAGKQSHYRTFVGSDSHENLQVYLNKGTNSPSVKNGYSRSYSHPVSHLLSEGILKPLPNQAHSWIRQKIITSLPDFAHFVGKYIEN

SEQ ID NO: 7747 - protein, 213 aa, Xenorhabdus bovienii
  Peptide sequence Name=Xb4151_4152.C433.gene142.pep
  Gene classification: Gene name=Gst; Function=Glutathione-S -transferases; Function class=O Posttranslational modification, protein turnover, chaperones
  Homolog annotation: Query=1..209bp; Hit=1..209bp; Blast score=330; Percent Identity=80.0; E value=5e-91; Homolog= sspA COG0625
MAVAANKRSVMTLFSGSTDIFSHQVRIVLAEKGVSVEIEHVEAGNLPQDLIDLNPYQTVPTLVDRELTLYDSRIIMEYLDERFPHPPLMPVYPVARGSSRLMMHRIEKNWYSLMYKIQGGNTQEANAARKQLAEELLAMAPVFRDMPFFMSEEFSLVDCYLSPLLWRLPVLGVELSGPGAKDIQIYMQRVFERDAFLASLTEAEREMRLPSRS

SEQ ID NO: 7748 - protein, 160 aa, Xenorhabdus bovienii
  Peptide sequence Name=Xb4151_4152.C433.gene143.pep
  Gene classification: Gene name=SspB; Function=Stringent starvation protein B; Function class=R General function prediction only
  Homolog annotation: Query=1..131bp; Hit=1..131bp; Blast score=186; Percent Identity=70.0; E value=8e-48; Homolog= sspB COG2969
MEMIQMSPRRPYLLRAHYEWLLDNEMTPHLVVDVTLYGVNVPMEYANDGQIILNISPRAVGNLELTNDEVRFNARFGGVARQVSVPMAAVIAVYGRENGAGMMFEPESAYQAGSTPEDSDVPVADNLVLISDAKIARDNDSSDDEPPQPPKGRPTLRVVK

SEQ ID NO: 7749 - protein, 166 aa, Xenorhabdus bovienii
  Peptide sequence Name=Xb4151_4152.C433.gene144.pep
  Homolog annotation: Query=1..164bp; Hit=1..162bp; Blast score=115; Percent Identity=39.0; E value=2e-25; Homolog= Pa|Phot3-190d09.p1k _g9| 7619 - 8125 277 168 aa, chain -
MRLLTQIFLFSFISLIMSSPSIAHLSTQAEILQQVRERGVNAVVAELGESGKRDEVAYNITTGESQWLRVAFTLSPNMHSEFSKQLLRSLSFALINNPVEVLSLSKKYNSFSSDQICDIPSTLKGLGERTSFIEKLSNSLNAAKKSNSGKNKENIENCLWRLDQTL

SEQ ID NO: 7750 - protein, 39 aa, Xenorhabdus bovienii
  Peptide sequence Name=Xb4151_4152.C433.gene145.pep
MKENKNICVSKRIYLFQSLSMNSYYLINYYLIFVWISFN

SEQ ID NO: 7751 - protein, 36 aa, Xenorhabdus bovienii
  Peptide sequence Name=Xb4151_4152.C433.gene146.pep
MRLLLYPKGKYSDLIYCVNTAKNLIPLIKEKTVFLV

SEQ ID NO: 7752 - protein, 65 aa, Xenorhabdus bovienii
  Peptide sequence Name=Xb4151_4152.C433.gene147.pep
LRKVERRHPVFSTISRFNPYSLFLQLLLRSFDRRKFQKFRDKFTFITFYSHISCIFLLYATTLIP

SEQ ID NO: 7753 - protein, 521 aa, Xenorhabdus bovienii
  Peptide sequence Name=Xb4151_4152.C433.gene148.pep
  Gene classification: Gene name=GltD; Function=NADPH-dependent glutamate synthase beta chain and related oxidoreductases; Function class=E Amino acid transport and metabolism
  Homolog annotation: Query=50..521bp; Hit=1..472bp; Blast score=801; Percent Identity=79.0; E value=0; Homolog= ZgltD COG0493
MAKAYWKAGHNGSINSRWLNLSPVMSVHCWDTAAVLPQNCGFKRSKELKMSQNVYQFIDLQRVDPPKKPLKIRKIEFVEIYEPFSEMQVEAQADRCLSCGNPYCEWKCPVHNYIPNWLKLANEGRIIEAAELSHRTNSLPEVCGRVCPQDRLCEGACTLNDDFGAVTIGNIERYINDTAIAMGWKPDMSDVIPTGKRVAVIGAGPAGLACADVLTRNGVQAVVYDRHPEIGGLLTFGIPAFKLEKDVMIRRREIFSDMGIEFRLNTEIGKDITLAELTEQFDAVFLGVGTYQSIHGGLENEGADGVYDALPFLIANTRHLMGYPALPEQPYVDMKGQRVLVLGGGDTAMDCLRTSVRQGATHVICAYRRDEGNMPGSRREVKNAKEEGVDFQFNLQPLSIEINSAGQVCGVKVAKTQLGEMDEKGRRRAEIIQGSEFRIETDAVITAFGFKPHNLHWLNAHQINLDQQGRIVAPEASNLPFQTSNPKIFAGGDAVRGSDLVVTAIAEGRKAASGILDYLEV

SEQ ID NO: 7754 - protein, 1485 aa, Xenorhabdus bovienii
  Peptide sequence Name=Xb4151_4152.C433.gene149.pep
  Gene classification: Gene name=GltB; Function=Glutamate synthase domain 2; Function class=E Amino acid transport and metabolism
  Homolog annotation: Query=378..1169bp; Hit=1..792bp; Blast score =1342; Percent Identity=82.0; E value=0; Homolog= ZgltB_2 COG0069
MLYDKSQEKDNCGFGLIAHIEGEQSHKVVRTAIHALARMQHRGAILADGKTGDGCGLLMQKPDRFFQMIASDQSWRLAKNYAVGMLFLSQDAKIAQSCRDIVEQELQNETLSIVGWREVPINRDILGGIALSSLPRIEQIFINAPAGWRPQDLERRLFIARRRIEKRITNDDFYVCSLSNLVTIYKGLCMAADLPRFYLDLADLRMESSICLFHQRFSTNTVPRWPLAQPFRYLAHNGEINTITGNREWARARAYKFRTPLIPDLQTAAPFINETGSDSSSLDNMLELFLNGGMDLIRAMRLLVPPAWQNNPDMDDDLRAFFDFNSMHMEPWDGPAGIVISDGRYAACNLDRNGLRPARYVITKDKLITCASEVGIWDYQPDEVVEKGRVGPGELMVIDTYEGRILHSAETDNDLKIRHPYKEWLDKNVKQLTPFEKLPEDQIGQRDLDDRMLATYHKQFAYSNEELDQIIRVLGENGQEATGSMGDDTPFAVLSSRPRVIYDYFRQQFAQVTNPPIDPLREAHVMSLATRIGREMNVFCEAEGQAHRLSFESPVLLYSDFVQLTTQQEPYYHAEILDLTFNPQESSLKSAVTTLCKQAEELIRNGAVLLVLSDRNISPEKLPIPAPMAVGAIQHCLVEKSLRCDANLIVETASARDPHHFAVLLGFGATAVYPYLAYESLGKMVDDGTINTPYIRVMLNYRNGINKGLYKIMSKMGISTISSYRCSKLFEAVGLHSDVTDLCFNGVVSRIEGADFNDFEQDLRNLSKRAWLHRHTLELGGLLKYAYDGEYHAYNPDVINTLQAAVHSGKYSDYQKYSQLVNGRPATTLRDLLAISSKAEPIAIEEVQPAESLFKRFDTAAMSIGALSPEAHEALAEAMNTLGGFSNSGEGGEDPARYGTKKVSRIKQVASGRFGVTPAYLSSADVIQIKVAQGAKPGEGGQLPGDKVTPYIARLRYSVPGVTLISPPPHHDIYSIEDLAQLIFDLKQVNPKALISVKLVSEPGVGTIATGVAKAYADLITIAGYDGGTGASPLSSVKYAGCPWELGLVETQQALVANGLRHKVRLQVDGGLKTGVDIIKAAILGAESFGFGTGPMVALGCKYLRICHLNNCATGVATQDEKLRKSHYHGLPERVINYFRFIAQETRELMAQLGIRELTDLIGRTDLLQILEGISAKQSKLNLEPLLETAQPHEGKDLHCTEDNPSFDQGILNKNIIKQAMPYVKNSQSKKLYFDIQNTDRSVGASLSGEIAALHGDQGLAADPIKLHFTGTAGQSFGVWNAGGVELTLTGDANDYVGKGMAGGQIVIRPPVGSAFRSNEATIIGNTCLYGATGGKLFAAGNAGERFAVRNSGAITVIEGIGDNGCEYMTGGIVCVLGNTGVNFGAGMTGGFAYVLDEFDDFRKRVNPELVEVLSIDTLAIHKEHLRGLITEHVRLTGSQHGESILESWSQWVNKFALVKPKSSDVSALLGHRSRSSAELRVQAQ

SEQ ID NO: 7755 - protein, 51 aa, Xenorhabdus bovienii
  Peptide sequence Name=Xb4151_4152.C433.gene150.pep
MLCHCIKTLHKYESENYPTGDFQWIPNLARKIEQVKSCQIAFFATKIIIFI

SEQ ID NO: 7756 - protein, 778 aa, Xenorhabdus bovienii
  Peptide sequence Name=Xb4151_4152.C433.gene151.pep
  Gene classification: Gene name=BaeS; Function=Signal transduction histidine kinase; Function class=T Signal transduction mechanisms
  Homolog annotation: Query=1..561bp; Hit=1..562bp; Blast score=803; Percent Identity=75.0; E value=0; Homolog= ZarcB_1 COG0642
MKRIRRFAQYYVDLMMKLGLVRFSLLLASVLIILAMVIQIAITLHWRGEVQRTDLIGSIFFGLLITPWAVYFLSIVVEQLEESRQRLSSLVAKLEEMRQRDAKLNLQLKENITQLNHEINDREKAEKTHLVLLDKLKSEMEHREKTQSALEQQSILLRSFLDASPDLVYYRNENNEFSGCNRAMELLTGKSEKQLIGLTPTEVYDKEVASKVMETDEKVFRHNVSLTYEQWLVYPDGRKACFELRKVPFYDRVGKRHGLMGFGRDITERKRYQDALENASRDKTTFISTISHELRTPLNGIVGLSRILMDTDLTPEQCNYLKTIHVSAITLGNIFNDIIELDKIERRKTQLDNQQIDFTGFMADLENLSGLLAQPKGIRFVLEPKLPLPAKILTDGTRLRQILWNLIGNAVKFTQKGEIRVRIWREEGERLLFEVTDSGIGIPSSELEKIFAMYYQVTDSAGGRPATGTGIGLAVSKRLAQSMGGDIVVESTVDQGSCFTLSIVAPAVDEKSEGQEESELPLPALNILLVEDIELNVIVARSVLEKLGNSVDVAMNGHDALMMFDPDEYDLVLLDIQLPDMTGLDIAHQLHQRYPSQSLPPLVALTANVLKDKREYLDVGMDDVLSKPLSVKELTAVMEKFWGKASEPEQTLQETKVVKKNEDLLDTELLNQYIDLVGPKMIADNLKIFETMMPSYLALLDSNMTARDQKGITEEAHKIKGAAGSVGLRHLQQLAQQIQSPDLPAWWDNVQEWVDELKLEWRSDTETLRNWLTDATKK

SEQ ID NO: 7757 - protein, 61 aa, Xenorhabdus bovienii
  Peptide sequence Name=Xb4151_4152.C433.gene152.pep
MNLVTKNLIFAMLVPVFSTEEFFNYSRRKQILDKRVDKFPWCWRSIRAPQLRLGLFFCSVS

SEQ ID NO: 7758 - protein, 217 aa, Xenorhabdus bovienii
  Peptide sequence Name=Xb4151_4152.C433.gene153.pep
  Gene classification: Gene name=ElbB; Function=Uncharacterized sigma cross-reacting protein 27A (ES1 or KNP-I alpha protein); Function class=S Function unknown
  Homolog annotation: Query=1..217bp; Hit=4..220bp; Blast score=266; Percent Identity=59.0; E value=9e-72; Homolog= yhbL COG3155
MKCVAVILSGCGVYDGSEIHESVLTMLSLSRLGAKVSFFSPDEVQHHVINHLNGKEEKETRHTMQESARITRGNIQPLSQVDINTLDALIIPGGFGVAKNLCNFAFKGSECEINKDLLSIVRSMHQQGKPMGFMCIAPVMVAKILGRPIKVTIGNDPETAAQIEAMGGIHIECPVDDIVIDFKNKIVTTPAYMLAESLSQAEQGIDKLVRKILEMIE

SEQ ID NO: 7759 - protein, 238 aa, Xenorhabdus bovienii
  Peptide sequence Name=Xb4151_4152.C433.gene154.pep
  Gene classification: Gene name=MrcA; Function=Membrane carboxypeptidase (penicillin-binding protein); Function class=M Cell envelope biogenesis, outer membrane
  Homolog annotation: Query=5..237bp; Hit=9..241bp; Blast score=282; Percent Identity=62.0; E value=2e-76; Homolog= mtgA COG0744
MKNPFSILWFWLKKIAVAITILWFVTVILFSFLPVPFSMVMAERQISALMSINLSYVSRSSWVDQNQISPYMTLAVIAAEDQNFPKHWGLDFEAIKTAMAHNKKFQKRIRGASTITQQTAKNLFLWEGRSWVRKGLEAGMAIVLELLWSKKRILTVYLNIAEFGHGIFGVEEAAWHYFGKSASRLTASEAALLAAVLPNPYRYKVDAPSAYLLQRQQWILQQMRQLGGESYLKQNKLR

SEQ ID NO: 7760 - protein, 191 aa, Xenorhabdus bovienii
  Peptide sequence Name=Xb4151_4152.C433.gene155.pep
  Gene classification: Gene name=OsmY; Function=Predicted periplasmic or secreted lipoprotein; Function class=R General function prediction only
  Homolog annotation: Query=1..190bp; Hit=1..190bp; Blast score=205; Percent Identity=64.0; E value=2e-53; Homolog= yraP COG2823
MRLFSLLIVFCSAMLLQGCIGAAVVGSAAIATKAGSDPRSIGQQVDDGTLEARVSNAISKDPQIKAQARIIVTVYQGRVLLTGQSPDLQLADRAKQLASKVEGTEVVYNEVRQGNPVDLGTASVDTWLTTKVRSKILASDSVKSSNIKVVTENGEVFLFGIVTRQEGADAAKITSETSGVKRVTTAFTYLN

SEQ ID NO: 7761 - protein, 165 aa, Xenorhabdus bovienii
  Peptide sequence Name=Xb4151_4152.C433.gene156.pep
  Gene classification: Gene name=GmhA; Function=Phosphoheptose isomerase; Function class=G Carbohydrate transport and metabolism
  Homolog annotation: Query=1..165bp; Hit=32..196bp; Blast score=285; Percent Identity=87.0; E value=2e-77; Homolog= yraO COG0279
MMMVQSLLNGNKILCCGNGGSAATAQRFAASMINRFETERPSLPALSLNADNVVITSIANSKQPDEIYAKQVRALGHAGDVLLAISTHGNSRDIIKAVEAAVTRDMTIVALTGYDGGELAGLLGPQDVEIRIPSHHSIRIQEVHMLTINCLCDLIDNTLFPHQDD

SEQ ID NO: 7762 - protein, 48 aa, Xenorhabdus bovienii
  Peptide sequence Name=Xb4151_4152.C433.gene157.pep
MPLLQLPRASAEKYCIQLLSGCINATSVWRRPRVALIFVQLQVRNLNG

SEQ ID NO: 7763 - protein, 172 aa, Xenorhabdus bovienii
  Peptide sequence Name=Xb4151_4152.C433.gene158.pep
LIQPDRSCMQYFSALALGNCSNGITICCVLAETNLDKYPCLFITHNQINFPTPNFHILRNKDKPLLLQKLFNLLLVMASLRIAIDAWFFHPEMTISVTYGINCTALLLSALLLTVLSTVASILLAALFSIMMRPLLNCIHARWRNIVQSFVTESSPDAPFIWNPVPCCSCVN

SEQ ID NO: 7764 - protein, 615 aa, Xenorhabdus bovienii
  Peptide sequence Name=Xb4151_4152.C433.gene159.pep
  Gene classification: Gene name=LppC; Function=Putative lipoprotein; Function class=R General function prediction only
  Homolog annotation: Query=68..584bp; Hit=139..675bp; Blast score=438; Percent Identity=46.0; E value=1e-123; Homolog= yraM COG3107
MTDLKLSIFEKNITGYSMLPSIFVRFKTGLVCTALLSTMIIAGCTTPEQQGQPPSKPQDKISAEINRYQSIIDAAHNQPSLDVIRAYIALETHTADDAAHQKNIDDTWQVLTHLSPQQLGELVINANEYTLQGWLDLLNAYHVNKQDLDKLRTAITDWRTRYPDNPAIRSLPTSLQQMLLKPKDSHAIIGLFLPLSGQAKVFGEAIRQGFLDAQKGLPQPTLPVNATVSAPEAGVAANTTETALSSSPVSAISNTIAAVPVNDQPVKVYDTNSQPLTNLLAQAEQDGITLVVGPLLKPSVEQLVQINTLLNILALNELDVSQSRPNICYFSLSPENEAQNAALHLWQQQKRNPLILVPRNELGNRITKAFAEEWQKLGGNVALQQTFGTLGEMKQSINRGIGIRLSGTPIPVSAYLPDAGESPLKTNGAVIATSAPTNSASGAVDAVYIAATTDELTLIKPMIDMAISSRKKPALYANSRSNKAGVGPDFRLEMDGMQFSDIPLLTGVNLPLMQQAASKFANDYSLMRLYAMGIDAWSLANQFTQLQQGTGFHMKGASGELSVTNDCTILRHLAWMQFNNGRIIIENNAANNIDATVDSTVNKSADSSNAVQLMP

SEQ ID NO: 7765 - protein, 290 aa, Xenorhabdus bovienii
  Peptide sequence Name=Xb4151_4152.C433.gene160.pep
  Gene classification: Function=Predicted methyltransferases; Function class=R General function prediction only
  Homolog annotation: Query=1..285bp; Hit=1..284bp; Blast score=431; Percent Identity=80.0; E value=1e-121; Homolog= yraL COG0313
MNQTNRAVVTTSTLYVVPTPIGNLGDITQRALEVLKHVDLIAAEDTRHTGLLLQHFAINARMFALHDHNEQQKADQILAKLEQGLSIALVSDAGTPLINDPGYHVVRRCREAGINVVPLPGPCAAITALSAAGLPSDRFCYEGFLPAKSKGRRDTLRDLAQEPRTLIFYESTHRLLDSLEDIVEVWGADRYVVLARELTKTWESIKGMPVGELLAWIREDETRRRGEMVLIVEGYRKPAEDCLPPEALRTLELLQKELPLKKAAALTAEIHGVKKNALYRHALEQIEEGA

SEQ ID NO: 7766 - protein, 72 aa, Xenorhabdus bovienii
  Peptide sequence Name=Xb4151_4152.C433.gene161.pep
LPAARCALTAPFHPYLIPPLFLQTKVGHRRFALCCTSRRLSPPRRYLAPCPVEPGLSSPLHLPKESGKAATV

SEQ ID NO: 7767 - protein, 89 aa, Xenorhabdus bovienii
  Peptide sequence Name=Xb4151_4152.C433.gene162.pep
  Homolog annotation: Query=1..74bp; Hit=1..74bp; Blast score=111; Percent Identity=83.0; E value=3e-24; Homolog= gi|22124036|ref|NP _667459.1| hypothetical [Yersinia pestis KIM] gi|21956781|gb|AAM83710.1|AE013612_3 hypothetical [Yersinia pest
VELTDKPGSVVDNHSSRPELARWLKQPTRVQYGPYHVNLYLVLLRVEFTVPRTVASRAVRSYRTLSPLPDPTLIFANKSRPSAVCSLLH

SEQ ID NO: 7768 - protein, 50 aa, Xenorhabdus bovienii
  Peptide sequence Name=Xb4151_4152.C433.gene163.pep
LSTTEPGLSVNSTRFSPIELWLYRAYSFSGQMKNVLSEYENQPPKSISSP

SEQ ID NO: 7769 - protein, 233 aa, Xenorhabdus bovienii
  Peptide sequence Name=Xb4151_4152.C433.gene164.pep
  Gene classification: Function=Pirin-related protein; Function class=R General function prediction only
  Homolog annotation: Query=1..231bp; Hit=1..231bp; Blast score=265; Percent Identity=55.0; E value=4e-71; Homolog= yhaK COG1741
MIITRTANQCGKADYGWLKARYTFSFGHYFDPKFLNYGALRVLNQEVLAPKAEFQPKAYPHVDILNIILQGEAQYRDSEGSHIHARQGDCLLFSARQDIRYSEHNISDEIPLTRMQLWLNACPEQEPLPLQRTVLPNRPLTLLASPSSENKSMFLRQQVWVSYLVIKTSDIQTLPLRGKNAYLQSIRGNAKISGSNHANVEIKCGDGVFIQEELLLKLRADTPFQGLLIDLGG

SEQ ID NO: 7770 - protein, 298 aa, Xenorhabdus bovienii
  Peptide sequence Name=Xb4151_4152.C433.gene165.pep
  Gene classification: Gene name=LysR; Function=Transcriptional regulator; Function class=K Transcription
  Homolog annotation: Query=1..295bp; Hit=1..295bp; Blast score=478; Percent Identity=84.0; E value=1e-135; Homolog= yhaJ COG0583
MGKERALTLESLRVMDAIDRRGSFAAAADELGRVPSALSYTMQKLEEELDVVLFDRSGHRTKFTNVGRMLLERGRLLLEAADKLTADAEALARGWETHLTIVCEALFPVVSLFPLVDKLAKKSNTQFSLMTEVLAGAWERLETGYADIVIAPDIHFRPSAEINSRTLYSINNVYVASVDHPIHHEPEPLSDATRVKYRGIAVADTARERPVLTVKLLDKQARLTVSTLEDKRRALLAGLGVATMPYPMVEQDIAEKRLRVIGSEYSHETNIIMAWRRDSMGEAKSWCLREIPKLFMKQ

SEQ ID NO: 7771 - protein, 163 aa, Xenorhabdus bovienii
  Peptide sequence Name=Xb4151_4152.C433.gene166.pep
  Gene classification: Function=Predicted membrane protein; Function class=S Function unknown
  Homolog annotation: Query=29..163bp; Hit=27..160bp; Blast score=149; Percent Identity=63.0; E value=1e-36; Homolog= yqjF COG2259
MINKLCFLAHELVIKNINRPFIIIAFCILEMFMKKFEDSSLLAARILISTLFIIAGYGKLGDAYAGTQQFMEAMKVPGILLPLTILLELGGGLAVLFGLLTRTTAVFTFIFCILTALLFHSDFSDGMNQTMFLKNMAIGAGYLLLAMMGPGKFSIDRALNKNW

SEQ ID NO: 7772 - protein, 68 aa, Xenorhabdus bovienii
  Peptide sequence Name=Xb4151_4152.C433.gene167.pep
LKENKKKTRDENSISARSGFCVDTIVNLTTRKLKMNRECSFSSGKECFPRSNGVQVCLNPSGVLHQCR

SEQ ID NO: 7773 - protein, 40 aa, Xenorhabdus bovienii
  Peptide sequence Name=Xb4151_4152.C433.gene168.pep
VCCINADSLFQWRSVNIARGMMVRAGCFLAKVIILNHHAA

SEQ ID NO: 7774 - protein, 30 aa, Xenorhabdus bovienii
  Peptide sequence Name=Xb4151_4152.C433.gene169.pep
LFFGESNYTKSSRCLIIPCKTSTRPIILLM

SEQ ID NO: 7775 - protein, 57 aa, Xenorhabdus bovienii
  Peptide sequence Name=Xb4151_4152.C433.gene170.pep
MSWVYALENESCFFEHKPSIKISFLSSLRKIITMVLHFPQSACPRGFLRPVISPAEY

SEQ ID NO: 7776 - protein, 393 aa, Xenorhabdus bovienii
  Peptide sequence Name=Xb4151_4152.C433.gene171.pep
  Gene classification: Gene name=AmpC; Function=Beta-lactamase class C and other penicillin binding proteins; Function class=M Cell envelope biogenesis, outer membrane
  Homolog annotation: Query=27..393bp; Hit=13..377bp; Blast score=429; Percent Identity=58.0; E value=1e-120; Homolog= ampC COG1680
MKDFPMMKKFVINTLAFATIATSPFYASAQKTLTAQQVEKIVNDTLTPLLEKQDIPGMAVAVIYDGKPQFFNYGVADIKTQRPITENTLFELGSVSKTFTGIAGGYAMQTDILNLNDPVTAYSPELTGSQWRDVKMLHLATYTAGGLPLQLPDSVTDQKSLWQYYQQWKPLSAPGMIRNYSNASIGLFGALAVNKSQLTFETYMTKYVFLPLKLTHTFITVPESMQSDYAWGYKNGQPVRVTPGMLSAEAYGVKSTTQDMVKYMQANMAPDSLPADNDKLKKAILAAQSRYYQVGNMFQGLGWEMHNWPINPQRVIADSNNDIALQPREVEALIPPRSAVPASWVHKTGGTDGFGAYIAFIPEEKIGIVMLANKNYPNPVRVEAAYHILKALR

SEQ ID NO: 7777 - protein, 102 aa, Xenorhabdus bovienii
  Peptide sequence Name=Xb4151_4152.C433.gene172.pep
  Homolog annotation: Query=10..87bp; Hit=6..83bp; Blast score=70; Percent Identity=43.0; E value=6e-12; Homolog= Pa|Phot3-190d09.p1k _g25| 27356 - 27616 177 86 aa, chain -
MTIMNKSRCQQREWRKQQLLLEIQQQRHSLSECTQHWLDITQPYDRGWQTLSAFKPYVAIGSGIALIYGICHPMKFYRGSRRMVSLLGFIRGIKSVLSVAIT

SEQ ID NO: 7778 - protein, 133 aa, Xenorhabdus bovienii
  Peptide sequence Name=Xb4151_4152.C433.gene173.pep
  Homolog annotation: Query=1..133bp; Hit=1..133bp; Blast score=139; Percent Identity=57.0; E value=6e-33; Homolog= gi|37527850|ref|NP _931195.1| hypothetical protein [Photorhabdus luminescens subsp. laumondii TTO1] gi|36787286|emb|CAE16367.1|
MIQSPRSQGPGKGIFDTLRRVAAIVVSMVETRIRLIAVELEENTATLVQLLLLIGFTLLLATFGLMCLLILIFWVIDPVYRATAMAITAGILLILAVFGAIWTIRKSRKLIFFNSTREQLKIDRKMLEDDHHE

SEQ ID NO: 7779 - protein, 101 aa, Xenorhabdus bovienii
  Peptide sequence Name=Xb4151_4152.C433.gene174.pep
  Homolog annotation: Query=1..101bp; Hit=1..101bp; Blast score=125; Percent Identity=73.0; E value=2e-28; Homolog= gi|16120899|ref|NP _404212.1| putative membrane protein [Yersinia pestis] gi|22127483|ref|NP_670906.1| hypothetical protein [Ye
MSQKKNSEDLRTELQSLADTLEEVLNSSGDKSKAELEKLRSKAEKTLKDARVTLSDASDKLVDQTKEMAGRADNYVRDNPWTGVGIGAAVGVVLGILLAKR

SEQ ID NO: 7780 - protein, 56 aa, Xenorhabdus bovienii
  Peptide sequence Name=Xb4151_4152.C433.gene175.pep
LRRKFTGSSIPCGMFWLDTTGKSQPLYWQKKNYHDRILLRRMVSTSLTPDDRQTAN

SEQ ID NO: 7781 - protein, 222 aa, Xenorhabdus bovienii
  Peptide sequence Name=Xb4151_4152.C433.gene176.pep
  Gene classification: Gene name=DedA; Function=Uncharacterized membrane-associated protein; Function class=S Function unknown
  Homolog annotation: Query=1..218bp; Hit=1..218bp; Blast score=268; Percent Identity=69.0; E value=4e-72; Homolog= yqjA COG0586
MEIVTDLIYALWHQDYETLANPSLVWAIYILLFTILFLENGILPAAFLPGDSLLILVGVLIAKDAMSFPATIFILTAGASLGCWVGYLQGRWLGNTKLVQGWLSHLPTHYYQRAHNLFHRHGLSALLIGRFLAFVRTLLPTLAGIAGLKNGRFQIFNWLSGFLWVIILTTLGYFLGKSPLFRQYEEYVMNFLVLLPLGLLLIGLIGSLTVIWRKRRANHPPQ

SEQ ID NO: 7782 - protein, 40 aa, Xenorhabdus bovienii
  Peptide sequence Name=Xb4151_4152.C433.gene177.pep
LVPKCINQVCYNFHQMFLKRGLRITSYFYGVFLVHSCWVL

SEQ ID NO: 7783 - protein, 51 aa, Xenorhabdus bovienii
  Peptide sequence Name=Xb4151_4152.C433.gene178.pep
MAAIRILPFRSHKCKQFVIKYCVVCIFQLIIRFSFFHFPILGKQTQKQQAH

SEQ ID NO: 7784 - protein, 414 aa, Xenorhabdus bovienii
  Peptide sequence Name=Xb4151_4152.C433.gene179.pep
  Gene classification: Gene name=SstT; Function=Na+/serine symporter; Function class=E Amino acid transport and metabolism
  Homolog annotation: Query=3..406bp; Hit=4..407bp; Blast score=485; Percent Identity=71.0; E value=1e-137; Homolog= ZygjU COG3633
MEKRQKGFVQYIVQGSLVTQIIIGLIAGILLAWLLPSTAQSADLLGSLFVSALKAVAPVLVWILVMSSIANHKKGQKTSIRPILILYLLGTFGAAVVAVIGSTLFPSTLILVTTDAKISPPDNIVEVIRGILLNIVVNPIDAILKGNYVGILAWSIGLGIALRHAKESTKSLVQDLAEAVTQLVRVVIRLAPIGIFGLVASTIATTGFEALLGYVRLLAVLLGCMIIVALVINPLIVYWTIRRNPYPLVFACLRESGVTAFFTRSSAANIPVNMAMCRRMNLNEDTYSVSIPLGATINMAGAAVTITVLTLAAVNTLDMTVGLPTAILLSVVSVIGACGSSGVAGGSLLLIPLACSIFGISNEIAMQVVAVGFIIGVLQDSAETGLNSSTDVLFTAAACQAEDARLNADQLAQR

SEQ ID NO: 7785 - protein, 677 aa, Xenorhabdus bovienii
  Peptide sequence Name=Xb4151_4152.C433.gene180.pep
  Gene classification: Gene name=NemA; Function=NADH; Function class=C Energy production and conversion
  Homolog annotation: Query=7..359bp; Hit=2..354bp; Blast score=534; Percent Identity=72.0; E value=1e-151; Homolog= fadH_1 COG1902
MENAMSNYPHLLAPLDLGFTTLKNRVLMGSMHTGLEEHPDGARRLARFYAERAAGGVALIVTGGIAPNGQGVVTAGASILNNEDTLSHHQVITDAVHQAGGKIALQILHTGRYSYQKNLVAPSAIQAPINPFKPREMSEEDIQQTIRDFARCARLAQQAGYDGVEIMGSEGYLINQFLVARTNHRQDKWGGNFENRMRFAVEIVKAARAITGEQFIIIYRLSMLDLVEEGSDWQEIEQLAKEIEKAGASIINTGIGWHEARIPTIATMVPRAGFSWVTQKLMGKVSIPLITTNRINDPHVAEQTLSEGCADMVSMARPFLADAEFVLKAEQNRADEINTCIGCNQACLDRIFVGKLTSCLVNPRACHETEFIAEPVKEPKTIAVIGAGPAGLSFAVTAASQGHHVTLFERDNKIGGQFNIAKQIPGKEEFYETLRYFDRQLALNGVEVKLNHTATAGQLASFDEIVIATGIIPRTPDIDGINHEKVLTYLDVLKHKCNVGPRVAIIGAGGIGFDTAEYLSQNGQSTSLSSHAFSQEWGIDQTLSHRGGLQPEGAQMERSPRKIYLLQRKNSKVGEGLGKTTGWVHRASLLMRGITMLNSVQYLKIDDQGLHISRNGEQQCLEVDNVIICAGQEPLKDLYQPLQTMGKNVHVIGGADVAVELDARRAIDQGARLALKI

SEQ ID NO: 7786 - protein, 38 aa, Xenorhabdus bovienii
  Peptide sequence Name=Xb4151_4152.C433.gene181.pep
MVPIRLEPSKFDLNLIRPLSHTENNNTFKSPNIRWRMQ

SEQ ID NO: 7787 - protein, 39 aa, Xenorhabdus bovienii
  Peptide sequence Name=Xb4151_4152.C433.gene182.pep
MTHSVIFFMLTPIFSISSKQPIQRDQLHPYAIKIKISSA

SEQ ID NO: 7788 - protein, 198 aa, Xenorhabdus bovienii
  Peptide sequence Name=Xb4151_4152.C433.gene183.pep
  Gene classification: Gene name=RimL; Function=Acetyltransferases, including N-acetylases of ribosomal proteins; Function class=J Translation, ribosomal structure and biogenesis
  Homolog annotation: Query=9..183bp; Hit=9..178bp; Blast score=141; Percent Identity=45.0; E value=5e-34; Homolog= NMA0331 COG1670
MKKITEWVILSGKFVTLVPLEHNRHDEFVRAIEEGQLHQLWYTNIPEPANVKADIERRLALHEQGSMLPFTVIDNQTGVAVGMTTYMNIDAKTPRLEIGSTWYARSAQRTPINTEAKYLLLEYAFEQLGGVAVEFRTHFLNHQSRRAIERLGAKLDGILRSHLRAKDGSIRDTCVYSMLASEWPAIKTHLLWLMAKPR

SEQ ID NO: 7789 - protein, 311 aa, Xenorhabdus bovienii
  Peptide sequence Name=Xb4151_4152.C433.gene184.pep
  Gene classification: Gene name=VirK; Function=Uncharacterized BCR; Function class=S Function unknown
  Homolog annotation: Query=10..301bp; Hit=30..320bp; Blast score=244; Percent Identity=45.0; E value=7e-65; Homolog= ybjX COG2990
MNYLQQPASSGMKLFADLVGKRVTPGEYWHSSSYRTKFALRSIFTPISTLKLLNKIAKTPLYKDILKKQPSLPCKLHRPYLSINFKRKQIVCALNEHYKILFEQLEPAVINKIFDTHAYLLATVQGKNESFMIYIDSLDNLNKEGELSLYITTTENVILAKCAFTLLTIKGKQTLFIGVLQGPAKMDSSLDIIRHATKECYGLFPKRLLIESICRFASHANCEQILAVSNETHIYRSIRYWHKKKDKMVADYNAFWESLNGIRKENNDFHLPSAIERKSLEEIASKKRAEYRRRYQLLDELDNHIKAALTD

SEQ ID NO: 7790 - protein, 144 aa, Xenorhabdus bovienii
  Peptide sequence Name=Xb4151_4152.C433.gene185.pep
  Gene classification: Gene name=WecD; Function=Histone acetyltransferase HPA2 and related acetyltransferases; Function class=K Transcription
  Homolog annotation: Query=1..143bp; Hit=1..143bp; Blast score=120; Percent Identity=46.0; E value=4e-28; Homolog= PA1428 COG0454
MYLKQATETDFAILIQIWEASVRATHDFLPETIIEDLRPLILNDYLPNLIIYKVVNDQHIIEGFVAVDQQRVEMLFISPQARGQGIGKMLLAFAMTELQINELDVNEQNEQGVGFYKHMGFQVFARSAVDGQGNPFPLLHMKLA

SEQ ID NO: 7791 - protein, 383 aa, Xenorhabdus bovienii
  Peptide sequence Name=Xb4151_4152.C433.gene186.pep
  Gene classification: Gene name=ProP; Function=77 Permeases of the major facilitator superfamily; Function class=G Carbohydrate transport and metabolism
  Homolog annotation: Query=12..377bp; Hit=13..377bp; Blast score=307; Percent Identity=51.0; E value=1e-83; Homolog= VCA0753 COG0477
VKLLRNNDSAFVPVAGLTVFAIASGYLMSLIPLSMASFSIDTGYASWLASAYYVGLLIGSTMIEPVIAKIGHRFSFISFLLLLATTVVVLPFFPTKEIWLVIRCVAGIAVAGIFVVVESWLLMGDSPKERAKRLSFYMTSLYGGTTLGQLAIGFIGTQGIVPFIVVLALLLLAILPPLLISQGQPPALQHQSLSLKKIAQFSKPAIVGCITSGVVMGTIYGLMPLSLSQSHFDGEQVGVLMAATILGGMVIQPIVSRLSVIVSKTLLLAMVSLLGVFAMGMIYLSENYIVMIVALGLLGMSSFALYPIAITLACDNLDSSCIVAATQVMLLSYSIGSSIGPLGAGNFMLQHNGLMNFFFIVLLATAIYMLLASLRRKDHILAN

SEQ ID NO: 7792 - protein, 73 aa, Xenorhabdus bovienii
  Peptide sequence Name=Xb4151_4152.C433.gene187.pep
LPSITELNSLSNQKQSQIPSSLRQVQMHCHCCAAVSLLSSPHKKSARYALLLIKILPNGGNDICQGLGYILVI

SEQ ID NO: 7793 - protein, 35 aa, Xenorhabdus bovienii
  Peptide sequence Name=Xb4151_4152.C433.gene188.pep
MNLFIHEYQFFSLYLSGVKGYSPQRSRLLSDLSTA

SEQ ID NO: 7794 - protein, 35 aa, Xenorhabdus bovienii
  Peptide sequence Name=Xb4151_4152.C434.gene1.pep
PAPVGPLFNNLIRQSVWALTRQYRQHRKMPKTLKS

SEQ ID NO: 7795 - protein, 43 aa, Xenorhabdus bovienii
  Peptide sequence Name=Xb4151_4152.C434.gene2.pep
VLSPACQTTVQTVSPPAVSTQITPLHPHRVTLERARSQRVLAS

SEQ ID NO: 7796 - protein, 45 aa, Xenorhabdus bovienii
  Peptide sequence Name=Xb4151_4152.C434.gene3.pep
VSSGVRFERLTSPVHDGTDCFKFSACSRLLKSKNFTTHGCFPHGF

SEQ ID NO: 7797 - protein, 44 aa, Xenorhabdus bovienii
  Peptide sequence Name=Xb4151_4152.C434.gene4.pep
MNSGQDSATDCTGFPHSGIAGYCGSYHLTGAYRRLARPSSPLTA

SEQ ID NO: 7798 - protein, 63 aa, Xenorhabdus bovienii; identical to SEQ ID NO: 5466
  Peptide sequence Name=Xb4151_4152.C434.gene5.pep
  Homolog annotation: Query=1..47bp; Hit=68..115bp; Blast score=85; Percent Identity=87.0; E value=2e-16; Homolog= gi|22124244|ref|NP _667667.1| hypothetical [Yersinia pestis KIM] gi|21957009|gb|AAM83918.1|AE013632_6 hypothetical [Yersinia pes

SEQ ID NO: 7799 - protein, 30 aa, Xenorhabdus bovienii
  Peptide sequence Name=Xb4151_4152.C434.gene6.pep
LGFFYKQTMDTEEVSYKQEKTQLNLAGLLI

SEQ ID NO: 7800 - protein, 282 aa, Xenorhabdus bovienii
  Peptide sequence Name=Xb4151_4152.C434.gene7.pep
  Gene classification: Gene name=LysR; Function=Transcriptional regulator; Function class=K Transcription
  Homolog annotation: Query=5..275bp; Hit=1..274bp; Blast score=318; Percent Identity=60.0; E value=4e-87; Homolog= ZyifAm COG0583
LEIHVDTELLKTFLEVSKTRHFGRAAESLYLTQSAVSFRIRQLENQLGTNLFTRHRNNIRLTAAGERLVPYAESLMNTWQLAKKEISYVSQHTELSIGATASLWEGYLISWLSTFYQHHQGMRIESRVSTRQILVKQLHSRELDLLITTEPPKMDEFQSQLIGNIQLVLSTTQHNLKQGIENYIKLEWGADFHQQEQQILKNDYPPIITTTSAHIARELLNSVNAAAFLPVHWQEDYPKLVTSPNKELIKRPLYAVWLQNSDQQTFIQQLLKIPVEKAPITG

SEQ ID NO: 7801 - protein, 121 aa, Xenorhabdus bovienii
  Peptide sequence Name=Xb4151_4152.C434.gene8.pep
  Gene classification: Function=Uncharacterized BCR; Function class=S Function unknown
  Homolog annotation: Query=10..121bp; Hit=1..112bp; Blast score=184; Percent Identity=81.0; E value=9e-48; Homolog= yifE COG3085
MTVELGVCQMAESFITTNRFFDNRNYPRGFSRHGDFTIKEAQLLERYGHAFNELDLGKREPQTEEEKLFVAVCRGERAPATTEEKVWIKYLAKISRPKRFHTLSGGKPQIDSAEDYTDTDD

SEQ ID NO: 7802 - protein, 508 aa, Xenorhabdus bovienii
  Peptide sequence Name=Xb4151_4152.C434.gene9.pep
  Gene classification: Function=Predicted ATPase with chaperone activity; Function class=O Posttranslational modification, protein turnover, chaperones
  Homolog annotation: Query=1..503bp; Hit=1..506bp; Blast score=608; Percent Identity=61.0; E value=1e-174; Homolog= HI1117 COG0606
MTLAVIYTRATIGVDSPIVTIEAHISNGLPGLTLVGLPETTVKEARDRVRSALLNSGFTYPPKRITVNLAPADLPKEGGRYDLPIAIAILAASEQIPTDKLHNYEFLGELALSGEIRRVMGAIPAALSAKRTGRQLILSIENQAELAILSQNETLVANHLLQVCHFLRGETAILSSPPPITLQADPLVLDIRDIIGQEQAKRALEITAAGGHNLLLLGPPGTGKTMLASRLCGLLPPLTHLEALDVAAINSLTGNSVNPQKWHTRPFRAPHHSSSMAALVGGGSIPKPGEISLAHNGILFLDELPEFSRSALDALREPLESGEIVISRARAKVCFPAQVQLIAAMNPSPTGYHQGLHNRSSPQQILRYLSKLSGPFLDRFDLSIEVPLLPSGILSQSSEKHGESSYEVKKRVQIARKVQIERCGHVNAYLNRKQTDSACKLKMEDSIFLEDTLLKLGLSVRAWHRILKVSRTIADLKEQKRIERPDIMEALSYRSMDRLLIQLQKQAG

SEQ ID NO: 7803 - protein, 33 aa, Xenorhabdus bovienii
  Peptide sequence Name=Xb4151_4152.C434.gene10.pep
MVNEFQNTNNSKYIYESLRKITTKYFLLFFINS

SEQ ID NO: 7804 - protein, 31 aa, Xenorhabdus bovienii
  Peptide sequence Name=Xb4151_4152.C434.gene11.pep
LKFIDHLVFLINILLYINNLMFLGAFYKESE

SEQ ID NO: 7805 - protein, 42 aa, Xenorhabdus bovienii
  Peptide sequence Name=Xb4151_4152.C434.gene12.pep
LLSEKIAICIFNKIINTKIIKIRLNHLFIGSNIQADIFYLCP

SEQ ID NO: 7806 - protein, 63 aa, Xenorhabdus bovienii
  Peptide sequence Name=Xb4151_4152.C434.gene13.pep
LYLACKWLAVMLFCYAFLRVKKNPRAFRCGGFCEIWLFFCLSLPSSKCSPARWDNNHHHAHDN

SEQ ID NO: 7807 - protein, 548 aa, Xenorhabdus bovienii
  Peptide sequence Name=Xb4151_4152.C434.gene14.pep
  Gene classification: Gene name=IlvB; Function=Thiamine pyrophosphate -requiring enzymes [acetolactate synthase, pyruvate dehydrogenase (cytochrome), glyoxylate carboligase, phosphonopyruvate decarboxylase]; Function class=E Amino acid transp
  Homolog annotation: Query=1..546bp; Hit=1..546bp; Blast score=860; Percent Identity=75.0; E value=0; Homolog= ZilvG COG0028
MNGAQWVVQALRTQGIEKVFGYPGGAIMPIYDALYDGGIEHLLCRHEQGAVMAAIGYARANGKPGVCIATSGPGATNLITGLADALLDSVPVVAITGQVSSELIGTDAFQEIDMLGLSLACTKHSFLVDSLDKLPQIIAEAFTIATSGRPGPVLIDLPKDIQLAQSDLAPYLMPVVSESFPPEQELEQARHMMLMAQKPILYVGGGIGMADAVPELRRFVTETGLPVVSTLKGLGAADAEHKYYLGMLGMHGTKAANLAVQSCDLLIAAGARFDDRVTGKLNTFAPHAKVIHVDIDPVEFNKLRQAHVSLPGNLKTLLPHLQQPLSIESWQQEIKRLKSEHTWHYDYQGVSIYAPSLLKQVSERKPSNAIITTDVGQHQMWTAQHMTFDRPANFITSSGLGTMGFGIPAAIGAQMARPEDMVLCISGDGSFMMNVQELGTIKRKQLPIKIILLDNQRLGMVRQWQELFFDKRYSETILNDNPDFIALAKAFDIPGQQITDKTQIDAALDALFSSEGPYLLHVSIDELENVWPLVPPGSSNATMLEKSL

SEQ ID NO: 7808 - protein, 85 aa, Xenorhabdus bovienii
  Peptide sequence Name=Xb4151_4152.C434.gene15.pep
  Gene classification: Gene name=IlvH; Function=Acetolactate synthase, small subunit; Function class=E Amino acid transport and metabolism
  Homolog annotation: Query=1..75bp; Hit=1..75bp; Blast score=89; Percent Identity=66.0; E value=5e-19; Homolog= ilvM COG0440
MMQHQLAIQARFCPEILERILRVTRHRGFQICALNMDHTTDSDNVSIELTVASQRSVNLLFSQLMKLVDVAGVEIRHKESQFISA

SEQ ID NO: 7809 - protein, 309 aa, Xenorhabdus bovienii
  Peptide sequence Name=Xb4151_4152.C434.gene16.pep
  Gene classification: Gene name=IlvE; Function=Branched-chain amino acid aminotransferase/4-amino-4-deoxychorismate lyase; Function class=E Amino acid transport and metabolism
  Homolog annotation: Query=2..307bp; Hit=3..308bp; Blast score=573; Percent Identity=87.0; E value=1e-164; Homolog= ZilvE COG0115
MTKQADYIWFNGEMVPWADAKVHVMSHALHYGTSVFEGVRCYNSHKGPVVFRHREHMRRLHDSAKIYRMPVSQSVDELMEACRETLRKNKLVSAYIRPLVFIGDVGMGVNPPDGYKTDIIIAAFPWGAYLGEEALDQGIDAMVSSWNRVAANTIPTGAKAGGNYLSSLLVGSEARRHGYQEGIALDVHGYISEGAGENLFEVKDGVLFTPPFASSALPGITRDAIIKLAQDLGLEVREQILTRESLYLADEVFMTGTAAEITPVRSVDGIQVGIGKCGPITKKIQNAFFGLFDGTTEDKWGWLDAVNPE

SEQ ID NO: 7810 - protein, 616 aa, Xenorhabdus bovienii
  Peptide sequence Name=Xb4151_4152.C434.gene17.pep
  Gene classification: Gene name=IlvD; Function=Dihydroxyacid dehydratase/phosphogluconate dehydratase; Function class=E Amino acid transport and metabolism
  Homolog annotation: Query=1..616bp; Hit=1..616bp; Blast score=1088; Percent Identity=87.0; E value=0; Homolog= ZilvD COG0129
MPKYRSATTTHGRNMAGARALWRATGMTDEDFGKPIIAVVNSFTQFVPGHVHLRDLGKLVAEQIEASGGVAKEFNTIAVDDGIAMGHGGMLYSLPSRELIADSVEYMVNAHCADAMVCISNCDKITPGMLMASMRLNIPVIFVSGGPMEAGKTRLSDQIIKLDLIDAMIQGANPNVSDEESNQIERSACPTCGSCSGMFTANSMNCLTEALGLSQPGNGSLLATHADRKELFLNAGKRIVELTKRYYEQNDDSALPRNIATKAAFENAMILDIAMGGSTNTVLHLLAAAQEGDVDFTMADIDRLSRLVPHLCKVAPSTQKYHMEDVHRAGGVIGILGELDRAELLNRDVKNVLGLDLPQTLAQYDIMLTQDEGVKSMYSAGPAGIRTTKAFSQDCRWPSLDTDRKEGCIRERTHAYSQDGGLAVLSGNVAANGCIVKTAGVDEGSLTFRGPAKVYESQDDAVEAILGGKVVAGDVVVIRYEGPKGGPGMQEMLYPTTYLKSMGLGKSCALITDGRFSGGTSGLSIGHASPEAASGGVIGLVYDGDIIDIDIPNRKIHLDVNETELAVRTQAELSRGDQAWTPKSRDRQVSFALRAYALLATSADKGAVRDKAKLGG

SEQ ID NO: 7811 - protein, 515 aa, Xenorhabdus bovienii
  Peptide sequence Name=Xb4151_4152.C434.gene18.pep
  Gene classification: Gene name=IlvA; Function=Threonine dehydratase; Function class=E Amino acid transport and metabolism
  Homolog annotation: Query=5..514bp; Hit=6..512bp; Blast score=789; Percent Identity=78.0; E value=0; Homolog= ilvA COG1171
VAVYPLNAEPKGAEYLKAALSAPVYDVAQVTPLQEMEKISARLANTILVKREDRQLVHSFKLRGAYTMIAGLTEEQKAKGVITASAGNHAQGVALSASKVGTRAIIVMPIATADIKVDAVRSFGGEVLLYGANFDEAKAKAISMAKERGYTFVPPFDHPAVIAGQATLAMELLQQDVHLDRIFVPVGGGGLIAGVAVLIKQLVPEMKVIGVETEDSACLKAALEAGCPVDLPRVGLFAEGVAVKRIGDETFRLCQLYVDDVITVDSDAICAAMKDIFEDVRAIAEPSGALALAGLKKYVQQHQIQGERLAHILSGANVNFHGLRYVSERCELGEQREALLAVTIPEQKGSFLNFCQTLGTRVVTEFSYRYSDATNPAEACIFVGVRLNRGNAERLEIINELKASGYQVADFTDDEMAKLHVRYMIGGRPAKPLQERLYSFEFPESPGALLKFLQTLGTHWNITLFHYRSHGMDYGRVLAAFELSGAEVRFDRHLEDLGYEYHDETNNPSFNLLLK

SEQ ID NO: 7812 - protein, 33 aa, Xenorhabdus bovienii
  Peptide sequence Name=Xb4151_4152.C434.gene19.pep
LIIGLKNSTLAGAIFRIKNCSQHPPKCFNQWFL

SEQ ID NO: 7813 - protein, 293 aa, Xenorhabdus bovienii
  Peptide sequence Name=Xb4151_4152.C434.gene20.pep
  Gene classification: Gene name=LysR; Function=Transcriptional regulator; Function class=K Transcription
  Homolog annotation: Query=1..293bp; Hit=1..293bp; Blast score=394; Percent Identity=69.0; E value=1e-110; Homolog= ilvY COG0583
MDIRDLKLFLHLAESCHFGRTAKAIHVSPSTLSRQIQRLEELLGHPLFLRDNRTVKLTFAGEQLKQFAQQTLLQYQQLRHSLNHQSPSLSGELRLFCSVTAAYSHLPQVLDKFRAEHPLVEIKLTTGDAADAVDRIQSDQADLGIAGKPEKLPHNVSFTKIGEIPLVLIAPSLPCAVRTLATQEQPDWNAIPFILPEHGPSRTRIELWFRRNSIPNPLIYATVSGHEAIVSMVALGCGIALIPAVVVENSPEPVRNRVSLLENIALVEPFELGVCTLSKRLQEPLVKAFWGML

SEQ ID NO: 7814 - protein, 492 aa, Xenorhabdus bovienii
  Peptide sequence Name=Xb4151_4152.C434.gene21.pep
  Gene classification: Gene name=IlvC; Function=Ketol-acid reductoisomerase; Function class=E Amino acid transport and metabolism
  Homolog annotation: Query=1..492bp; Hit=1..491bp; Blast score=846; Percent Identity=86.0; E value=0; Homolog= ilvC COG0059
MANYFDTLNLRQQLAQLGKCRFMAREEFADEAGYLKGKKVVIVGCGAQGLNQGLNMRDSGLNIAYALRQEAIEEKRASWRKATENGFKVGTYEELIPQADLVINLTPDKQHSTVVQAVQPLMKEGAALGYSHGFNIVEVGELVRKDITVVMVAPKCPGTEVREEYKRGFGVPTLIAVHPENDVKGEGMAIAKAWAAATGAHRAGVLESSFVAEVKSDLMGEQTILCGMLQAGSLLCYDKLVAEGTEPGYAGKLIQFGWETITEALKQGGITLMMDRLSNSAKLRAYALSEQLKVILAPLFQKHMDDIISGTFSSTMMADWANDDKNLLTWRAETGQTPFENYPDHSGNISEQEYFDHGVLMIAMVKAGVELAFETMVDAGIIEESAYYESLHELPLIANTIARKRLYEMNVVISDTAEYGNYLFSHVAVPLLKEKFMATLQAGDMGKPVADGSIDNAQLRDVNEAIRHHPIETIGRTLRGYMTDMQRIAVGG

SEQ ID NO: 7815 - protein, 35 aa, Xenorhabdus bovienii
  Peptide sequence Name=Xb4151_4152.C434.gene22.pep
MNLHKITPDEILSGVVFYGNLQAKLLFQIIDCLTL

SEQ ID NO: 7816 - protein, 371 aa, Xenorhabdus bovienii
  Peptide sequence Name=Xb4151_4152.C434.gene23.pep
  Gene classification: Gene name=AcuC (BS); Function=Deacetylases, including yeast histone deacetylase and acetoin utilization protein; Function class=T Signal transduction mechanisms
  Homolog annotation: Query=1..371bp; Hit=1..370bp; Blast score=505; Percent Identity=65.0; E value=1e-143; Homolog= PA3774 COG0123
MLRKTGFFFDELCFWHNMGSMHTFIFPVGGWIQPPCGAGHAESPETKRRMKSLMDVSGLSHSLELMSAEPIDEATLRLVHTESYLQRFKYLSDNGGGTLGSEASLGAGSYEIAKLSAGLTYAAVKAVLQGELDNAYSLSRPPGHHCLPDQAMGFCFLANISLAIEKAKEQLGLGRVAVVDWDVHHGNGTQHIFWQRDDVLTISLHQDRCYPAGYSGESDIGEGPGEGFNINIPLMAGAGHDSYMYAMDQIVMPALRRYQPELIIIACGYDANGFDPLARMQLHSDSFREMTRKMQQIADEFCHGKLVMVHEGGYSEAYVPFCGLAVMEELSGVRTEVIDPALAILELQQPRAPFETLQRQAIDDLKQQLSL

SEQ ID NO: 7817 - protein, 30 aa, Xenorhabdus bovienii
  Peptide sequence Name=Xb4151_4152.C434.gene24.pep
MTILLRKNKLLRYSIYINIIPLLNTNKHQP

SEQ ID NO: 7818 - protein, 676 aa, Xenorhabdus bovienii
  Peptide sequence Name=Xb4151_4152.C434.gene25.pep
  Gene classification: Gene name=UvrD; Function=Superfamily I DNA and RNA helicases; Function class=L DNA replication, recombination and repair
  Homolog annotation: Query=1..667bp; Hit=1..667bp; Blast score=1083; Percent Identity=80.0; E value=0; Homolog= Zrep COG0210
MRLNPSQQQAVEFVTGPCLVLAGAGSGKTRVITNKIAHLIRACGYQARHIAAVTFTNKAAREMKERVAQTLGRKETRGLMISTFHTLGLEIIKREYKALGMKSNFSLFDDQDQRVLLKDLTADLLEEDKDLLQKLNSSISNWKNDLMSPEQVIRQARSAQEHQFAECYRRYDLHLNSCNVLDFDDLITKPTLLLMQNEEVRERWQNKIRYLLVDEYQDTNTSQYQLVKLLVGNRARFTVVGDDDQSIYSWRGARPQNLILLNEDFPQLNVIKLEQNYRSSGRILKAANILIANNPHVFEKKLFSELGYGDPLRVIEANNEDHEAERVVGELLAHHFINKTEYKDYAILYRGNHQSRIFEKMLMQNRIPYRISGGTSFFSRPEIKDLLSYLRVLTNPDDDSAFLRIVNTPRREIGAMTIQKLGEWANQRNKSLYHASFDLGLEQSLTGRGLAALQHFTHWMDEISRQAEREPLLAVRDLLRGMDYESWLYETSPSPKAAEMRMKNVNQLFTWMSEMFEGDDLNEPMTLSQVVARFTLRDMLERGEDDEELDQVQLMTLHASKGLEFPYVFLVGMEEGLLPHQSSIDENNIDEERRLAYVGITRARRELFFTLSKERRQYGELIRPEPSRFLLELPQDDLHWPRGKKMISAEDRMKQGQSRLADIKSRLGLGQKNSDK

SEQ ID NO: 7819 - protein, 502 aa, Xenorhabdus bovienii
  Peptide sequence Name=Xb4151_4152.C434.gene26.pep
  Gene classification: Gene name=GppA; Function=Exopolyphosphatase; Function class=F Nucleotide transport and metabolism
  Homolog annotation: Query=1..491bp; Hit=1..491bp; Blast score=683; Percent Identity=71.0; E value=0; Homolog= ZgppA COG0248
MLSSSSLYAAIDLGSNSFHMLVVREVSGSIQVVTRIKRKVRLATGLDKNNHLSQQAMERGWQCLRLFSEYLQDIPASQIRVVATATLRLAVNSADFVGKASEILGNPVKIISGEEEARLIYQGVAHTTGGSEKRLVVDIGGGSTELVTGTGAKANQLFSLEVGCVTWLERYFNDRSLTEENFAQAESAAHHILAPITTTLLKQGWQICVGASGTVQALQEIMIAQGMDELITLPKLQQLKYKAIECGKLEELEIDGLTLERALVFPSGLAILIAIFQALNIESMILAGGALREGLVYGMLDFPIEQDIRTRTLCNIQHRFQLDIEQALRVKQLAEHFCQQVATVWNLDARCRELLTSACLLHEIGLCVDFRQGPAHSAYLISHLDLPGYTPAQKRLLATLLNNQSGPIDLASLSQQNALPPLQAQQLCRLLRLAIIFASRRQDDTLPALRLRVENETLTITLPYQWQMQHPLRAEALHQEIQWQSYIQWTLFLEEQNNSHLG

SEQ ID NO: 7820 - protein, 427 aa, Xenorhabdus bovienii
  Peptide sequence Name=Xb4151_4152.C434.gene27.pep
  Gene classification: Gene name=SrmB; Function=3 Superfamily II DNA and RNA helicases; Function class=L DNA replication, recombination and repair
  Homolog annotation: Query=1..427bp; Hit=1..421bp; Blast score=731; Percent Identity=83.0; E value=0; Homolog= rhlB COG0513
MSKTHLTEKKFSDFALHPKVIEALDKKGFSNCTPIQALTLPFTVEGRDVAGQAQTGTGKTLAFLTSTFHYLLTHPAAADHKTNQPRALIMAPTRELAVQIYSDAEELAEATGLKMGLAYGGDGYDKQLKVLESGVDIVIGTTGRLIDYTKQGYVNLNAVQVVVLDEADRMYDLGFIKDIRWLFRRMPVAAQRMNLLFSATLSYRVRELAFEQMNSPEYVEVEPLQKTGHRIQEELFYPSNEEKMRLLQTLLEEEWPDRCIIFANTKHRCEDIWAHLAADGHRVGLLTGDVAQKKRLRILEEFSLGNLDILVATDVAARGLHIPFVTHVFNYDLPDDCEDYVHRIGRTGRAGESGHSISLACEEYALNLTSIEEYIQHQIPVSKYNSDALLMDLPVPKRRNRARSGGHPRRTNMSRRGNPTRNRKHPG

SEQ ID NO: 7821 - protein, 131 aa, Xenorhabdus bovienii
  Peptide sequence Name=Xb4151_4152.C434.gene28.pep
  Gene classification: Gene name=TrxA; Function=Thiol-disulfide isomerase and thioredoxins; Function class=O Posttranslational modification, protein turnover, chaperones
  Homolog annotation: Query=21..131bp; Hit=16..126bp; Blast score=154; Percent Identity=64.0; E value=2e-38; Homolog= trxA COG0526
MLVNVHWDRKKFYFGAKIMNEKIISDRIIHLADADFDAKKLNVKGAVLIEFWAEWCGPCKMIAPILDEVSEEYAGKLTVAKLNVDDHEQTPKAHGIRGIPTLMLFKDGEKVATQVGALSKTQLKAFLDSHI

SEQ ID NO: 7822 - protein, 77 aa, Xenorhabdus bovienii
  Peptide sequence Name=Xb4151_4152.C434.gene29.pep
MLNIETLSAPSYIPNDSRIYALKYFAKCDMPSDTSDEPEITDLSDTTDCLVCNMLNVNSLYRLKNPLMQCFIQAHDC

SEQ ID NO: 7823 - protein, 49 aa, Xenorhabdus bovienii
  Peptide sequence Name=Xb4151_4152.C434.gene30.pep
LKLTTFRYYYLSRVLTVCQPYFEINLSTSNYCLVILVNMLKGFIRFWYK

SEQ ID NO: 7824 - protein, 78 aa, Xenorhabdus bovienii
  Peptide sequence Name=Xb4151_4152.C434.gene31.pep
MSCLRIRARFSSPIFSPRVINSDTGVFFNSVRFIMVGSLTRGISRTMNVNGMAALSVPVYLYQKRIKPFNILTNITRQ

SEQ ID NO: 7825 - protein, 419 aa, Xenorhabdus bovienii
  Peptide sequence Name=Xb4151_4152.C434.gene32.pep
  Gene classification: Gene name=Rho; Function=Transcription termination factor; Function class=K Transcription
  Homolog annotation: Query=1..419bp; Hit=1..419bp; Blast score=789; Percent Identity=96.0; E value=0; Homolog= rho COG1158
MNLTELKNTPVSELITLGENMGLENLARMRKQDIIFSILKQHAKSGEDIFGDGVLEILQDGFGFLRSGDSSYLAGPDDIYVSPSQIRRFNLRTGDTISGKIRPPKEGERYFALLKVNEVNFDKPENARNKILFENLTPLHANNRLRMERGNGSTEDLTARVLDLAAPIGRGQRGLIVAPPKAGKTMLLQNIAANIANNYPDCVLMVLLIDERPEEVTEMQRLVKGEVIASTFDEPASRHVQVAEMVIEKAKRLVEHKKDVIILLDSITRLARAYNTVVPASGKVLTGGVDANALHRPKRFFGAARNVEEGGSLTIIATALVDTGSKMDEVIYEEFKGTGNMELHLSRKIAEKRVFPAIDYNRSGTRKEELLTTQDELQKMWILRKIIHPMGEADAMEFLINKLAMTKTNEEFFDFMKRS

SEQ ID NO: 7826 - protein, 52 aa, Xenorhabdus bovienii
  Peptide sequence Name=Xb4151_4152.C434.gene33.pep
VFSGRNHLQMLRKPLLVMLYSLHYLFALFLYIDRMSSLLTGNLWIWCRMEHP

SEQ ID NO: 7827 - protein, 39 aa, Xenorhabdus bovienii
  Peptide sequence Name=Xb4151_4152.C434.gene34.pep
MQKISTLILGIFTITTLCKIMMDHLLFIDLWMFHSTPNP

SEQ ID NO: 7828 - protein, 357 aa, Xenorhabdus bovienii
  Peptide sequence Name=Xb4151_4152.C434.gene35.pep
  Gene classification: Gene name=Rfe; Function=UDP-N-acetylmuramyl pentapeptide phosphotransferase/UDP-N- acetylglucosamine-1-phosphate transferase; Function class=M Cell envelope biogenesis, outer membrane
  Homolog annotation: Query=1..344bp; Hit=6..349bp; Blast score=449; Percent Identity=77.0; E value=1e-126; Homolog= Zrfe COG0472
MSVEIFCIFIFSSVFLFVARKVAKIIGLVDKPNYRKRHHGLIPLVGGISVFFGVFFAFAITKEFIPHKWLYLACAGILVFIGALDDRFDISVKIRAAIQALVGISMMYFADLKIESLGSAFGSWEMTLGPFSYVVTLFAVWAAINAFNMVDGIDGLLGGLSSVSFGALGILLYVNGNTALAFWCFAFIAGILPYIFLNLGLLGKRFKVFMGDAGSTLIGFTIIWLLTETTQGEHSSINPVTALWIIAIPLMDMVAIMYRRLRKGMSPFSPDRQHIHHLIMRAGFTSRQAFILITVAAALLASIGIIGEHLSFVPEWVMLALFLLAFMLYGYCIKRAWRVARFIKRCKRRMRRAVSHH

SEQ ID NO: 7829 - protein, 375 aa, Xenorhabdus bovienii
  Peptide sequence Name=Xb4151_4152.C434.gene36.pep
  Gene classification: Function=Chain length determinant protein; Function class=M Cell envelope biogenesis, outer membrane
  Homolog annotation: Query=40..372bp; Hit=15..346bp; Blast score=414; Percent Identity=60.0; E value=1e-115; Homolog= ZwzzE COG3765
VQASYAPGSQPSLKTFGLSKRFWAVINSETKSKQDQSVIEHELDIRALCHALWRGKIWIIALAMIFAAVALGASYLMQQKWSATAIVDLPTTNDLGSYYSQQQFLRNLDTHINASPEVQLPTISDGAYKEFITQVVAYDTRREFWLQSNYYKQYREGNEKADAVLLEELINTIQVVRRDDKKLPNEVIKLTAETAVNANQFLREYMAFANQRASTHLNNEIKGAWATRIQSMKALVKRQEMVAKAMYNRKLNVLQQSLKIAEKQGINRNQTDIPIEELPESQMFMMGAPLLQSQIETLEATGPNYSIDYDQNIAMLATLNVGPTLQNTFQTYRYLRTPEVPVNRDSPRRVFMMIMWGAIGLLVGAGVALTRRSHT

SEQ ID NO: 7830 - protein, 86 aa, Xenorhabdus bovienii
  Peptide sequence Name=Xb4151_4152.C434.gene37.pep
MLCSHTHFCVKGSILGQCVYQRSHFDSFRPSTKHSQHFHSGSLILSIITDASRKGRFFTAISIPASDICVCSIQTIGNSHYFVFPE

SEQ ID NO: 7831 - protein, 376 aa, Xenorhabdus bovienii
  Peptide sequence Name=Xb4151_4152.C434.gene38.pep
  Gene classification: Gene name=WecB; Function=UDP-N-acetylglucosamine 2-epimerase; Function class=M Cell envelope biogenesis, outer membrane
  Homolog annotation: Query=1..376bp; Hit=15..390bp; Blast score=600; Percent Identity=78.0; E value=1e-172; Homolog= ZwecB COG0381
VKVLTVFGTRPEAIKMAPLVHALAKDAAFDAKVCVTAQHREMLDQVLHLFDITPDFDLNIMKKGQDLTDITCRILEGMKPVLEEFKPDVVLVHGDTATTMATSLAAFYQRIPVGHVEAGLRTGDLYSPWPEEANRKIAGHLAMYHFAPTENSQNNLLKESISENSIFVTGNTVIDALLWVRDRIVSDDALSGQLAKLYPFIDPNKKMILVTGHRRESFGGGFERICEALAQVARAHPEVQVVYPVHLNPNVSEPVKRILHDMDNVILINPQDYLPFVYLMNHAYMILTDSGGIQEEAPSLGKPVLVMRDTTERPEAVDAGTVRLVGTKTQTIVEEVTRLLTDDIAYQQMSRAHNPYGDGQACQRILEALRKNQVTL

SEQ ID NO: 7832 - protein, 420 aa, Xenorhabdus bovienii
  Peptide sequence Name=Xb4151_4152.C434.gene39.pep
  Gene classification: Gene name=WecC; Function=UDP-N-acetyl-D -mannosaminuronate dehydrogenase; Function class=M Cell envelope biogenesis, outer membrane
  Homolog annotation: Query=1..420bp; Hit=1..420bp; Blast score=674; Percent Identity=77.0; E value=0; Homolog= ZwecC COG0677
MSFETISVIGLGYIGLPTAAAFASRKKNVIGVDVNQHAVETINRGAIHIVEPDLDKVVKTAVEGGYLKAVTCPQAADAFLIAVPTPFKGEHEPDMAYVRSAAESIAPVLKKGDLIILESTSPVGATEQMAEWLAAARPELSFPQQAGENADIDIAYCPERVLPGQVMVELIKNDRVVGGMTLKSSRRASELYKIFLEGECVVTNAKTAEMCKLTENSFRDVNIAFANELSLICSEQGINVWELISLANRHPRVNILQPGPGVGGHCIAVDPWFIVSQNPAQSRLIHTARLVNDGKPLWVVDQVKAAVAGCLVESGKRADEIKIACFGLAFKPNIDDLRESPAVHITKMVAQWHVGQTVAVEPNVHELPNSLKESVELIDMQQALNEADVVLMLVDHSQFKAIAGREIKQKWVVDTKGVWR

SEQ ID NO: 7833 - protein, 358 aa, Xenorhabdus bovienii
  Peptide sequence Name=Xb4151_4152.C434.gene40.pep
  Gene classification: Gene name=RfbB; Function=dTDP-D-glucose 4,6 -dehydratase; Function class=M Cell envelope biogenesis, outer membrane
  Homolog annotation: Query=3..355bp; Hit=1..353bp; Blast score=598; Percent Identity=79.0; E value=1e-171; Homolog= ZrffG COG1088
LALKRILITGGAGFIGSAVVRHIINHTEDSVVVVDSLTYAGNLESLASVVDHPRYAFEQVDICQRDALDRVFQQYQPDAVMHLAAESHVDRSIDGPAAFIETNIMGTYVLLEASRAFWQQLDQEKQAAFRFHHISTDEVYGDLHGDEGFFTETTPYAPSSPYSASKASSDHLVRAWRRTYGLPTVITNCSNNYGPYHFPEKLIPLIILNALAGKPLPVYGKGEQIRDWLYVEDHARALHLVATTAEPGENYNIGGHNERRNIDVVETICELLEELRPVKPAGIVCYRDLITHVADRPGHDMRYAIDAAKIERELGWTPQETFESGIRKTVQWYLENENWWRRVQDGSYAGERLGLANE

SEQ ID NO: 7834 - protein, 293 aa, Xenorhabdus bovienii
  Peptide sequence Name=Xb4151_4152.C434.gene41.pep
  Gene classification: Gene name=RfbA; Function=dTDP-glucose pyrophosphorylase; Function class=M Cell envelope biogenesis, outer membrane
  Homolog annotation: Query=1..293bp; Hit=1..293bp; Blast score=486; Percent Identity=80.0; E value=1e-137; Homolog= rffH COG1209
MKGIILAGGSGTRLYPITRGVSKQLLPIYDKPMIYYPLSVLMLAGIRDILIISTSEDLPAFKRLLGNGEQFGIRLSYAVQPSPDGLAQAFIIGEEFIGNDACCLVLGDNIYFGQAFSPKLQSVVARQTGATVFGYQVMDPERFGVVEFDEQYRVLSIEEKPARPKSNWAVTGLYFYDNKVVDLAKQVKPSARGELEITSINQMYLERGELNVELLGRGFAWLDTGTHDSLIEASTFVQTVEKRQGFKIACLEEIAWRHGWLDDEQLKAAAAELAKTGYGKYLMDLLHVYSRQY

SEQ ID NO: 7835 - protein, 242 aa, Xenorhabdus bovienii
  Peptide sequence Name=Xb4151_4152.C434.gene42.pep
  Gene classification: Gene name=WecD; Function=Histone acetyltransferase HPA2 and related acetyltransferases; Function class=K Transcription
  Homolog annotation: Query=44..241bp; Hit=1..181bp; Blast score=171; Percent Identity=47.0; E value=9e-43; Homolog= wecD COG0454
MSIHANIEPLAWDSQFFGLSTARLNFSPQASVLTTAQLDEYALVQAKVPARQTDIIDGLSALGFSLVEGEADFLLPVDSGAMSYRNATGIQSEQALISATSQDIPVLTAAAASVFKASRFRVPWYQPDDSGRFYAAWVEKAVLGTFDHECLLVNDECGQIIGFVTLRDIGSHEARIGLLAALPGNYHRGIGKKLMSAAQRWCENHQIQRLRVATQISNITALRLYTRSGATIESTAYWLYRG

SEQ ID NO: 7836 - protein, 376 aa, Xenorhabdus bovienii
  Peptide sequence Name=Xb4151_4152.C434.gene43.pep
  Gene classification: Gene name=WecE; Function=Predicted pyridoxal phosphate-dependent enzyme apparently involved in regulation of cell wall biogenesis; Function class=M Cell envelope biogenesis, outer membrane
  Homolog annotation: Query=1..376bp; Hit=1..376bp; Blast score=617; Percent Identity=74.0; E value=1e-177; Homolog= wecE COG0399
MIPFNKPPVVGTELEYMQQAMGSGKLCGDGHFTKRCEEWMEQHFNCLKVLLTPSCTAALEMAAILLNIQPGDEIIMPSYTFVSTSNAFVLRGATIVFVDIRTDTMNMDETKIEAAITDQTRAIVPVHYAGVACEMDTIMALAEKYNLYVVEDAAQGVMSTYKGRALGTIGHIGCFSFHETKNYSSGGEGGAILINDESMIPRAEIIREKGTNRSQFFRGQVDKYTWRDIGSSYLLSDLQAAYLWGQLEIAENINQRRLSLWDNYYQALQPFAEAGHLTLPVVPEGLEHNAHMFYIKLKDVEERGAFNRYMQEANILTVFHYVALHTSPAGEKCGRFHGEDRFTTSDSERLVRLPMFYNITDEEQQVVINRIKEFFA

SEQ ID NO: 7837 - protein, 416 aa, Xenorhabdus bovienii
  Peptide sequence Name=Xb4151_4152.C434.gene44.pep
  Gene classification: Gene name=RfbX; Function=Membrane protein involved in the export of O-antigen and teichoic acid; Function class=R General function prediction only
  Homolog annotation: Query=1..416bp; Hit=1..416bp; Blast score=527; Percent Identity=72.0; E value=1e-149; Homolog= wzxE COG2244
MSLAKASVWTAGSTLIKIGVGLLVIKLLAVSFGPAGVGQAGNFRQLITVLGVLSGAGIFNGVTKYVAEHHQQPEKLRAILGTSSSIILGFSTLLAVIFLLFTDAISIGLFGHNNYKTVVQALALIQMGIAYANYFLSILKGFRDAQGNALSIILGSLTGMIAYGLCYWLGGYEGALAGLALVPALVVLPAGLMILRSKVITFSALKPMWDRVIASHLGKFTLMALLTSITLPVAYIMMRNLMAERYSWEEVGIWQGVSSISDAYLQFITASFTVYLLPTLSRLESKQEITGEIVKALKFVLPAVAAASFSVWLLRDFVIWLLFSDKFTAMRDLFAWQLVGDVLKVGAYVFGYLVIAKAALRFYVLTEISQFLLLAGFSHWLIPENGALGAAQSYMATYIIYFILCCSVFIIYRRRA

SEQ ID NO: 7838 - protein, 359 aa, Xenorhabdus bovienii
  Peptide sequence Name=Xb4151_4152.C434.gene45.pep
  Homolog annotation: Query=1..358bp; Hit=1..359bp; Blast score=514; Percent Identity=69.0; E value=1e-145; Homolog= gi|37528470|ref|NP _931815.1| 4-alpha-L-fucosyltransferase (TDP-Fuc4NAc:lipid II Fuc4NAc transferase) (Fuc4NAc transferase) [P
MTILIHVLGSDIPHHNQTVLRFFNDVLAQEMIFPAKPCFMVVSKDHTWLSNYPALAITVYGSKAALARAVIEKAQADRKTRFFFHGQFNAALWLALWVGKIKRHQFWWHAWGADLYEDSRQLKFRLFYQLRRLAQKRVGQVFATRGDLQYFSQSNPNVPSTLLYFPTRMEPSLIVTEKLCSPEGITILLGNSGDQSNRHIEALNKIHRQFGNEARVIMPMGYPGNNRAYVQNVEQTALSLFRAENVHILKNKMAFDDYLSLLRQCDLGYFIFNRQQGVGTLCLLIQFGIPFVLSRQNPFWHDLTEQQIPVLFDGDELNKHWVQEAQRQMLSLDKKAIAFFDPNFIEGWKAALSAALGEY

SEQ ID NO: 7839 - protein, 472 aa, Xenorhabdus bovienii
  Peptide sequence Name=Xb4151_4152.C434.gene46.pep
  Homolog annotation: Query=1..461bp; Hit=1..448bp; Blast score=635; Percent Identity=81.0; E value=0; Homolog= gi|37528469|ref|NP _931814.1| Putative ECA polymerase [Photorhabdus luminescens subsp. laumondii TTO1] gi|36787907|emb|CAE17024.1|
MTLAQFSGLFVVYVISLFFILTLTYQEFQRVRFNFNIFFSLLYLLTFYFGFPLTCMLVFHFEVQIVPVDALLYAMLASGCFYAIYYVSYKTRLRYKTPACKTASSSTPSSVVSRRPLFTMNRVETNLTWLLLASIAIFTVGSFFMQNGFLLFKLQSYSQIFSNQVSGVALKRFFYFFIPAMLVVFFLKPTKTRWLCFLVATVGFGILTYVIVGGTRANIILAFALFLFIGIVRGWITLWMLLLAGVIGIVGMFWLALKRYGLDVSGSEAFYTFLYLTRDTFSPWENLALLLDNYGKIDFQGLAPIARDFYVFIPSWVWPDRPNLILNTANYFTWDVLDNHSGLAISPTLIGSLVVMGGVFFIPFGAIVVGLIIKWFDWVYEAGKQESNRYKAAILQAFCFGAIFNIIVLAREGMDSFVSRVVFFCLVFGLCLVVAKLLYWLFESVGLVRKFVISNMPASQKISVIADVKEEK

SEQ ID NO: 7840 - protein, 245 aa, Xenorhabdus bovienii
  Peptide sequence Name=Xb4151_4152.C434.gene47.pep
  Gene classification: Gene name=WecG; Function=Teichoic acid biosynthesis proteins; Function class=M Cell envelope biogenesis, outer membrane
  Homolog annotation: Query=7..245bp; Hit=8..246bp; Blast score=350; Percent Identity=74.0; E value=6e-97; Homolog= wecG COG1922
MTLNNIPKYRIRGLSLWGFRGMSHFLDHLFQDGQVKTGTLVAINAEKVLTAEKDNVLNILLDEAEYLYADGISIVRAIRRKYPGAQVSRIAGADLWEALMERAGREGTPVFLVGGKPDVLAQTENKLRSQWSVNIVGSQDGYFTQEGRDAVFERIHASGAAIVTVAMGSPKQEIFMRDCRKVYSDALYMGIGGTYDVFTGHVKRAPKIWQNLGLEWLYRLLSQPSRIRRQIKLLKFLGYYYGGKL

SEQ ID NO: 7841 - protein, 54 aa, Xenorhabdus bovienii
  Peptide sequence Name=Xb4151_4152.C434.gene48.pep
LSISEIKNYKIESKPVSLCIVNSRQNGCMEWKKLARQVKPTISILITDVDTVGQ

SEQ ID NO: 7842 - protein, 32 aa, Xenorhabdus bovienii
  Peptide sequence Name=Xb4151_4152.C434.gene49.pep
MMSLFASRKLQELIINHCKKGRDQNTFCPSVK

SEQ ID NO: 7843 - protein, 459 aa, Xenorhabdus bovienii
  Peptide sequence Name=Xb4151_4152.C434.gene50.pep
  Gene classification: Gene name=AnsP; Function=Gamma-aminobutyrate permease and related permeases; Function class=E Amino acid transport and metabolism
  Homolog annotation: Query=1..445bp; Hit=1..445bp; Blast score=600; Percent Identity=75.0; E value=1e-172; Homolog= ZyifK COG1113
MSDSKQSLQRGLEARHIELIALGGTIGVGLFMGSASTLKWAGPSVLLAYIIAGIFVFFIMRSMGEMLFLEPVTGSFAAFGHKYLSPYWGCLTAWGYWFMWVSVGISEITAVGVYAEFWFPDLPQWVSALVAVGLVALANLAAVRLYGELEFWFAMIKVTTIIVMILIGIGLIFFGLGNDWQPIGLDNLTAHGGFFSGGWKGFLFALCIVVASYQGVELVGITAGEAKNPQVTLKKAINNILWRILIFYVGAIFIVVTLFPWTEAGTHGSPFVMVFSKVGIASAAAVINFVVLTAALSGCNSGMYSGGRMLYALAKNRQLPASLLKLSKNGVPVRCIAITIGCLIAGSSLNYLIPNPQSVFVYVYSASVLPGMVPWFVILVSQLRFRQQNQEALKQHRFKSLLFPYVNYLTLVFLSCVLIGMAINPDTRFSLMVGGAFLLLVSLAYWLGKFICDKRKIVR

SEQ ID NO: 7844 - protein, 31 aa, Xenorhabdus bovienii
  Peptide sequence Name=Xb4151_4152.C434.gene51.pep
LKCNQTNLFLKKSTGQFDIKSVLSSTATALS

SEQ ID NO: 7845 - protein, 39 aa, Xenorhabdus bovienii
  Peptide sequence Name=Xb4151_4152.C434.gene52.pep
MTKRNEGLFDSWEITVRNSISTRNAKRKSPAICRAFSES

SEQ ID NO: 7846 - protein, 56 aa, Xenorhabdus bovienii
  Peptide sequence Name=Xb4151_4152.C434.gene53.pep
VHHANLRIQAKKNTYQKRQVYKYNQVYRRIVPHSTLCPVGDEKTKCLFIYNVDHRH

SEQ ID NO: 7847 - protein, 401 aa, Xenorhabdus bovienii
  Peptide sequence Name=Xb4151_4152.C434.gene54.pep
  Gene classification: Gene name=HemY; Function=Uncharacterized enzyme of heme biosynthesis; Function class=H Coenzyme metabolism
  Homolog annotation: Query=1..394bp; Hit=1..393bp; Blast score=454; Percent Identity=63.0; E value=1e-128; Homolog= hemY COG3071
MLKVLLLFIILIVGVVLGPVLSGHQGYVLIQTDNHNITTSVTAMVIMFVLLQFLLILIGWCYRRLKRTSTFTHSWLFGGYKRSRARLQTKQALLKLAEGDFKQVEHLMTRNADHAESPVVNYLLAAEAAQQRGDYHRTIQYIERAAEVADKDQLPVDITRVRIQLAQGEVHAARNGVDKLLNHAPRHPEVLRLAEQAYTQSGAYQSLIDILPSLIKVGLCDEEHIHQLRQQAYIGLMNQIMAEKGSTGLKAWWKDQNRKLRNDIVLQVAMAEHLIECNDHDTAQQIVLNGLKQQYDERLLLLIPHLKADETEALQKSLAYLLKRHGATPLLNSTLGQVALHHSQWAEAETAFKAALVQRPDAHDYAWLADALDKQHKREEAAQTRSKGFMLTLKRESDAEE

SEQ ID NO: 7848 - protein, 398 aa, Xenorhabdus bovienii
  Peptide sequence Name=Xb4151_4152.C434.gene55.pep
  Gene classification: Gene name=HemX; Function=Uncharacterized enzyme of heme biosynthesis; Function class=S Function unknown
  Homolog annotation: Query=4..367bp; Hit=1..367bp; Blast score=304; Percent Identity=50.0; E value=1e-82; Homolog= ZhemX COG2959
MSIMTEQKQSTDAVETKHPQQPETAPHKPKRCGWVGNTLSVAIMLAIGAGGVYLYHHGKQQNAVLTAENLALQQQVASLVQQQSGDKQDFATQFQKLESDLQQAKLQNKQTDSRMVELQTRISEISNTDLENWRLTQANYLVKMAGRKIWTEQDTTTAIALLKDADQSLAEMDDPSLLHVRQAIMEDINTLSKINQLDLDGIILTLNRLSNQIDNLRLEDNGEQEAPMDEGDTGISASLSDWRKNLSKSWDSFMENFITIKRRDSSAVPLLAPNQDVYLRENIRSRLLVAAQAVPRHQNEVYKQSLEAVSSWVRSYFDTASSDTKTFLQDIDSLAQKPLSIELPEHLSSQPILADLMRKRIYNLPHQSDTQVQPQSEVQPQPKPAETSGQAATPVQEG

SEQ ID NO: 7849 - protein, 246 aa, Xenorhabdus bovienii
  Peptide sequence Name=Xb4151_4152.C434.gene56.pep
  Gene classification: Gene name=HemD; Function=Uroporphyrinogen-III synthase; Function class=H Coenzyme metabolism
  Homolog annotation: Query=1..246bp; Hit=1..246bp; Blast score=246; Percent Identity=51.0; E value=2e-65; Homolog= ZhemD COG1587
MSILITRPDPAGEQLAKRLRAMGKIAFSAPLITIYPGGDLPLLSQKLQRLSAGDLVFLLSKNAVHYANEQLLQEGLSWPDKLSYYGIGKSTSLMFHQKTGLEILWPEQGETSEDLLQLPILQRVNDKKILLLRGNGGREVIASTLINRGGKVDYCECYSRQPIKYHVADFSRHWQQYGIKTLVVTSGEMLQLLYNLATDDDGKAWLLSCYLIVVSERLANIAQTLGWQTIKVAKSADNDALMQALE

SEQ ID NO: 7850 - protein, 311 aa, Xenorhabdus bovienii
  Peptide sequence Name=Xb4151_4152.C434.gene57.pep
  Gene classification: Gene name=HemC; Function=Porphobilinogen deaminase; Function class=H Coenzyme metabolism
  Homolog annotation: Query=3..310bp; Hit=12..319bp; Blast score=447; Percent Identity=75.0; E value=1e-126; Homolog= ZhemC COG0181
MKIIRIATRQSPLAMWQAQYVQKQLEQFHPELKVELIPMVTRGDVILDTPLAKVGGKGLFVKELELALLENRADIAVHSMKDVPVEFPDGLGLVTICERGDPRDAFVSVKYTSLDELPIGSIVGTSSLRRQCQLRQLRPDLVVRDLRGNVGTRLGKLDNGDYDAIILAAAGLKRLGLEDRIRMPLEPELLLPAVGQGAVGIECRLDDKQTRELLAPLNHTGTEICVLAERAMNTHLEGGCQVPIGSYAIWQGNNIWLRALVGAPDGSITVRGEKTVSPEEARRAGVELAEELLEKGARQILADVYQRNPPE

SEQ ID NO: 7851 - protein, 30 aa, Xenorhabdus bovienii
  Peptide sequence Name=Xb4151_4152.C434.gene58.pep
MLKLTLSSRNLAAQKPLNTVINTIIQYNYQ

SEQ ID NO: 7852 - protein, 38 aa, Xenorhabdus bovienii
  Peptide sequence Name=Xb4151_4152.C434.gene59.pep
MTFKNFYKIIVGNVINLTPCSRSVKYAIPPFRPLRNRR

SEQ ID NO: 7853 - protein, 866 aa, Xenorhabdus bovienii
  Peptide sequence Name=Xb4151_4152.C434.gene60.pep
  Gene classification: Gene name=CyaA; Function=Adenylate cyclase; Function class=F Nucleotide transport and metabolism
  Homolog annotation: Query=1..836bp; Hit=1..835bp; Blast score=1345; Percent Identity=75.0; E value=0; Homolog= cyaA COG3072
LYLYIETLKQRLDAINQLKLERATSSMSPVFKQVYNLIPVLLHYHHPMMPGYIKSNVPHGVCFFTPDESQQFWINDLACQSADILSLAPNGELPITGIYSMGSTSSIGQSCSSDLDIWICHQSWLDHNEKALLEQKCTLIEQWAGSLGIEVTFFLVDENRFRHNACGSLNGEDCGTTQHILLLDEFYRTAVCMAGKRLLWMMVPVEEEGQYDEYVLSLYAQGVLTPNEWLDLGGLSELSAEEYFGASLWQLYKSVDSPYKAVLKSLLLEAYSWEYPNGKLLSMEMKQHFHDGSIVSFGLDSYSMMLERVTRYLTATNDFTRLDLARRCFYLKVCEKMLESHEDKGCTGWRHQVMSQLAHEWGWDAGKLAMLDNRNSWKIGLVRDAHNELLDTMMMSYRNLIRFARRNNLSVSASPQDIGVLTRKLYAAFEALPGKVTLVNPQISPDLTEQDLTFIYVPPGRVNRSGWYLYNHAPTIESIIGHQPLEYNRYLNKLVAWTYFNGLLTKKSRIHIHHGKSQCDRNNLCDLVNDIATHFPIRLPAPTPKALYSPCEIRHLAIIVNLEKDPTTDFSNRIVHFDFRKLDVFSFGELQQCLVGSIDLLYRNSWNEVRTLHFSGEQSMLEALKTILGKMHQDAAPPAEVDVFCYSEHLRGLIRTRVQQLVSECIELRLCSNRQDPNRFKALRISGQTWGLFFERLNVSVQKLENAVEFYGAISNTKLHGLPVKIDNKEKHLPPVIDGFACEGIIQFFFEDIEKSQGFNIYILDESNRVEIYSHCEGSKEELVCDVSRFYSSSHDRFTYGSSFINFNLPQFYQIIRKGERTHVSPFIDGVFPPDNTKLNDTAYSVDVLLDDSCRSHDPCHSLYPY

SEQ ID NO: 7854 - protein, 36 aa, Xenorhabdus bovienii
  Peptide sequence Name=Xb4151_4152.C434.gene61.pep
LLYFIFYILYYCNWFYGDLQRLGLWKVIKMPYFNTA

SEQ ID NO: 7855 - protein, 48 aa, Xenorhabdus bovienii
  Peptide sequence Name=Xb4151_4152.C434.gene62.pep
VVTIFYPCWNSRSQNRVANHFSFRICFATTQIIYRLCRIEIRHFYYLP

SEQ ID NO: 7856 - protein, 107 aa, Xenorhabdus bovienii
  Peptide sequence Name=Xb4151_4152.C434.gene63.pep
  Gene classification: Gene name=CyaY; Function=Protein implicated in iron transport, frataxin homolog; Function class=P Inorganic ion transport and metabolism
  Homolog annotation: Query=3..107bp; Hit=1..105bp; Blast score=138; Percent Identity=70.0; E value=1e-33; Homolog= ZcyaY COG1965
MNMNDSEFHQLADQLMQRIEEQLDNYDGDADIDCETNGGVMTLTFENGSKIIINRQEPFHQIWLATKSGGYHFDYQENRWICDRSGNDFLSMLEQSITEQSGESFQF

SEQ ID NO: 7857 - protein, 31 aa, Xenorhabdus bovienii
  Peptide sequence Name=Xb4151_4152.C434.gene64.pep
LIGQLMKFAIVHVHFLFAFQGLTAIIESIDA

SEQ ID NO: 7858 - protein, 59 aa, Xenorhabdus bovienii
  Peptide sequence Name=Xb4151_4152.C434.gene65.pep
MKKQFRWSLAIITLLAVSGCGLKGPLYFPPAEPTVTQAPADQENKAQPEHNTQSDTQQK

SEQ ID NO: 7859 - protein, 301 aa, Xenorhabdus bovienii
  Peptide sequence Name=Xb4151_4152.C434.gene66.pep
  Homolog annotation: Query=93..301bp; Hit=88..284bp; Blast score=63; Percent Identity=27.0; E value=5e-09; Homolog= gi|23485103|gb|EAA20211.1| hypothetical protein [Plasmodium yoelii yoelii]
MTDALSLAIHVPFHQGDTFTHRMRNAYLIDSIGIADKKLRIIQQIIHYRLIIQPIFQVQWIVIFTHFPMPHISIMTQIKLNPSQMNRTFINVSCRPYHIEWLARPVPANLQETTRQINANLTIQQILLDTDGDGCTCTAATSPCLSCTTFKDTQSNMTTIHDLHETNIRPLRKTVMIFQYWPQNLHFCGVDIFNLYHTMRISHRHDTAEHGAFNGTDNIGFLRLNGTKRNMLWFKVRFSHIDTDLIIIGDAQYHPACLRTDLNITLIGQSFQANKTGKAARSVATLGNFTTISIKNAIVKV

SEQ ID NO: 7860 - protein, 234 aa, Xenorhabdus bovienii
  Peptide sequence Name=Xb4151_4152.C434.gene67.pep
  Gene classification: Function=Uncharacterized BCR; Function class=S Function unknown
  Homolog annotation: Query=14..234bp; Hit=15..235bp; Blast score=250; Percent Identity=57.0; E value=7e-67; Homolog= yigA COG3159
MGKNDDPLHLENWLNDQAVVDYLLNNPEFFIRNANRVDKIRVPHPVRECVSLMEWHMDRQRKRICHLEDDLLHLVEQAKQNEILFCRLLQLLADLSAAKSLQDFLSRLSSWSKTFGLSNSYVRLFSDKWRLGAPLNAPELAISRHIFEPVRIQRFGDSNHYLGTLYGPEILLLIPQARYVGSVAISLLGSRGELGMVIFNSRNKQHYHEGVGTDLLDHLAKLLPELLSRWVERV

SEQ ID NO: 7861 - protein, 304 aa, Xenorhabdus bovienii
  Peptide sequence Name=Xb4151_4152.C434.gene68.pep
  Gene classification: Gene name=XerC; Function=Integrase; Function class=L DNA replication, recombination and repair
  Homolog annotation: Query=12..303bp; Hit=8..298bp; Blast score=416; Percent Identity=70.0; E value=1e-116; Homolog= ZxerC COG0582
MTQPLDLLLEPVETFLHYLRVERRLSPLTITNYRRHLVVLASMSLDMGIHEWQALDPAKVRMFASRSRRAGLQSASLALRLSSLRTFLDWMVIQGELDANPAKAVSAPRKKRHLPKNMDVDEVNQLLNINLNDPLSVRDRTMMEVMYGAGLRLSELVGLDCRHLELASGEVWVQGKGSKERKVPVGRIALEWLQRWLEMRELFEPEDNAVFISTKSGKRISARNVQKRFEQWGVRQGVNSHIHPHKLRHSFATHILESSGDLRAVQELLGHANLSTTQIYTHLDFQHLAKVYDVAHPRAKRGKS

SEQ ID NO: 7862 - protein, 238 aa, Xenorhabdus bovienii
  Peptide sequence Name=Xb4151_4152.C434.gene69.pep
  Gene classification: Function=Predicted hydrolases of the HAD superfamily; Function class=R General function prediction only
  Homolog annotation: Query=1..238bp; Hit=1..238bp; Blast score=281; Percent Identity=59.0; E value=3e-76; Homolog= yigB COG1011
MRFYRPLAPFAAMTFDLDDTLYDNHPVIDKTEKEVLCFIRQYDVKFNHFEREDLYVYRQAVLESEPEIYHDVTSWRRQSVELMFSHHGFNREETLRGADELMSCFTYWRNQIIVPESTYNTLSVLAKKIPLVAITNGNAEPAACGLEPYFEFVLKAGVDGRAKPYPDMYHLAAERLNLPISQILHVGDNLKTDVEGALCSGMQACWINLENRNLMQEPEGRRVPHVEISDLASLIALI

SEQ ID NO: 7863 - protein, 34 aa, Xenorhabdus bovienii
  Peptide sequence Name=Xb4151_4152.C434.gene70.pep
LFIIQAFEQIRNVHNYHQLRTVTFVTVFFIQITI

SEQ ID NO: 7864 - protein, 724 aa, Xenorhabdus bovienii
  Peptide sequence Name=Xb4151_4152.C434.gene71.pep
  Gene classification: Gene name=UvrD; Function=Superfamily I DNA and RNA helicases; Function class=L DNA replication, recombination and repair
  Homolog annotation: Query=4..722bp; Hit=1..719bp; Blast score=1252; Percent Identity=85.0; E value=0; Homolog= ZuvrD COG0210
MVIMDVSYLLESLNDKQREAVTASRTNMLVLAGAGSGKTRVLVHRIAWLLSVENASPFSIMAVTFTNKSAAEMRHRIENLIGTSQGGMWIGTFHSLAHRLLRFHHLDANLPQDFQILDSEDQHRLIKRIIKAMNLDDKQWPARQGMWYINGKKDEGLRPQHIEIYGNPVETTWMKIYQAYQEACDRAGLVDFAELLLRAHELWLNKPQILQHYRERFTNLMVDEFQDTNSIQYAWIRLLAGDSGKVMIVGDDDQSIYGWRGAQVENIQRFLRDFPAAETIRLEQNYRSTSNILKAANALIANNNDRLGKSLWTEGGEGEPIALYCAFNELDESRYVVSRIKHWLDNGGALKECAILYRSNAQSRVLEEALLQVSMPYRIYGGQRFFERQEIKDALSYLRLVSNRYDDSAFERVVNTPTRGIGDRTLDVVRQVARDQQKTLWESCLLLLQQKVLAGRAASALQRFIELIDALETETQEMPLHVQTDRIIRDSGLWAMYQQEKGEKAQARIENLEELVTATRQFSFKDEDEDLMPLQAFLSHAALEAGEGQADVYQDAVQLMTLHSAKGLEFPQVFIVGMEEGMFPSQMSLDEGGRLEEERRLAYVGVTRAMQKLTLTYAETRRLYGKAVYHRPSRFVGELPTECVAEVRLRATVSRPVSHKQLGTPISAGDSGYALGQRVHHPKFGEGTIINIEGSGEHCRLQIAFQGEGIKWLVAAYARLETGQ

SEQ ID NO: 7865 - protein, 316 aa, Xenorhabdus bovienii
  Peptide sequence Name=Xb4151_4152.C434.gene72.pep
  Gene classification: Gene name=CorA; Function=Mg2+ and Co2+ transporters; Function class=P Inorganic ion transport and metabolism
  Homolog annotation: Query=1..316bp; Hit=1..316bp; Blast score=514; Percent Identity=84.0; E value=1e-146; Homolog= corA COG0598
MLNAFKLENNRLLRLELENGDQLSDSMWVDLVGLGDEDRLRVQNELGQVLATRTELDDIEASARFFEDEDGLHVHSFFYFEDAEDHAGNSTVAFTIRDSRLYTLRERELPAFRLYRMRARNQTMVDGNAYELLLDLFETKIEQLADVIENIYSVLESLSRVIMEGKQGDEFDSALSNLAEQEDIGWKVRLCLMDSQRALNFLVRRARLPANQLEQAREILRDIESLLPHNESLFQKVNFLMQAAMGFINIEQSRIIKIFSVVSVVFLPPTLVASSYGMNFEFMPELHWTFGYPAAIGVMIAAGLAPYLYFKRKNWL

SEQ ID NO: 7866 - protein, 296 aa, Xenorhabdus bovienii
  Peptide sequence Name=Xb4151_4152.C434.gene73.pep
  Gene classification: Gene name=RarD; Function=Predicted permeases; Function class=R General function prediction only
  Homolog annotation: Query=1..293bp; Hit=1..293bp; Blast score=328; Percent Identity=62.0; E value=5e-90; Homolog= ZrarD COG2962
MTDQQTAKGVLYALGAYLIWGLAPIYFKTIQQVPPDEIVSHRVIWSVFFMVLLLTLTRHWRKVWVVARQPKKLLLLGITAFTIASNWLVYIWAVNNGHLLEASLGYFINPLVNVLFGMIFLGERFRRMQWVAVGLAFTGVLIQLWQFGSVPVVGLYLAMTFAVYGLIRKKLGVDAQTGMMIETVWVFPVAMVYLLCFTSSPTSNMLDNTLSLNMLLIAAGIITTVPLLFFTAAAAHLRLSTLGFFQYLGPTLMFLLATLVYGEQIGPERLITFGFIWAALILFTLDALYTQHRLRK

SEQ ID NO: 7867 - protein, 43 aa, Xenorhabdus bovienii
  Peptide sequence Name=Xb4151_4152.C434.gene74.pep
VAKFYSSLTALTPCKSFIPVTHCMSANNSQALLILFYIQGYYD

SEQ ID NO: 7868 - protein, 30 aa, Xenorhabdus bovienii
  Peptide sequence Name=Xb4151_4152.C434.gene75.pep
LYLLKNNSLYLYNLTHFSSQSLCVQKWIKK

SEQ ID NO: 7869 - protein, 58 aa, Xenorhabdus bovienii
  Peptide sequence Name=Xb4151_4152.C434.gene76.pep
  Homolog annotation: Query=1..44bp; Hit=1..44bp; Blast score=61; Percent Identity=56.0; E value=4e-09; Homolog= gi|32307204|gb|AAP74963.1| InsAB' protein [Klebsiella oxytoca]
MAKIDVTCPSCCAVKGGHRNGRSRSGHQRYLCQSCRHSWQREFTDASDGATGMKCKLF

SEQ ID NO: 7870 - protein, 388 aa, Xenorhabdus bovienii
  Peptide sequence Name=Xb4151_4152.C434.gene77.pep
  Gene classification: Gene name=AraJ; Function=Arabinose efflux permease; Function class=G Carbohydrate transport and metabolism
  Homolog annotation: Query=3..346bp; Hit=6..350bp; Blast score=127; Percent Identity=30.0; E value=3e-29; Homolog= BS_ybcL COG2814
MKKIIFLAIGMFALGFDAYIIAGLVPGISETYQKSASQIGQSVSIFTLCYAISAPLFASLLAGKPIKKVLLTAIVIFGLANALTALSPNFSVFLISRAIAGVGAGLFSPLAVAGSTLLVPIDKKGRALGLTIGGMSMGTVLGVPIGLYIADQFNWQSAMWFVVILSFIAALSILKFLPHVPVTAPPAITERIAMFLDKRVTITVLITFFASIASLGLYTYLSPLLQDINDSNNLTMYLWAWGLGGLFGSLSIGYIIDYFKKPKILMAFILIILMISVMCIPIMINLSFIKYLPFFIWGAMGWASGAPQQHILLSYQPKHGSAAIALNSSINYLGSSVGAIIGGVVISLGMGTMVLIYFAVFSMVISLGLQFYSMKSNDFKIINTESSQ

SEQ ID NO: 7871 - protein, 79 aa, Xenorhabdus bovienii
  Peptide sequence Name=Xb4151_4152.C434.gene78.pep
VPFKMRKFTYGDFIKTRGIFRLFYNKINDFIFLLWESIKSITQPNTSPLRWRYAPAAHCAVQFWQLILCCHYGRYCCWR

SEQ ID NO: 7872 - protein, 161 aa, Xenorhabdus bovienii
  Peptide sequence Name=Xb4151_4152.C434.gene79.pep
  Gene classification: Gene name=PaaI; Function=Uncharacterized protein, possibly involved in aromatic compounds catabolism; Function class=Q Secondary metabolites biosynthesis, transport and catabolism
  Homolog annotation: Query=11..161bp; Hit=11..161bp; Blast score=200; Percent Identity=63.0; E value=4e-52; Homolog= yigI COG2050
METIQRSTQPLTQEEARKIIGDLFVYHMPFNQLLGFELLRFDHDYAELQFRNQDKLVGNMAQKILHGGVIASILDVAGGLICAGNALTAMETITIAEMEKRLPTIGTIDLRIDYLRPGRGEVFTASSNIVRSGNKVSVARIELHNERQVHIASAMATYLVG

SEQ ID NO: 7873 - protein, 43 aa, Xenorhabdus bovienii
  Peptide sequence Name=Xb4151_4152.C434.gene80.pep
MVNNLLSLCFYNSSYQFAKHLEKQFIEGKLTTENHHSVCRINR

SEQ ID NO: 7874 - protein, 45 aa, Xenorhabdus bovienii
  Peptide sequence Name=Xb4151_4152.C434.gene81.pep
MVSMPKRIFPKSSSIMDSPYPLKSLGIKTAIPKLKRHLFILHTEW

SEQ ID NO: 7875 - protein, 38 aa, Xenorhabdus bovienii
  Peptide sequence Name=Xb4151_4152.C434.gene82.pep
MTSAVDTPSLNHLKKTGSKKYRRDSGACTYYAISLLKQ

SEQ ID NO: 7876 - protein, 612 aa, Xenorhabdus bovienii
  Peptide sequence Name=Xb4151_4152.C434.gene83.pep
  Gene classification: Gene name=RecQ; Function=Superfamily II DNA helicase; Function class=L DNA replication, recombination and repair
  Homolog annotation: Query=5..610bp; Hit=3..607bp; Blast score=983; Percent Identity=78.0; E value=0; Homolog= ZrecQ COG0514
LREGVSTAEVISTASLAEQVLRKTFGYQQFRPGQQQVIDAVLDGRDCLVVMPTGGGKSLCYQIPALINNGLTLVVSPLISLMKDQVDQLRANGVEAECLNSTQNREQQVDIIQRCRQGSIKLLYIAPERLVTDNFLDQLHDWHPVLLAVDEAHCISQWGHDFRPEYRALGQFRRRFPELPFIALTATADKTTRQDITRLLELHDPLIHLSSFDRPNIRYTLVEKYKPLDQLWSFVRGQQGKSGIIYCNSRTKVEETAERLQKRGLSVAPYHAGLDNNQRAWVQDAFQRDDLQVVVATVAFGMGINKPNVRFVVHFDIPRNIESYYQETGRAGRDGLPAEAILFFDPADMAWLRRCLEEKPAGEQQDIERHKLNAMGAFAEAQTCRRLVLLNYFGESQQTSCGNCDICLDPPKRYDGLMDAQKALSCIYRVGQRFGIGYIVEVLRGANNQRIRDFGHDKLPIYGIGKEQSQEHWMSVLRQLVHLGLISQNIANYSALQLTEAARPVLRGEASLQLAVPRIQSLKSRNQQNKSYSGNYDRKLFAKLRKLRKSIADENNIPPFVVFNDVTLIEMAEQCPITPNELLLINGVGQRKLERFGDVFMALIRDHFEGFE

SEQ ID NO: 7877 - protein, 336 aa, Xenorhabdus bovienii
  Peptide sequence Name=Xb4151_4152.C434.gene84.pep
  Gene classification: Gene name=PldB; Function=Lysophospholipase; Function class=I Lipid metabolism
  Homolog annotation: Query=10..336bp; Hit=8..329bp; Blast score=370; Percent Identity=55.0; E value=1e-102; Homolog= ZpldB COG2267
MAPEILKASWLNREPQFSAFTNGLLLDFWKTRDEREFMGVDDIPIRYVSFRSLHHDKTLLILPGRSESYVKYPEIAYDFYHLGYDIFIIDHRGQGRSGRMLDDPQKGHVEKFDHYVDDLAKFVELEITPRQSHGYYALAHSMGAAILSRFLLRQELVRQEPDFRAVALCAPMFGINLPMPRWLANFLVNQAEPYPKRRNSYAVSTGQWRPLPYLINLLTHSYARYQRYLRYYADYPELRLGGPTYHWMRESMQMGDELIENAGVIQTPLIVLKASEDKIVNNRELLAFCESRQKAGTGKAGRKPLVIQGAHHEILFEKDALRAQALNAICDFFDQH

SEQ ID NO: 7878 - protein, 266 aa, Xenorhabdus bovienii
  Peptide sequence Name=Xb4151_4152.C434.gene85.pep
  Gene classification: Gene name=Cof; Function=Predicted hydrolases of the HAD superfamily; Function class=R General function prediction only
  Homolog annotation: Query=1..264bp; Hit=40..303bp; Blast score=362; Percent Identity=64.0; E value=1e-100; Homolog= Z5347 COG0561
MYHVVASDLDGTLLSPDHKLTPYTKETLNLLMNKGIHFIFATGRHHIDVGQIRDGLGIDAYMITSNGARVHNTQGKLVFSHNLAPEIALDLCLMEFDNPNTLTNYYRNDDWFINRESPEQNEFFQESVFQYQIFPRDNFPTDGVCKVYYVSEDHDYLEQLEETIKARWGDSVNVSFSLRNCLEVMAGGVSKGHALEQVCQAIGYQLSDCIVFGDGMNDQEMLSVAGKGCIMQGAHQRLKDILPEMEVIGANADDAVSYYLRNMYQV

SEQ ID NO: 7879 - protein, 38 aa, Xenorhabdus bovienii
  Peptide sequence Name=Xb4151_4152.C434.gene86.pep
MARKKQHPIRCCSQSTFRTITIRLDTCSANSMKRHHQH

SEQ ID NO: 7880 - protein, 49 aa, Xenorhabdus bovienii
  Peptide sequence Name=Xb4151_4152.C434.gene87.pep
MLKIGTKASKNHQPERLVSWRRRITTASEGIKITGDVLSSGLRIQWSMS

SEQ ID NO: 7881 - protein, 51 aa, Xenorhabdus bovienii
  Peptide sequence Name=Xb4151_4152.C434.gene88.pep
  Gene classification: Function=Uncharacterized membrane protein; Function class=S Function unknown
  Homolog annotation: Query=1..48bp; Hit=66..114bp; Blast score=57; Percent Identity=61.0; E value=2e-09; Homolog= yhaI COG3152
VVIRRLHDTNRSGWWFLLAFVPILSIALLVFFCLEGSKGNNDFGADPKGML

SEQ ID NO: 7882 - protein, 33 aa, Xenorhabdus bovienii
  Peptide sequence Name=Xb4151_4152.C434.gene89.pep
LLNVVFSLNKCPYHFVMHLFRFRVADCFSIQPF

SEQ ID NO: 7883 - protein, 66 aa, Xenorhabdus bovienii
  Peptide sequence Name=Xb4151_4152.C434.gene90.pep
MAKVDVHYRYCHKPEDVKGHGKGNEGYSRYRFCPPLTFGSTARMIMLFIIALWKKTILLERCLPNE

SEQ ID NO: 7884 - protein, 47 aa, Xenorhabdus bovienii
  Peptide sequence Name=Xb4151_4152.C434.gene91.pep
MFHHKKAGVITTTNHSIHDPISLLSVVASVEFSGSNQDLCIKFWVSP

SEQ ID NO: 7885 - protein, 93 aa, Xenorhabdus bovienii
  Peptide sequence Name=Xb4151_4152.C434.gene92.pep
MISKTIVLSALIVFSMSAAYASQEKTGCEIKKKTLEKQLKYAQADGDKRLIAGLTRTLESIKATCELEKRLKYPQHNPEPTKDRLKKVQTKKK

SEQ ID NO: 7886 - protein, 178 aa, Xenorhabdus bovienii
  Peptide sequence Name=Xb4151_4152.C434.gene93.pep
  Homolog annotation: Query=7..174bp; Hit=15..184bp; Blast score=117; Percent Identity=39.0; E value=7e-26; Homolog= gi|37524174|ref|NP _927518.1| hypothetical protein [Photorhabdus luminescens subsp. laumondii TTO1] gi|36783597|emb|CAE12447.1
MMFVHVANKNIIIIFALILGISIVFLSFNNSRLSLIGYVDKHCQKNTACLIDVNKITSFDWDKMYIIDKGMGREDIEYIIGAAFTGKASLFYKIIFVKNQKVIYSDEYYPHAESYEKKFLKPDFNYPYDVTGNDFIYYAISRDNSILSVEIENKPFMGDKVYYKISPSNAQQVRGRSL

SEQ ID NO: 7887 - protein, 30 aa, Xenorhabdus bovienii
  Peptide sequence Name=Xb4151_4152.C434.gene94.pep
MDKHHSPFIIKFDMRKRFLEFYPWQSTHYY

SEQ ID NO: 7888 - protein, 48 aa, Xenorhabdus bovienii
  Peptide sequence Name=Xb4151_4152.C434.gene95.pep
LLHYLQATVLQLLFNLLSATYKIKNSTPFLFFLHLKNTIIGALYSEKV

SEQ ID NO: 7889 - protein, 82 aa, Xenorhabdus bovienii
  Peptide sequence Name=Xb4151_4152.C434.gene96.pep
LCLGACQGNDFSYNALPVPMKNFNSTAYRKYYTKSTIHRYVSGNSSVGRARPCQGRGREFESRFPLQFLLCKPPRKSAFLSH

SEQ ID NO: 7890 - protein, 39 aa, Xenorhabdus bovienii
  Peptide sequence Name=Xb4151_4152.C434.gene97.pep
LLSWFTTASTLSRNKKCVWCTRFTIINLWIDDETDFLLI

SEQ ID NO: 7891 - protein, 181 aa, Xenorhabdus bovienii
  Peptide sequence Name=Xb4151_4152.C434.gene98.pep
  Gene classification: Gene name=Orn; Function=Oligoribonuclease (3' ->5' exoribonuclease); Function class=F Nucleotide transport and metabolism
  Homolog annotation: Query=1..180bp; Hit=24..203bp; Blast score=317; Percent Identity=83.0; E value=3e-87; Homolog= orn COG1949
MSKSENNLIWIDLEMTGLEPERDRIIEIATIVTDSELNILAEGPVIAVYQPDEQLALMDDWNVRTHTASGLVERVKQSQFGDAEAEKATIAFLEQWVPAGKSPICGNSVGQDRRFLFRYMPELEKYFHYRYLDVSTLKELARRWKPEMLSGFSKKNTHQALDDIRESIAELVYYREHFIQK

SEQ ID NO: 7892 - protein, 356 aa, Xenorhabdus bovienii
  Peptide sequence Name=Xb4151_4152.C434.gene99.pep
  Gene classification: Function=Predicted GTPases; Function class=R General function prediction only
  Homolog annotation: Query=14..353bp; Hit=1..334bp; Blast score=522; Percent Identity=74.0; E value=1e-148; Homolog= ZyjeQ COG1162
VAKNKLSKGQQRRVQANHQRRLKQPLNKAGTHKPEMDDSLFGEPQEGLVISRFGQHADIEAADASIQRCNIRRTIRSLVTGDRVVWRPTLQLQTDVKVNGIVEAVHERTSVLTRPDYYDGIKPIAANINQIMIVSAILPELSLNIIDRYLVACETLNIEPLIVLNKIDLLDAESRAWVNSVMDIYRHIGYRVLEVSSHTGEGVSELVSQLVDKISIFAGQSGVGKSSLLNTLLPDNEKDILVNEVSDNSGLGQHTTTTARLYHFPQGGDVIDSPGVREFGLWHLTPEQVTQGFIEFREYIGECKFRDCKHQTDPGCALNAALEQGAIAEERFENYHRILESMAQVKPRRNFTDGQK

SEQ ID NO: 7893 - protein, 328 aa, Xenorhabdus bovienii
  Peptide sequence Name=Xb4151_4152.C434.gene100.pep
  Gene classification: Gene name=Psd; Function=Phosphatidylserine decarboxylase; Function class=I Lipid metabolism
  Homolog annotation: Query=21..314bp; Hit=1..298bp; Blast score=408; Percent Identity=64.0; E value=1e-114; Homolog= psd COG0688
MAGTIVDFCPICLSKIQEVDVLDNIKIKLQYLLPKQCITNLAGWFANKKAGWLTQFAIQSFAKVYKVDMNEAENSSFTAYSTFNEFFVRPLKEGIRPIVNEAHQLALPADGTISQLGMIRDDQIIQAKGHYYTVEALLAGQHQLAEQFRNGHFVTTYLSPKDYHRVHMPCDGVLQEMIYVPGELFSVNPLTAANVPNLFARNERVICLFDTAFGPMVQILVGATIVGSIETVWSGCVTPPREGIIKRWAYPAAGQEGAISLKKGEEMGRFKLGSTVINLFAPNQIQFANNLYSGSQTLMGDLLAQSVTANEEQAANADDESINKDIIS

SEQ ID NO: 7894 - protein, 1114 aa, Xenorhabdus bovienii
  Peptide sequence Name=Xb4151_4152.C434.gene101.pep
  Gene classification: Function=Small-conductance mechanosensitive channel; Function class=M Cell envelope biogenesis, outer membrane
  Homolog annotation: Query=1..1114bp; Hit=1..1107bp; Blast score=1238; Percent Identity=60.0; E value=0; Homolog= yjeP COG3264
VRLIISLLFSLFLANPAFASIAQLDETQLKQELKQVGGSKNPQDAEIAQALQGAINWLNDAKSTDERSQTYQQTIDDFPKIIKELRQKTLTESDIVPSIPANQSIGELEQQTLQTSSQLLEQERQLQQEQDKIREISDSMNLLPQQQVEARRLLAVATSRLQSLGTPPTPLTEAQLKLAQAEVSARKAVTNELEMSQLSANNRQEIARMRADLFKKRYQRLDLKLQQLRNQLNIQRQQKAESALEHTEMLAEQAGGKLPQFLLDELHQNRQLSQLLSQQTQRMEAIGSQQRKAANDILQVRRTLNTIREQAEWLSDSTALGEALRTQLTRIPDVPKYQQLDRNIVELRVERLKYEEMQERSQQENGQALPSSQSLTSGQKQVYESLIRTRKELLNSLLSGYDNEILELTKLKVATNQLNEALKEIKDATHRYLFWVTDVNPISLDYPLLVVQALTRLLSLDTLSQLGVAIHVMLTTKDTLLYLLGTLLLVIFSISSHRQYHAFLERSSNRIGKVTQDHFSLTLRTVFWSIVAALPLPILWSAIGYGLQNAWQYPMATAIGLGVSETTPVLWVFMLSAAFANPNGLFISHFRWPEERIKRAMRFYRLSIFLIVPLMMALITFNNYSEREFAATLGRLCFLMLCVSLSLVTSSLKRAGVPLYMDKHGAGENIINSVLWWILLSAPILAALAAILGYLQTSQALLGRLETSVAIWLSLLVIYHIIRRWMLIQRRKLAFERAKQRRAEILAQRAKSEEETANINSSVEGSIEVEEPVIDLDAISAQSLGLVRSILTMIALVSLILLWSELHSAFSFLENIRLWDVSTTVNGVNTIQPITMGSVLIAILVIVITTQLVRNLPALLELALLQHLELTPGTGYAITTLTKYGLTLIGGIVGFSLVGIEWSKLQWLIAAMGVGLGFGLQEIFANIISGLIILFEKPIRIGDTVTIRNLTGSITKINTRATTLSDWDRKEIIVPNKAFITEQFINWSLSDTITRIVLTIPVPAETDSAEATDILMTASRRSPLILDNPMPEVYLVDLQNGIQIYELRAYAAEMGHRMPARHEVHQYILQEFHKHGITLPFPPFQARVDIFGQEIRSATTNISGRNPPRKPGEL

SEQ ID NO: 7895 - protein, 401 aa, Xenorhabdus bovienii
  Peptide sequence Name=Xb4151_4152.C434.gene102.pep
  Gene classification: Gene name=ProP; Function=77 Permeases of the major facilitator superfamily; Function class=G Carbohydrate transport and metabolism
  Homolog annotation: Query=6..391bp; Hit=9..381bp; Blast score=73; Percent Identity=23.0; E value=3e-13; Homolog= BH3886 COG0477
MMRRIPFQISGLLALNGVSILGNAITDIAIPWLILEISGSPLLVAAVMSAKIVPLILSIFFSAQLVDKYGAFRISVLSDLVNFLSVLLIPVFYTMDIMHFYLLAILLIFSTILDSPGRLAKDVMLAKEIKQNKSEHELINGINSTIENICDLTGPVLGSLIIALFGTINALYFDAVSFLVVALGLIILKKHFVTNINEVTEIPSLPHHYFLEALKYVKSEKELFSILILSSVVNFVIAPFLIVYLPYVNKVEFNSVVSLGVSMTCFGLGTTFSSLLYGIYGKHFANNHIILSGYSLFVLCLITLSLLSGQYILFAQLFAIGCCIGFTAPVEVTLIQRQVPENLFSRIITLFSSTRFLAVPVGYVCFGTLLGSSLTKQTPLIMATIVLGGLLAYLAMHGRVK

SEQ ID NO: 7896 - protein, 113 aa, Xenorhabdus bovienii
  Peptide sequence Name=Xb4151_4152.C434.gene103.pep
  Gene classification: Gene name=ARO8; Function=Transcriptional regulators containing a DNA-binding HTH domain and an aminotransferase domain (MocR family) and their eukaryotic orthologs; Function class=K Transcription
  Homolog annotation: Query=18..87bp; Hit=1..70bp; Blast score=68; Percent Identity=51.0; E value=1e-12; Homolog= Z3973 COG1167
MKTTLFQIDKLLQHHVSLPLYRQIYQRFIQAINQGILRPEQRVPSIRTLSSELQVSRSTVESAYTLLLNEGYLESRGQAGTIVSPKLADRVLQPPETLISSSIDVTRSCPLII

SEQ ID NO: 7897 - protein, 318 aa, Xenorhabdus bovienii; identical to SEQ ID NO: 6992
  Peptide sequence Name=Xb4151_4152.C434.gene104.pep
  Gene classification: Function=Transposase; Function class=L DNA replication, recombination and repair
  Homolog annotation: Query=9..306bp; Hit=6..302bp; Blast score=201; Percent Identity=38.0; E value=8e-52; Homolog= NMA1185 COG3547

SEQ ID NO: 7898 - protein, 46 aa, Xenorhabdus bovienii
  Peptide sequence Name=Xb4151_4152.C434.gene105.pep
MQSDNHQGIKPVNELSTHDCDFSSRNPNSCLKHNSYLQEWEPKNHD

SEQ ID NO: 7899 - protein, 49 aa, Xenorhabdus bovienii
  Peptide sequence Name=Xb4151_4152.C434.gene106.pep
MFAEIDTDNCNSVHDNGLFKKNHSVSILLQGEGDHLVSLIWFIMVKLDW

SEQ ID NO: 7900 - protein, 335 aa, Xenorhabdus bovienii
  Peptide sequence Name=Xb4151_4152.C434.gene107.pep
  Gene classification: Function=Transposase; Function class=L DNA replication, recombination and repair
  Homolog annotation: Query=7..334bp; Hit=6..337bp; Blast score=243; Percent Identity=41.0; E value=2e-64; Homolog= PA2319 COG3547
MNTVAIIGIDLGKHSFHVHCQDKHGKAILRKKFTRNKLFEFLGSTPSTCIVMEACAGAHFMARKMSALGHEAKLISPQFVRPFVKSNKNDFIDAEAICEAASRPSMRFVQPRPEAQQAMRALHRVRESLIKDKVKTTNQMHAFLLEFGVSMPKGIAIIRRLSGVLAENELPPYLVQLLMRLHAHYLYLVEQITELENELTQELFRDDTSQRLMTIPGIGPITASVLSSQLGDGKQYAKSRDFASSTGLVPRQYSTGGKNTLMGISKRGDKNLRRLLVQCARVYIQRLTHQTGRLAEWVKNQLQKKHSCVVACALANKFARIAWAITTQRTEFNPS

SEQ ID NO: 7901 - protein, 47 aa, Xenorhabdus bovienii
  Peptide sequence Name=Xb4151_4152.C434.gene108.pep
MAHRSRAVFKGVSGAELIEARASLPILTPDRFKQAHHKSKSVLQKRG

SEQ ID NO: 7902 - protein, 47 aa, Xenorhabdus bovienii
  Peptide sequence Name=Xb4151_4152.C434.gene109.pep
LPIPFVPPEINAILSFKLNMVVSLYMSGYSIFVTNNIIFQYIFNNPN

SEQ ID NO: 7903 - protein, 249 aa, Xenorhabdus bovienii
  Peptide sequence Name=Xb4151_4152.C434.gene110.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=3..245bp; Hit=4..248bp; Blast score=218; Percent Identity=51.0; E value=5e-57; Homolog= mll6717 COG1028
MFNLKDKIAFISGGTKGIGKGIAQVFKRAGAITIISGTNRARGEAIAKELDIDFIPLDVTDQAACKNVIDEIVEKYGRLDILCSNAGIFPQHYLKDMTAEDWDLVNTVNLKGTFLLVQAALNVMEKQHYGRVVLTSSVTGEMTGIPGYSHYGASKAGQLGFMRSAALEYAGQGITINAIMPGMIMTEGLKAFGEDYLQHVQSTTPMRVLGLPEDIGYTACFLASDEAKYITGQAIVVDGGQILPEVQGA

SEQ ID NO: 7904 - protein, 46 aa, Xenorhabdus bovienii
  Peptide sequence Name=Xb4151_4152.C434.gene111.pep
LGDYLIFFFCLTAMVEKKKRFLSHQGLKHPALLAVSARHQPQSPVR

SEQ ID NO: 7905 - protein, 226 aa, Xenorhabdus bovienii
  Peptide sequence Name=Xb4151_4152.C434.gene112.pep
  Gene classification: Function=Uncharacterized BCR; Function class=S Function unknown
  Homolog annotation: Query=7..214bp; Hit=8..214bp; Blast score=363; Percent Identity=81.0; E value=1e-101; Homolog= XF2273 COG1636
MSLNYERNPLPLPNGHNKVLLHSCCAPCSGEVMEAMLASGIDFTIFFYNPNIHPLKEYELRKDENIRFAEQMGIPFIDADYDRDNWFERAKGMENEPERGIRCTMCFDMRFERTALYAYEHGFPVISSSLGISRWKNMQQINECGVRAASHYPDLTYWEYNWRKGGGSSRMIEISKREEFYQQEYCGCVYSLRDTNRHRLSTGRERIKLGTVFYQAESDKKDHESN

SEQ ID NO: 7906 - protein, 65 aa, Xenorhabdus bovienii
  Peptide sequence Name=Xb4151_4152.C434.gene113.pep
VIKKITNQIDVQGYTLYSLLVHTPASYCYVTDRCFLCYYFILFYFILFYFILFYFILFYFILFYF

SEQ ID NO: 7907 - protein, 40 aa, Xenorhabdus bovienii
  Peptide sequence Name=Xb4151_4152.C434.gene114.pep
LNYCTISFFSMKNKPIVLLMNIMSILCHLNSSLSYYLKIK

SEQ ID NO: 7908 - protein, 330 aa, Xenorhabdus bovienii
  Peptide sequence Name=Xb4151_4152.C434.gene115.pep
  Homolog annotation: Query=31..275bp; Hit=57..287bp; Blast score=100; Percent Identity=32.0; E value=4e-20; Homolog= gi|15888182|ref|NP _353863.1| AGR_C_1537p [Agrobacterium tumefaciens] gi|17934749|ref|NP_ 531539.1| conserved hypothetical pro
MKKFCRWIKILPIISVFLLIACDEENYSFKLRKDNYAEAHTKFKTNIVDESFIGDGKPATPPKDIFSLVYYPADDGDMAAFLSAPPLNNDKKYPAVIWLIGGYGGIGNSDFFWSEQPEDNDQSASAFRRDGLVLMIPSFRGENVNPGRYEMFYGELRDIESARQYLAKLPYVDQNRIYLAGHSTGGTRALLASEYSKGFRAVFSLGGIPDLRLRLEYGSVPVAVPFDQNNPEEFELRSPRTFLSSIKSPTFYFEGEKSYWDEFDEIKQIVEDKGIPLHIYAIQGGDHFNIILPLTKMIAEKILSDTGEKTNIQFDEQDILKIQYHLPLTD

SEQ ID NO: 7909 - protein, 36 aa, Xenorhabdus bovienii
  Peptide sequence Name=Xb4151_4152.C434.gene116.pep
LTIPIVNKFIYVISRFENIKVKKKGLHRQAKGYGEA

SEQ ID NO: 7910 - protein, 35 aa, Xenorhabdus bovienii
  Peptide sequence Name=Xb4151_4152.C434.gene117.pep
LIEQIEKRRFFQLDEGLTAFQFDLKYLYINLESLD

SEQ ID NO: 7911 - protein, 271 aa, Xenorhabdus bovienii
  Peptide sequence Name=Xb4151_4152.C434.gene118.pep
  Gene classification: Gene name=AraC; Function=AraC-type DNA-binding domain-containing proteins; Function class=K Transcription
  Homolog annotation: Query=1..271bp; Hit=1..271bp; Blast score=324; Percent Identity=57.0; E value=6e-89; Homolog= PA1713 COG2207
MKRTTGLNQKSICTHLLTIPDFNTLEHKQRGLYVLLDGEMIWKDCTNTYYITSNEILFTHPGSYVAKTNTENCQVLWLPLQMEFLRSFLKRFGSLLSKIERHNFPARRLIPFSQFPLLTESIRGLANLLAHDYPPALIQLRVEELLLLLSLSKQGALLMSVLRQLSNRQVERLQTFMDAHYLKEWRLNDFAREFGMGLTSFKELFNSVYGTSPRAWISEQRILYAHQLILNSEMSIADISLESGFSSQSYFTQSYRRRFGCTPNRARYGKD

SEQ ID NO: 7912 - protein, 54 aa, Xenorhabdus bovienii
  Peptide sequence Name=Xb4151_4152.C434.gene119.pep
MLFRYLSILFHFALNAISIIREPNERLFQHLLINKINKYTMHSSQKMITHDTED

SEQ ID NO: 7913 - protein, 35 aa, Xenorhabdus bovienii
  Peptide sequence Name=Xb4151_4152.C434.gene120.pep
LYYISKLIFVLGFSVKICAINLFLCFLKVLKQVYL

SEQ ID NO: 7914 - protein, 34 aa, Xenorhabdus bovienii
  Peptide sequence Name=Xb4151_4152.C434.gene121.pep
LFIFYLMVFNAFIIHLLESCSLLSFRWFYTFNPI

SEQ ID NO: 7915 - protein, 31 aa, Xenorhabdus bovienii
  Peptide sequence Name=Xb4151_4152.C434.gene122.pep
MTIFIIKNMSVNMCNYLILKINYKLFALLGR

SEQ ID NO: 7916 - protein, 33 aa, Xenorhabdus bovienii
  Peptide sequence Name=Xb4151_4152.C434.gene123.pep
LLTFFSMPPCNWLAKFKNNLSISLAYSIYLLYK

SEQ ID NO: 7917 - protein, 31 aa, Xenorhabdus bovienii
  Peptide sequence Name=Xb4151_4152.C434.gene124.pep
MINNMATEIKYHDSNSVIISPPIKAKDNNLI

SEQ ID NO: 7918 - protein, 35 aa, Xenorhabdus bovienii
  Peptide sequence Name=Xb4151_4152.C434.gene125.pep
LNKKTDKLIILQQYKQNTNNLISCLVCGKHFRSVD

SEQ ID NO: 7919 - protein, 30 aa, Xenorhabdus bovienii
  Peptide sequence Name=Xb4151_4152.C434.gene126.pep
MDFLFWEYGIIKRKFRTLNLSSNVIRVIAL

SEQ ID NO: 7920 - protein, 221 aa, Xenorhabdus bovienii
  Peptide sequence Name=Xb4151_4152.C434.gene127.pep
  Gene classification: Function=Uncharacterized BCR; Function class=S Function unknown
  Homolog annotation: Query=75..188bp; Hit=3..111bp; Blast score=60; Percent Identity=36.0; E value=1e-09; Homolog= VCA1042 COG1664
MERYRFSDNAFLYSVWLLWGGALGLYLYGAHLGCAITAIISFLALVLYFTNMKLRINAMFGKKTEAPVANPVTPIISTQPEDKKNLSVETRSNTIIAKNSVFKGDIEMEGDIQVWGKVVGNIRVKGGAIRVMHAGKVEGELNAPEIIIDGHVDGTCCAETLDILEHGELRGISRCGSMSIRRGGLFVGQSEQVENKKKPDIERVVSIKENPADKAKAKNSA

SEQ ID NO: 7921 - protein, 31 aa, Xenorhabdus bovienii
  Peptide sequence Name=Xb4151_4152.C434.gene128.pep
MIHIFRRLWHGFLLSNIKHYFWLSLYLPDSL

SEQ ID NO: 7922 - protein, 180 aa, Xenorhabdus bovienii
  Peptide sequence Name=Xb4151_4152.C434.gene129.pep
  Gene classification: Gene name=RimL; Function=Acetyltransferases, including N-acetylases of ribosomal proteins; Function class=J Translation, ribosomal structure and biogenesis
  Homolog annotation: Query=4..178bp; Hit=16..190bp; Blast score=144; Percent Identity=44.0; E value=7e-35; Homolog= PA3945 COG1670
MIIKLETERLLLRGWKEEDREPFFRLNSDPEVMEFFFNTLNEEQNNILVDNLIRKFETQGGWGLWAVERKQDGAFIGMIGLNIPSEESPCYPCVEIGWRLDKPFWGKGYTCEAARRIFDFAFTDAGLDEVVAFTSVLNYRSESVMKKLGMIRDEKTFLHPLVPEGHRLREHVLYRIRRSS

SEQ ID NO: 7923 - protein, 37 aa, Xenorhabdus bovienii
  Peptide sequence Name=Xb4151_4152.C434.gene130.pep
MVSIKVILPVGITLIMFTLSCHQLERRIRYRTCSLNR

SEQ ID NO: 7924 - protein, 196 aa, Xenorhabdus bovienii
  Peptide sequence Name=Xb4151_4152.C434.gene131.pep
  Homolog annotation: Query=1..195bp; Hit=10..203bp; Blast score=302; Percent Identity=74.0; E value=3e-81; Homolog= Pa|Phot4-254a01.q1k _g27| 25856 - 26470 385 204 aa, chain +
MGADSGGRPAIERLVRAYGFKSRQALSDHLGVSKSTMANRYLRDSFPADWIIQCNLETGASLLWLSTGQGEMFSDGESGKTERLEDIIAPSIPRIKLSGGKLNEANPVILDSELISKELNNPLVVDDGVTWYLLDAQGDNIQDGLWLVDIEGMHSIKRIAKIPVSKIRVSDDDVTFDCSVSDIQFIGRVVLVISRQ

SEQ ID NO: 7925 - protein, 312 aa, Xenorhabdus bovienii
  Peptide sequence Name=Xb4151_4152.C435.gene1.pep
  Gene classification: Gene name=ZnuA; Function=ABC-type Mn/Zn transport system, periplasmic Mn/Zn-binding (lipo)protein (surface adhesin A); Function class=P Inorganic ion transport and metabolism
  Homolog annotation: Query=12..311bp; Hit=30..325bp; Blast score=376; Percent Identity=59.0; E value=1e-104; Homolog= ZyebL COG0803
KDAHKFFRKIVLATALMTGVNYSAQADVVTSIRPLGFIVAAIADGVTDTQVLLPDGASPHDYALRPSDIRKINQADLVIWIGPDMETFLAKPITKIAQNKQLALAQLSTIKPLLLKNNEDENDLEESSQPKHDADHEHHHHGEYNMHIWLSPEIAKQVAQAIYIQLVEQYPQQKQQLEVNLRKFNGQLVQTDKNIASILKPVRGKGYFVFHDAYGYFEKHYKLAPLGVFTVNPEIQPGAQKLHYIRTQLVEQKATCIFAEPQFRPAVIHTVAKGTDVRTGTLDPLGSGIVLNKDSYMKFITQLSEQYASCLN

SEQ ID NO: 7926 - protein, 423 aa, Xenorhabdus bovienii
  Peptide sequence Name=Xb4151_4152.C435.gene2.pep
  Gene classification: Gene name=NlpD; Function=Membrane proteins related to metalloendopeptidases; Function class=M Cell envelope biogenesis, outer membrane
  Homolog annotation: Query=8..423bp; Hit=1..419bp; Blast score=514; Percent Identity=61.0; E value=1e-146; Homolog= yebA COG0739
LPRPHKLMLGSLTLVTLAVAVWRPVAYHEQEERTGSIILSTPNNISDATDDSIGDIDEQLPDEGIGDEEGGSDTTVNYPHQYVVSDGDTLSSILTQFGIDSSDVALLANQYKSLRDLNIGQSLSWTIDDNGNLKTLTWGISRRETRIYTREGDVFKETSAFQKGEWKNTIVKGKINGSFSGSALSAGLTSGEARDITKALQWQIDFRKLRKGDRFSVLMSREMLDGKSEQSQLMGVRLHSGGNDYYAFRADDGRFYDGNASGLERGFLRFPTMKQFRLSSSFNPHRLNPVTGRITAHKGVDFAMPVGTPVLAVGDGEVIVSKFDGAAGNFIAIRHGRQYTTRYMHLRKLLVKPGQKVKRGERIALSGNTGRSTGPHLHFEFWNNQQPVNPLTAKLPRSGGLNGKERSEFIAKVRGIKPQLLLD

SEQ ID NO: 7927 - protein, 55 aa, Xenorhabdus bovienii
  Peptide sequence Name=Xb4151_4152.C435.gene3.pep
MKRWDISQFTICIFLFIHELTLMVPKQAFNTQASNKNNIKADDINHPLLCLLIIE

SEQ ID NO: 7928 - protein, 322 aa, Xenorhabdus bovienii
  Peptide sequence Name=Xb4151_4152.C435.gene4.pep
  Gene classification: Gene name=HtrB; Function=Lauroyl/myristoyl acyltransferase involved in lipid A biosynthesis; Function class=N Cell motility and secretion
  Homolog annotation: Query=13..322bp; Hit=10..319bp; Blast score=427; Percent Identity=64.0; E value=1e-120; Homolog= msbB COG1560
MNKEKDTDSKLGYVPTFHLSYLHPRYWGLWTGVGILAGLAYVPVKWRDPLLAKMGIWAGKKAKSARRRAKINLVYCFPELQEQQREALIDKMFATAPQSFVMLAELCLKGAESTLQRTRWHGEEILHSLKAQSKNVILLVPHGWAIDIPAMLLAARDQKVAGMFHHQSNPVADYLWNKVRTHFGGRLHSREAGIKPFIASIRQGHLGYYLPDQDHGEEHSEFVDFFATYKATLPAIGRLMKVSRAAVVPLFPVYNCQTHQLDIYIRPPMDDIEGQDDTYIARRMNQELEELVRPNPEQYTWILKLLKTRKAGDIEPYKRKDL

SEQ ID NO: 7929 - protein, 480 aa, Xenorhabdus bovienii
  Peptide sequence Name=Xb4151_4152.C435.gene5.pep
  Gene classification: Gene name=PykF; Function=Pyruvate kinase; Function class=G Carbohydrate transport and metabolism
  Homolog annotation: Query=1..480bp; Hit=1..480bp; Blast score=776; Percent Identity=86.0; E value=0; Homolog= pykA COG0469
MSRRLRRTKIVTTLGPATDRDGNLEKVISAGANVVRLNFSHGTAEDHVQRANKVREIAARLGYHVAILGDLQGPKIRVSTFKEGKIFLNIGDKFLLDANLGKGEGDKEKVGIDYKGLPSDVTTGDTLLLDDGRVQLRVLDVQGMKVFTEVTVGGPLSNNKGINKQGGGLSAEALTEKDKQDIITAAKIGVDYLAVSFPRSGEDLNYARRLARDAGCETQIVAKVERAEAVSSDDIIDEIILASDVVMVARGDLGVEIGDPELVGVQKKLIRRARQLNRVVITATQMMESMITNPMPTRAEVMDVANAVLDGTDAVMLSAETAAGQYPAETVAAMAQVCLGAEKMPSINVSKHRLDITFDSIEEAISMSAMYAANHLKGVKAIIAMTESGRTARMMSRISSGLPIFSMSRHESTLNRTALYRGVTPVYCSTHTDGISAANEAVNRLRDKGYLTSGDVVLVTQGDQMETIGSTNTCRVLEVE

SEQ ID NO: 7930 - protein, 36 aa, Xenorhabdus bovienii
  Peptide sequence Name=Xb4151_4152.C435.gene6.pep
LIINPVIRMILTGGDFPLCYQPRGLINSEQKHSLFF

SEQ ID NO: 7931 - protein, 294 aa, Xenorhabdus bovienii
  Peptide sequence Name=Xb4151_4152.C435.gene7.pep
  Gene classification: Gene name=RpiR; Function=Transcriptional regulators; Function class=K Transcription
  Homolog annotation: Query=13..292bp; Hit=1..280bp; Blast score=425; Percent Identity=79.0; E value=1e-119; Homolog= ZyebK COG1737
MKSLKPKVELRLMNTLERLQNSLDILSKSEKKVAQVILDSPHTAIHSSIATLAKMANVSEPTVNRFCRRLNTKGFPDFKLHLAQSLANGTPYVNRNVEESDSVTSYTSKIFESVMANLETVKSNLDITAINRAVDLLTQARKISFFGLGASAAVAHDAMNKFFRFNIPITYFDDIVMQRMSCINSAEGDVVVLISHTGRTKNLVEIARLARENDATVIAITSTGSPLAHEATLSILLDVPEDTDIYMPMVSRIAQLTIIDVLATGFTLRRGSKFRDNLKRVKEALRNSRFDKYE

SEQ ID NO: 7932 - protein, 44 aa, Xenorhabdus bovienii
  Peptide sequence Name=Xb4151_4152.C435.gene8.pep
VLSLLSPQKSPNHKPELRMSPPCCISSITGYCNFFTELAGNVLF

SEQ ID NO: 7933 - protein, 491 aa, Xenorhabdus bovienii
  Peptide sequence Name=Xb4151_4152.C435.gene9.pep
  Gene classification: Gene name=Zwf; Function=Glucose-6-phosphate 1 -dehydrogenase; Function class=G Carbohydrate transport and metabolism
  Homolog annotation: Query=1..491bp; Hit=1..491bp; Blast score=843; Percent Identity=81.0; E value=0; Homolog= zwf COG0364
MAVTSVAQACDLVIFGAKGDLARRKLMPSLYQLEKAGYIHPDTRIIGVGRADWDKKAYTKVVEEALATFMSEKLDPELWKKFSSRLEFCNLDVNETEHFTRLAKILKQDSLPAIHYFAMPPNTFGSVCHGLGAAGLNKEPNRVVMEKPLGTDLASSRAINDEVAKYFNESQIYRIDHYLGKETVLNLLALRFANSLFANNWDHRTIDHVQITVAEEVGIEGRWGYFDQAGQMRDMIQNHLLQILTMIAMSPPSDLTADRIRDEKVKILRSLRRIDQTNVREKTVRGQYTAGFVHGKKVPGYLEEEGANKISKTETFVSIRVDIDDWRWSGVPFYLRTGKRLPAKCSEVVVYFKEPSLNLFANSYQQLPQNKLTIRLQPDEGIDIEVLNKAPGLEHKHRLQTTKLDLSFSQTFNQTHLADAYERLLLEAMRGIQALFVRRDEVEEAWKWVDSIMDAWEADNEPPKPYQAGTWGPVASIAMITRDGRSWNEFE

SEQ ID NO: 7934 - protein, 34 aa, Xenorhabdus bovienii
  Peptide sequence Name=Xb4151_4152.C435.gene10.pep
LLSILGYVRNIPTINTTNMEIRSISYSDHRVMKE

SEQ ID NO: 7935 - protein, 38 aa, Xenorhabdus bovienii
  Peptide sequence Name=Xb4151_4152.C435.gene11.pep
MNSAKSVTIQYSSKIQRSTHVLFLSAILSSEHYWCGAL

SEQ ID NO: 7936 - protein, 54 aa, Xenorhabdus bovienii
  Peptide sequence Name=Xb4151_4152.C435.gene12.pep
LFHGQSTNHFCHNRQCKKYPINHFFLLNILYVACQDTKPLIPIRLFKNVISESA

SEQ ID NO: 7937 - protein, 116 aa, Xenorhabdus bovienii
  Peptide sequence Name=Xb4151_4152.C435.gene13.pep
  Gene classification: Gene name=EmrE; Function=Membrane transporters of cations and cationic drugs; Function class=P Inorganic ion transport and metabolism
  Homolog annotation: Query=2..114bp; Hit=3..115bp; Blast score=114; Percent Identity=69.0; E value=2e-26; Homolog= ydgF COG2076
MIYWIFLALAIMTEVIGTLSMKQASVSGDFTGMIVMYSMITTSYILLAIAVKKVALGVAYALWEGFGILFITAFSVLWFNESLSPMKIGGLALLIAGIALIKSGTKKASNPQLKEA

SEQ ID NO: 7938 - protein, 110 aa, Xenorhabdus bovienii
  Peptide sequence Name=Xb4151_4152.C435.gene14.pep
  Gene classification: Gene name=EmrE; Function=Membrane transporters of cations and cationic drugs; Function class=P Inorganic ion transport and metabolism
  Homolog annotation: Query=2..110bp; Hit=1..109bp; Blast score=97; Percent Identity=67.0; E value=1e-21; Homolog= ydgE COG2076
MLTPFEWWHAAFLVLAVLLEIVANILLKLSNGFQRFWIGVLSLMAVLAAFSALAQAVKGIELSIAYAIWGAFGIIATVAAGWIMFNQRLNFKGWGGIVLLLIGMVMIKMS

SEQ ID NO: 7939 - protein, 114 aa, Xenorhabdus bovienii
  Peptide sequence Name=Xb4151_4152.C435.gene15.pep
  Gene classification: Gene name=TdcF; Function=Putative translation initiation inhibitor; Function class=J Translation, ribosomal structure and biogenesis
  Homolog annotation: Query=1..114bp; Hit=17..130bp; Blast score=163; Percent Identity=72.0; E value=3e-41; Homolog= yoaB COG0251
MTIERIDPDTRWSEAIIHNDTIYYTSVPENLDGDITEQTANTLAAIDIMLQRLGSDKSKIIDATIFLANKADFAGMNAAWDAWVVAGSSPVRCTVQAELMNPKYKVEIKIIAAL

SEQ ID NO: 7940 - protein, 638 aa, Xenorhabdus bovienii
  Peptide sequence Name=Xb4151_4152.C435.gene16.pep
  Gene classification: Gene name=DinG; Function=Rad3-related DNA helicases; Function class=L DNA replication, recombination and repair
  Homolog annotation: Query=1..630bp; Hit=1..630bp; Blast score=951; Percent Identity=73.0; E value=0; Homolog= Z2851 COG1199
VSDDFAKNGVLAKAIQGFNPRDAQREMASSITAAIKKQRQLVVEAGTGTGKTFAYLVPALRSGKKVIISTGSKALQDQLYNRDLPTVADALKFTGRMALLKGRSNYLCLERLEQQSFGSSQLEPEMLAEVVRLRSWSSQTEDGDISTCHQIAEDSIVWPLVTSTNDNCLGSDCPRYQECFVLKARRKAMESDIVVVNHHLFMADMVVKDTGFGELIPRADVVIFDEAHQLPDIASQYFGQQLSSRQLMDLSRDIIMAYRTEVRDQAQLQKSADRLSQSTQDFRLSLGDNSYRGNLREALQQPQIQRMLVRLDDALELCYDVMKLSLGRSAMLDAAFERATIYRNRLKRLIDVVVPNYSYWFESYGRHFLLALTPLSVSDKFSDMIREQSGCWIFTSATLSVNEQLDHFTARLGLKQAQTLLLPSPFDYQRQMLLCVPRHLPSPNQNGGAKWLARMLKPLIESNKGRCFFLCTSHQMVRGLAEEFRANLTLPVLVQGETSKGQLLSQFISAGNALLVATGSFWEGVDVRGDALSCVIIDKLPFTAPDDPLLKARIEDCQLKGGDAFSEVQIPDAVLSLKQGVGRLIRDIDDYGVVIICDNRLVMRPYGEIFLNSLPPARRTRDLSKAVEFLKSRPIESE

SEQ ID NO: 7941 - protein, 231 aa, Xenorhabdus bovienii
  Peptide sequence Name=Xb4151_4152.C435.gene17.pep
  Gene classification: Function=Inactive homologs of metal-dependent proteases, putative molecular chaperones; Function class=O Posttranslational modification, protein turnover, chaperones
  Homolog annotation: Query=4..231bp; Hit=2..230bp; Blast score=290; Percent Identity=65.0; E value=1e-78; Homolog= yeaZ COG1214
MSTRILAIDTATEACSVALWNESVIEAQFEISPREHTQRILPMVQAVLSQGNLSLQQLDALAFGRGPGSFTGVRIGIGVAQGLALGAELPMLGVSSLKTMAQGVFRLKGVQNVLVAIDARMGEVYWGQYTRNLQGEWQGDETEAVLKPEQALAIMNALTGVWAIAGTGWEAYPQLLDSHLDLVKSDITLPHAEDMLPLAVQMWKAGEATAVEHAEPTYLRNEVTWKKLPGR

SEQ ID NO: 7942 - protein, 195 aa, Xenorhabdus bovienii
  Peptide sequence Name=Xb4151_4152.C435.gene18.pep
  Gene classification: Gene name=Slp; Function=Starvation-inducible outer membrane lipoprotein; Function class=M Cell envelope biogenesis, outer membrane
  Homolog annotation: Query=20..163bp; Hit=12..157bp; Blast score=170; Percent Identity=54.0; E value=9e-43; Homolog= yeaY COG3065
MEELMLKGTHYRAMLQVVALAGAMILTGCVSVPDAIKGTTKTPVENLLSVKDTPELYIGHEGRFGGKVLSVLNEKDRTRLEILALPLASNAAPLLNKPSLGRVYAYVNGFLEPNDFKDQYVTVVGSITDLEKGMVGNSPYNYVVMSVVGFKRWYESERVNLPPVGNSVFWNYYGSPYFPDLSQMASMKDALSERH

SEQ ID NO: 7943 - protein, 32 aa, Xenorhabdus bovienii
  Peptide sequence Name=Xb4151_4152.C435.gene19.pep
VARPSSRFHIFVYYYLPNNYTLLVYSAYNYLE

SEQ ID NO: 7944 - protein, 565 aa, Xenorhabdus bovienii
  Peptide sequence Name=Xb4151_4152.C435.gene20.pep
  Gene classification: Gene name=CaiC; Function=Acyl-CoA synthetases (AMP-forming)/AMP-acid ligases II; Function class=I Lipid metabolism
  Homolog annotation: Query=1..561bp; Hit=1..561bp; Blast score=909; Percent Identity=78.0; E value=0; Homolog= fadD COG0318
LEKVWLKHYPADVPAEIDPDRYLSLIEMFENAVARYADQVAFINMGEVITFRKLEERSRAFAAYLQNGLGLKKGDRVALMMPNLLQYPVALFGVLRAGMVVVNVNPLYTPRELEHQLTDSGTSAIVIVSNFAHTLEKIVFNTQVKHVILTRMGDQLSRPKGTLVDFVVKYVKRLVPKYHLPDAISFRNVIHKGYRMQYVKPDVDGDALAFLQYTGGTTGVAKGAMLTHRNMLANLEQGKANYAPLMAPGQELVVTALPLYHIFALTVNCLLFIELGGQNLLITNPRDINGTVKELSRYPFTALSGVNTLFNAWLNNPEFQKLDFSSLRLSVGGGMAVQRIVAEKWQNLTGCHLLEGYGLTECAPLVSGNPYNLTHYSGSIGFPVPSTEIKLVSDDGNEVPLEQAGEMWVRGPQVMKGYWNRPEATAEVLKDGWLATGDIANVDENGFLHIVDRKKDMILVSGFNVYPNEVEDVVSSHPKVLESAAIGVPNDNSGETVKIFVVRKDQSLTENELKTHCRRYLTGYKVPKLIEFRDELPKSNVGKILRKELRNEELEKANNAATAAN

SEQ ID NO: 7945 - protein, 56 aa, Xenorhabdus bovienii
  Peptide sequence Name=Xb4151_4152.C435.gene21.pep
MDSLINESNINEDVTPILIGVTIPNICPQFSPNYSLISPIGYLLTDNSKHHSLSHS

SEQ ID NO: 7946 - protein, 151 aa, Xenorhabdus bovienii
  Peptide sequence Name=Xb4151_4152.C435.gene22.pep
MSISITTIQYKNAYNFYHRNAMAIYEIDNKKFMFGQSETQGNKHFIQEILPDGRLGHTTESGSSPIYYDYATILEDGDKKYLCCINTSSAAIQFLELTPDGKTKLVFSDNYSQDGFETFIPYMNNGVLFAYRQNEASKRWEIVKLEQKNEL

SEQ ID NO: 7947 - protein, 38 aa, Xenorhabdus bovienii
  Peptide sequence Name=Xb4151_4152.C435.gene23.pep
MELSIYFYLLLCKSHQYIRRYSIFYKFTIIMSSYVYFS

SEQ ID NO: 7948 - protein, 39 aa, Xenorhabdus bovienii
  Peptide sequence Name=Xb4151_4152.C435.gene24.pep
MTFSLLYSNWQSQLSATWQLPLNIVAICDCAIQVHRGII

SEQ ID NO: 7949 - protein, 757 aa, Xenorhabdus bovienii
  Peptide sequence Name=Xb4151_4152.C435.gene25.pep
  Gene classification: Gene name=LdcC; Function =Arginine/lysine/ornithine decarboxylases; Function class=E Amino acid transport and metabolism
  Homolog annotation: Query=1..756bp; Hit=2..755bp; Blast score=1214; Percent Identity=73.0; E value=0; Homolog= adiA COG1982
MKVLIAKNEVGTRYHSHYIENAVHRLADKLTDRNVEVVIADSFDDSYTIIASNESFDCLMVSCALMDDELYREIQQLLNKLFERQENVPVFLLSDREKTVFLLNHELLEQLTEFAWILEDSADFIAGRAIAAMRRYRQQLLPPLMAALMKYSQTYEYSWAAPGHQGGVGFNKTPVGRLYHDYYGENLFRTDMGIERASLGSLLDHSGAFGESEKNAARVFGADHSYSVVVGTSGSNRTIMQACMTEDDVVIIDRNCHKSIEQGLILTGAKPVYLLPSRNRYGIIGPIYPQEMQTETLQKKLKQNPLTQGMASRKPAYSVVTNCTYDGVCYNARHVQELLDKSVDRIHFDEAWYGYARFNPIYHDHYAMRGNPKDHAGPTVFATHSSHKLLNALSQASFIHVRDGRNSVDFSRFNQAYMMHATTSPLYAICASNDIAVSMMDGNSGYSLTQEVIEEAVDFRQALARLHRDFNEKGDWFFKPWNQEKVLDPATGKKIAFEDAPRDLLTKEQSCWTMRPGDSWHGFEDLPDDWSMLDPIKVSILAPGMGDNGQLLKQGVPAALVTAWLSQHGIVPTRTTDFQIMFLFSMGITKGKWGTLLNTLLSFKHHYDANTPLNKVLPDLVNQYQEVYGNLGLQELGDKMFAYLRQNNPGDKLNHAYSGLPEMAMIPRAAYQAIVTNNVEMVAIDDLPHRIAANSIIPYPPGIPMLLSGENFGDKTSPQMSYLHALQKWDHEFPGFEHETEGTEIINGVYHVMCIKK

SEQ ID NO: 7950 - protein, 442 aa, Xenorhabdus bovienii
  Peptide sequence Name=Xb4151_4152.C435.gene26.pep
  Gene classification: Gene name=PotE; Function=Amino acid transporters; Function class=E Amino acid transport and metabolism
  Homolog annotation: Query=1..439bp; Hit=1..439bp; Blast score=629; Percent Identity=80.0; E value=1e-180; Homolog= aniC COG0531
MTTVSETKKVGLIPVTLMVAGNIMGSGVFLLPASLASTGGIAILGWLVTIIGAVGLSMVYAKISSLDDSPGGSYAYARRAFGPFLGYQTNVLYWLACWIGNIAMVVIGVGYLSYFFAILKDPIILTMTCIAILWVFVFLNIIGPHVITRVQAVATTLALIPIVATAVFGWFWFSGKTYMDAWNVSGLNTFGAIQSILNVTLWSFIGVESASVAAGVVKNPKRNVPIATIGGVLIAAVCYILSSSVIMGMIPNAALKLSSSPFGDAARLALGDTAGAVVVFCAAVGCLGSLGGWTLLAGQTAKAAADDGLFPAIFGKVNKEGTPVAGLLILGVLMTIFQFSSISPNAAKEFGLVSSVSVIFTLIPYLYTCAALLLLGHGHFRQEKLRYIVITFIAFAYCIWAVMGTGAEQVVWTLVVMMIVTAMYTFNYNTKHPAPFPLEKND

SEQ ID NO: 7951 - protein, 48 aa, Xenorhabdus bovienii
  Peptide sequence Name=Xb4151_4152.C435.gene27.pep
MHNCVEKSINQPTIDLKKGLIFQPPVIPQTDVNHFSPMGKEQDVLCCS

SEQ ID NO: 7952 - protein, 115 aa, Xenorhabdus bovienii
  Peptide sequence Name=Xb4151_4152.C435.gene28.pep
MAQGWDWRSPALLSALNSILLSWLGLSAGDFQASHSPEMGWYGRKMPVIFRFDIPQVALHVLPDVQSAMPAISAIIIVEATVVAPCFSSATTNGRSRRLTFATKCRSFPRNSMFS

SEQ ID NO: 7953 - protein, 148 aa, Xenorhabdus bovienii
  Peptide sequence Name=Xb4151_4152.C435.gene29.pep
  Gene classification: Gene name=IndA; Function=Uncharacterized enzyme involved in pigment biosynthesis; Function class=Q Secondary metabolites biosynthesis, transport and catabolism
  Homolog annotation: Query=7..144bp; Hit=173..310bp; Blast score=182; Percent Identity=65.0; E value=2e-46; Homolog= yeiN COG2313
LLKWRALPTEHLEAHGVPLVGYQTEKLPAFFCRTSPFPVSVTLENPRQIAQAMKAKWNSGLRGGLVIANPIPEPFAMSEVQINAAIEQAVRESQEQGIHGKESTPFLLTRVSELTGGEGLQANIELVFNNAKLAAQITIAYQAINKHQ

SEQ ID NO: 7954 - protein, 33 aa, Xenorhabdus bovienii
  Peptide sequence Name=Xb4151_4152.C435.gene30.pep
MFLFQAGIYFIVTLDKIYRMIFTDAYLLLDKQW

SEQ ID NO: 7955 - protein, 437 aa, Xenorhabdus bovienii
  Peptide sequence Name=Xb4151_4152.C435.gene31.pep
  Gene classification: Gene name=NupC; Function=Nucleoside permease; Function class=F Nucleotide transport and metabolism
  Homolog annotation: Query=20..436bp; Hit=1..416bp; Blast score=478; Percent Identity=71.0; E value=1e-135; Homolog= yeiJ COG1972
MVISLGIFLGWLKNNGNIMMDILRSLMGIVILLLVGYLFSVNKKIISLRTVVAALLLQVSLGAIMLYVPAGKWLIHNIANGVNAVIYYSSAGSSFIFGSLVGPKMNELFDGAGFVFAFQVLPAIIFITSLISILYYIGIMKWVINILGYAFQKAMRISKVEAFAAVTTIFLGQNELPAVLKPFVNKMNRNELFTVICSGMASIAGSMLVGYAGLGVPIEYLLAASLMAIPGGILFARLLSPATEPSQVQFEQISFSETRPASIIEAAAGGAMLGLKIAVGVATVVMAFVALIALLNGVIGGIGELFGLTGLSMQSLLGYLFSPLAYIMGVNWEHTDLAGSLIGQKLAINEFVAYVNFSPYLKDPAVLLDTKTIAVISFALCGFANFGSIAVVVGAFTAVVPERASDIARLGLRALLAATLSNLMSATIAGLFINLAG

SEQ ID NO: 7956 - protein, 33 aa, Xenorhabdus bovienii
  Peptide sequence Name=Xb4151_4152.C435.gene32.pep
MHAPIIQIPSLVDSPIVEGFSITYCELSNTSTC

SEQ ID NO: 7957 - protein, 142 aa, Xenorhabdus bovienii
  Peptide sequence Name=Xb4151_4152.C435.gene33.pep
  Gene classification: Gene name=UspA; Function=Universal stress protein UspA and related nucleotide-binding proteins; Function class= T Signal transduction mechanisms
  Homolog annotation: Query=1..142bp; Hit=1..142bp; Blast score=112; Percent Identity=43.0; E value=1e-25; Homolog= ZybdQ COG0589
MYRTILVPVDISEEELTSKAVRCALDIARETGAKLHILHVLPISSAIINAYALGYMEIKDKATVKAEKELSMLVDSIDLPNDRISYSISFGSPRDEITSTADEIEADLIVIGSRRPNITTHLLGSNSAGIVRYAKTSVLVVR

SEQ ID NO: 7958 - protein, 145 aa, Xenorhabdus bovienii
  Peptide sequence Name=Xb4151_4152.C435.gene34.pep
  Gene classification: Gene name=UspA; Function=Universal stress protein UspA and related nucleotide-binding proteins; Function class= T Signal transduction mechanisms
  Homolog annotation: Query=1..145bp; Hit=1..142bp; Blast score=113; Percent Identity=43.0; E value=8e-26; Homolog= ZybdQ COG0589
MYKAILVPIDIPEDQLTDNAIKHAEFLAKISGAKIHLFHAVPDISRFSVNYSYHYDLLSAFAKKAVTNSEEELKKVVEKINLPKDRVSFSVAFGSPREKVLSTAREIGADLIIVGSRRPDISTHLLGSNASGIVSYANISVLVVR

SEQ ID NO: 7959 - protein, 39 aa, Xenorhabdus bovienii
  Peptide sequence Name=Xb4151_4152.C435.gene35.pep
MRQELFPTLIYRYWLFDNYLVTCLKPCRELHGYLCLISK

SEQ ID NO: 7960 - protein, 62 aa, Xenorhabdus bovienii
  Peptide sequence Name=Xb4151_4152.C435.gene36.pep
MTISNKIKQPEQELLEVVRKYSGNEKVTIMTTNSSKNNLQIQVITAGKNQLDITLNSFTDQT

SEQ ID NO: 7961 - protein, 334 aa, Xenorhabdus bovienii
  Peptide sequence Name=Xb4151_4152.C435.gene37.pep
  Gene classification: Gene name=EndA; Function=Endonuclease I; Function class=L DNA replication, recombination and repair
  Homolog annotation: Query=29..236bp; Hit=27..226bp; Blast score=231; Percent Identity=57.0; E value=9e-61; Homolog= ZendA COG2356
LNSKISLWASYFLFFGLTISFNAWSAPTSFEQAKIESRKNVYSEQTKSEIGTLYCGCDWQWVGKSGGRVDLASCGYQVRSQQSRAERIEWEHMVPAWVFGHQRQCWQNGGRKNCVENDPFFRVIESDMHNLAPSIGEVNGDRSNFAYGMVPKNMANMYGACSSKVDFKSRLFEPRDRVKGVVARVYFYMHDRYNLAMSRQQQQLMMAWDRQYPVDGWERERDNKIARIMGHHNPFVTGSQKWELGHKNSGQGLSVQNGVQKQNSFQAVGNQAPVRNPTVKTAQSEKIKGNKNSQIYHFAHCSGYKTIADKNAVYFRTEAEAKKAGYRLAGHCKK

SEQ ID NO: 7962 - protein, 248 aa, Xenorhabdus bovienii
  Peptide sequence Name=Xb4151_4152.C435.gene38.pep
  Gene classification: Gene name=CutC; Function=Uncharacterized protein involved in copper resistance; Function class=P Inorganic ion transport and metabolism
  Homolog annotation: Query=1..243bp; Hit=1..242bp; Blast score=277; Percent Identity=55.0; E value=7e-75; Homolog= cutCm COG3142
MIKLEICCYSISCALVAQNAGADRIELSASPLEGGLTPSFGALQQSLQRLSIPVHPIVRPRGGDFCYNNMDFEVMKNDVARIRDMGFPGIVFGILSENGHIDRLRMRQLMSLSGNMAVTFHRAFDMCFNPHVALEQLTELGVQRILTSGQQQNAELGLTLLKELMQASCGPIIMPGAGVRVSNISKFLEAGMTEVHSSAGKIVPSTMKYRKAGVAMSSDDRDVDEYSHYSVDGELVESMKGVMNLIER

SEQ ID NO: 7963 - protein, 43 aa, Xenorhabdus bovienii
  Peptide sequence Name=Xb4151_4152.C435.gene39.pep
LKATLPHCVLFSLPASHNIEQILMSELSNMAVHTLISKISLSL

SEQ ID NO: 7964 - protein, 323 aa, Xenorhabdus bovienii
  Peptide sequence Name=Xb4151_4152.C435.gene40.pep
  Gene classification: Gene name=SmtA; Function=SAM-dependent methyltransferases; Function class=Q Secondary metabolites biosynthesis, transport and catabolism
  Homolog annotation: Query=1..323bp; Hit=1..323bp; Blast score=504; Percent Identity=74.0; E value=1e-143; Homolog= yecP COG0500
MIDFGNFYQLIAKHPLSHWLDSLPAQLSHWQKTSQHGQFSSWVKILENLPEIKPSHLDLKNGVIATHEPDLSKGEKARLHNILKILMPWRKGPFSLYDVEIDTEWRSDWKWERVLPHISPLEGKTVLDVGCGSGYHMWRMVGEGAQLVVGIDPTQLFLCQFEAVRKLLGNDQRAHLLPLGIEQLPELQAFDTVFSMGVLYHRRSPLDHLWQLKNQLVSDGELVLESLVIEGDENQCLIPGERYAQMRNVYFIPSAKMLKVWLEKCGFVDVRIVDHAATTPDEQRRTEWMKTESLVDFLDPSDHNKTIEGYPAPLRAVLIARKP

SEQ ID NO: 7965 - protein, 252 aa, Xenorhabdus bovienii
  Peptide sequence Name=Xb4151_4152.C435.gene41.pep
  Gene classification: Gene name=SmtA; Function=SAM-dependent methyltransferases; Function class=Q Secondary metabolites biosynthesis, transport and catabolism
  Homolog annotation: Query=8..251bp; Hit=2..245bp; Blast score=409; Percent Identity=77.0; E value=1e-114; Homolog= ZyecO COG0500
MSNQDPHNQRDSLFSAPIANLGDWSFDERVAEVFPDMVKRSIPGYSNIISMIGMLAGRFVTPGSQIYDLGCSLGAATLSIRRSINTDDCRIIAIDNSPAMIERCRRHIDSFKASTPVEVIEQNILDTDIQNASMVVLNFTLQFLPPDDRQKILRKIYAGLKPGGVLVLSEKFNFEDQKIGELLFNMHHDFKRANGYSELEVSQKRSMLENVMRTDSVDTHKSRLKEVGFQHVEVWFQCFNFGSLLAIKGTEQ

SEQ ID NO: 7966 - protein, 46 aa, Xenorhabdus bovienii
  Peptide sequence Name=Xb4151_4152.C435.gene42.pep
MQTLMYIMTPMHKKAHHYQGRYSSRLRFLLIIPFCPFPHSVRMPTS

SEQ ID NO: 7967 - protein, 132 aa, Xenorhabdus bovienii
  Peptide sequence Name=Xb4151_4152.C435.gene43.pep
  Gene classification: Function=Uncharacterized BCR related to glutathione S-transferase, MAPEG superfamily; Function class=R General function prediction only
  Homolog annotation: Query=1..129bp; Hit=11..139bp; Blast score=158; Percent Identity=65.0; E value=1e-39; Homolog= ZyecN COG3788
MVSSLYIVLGALLLIKLSLDVVKLRTQYRVAYGDGGFYELQTAIRVHGNAVEYIPISMLLLLMMEMNGAAVWMLHICGLLLLSGRILHYFGLRHREIRWRRMGMGATYISMIIMIITNIYYLPWEQIFSFYA

SEQ ID NO: 7968 - protein, 33 aa, Xenorhabdus bovienii
  Peptide sequence Name=Xb4151_4152.C435.gene44.pep
MGQAQLPTIISTHTISFYSARYAFCCGNFGIVL

SEQ ID NO: 7969 - protein, 589 aa, Xenorhabdus bovienii
  Peptide sequence Name=Xb4151_4152.C435.gene45.pep
  Gene classification: Gene name=AspS; Function=Aspartyl-tRNA synthetase; Function class=J Translation, ribosomal structure and biogenesis
  Homolog annotation: Query=1..586bp; Hit=1..586bp; Blast score=978; Percent Identity=79.0; E value=0; Homolog= ZaspS COG0173
MRTNYCGQLSLAHEGQKVTLCGWVNRRRDLGGLIFIDMRDREGIVQVFFDPDQKEAFAQASELRNEFCIQITGIVRARPDSQINKEMATGEVEVFADSLMVFNRSEPLPLDSNQNNSEEQRLKYRYLDLRRPEMSLRLKTRAKVTNFVRRFMDNAGFLDVETPMLTKATPEGARDYLVPSRVHKGKFYALPQSPQLFKQLLMMSGFDRYYQIVKCFRDEDLRADRQPEFTQIDVETSFMTAEQVREIMENMIRELWLDARNVDLGKFPIMTFAEAMRRFGSDKPDLRNPLELVDVADLVKNVEFAVFAEPANDPKGRVATICVPGGAELSRKQIDEYGKFVGIYGAKGLAWMKVNNRAAGLEGVQSPVAKFLSAEVVEGLLSRTNAQDGDILFFGADKKNVVTDAMGALRLKLGRDLNITDLASWKPLWVIDFPMFEDNGEGGLHAMHHPFTSPCDMSATELEHDPESAIANAYDMVINGYEVGGGSVRIHRNEMQQVVFRILGITEEEQQEKFGFLLNALKYGTPPHAGLAFGLDRLVMLLTDTDNIRDVIAFPKTTAAACLMTEAPSYANPASLEELAISVVKKESE

SEQ ID NO: 7970 - protein, 144 aa, Xenorhabdus bovienii
  Peptide sequence Name=Xb4151_4152.C435.gene46.pep
  Gene classification: Gene name=MutT; Function=NTP pyrophosphohydrolases including oxidative damage repair enzymes; Function class=L DNA replication, recombination and repair
  Homolog annotation: Query=3..144bp; Hit=6..147bp; Blast score=193; Percent Identity=68.0; E value=4e-50; Homolog= ntpA COG0494
MDYKRPESVLVVIYAATSKRVLMLQRRDDPEFWQSVTGSLEGNEKPWEAALREVQEEIGIDIINAGFELTDCQRCLYYEIFSHLRYRYAPGVTRNKEHWFLLVLPEEREILLTEHLAYQWLAVEEAARLTKSWSNRQAIEEFVI

SEQ ID NO: 7971 - protein, 247 aa, Xenorhabdus bovienii
  Peptide sequence Name=Xb4151_4152.C435.gene47.pep
  Gene classification: Function=Uncharacterized ACR; Function class=S Function unknown
  Homolog annotation: Query=1..247bp; Hit=1..246bp; Blast score=385; Percent Identity=83.0; E value=1e-107; Homolog= yebC COG0217
MAGHSKWANTKHRKAAQDSKRGKIFTKIIRELVTAARLGGGDPASNPRLRAAVDKALSNNMTRDTLNRAIARGVGNDDADNMETIIYEGYGPGGTAVMVECLSDNRNRTVSDVRHAFTKTGGNLGTDGSVSYLFTKKGVISYAPGLDEDAVMEAALEAGADDVETYDDGAIDVYTTPESFGDVKDALDAAGFKAESAEVSMIPSTNAELDAETAPKLLRLIDMLEDSDDVQEVYHNGEISDEIAAQL

SEQ ID NO: 7972 - protein, 46 aa, Xenorhabdus bovienii
  Peptide sequence Name=Xb4151_4152.C435.gene48.pep
MKLQRSCNYHQGSQRRESVPYLRALSLTFLSHITGGINRYGDYSWY

SEQ ID NO: 7973 - protein, 173 aa, Xenorhabdus bovienii
  Peptide sequence Name=Xb4151_4152.C435.gene49.pep
  Gene classification: Gene name=RuvC; Function=Holliday junction resolvasome endonuclease subunit; Function class=L DNA replication, recombination and repair
  Homolog annotation: Query=1..173bp; Hit=1..173bp; Blast score=251; Percent Identity=82.0; E value=3e-67; Homolog= ruvC COG0817
MAIILGIDPGSRVTGYGVIRQQGRQLIYIGSGCIRTKVDDLPNRLQRIYAGITEIIIQFRPDVFAIEQIFMAKNADSALKLGQARGVAIVAAANESIPVFEYAARQVKQTVVGTGAAEKSQVQHMVRSMLKLSANPQADAADALAIAITHCHLNQNLLRVGDVRLNLTRGRLK

SEQ ID NO: 7974 - protein, 205 aa, Xenorhabdus bovienii
  Peptide sequence Name=Xb4151_4152.C435.gene50.pep
  Gene classification: Gene name=RuvA; Function=Holliday junction resolvasome DNA-binding subunit; Function class=L DNA replication, recombination and repair
  Homolog annotation: Query=1..205bp; Hit=1..203bp; Blast score=295; Percent Identity=74.0; E value=3e-80; Homolog= ruvA COG0632
VIGRLRGTVLEKQPPLVLLETNGVGYEVHMPMTCFYELPEIGQEATLFTQFIVREDAQLLYGFNDKQERALFRELIKVNGVGPKLALAILSGMSAQQFVTAIEQEAITSLVKLPGVGKKTAERLVVEMKDRFKGLNGDLFNQSNDINLPAVAKQANSNTDIEAEAASALVSLGYKLQEASRMVSKVAKPGADCETLIREALRAAL

SEQ ID NO: 7975 - protein, 335 aa, Xenorhabdus bovienii
  Peptide sequence Name=Xb4151_4152.C435.gene51.pep
  Gene classification: Gene name=RuvB; Function=Holliday junction resolvasome helicase subunit; Function class=L DNA replication, recombination and repair
  Homolog annotation: Query=1..331bp; Hit=1..331bp; Blast score=536; Percent Identity=83.0; E value=1e-152; Homolog= ruvB COG2255
MIEADRLISAEVLQDDEVIDRAIRPKLLSEYVGQPHVCEQMEIFIQAARQRGDALDHLLIFGPPGLGKTTLANIVANEMGVNLRTTSGPVLEKAGDLAAMLTNLEPHDVLFIDEIHRLSPVVEEILYPAMEDYQLDLMIGEGPAARSIKIDLPPFTLVGATTRAGSLTSPLRDRFGIVQRLEFYNVDDLQSIVSRSARYMGLGISEEGARQIAMRSRGTPRITNRLLRRVRDFSQVKGDGSINGDIAVQALDMLSVDSAGFDYLDRKLLIAIIDKFMGGPVGVDNLAAAIGEERETIEDVLEPFLIQQGFIQRTPRGRIATNHAYRHFGLSKEAE

SEQ ID NO: 7976 - protein, 53 aa, Xenorhabdus bovienii
  Peptide sequence Name=Xb4151_4152.C435.gene52.pep
LVAKSWNVCAIRRGNSAEISLKASIRRKTNMANMSSEYLDKVLIAGFQVLSEK

SEQ ID NO: 7977 - protein, 46 aa, Xenorhabdus bovienii
  Peptide sequence Name=Xb4151_4152.C435.gene53.pep
MVLNQPKIYLFVYLCDPRQITSFKDFLSKQGINEFIISSTKYLKLI

SEQ ID NO: 7978 - protein, 218 aa, Xenorhabdus bovienii
  Peptide sequence Name=Xb4151_4152.C435.gene54.pep
  Gene classification: Gene name=OmpW; Function=Outer membrane protein W; Function class=M Cell envelope biogenesis, outer membrane
  Homolog annotation: Query=5..218bp; Hit=1..212bp; Blast score=248; Percent Identity=57.0; E value=3e-66; Homolog= ompW COG3047
MGWIMKKISALVLAAATLAPSLTFAHEAGDFLFRAGTATVRPNAGSDDVLGQGSFGVNNNTQLGLTFGYMITDNIGVELLAATPFQHRVNLPKAGDVAKVKHLPPTLMAQYYFGAKENNLRPYVGVGVNYTTFFSEKFNDNNATVEAAKLNSLDLKDSWGIAGQVGLDYQLDKNWILNTSLWWVNIETDVRFKAGDAEQKYKTRLDPWVFMFGVGYKF

SEQ ID NO: 7979 - protein, 40 aa, Xenorhabdus bovienii
  Peptide sequence Name=Xb4151_4152.C435.gene55.pep
VRKSTCFDPQWRYRHCGSKIQQGFHLGRVVSGRERNNTLS

SEQ ID NO: 7980 - protein, 391 aa, Xenorhabdus bovienii
  Peptide sequence Name=Xb4151_4152.C435.gene56.pep
  Gene classification: Function=Zn-dependent dipeptidase, microsomal dipeptidase homolog; Function class=E Amino acid transport and metabolism
  Homolog annotation: Query=182..391bp; Hit=95..311bp; Blast score=90; Percent Identity=30.0; E value=3e-18; Homolog= APE0337 COG2355
MTRREKIILTSTGVGIIIGVCALIFFFVLPRLVETRMNRVIGVTDVATQTAVDLHKRLLIADLHADTLLWGRDLLDRSTRGQVDIPRLIDGNVAVQVFAVVSKSPRGLNIEKNSAETDDVTLLALAQCWPWRTLFSLKERALYQAARLHEAAARSNGKLVVIKSRADLKAFLERRRSDPKIVGVLLASEGAQVLEGDPTNVDVLFEAGYRMMAPTHFFDTEFGGSAHGIEKGGLTAAGADMVRRMEAKSMIIDLAHASTKTIDDILVIATRPVVVSHTGVKGTCDNIRNLSDDQLRRIAAMGGLIGIGFWDKAVCDPTPTGIAKAQIYAANIAGDDHVALGSDFDGAVEMPFDATGLVSITDALLKNGAHPERIAKLMGENQIRFLLENLP

SEQ ID NO: 7981 - protein, 104 aa, Xenorhabdus bovienii
  Peptide sequence Name=Xb4151_4152.C435.gene57.pep
  Gene classification: Gene name=OsmY; Function=Predicted periplasmic or secreted lipoprotein; Function class=R General function prediction only
  Homolog annotation: Query=27..104bp; Hit=45..122bp; Blast score=58; Percent Identity=41.0; E value=1e-09; Homolog= ZosmY COG2823
MKLLKVVSTFFVTAVMAMTISACAPTATTESTGNYIDDTVITAKVKSALLEANNLKSREISVETFKGRVQLSGFVSSPEDVTRAIQITRGIKGVNTVINSIKLR

SEQ ID NO: 7982 - protein, 57 aa, Xenorhabdus bovienii
  Peptide sequence Name=Xb4151_4152.C435.gene58.pep
MFIYRNIILIFTLSIMPLCHTRTQKVLLKTGKSTNDRGKYLFSDGERLAAIASPIIY

SEQ ID NO: 7983 - protein, 268 aa, Xenorhabdus bovienii
  Peptide sequence Name=Xb4151_4152.C435.gene59.pep
  Gene classification: Gene name=TrpA; Function=Tryptophan synthase alpha chain; Function class=E Amino acid transport and metabolism
  Homolog annotation: Query=1..267bp; Hit=1..267bp; Blast score=360; Percent Identity=70.0; E value=1e-100; Homolog= trpA COG0159
MERYEQLFKKLENQNQGAFVPFVTLGDPNPELSLEIIDALIAGGADALELGIPFSDPLADGPTIQNANLRALSSNVTSALCFELLSQIRTKYPDIPIGLLMYANLVFHNGIDEFYRCCKNAGVDSVLIADVPLSESRNFRSAALKYDIAPIFICPPNADDDLLREIAVCGRGYTYLLSRAGITGTQNRAEYPLTHLVNKLKEYHAAPALQGFGISEPAQVTSVLDSGAAGAISGSAVVKIIEDNLNQPQIMLEKLETFVRTMKTATQR

SEQ ID NO: 7984 - protein, 400 aa, Xenorhabdus bovienii
  Peptide sequence Name=Xb4151_4152.C435.gene60.pep
  Gene classification: Gene name=TrpB; Function=Tryptophan synthase beta chain; Function class=E Amino acid transport and metabolism
  Homolog annotation: Query=8..400bp; Hit=5..397bp; Blast score=695; Percent Identity=85.0; E value=0; Homolog= trpB COG0133
MMRIMSKLNPYFGDFGGQFVPQILIPALDQLEEVFIEAQNDPEFQQTFQDLLKNYAGRPTALTLCQNLTKGTKSRLYLKREDLLHGGAHKTNQVLGQALLAKRMGKNEIIAETGAGQHGVATALACALLGLKCRIYMGAKDIERQSPNVFRMRLMGAEVIPVHSGAATLKDACNEAMRDWAGCYDKAHYLLGTAAGPHPYPTIVREFQRMIGEEAKAQIMEKEGRLPDAVIACIGGGSNAIGLFAEFIPETNVRLIGVEPAGHGIETGEHGAPLKHGKLGIYFGMKSPIMQTEDGQIEESYSISAGLDFPSVGPQHAYLNNIGRADYVSVTDDEAIDAFKALSHNEGIIPALESSHALAHALKMIHQAPDKEQLLIVNLSGRGDKDIFTVHDILQSRGEI

SEQ ID NO: 7985 - protein, 454 aa, Xenorhabdus bovienii
  Peptide sequence Name=Xb4151_4152.C435.gene61.pep
  Gene classification: Gene name=TrpC; Function=Indole-3-glycerol phosphate synthase; Function class=E Amino acid transport and metabolism
  Homolog annotation: Query=1..254bp; Hit=1..254bp; Blast score=337; Percent Identity=66.0; E value=2e-92; Homolog= ZtrpC_1 COG0134
MKNNILQKIVDDKAAYLAKRKAEQPLESFIDSLVPSHRQFYQALSHKQTVFILECKKASPSKGLICTDFDPVRIAKTYQPYAAAISVLTDEKYFQGNYDFLRMVSSAVHQPVLCKDFIIDAYQVYLARYYQADAILLMLSVINDETYRELSALAHSLDMGVLTEVSTEDERRRAIVLGAKVIGINNRDLRDLSIDLDRTRRLATDLPEGTIIISESGISQHQQVRELSRFAHGFLIGSALMVQSDLDLALRRLILGDNKICGLTRPQDAKTALQAGAVYGGLIFAEKSPRKINLQQAQQIINEAPLQYVGVFQNQPLDFVSGIARQLSLNAVQLHGNEDKNYINALRPLLPEYCEIWKAIDMSKATEFSEISNIDHLLLDNGAGGTGKTFDWQSIDQRFQRNSMLAGGLNPENCQQAAALGCYGLDFNSGVETSVGIKNSQKIKLIFQQLRCYH

SEQ ID NO: 7986 - protein, 332 aa, Xenorhabdus bovienii
  Peptide sequence Name=Xb4151_4152.C435.gene62.pep
  Gene classification: Gene name=TrpD; Function=Anthranilate phosphoribosyltransferase; Function class=E Amino acid transport and metabolism
  Homolog annotation: Query=1..331bp; Hit=4..334bp; Blast score=436; Percent Identity=73.0; E value=1e-122; Homolog= trpD_2 COG0547
MQLIFEKLFSAQTLTQQESQQLFTAIVCGELSDAQLAAVLVSMKLHGEQPQEIAGAAQALLANASPFPRPDYTFCDIVGTGGDGTNSINISTTSAFVAAACGLKVAKHGNRSTSSRSGSSDLLTAFGIALNASAEDSRSALDEIGVCFLFAPQYHSGFRHVVQVRQQLKVRTLFNVLGPLINPARPPLTLIGVYSPELVAPIAHTLQVLGYQRAAVVHSGGMDEVALHAPTLVAELNHGEIIQYQLTAKDFGLPNYPISSLKGGSPEENCDMLRLLLQGRGQKAHVDAVAANVALLMKVHGQENLRENTQLALNTIYSGQAYEKVTALAARI

SEQ ID NO: 7987 - protein, 192 aa, Xenorhabdus bovienii
  Peptide sequence Name=Xb4151_4152.C435.gene63.pep
  Gene classification: Gene name=PabA; Function=Anthranilate/para -aminobenzoate synthases component II; Function class=E Amino acid transport and metabolism
  Homolog annotation: Query=1..192bp; Hit=1..192bp; Blast score=271; Percent Identity=67.0; E value=3e-73; Homolog= trpD_1 COG0512
MANILLLDNVDSFTYNLVDQLRVGDHQVVIYRNTVSTETIMAQLSQMKSPLLMLSPGPGKPADAGCMPQLLKRIISQIPVIGICLGHQAIIEAYGGTISAAREILHGKSTLATHDGQAMFSGLINPLPVARYHSLTGINIPDTLVVSASCGDTVMAVRHDRHKVCGFQFHPESILTTQGAKLLEQTLAWVQE

SEQ ID NO: 7988 - protein, 519 aa, Xenorhabdus bovienii
  Peptide sequence Name=Xb4151_4152.C435.gene64.pep
  Gene classification: Gene name=TrpE; Function=Anthranilate/para -aminobenzoate synthases component I; Function class=E Amino acid transport and metabolism
  Homolog annotation: Query=17..519bp; Hit=17..520bp; Blast score=653; Percent Identity=65.0; E value=0; Homolog= ZtrpEm COG0147
MTDLNLKISIKQVDTVYQTDPTLLFNQLCGNRSATLLLESAEISSKKNLKSLLIIDSAMRITANEQQVTFEALTENGRNLLPILTDLLSAKAQLHVGLHILQAQFPATRHNLDEDSRLKADSIFDALRALMTLSSLSGTPDAIFVGGLFAYDLVAGFEPLPKVKTHQRCPDFCFYLAEMLLVVDHRNKHAFLQTSLFGESDSEKQRLHDRLTTLTAAILEPGQPLESVKLPDMTIACNQSDDQYADIVQQLQQSIRQGDIFQAVPSRRFTLPCPSPLNAYQTLKHQNPSPYMFFMQDQDFCLFGASPESALKYDTSSRQIEIYPIAGTRPRGRNANGTLDADLDSRIELEMRTDAKELSEHLMLVDLARNDLARICEPGSRYVADLTKVDRYSFVMHLVSRVVGTLRHDLDVFHAYQACMNMGTLTGAPKVRAMQLIAQHEGERRGSYGGAVGYFTGKGDFDTCIVIRSAYVENGIAVVQVGAGIVLDSIPESEIDETHSKARAVIRAIIQAHKAEVIF

SEQ ID NO: 7989 - protein, 54 aa, Xenorhabdus bovienii
  Peptide sequence Name=Xb4151_4152.C435.gene65.pep
MIDKRILIQFTSTKVGRNTWPLFHLTNEALEMIILMKAIRWWQNFPFRAVESRT

SEQ ID NO: 7990 - protein, 65 aa, Xenorhabdus bovienii
  Peptide sequence Name=Xb4151_4152.C435.gene66.pep
VIKLHLKRLYGYVNHSALSCHWLRSSPSNPQSYSSPYSIPLHSIFLIWFINRIFSTNTLFLYIFH

SEQ ID NO: 7991 - protein, 285 aa, Xenorhabdus bovienii
  Peptide sequence Name=Xb4151_4152.C435.gene67.pep
  Gene classification: Function=Predicted metal-dependent phosphoesterases (PHP family); Function class=R General function prediction only
  Homolog annotation: Query=11..285bp; Hit=10..284bp; Blast score=358; Percent Identity=63.0; E value=4e-99; Homolog= ZyciV COG0613
MTVTNDMIKRYDLHSHTTASDGVLSPEQLVDRAVSMGINVLAITDHDTTDGIPPARVYIQQQNLPLSLVAGVEISTLWENFEIHIVALNIDTDCVFLTNFLSNQVTLRKQRGIEIGQRLAKVGIPDAWEGASRLANGGQVTRGHFARYLIEAGVEPTIPKVFKKYLAKGKIGYVPAQWCTIEQAIETIHQAGGQAVIAHPGRYDLSMKWLKRLIAWFQQHGGDAMEVAQCQQAPNERQQLGQLAKEYGLKVSLGSDFHQPCSWIELGRNLWLPGDVIPIWHDWSR

SEQ ID NO: 7992 - protein, 184 aa, Xenorhabdus bovienii
  Peptide sequence Name=Xb4151_4152.C435.gene68.pep
  Gene classification: Gene name=SUA5; Function=Putative translation factor (SUA5); Function class=J Translation, ribosomal structure and biogenesis
  Homolog annotation: Query=1..184bp; Hit=35..218bp; Blast score=292; Percent Identity=75.0; E value=1e-79; Homolog= yciO COG0009
MLKKGGVVIYPTDSGYAIGCCLENKDAMTRICRIRQLDGRHNFTLMCRDLSEIATYAHVDNQAFRLIKNNTPGNYTFILQATKDVPRRLMNEKRKTIGLRVPSNPIALALLEGMREPLMSCSLILPGNDFAESDPEEIKDVLGKQVDLIIHGGYLGQQPTTVIDLTGDSPAVLREGEGDVTPFL

SEQ ID NO: 7993 - protein, 317 aa, Xenorhabdus bovienii
  Peptide sequence Name=Xb4151_4152.C435.gene69.pep
  Gene classification: Gene name=RsuA; Function=16S rRNA uridine-516 pseudouridylate synthase and related pseudouridylate synthases; Function class=J Translation, ribosomal structure and biogenesis
  Homolog annotation: Query=14..299bp; Hit=2..287bp; Blast score=446; Percent Identity=80.0; E value=1e-125; Homolog= yciL COG1187
MSDKTQKTQKTERTEKLQKILARAGHGSRREIEGYIQEGRISIDGKTATLGDRIEVKPSIKIRLDGRILSIKEPQKTICRVLAYYKPEGELCTRHDPEGRPTVFDRLPKMQDARWIAVGRLDINTCGLLLFTTDGELANRLMHPSREVEREYAVRVFGEVDNAKLRQLTQGVQLEDGPASFKTVSFKGGEGINQWYNVTLTEGRNREVRRLWEAVGVQVSRLIRVRYGDIDLPKGLPRGGWTELGLEQTNYLRQLVDLNEETMSKVAVERDQRRIKANQIRRAVKRHSQVGSSRPAGKRPASSSRQNAGRKAAPKGR

SEQ ID NO: 7994 - protein, 38 aa, Xenorhabdus bovienii
  Peptide sequence Name=Xb4151_4152.C435.gene70.pep
MQEEKRHLKVVNVPESLFQCYIKAGTAAFYLSYQSTPF

SEQ ID NO: 7995 - protein, 198 aa, Xenorhabdus bovienii
  Peptide sequence Name=Xb4151_4152.C435.gene71.pep
  Gene classification: Gene name=BtuR; Function=ATP; Function class=H Coenzyme metabolism
  Homolog annotation: Query=3..198bp; Hit=1..196bp; Blast score=290; Percent Identity=70.0; E value=5e-79; Homolog= ZbtuR COG2109
MPMDNGQYKKRQQRLKEKVDARIEAAQQKRGIVIIFTGNGKGKTTAAFGTVTRTIGHGQRAGVIQFIKGTWESGERNLLAQQGVEFHVMATGFTWETQNRETDIAACQAVWQHALTMLSDSSLQLVVLDELTYMVSYKYLDLIDVLTALKQRPIHQSVIITGRGCHRELLELADTITEMRPVKHAFDAGIKAQKGVDW

SEQ ID NO: 7996 - protein, 124 aa, Xenorhabdus bovienii
  Peptide sequence Name=Xb4151_4152.C435.gene72.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=1..121bp; Hit=130..249bp; Blast score=176; Percent Identity=75.0; E value=5e-45; Homolog= ZyciK COG1028
MLTQVLIPLLLKSPKGSLVFTSSSVGRVGRSGWGAYAVSKFATEGLMQVLAQEYQEIGLRINCINPGGTRTGMRASAFPDENATKLKIPAEIMPIYLYLMGDDSLSDSGISFDAQPGRKAGPAK

SEQ ID NO: 7997 - protein, 95 aa, Xenorhabdus bovienii
  Peptide sequence Name=Xb4151_4152.C435.gene73.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=2..48bp; Hit=75..121bp; Blast score=62; Percent Identity=59.0; E value=7e-11; Homolog= yciK COG1028
VTAEECQAFADELTQRYPRLDGVLHNAGLLGVVAPVLEQPVQLWHEVMPSECQRDFHADSGVNSPVIKIPQRLSGIYQFQCGACRKEWLGCICCF

SEQ ID NO: 7998 - protein, 97 aa, Xenorhabdus bovienii
  Peptide sequence Name=Xb4151_4152.C435.gene74.pep
  Gene classification: Gene name=FabG; Function=Dehydrogenases with different specificities (related to short-chain alcohol dehydrogenases); Function class=Q Secondary metabolites biosynthesis, transport and catabolism
  Homolog annotation: Query=29..94bp; Hit=1..64bp; Blast score=73; Percent Identity=60.0; E value=5e-14; Homolog= yciK COG1028
MTDFMCQPKMADVHALSNSFKKQEDSQMLDYQPNHDLLQQKIILVTGAGDGIGREAALTYARYGAQVILLGRTTAKLESGQTANRKRRRLTRLPFIQ

SEQ ID NO: 7999 - protein, 348 aa, Xenorhabdus bovienii
  Peptide sequence Name=Xb4151_4152.C435.gene75.pep
  Gene classification: Gene name=SppA; Function=Periplasmic serine proteases (ClpP class); Function class=N Cell motility and secretion
  Homolog annotation: Query=1..347bp; Hit=1..348bp; Blast score=392; Percent Identity=61.0; E value=1e-109; Homolog= ZsohB COG0616
VEYLSLYGLFLAKVATVVLAVVVLAVFCIGLGVRKTTQKGELRLTNLGESYREKQRQMQQARMNDAEQKIWQKALKKQQKNDAKQKKAEAKASQKVLQKSNLYVLDFKGSMDAHEVDSLREEISAILAVADSKDEVLLRLESPGGMVHGYGLAASQLARLRQKGIRLTIAVDKVAASGGYMMACVADRIIAAPFAIIGSIGVVAQLPNIHRLLKKNDIDVELHTAGEYKRTLTVLGENTEQGRQKFQEDLNETHQLFKSFIYQHRPSLDVEKVATGEYWYGTQAKENGLIDDVGVSDDFLIEQIEHCEVIGVSYSRRKRVIERFMGSAMENVDKLFMRWWQRGEKPLF

SEQ ID NO: 8000 - protein, 65 aa, Xenorhabdus bovienii
  Peptide sequence Name=Xb4151_4152.C435.gene76.pep
LNSDNLSTVKSTVAFNIFKHLAHRLSEKYHLADDKFDQVISNRLFIIVRVIREIQTATLLPFIVL

SEQ ID NO: 8001 - protein, 42 aa, Xenorhabdus bovienii
  Peptide sequence Name=Xb4151_4152.C435.gene77.pep
MQLYDLTVVNKIFHLHDEKPTLYLIKNDAQQLISQRSIIYAN

SEQ ID NO: 8002 - protein, 863 aa, Xenorhabdus bovienii
  Peptide sequence Name=Xb4151_4152.C435.gene78.pep
  Gene classification: Gene name=TopA; Function=Topoisomerase IA; Function class=L DNA replication, recombination and repair
  Homolog annotation: Query=1..590bp; Hit=1..592bp; Blast score=971; Percent Identity=80.0; E value=0; Homolog= ZtopA_1 COG0550
MGKALVIVESPAKAKTINKYLGNDYVVKSSVGHIRDLPTSGAASQKSSNSSTDKNKKKKDEKTALVNRMGVDPYHGWEADYQILPGKEKVVAELKMLAEKADHIYLATDLDREGEAIAWHLREVIGGGEARFSRVVFNEITKNAITQAFDNPGELNIDRVNAQQARRFMDRVVGYMVSPLLWKKVARGLSAGRVQSVAVRLIVEREREIKAFVPEEYWQLHADLMAKGDIDLHMEVTHEGGKPFKPINAQQTQAAVSLLEKARYKVLDREDRPTSSKPGAPFITSTLQQAASTRLGFGVKKTMMMAQRLYEAGHITYMRTDSTNLSQDALDMVRGYINDQFGDKYLPKTANIYSNKENSQEAHEAIRPSSVDVMAEELKDMEADAQKLYQLIWRQFIACQMMPAKYDSTTLTIQAGNFELRAKGRTLRFDGWTKVMPALRKGDEDHTLPVVEVGTELDLKQLSPSQHFTKPSARFSEASLVRELEKRGIGRPSTYASIISTIQDRGYVRGENRRFYAEKMGEIVNDRLEENFNELMSYDFTARMEDQLDHVANNEANWKGVLDEFFTNFSEQLDVASKDPDEGGMRPNPMVSTSIDCPTCSRPMGIRTATTGVFLGCSGYTLSPKERCKQTINLIPENEILNILEGDEAETNALRARHRCKECGTAMDSYLIDNQRKLHVCGNNPACDGYEVEEGEFRIKGYDGPIVECDKCGSEMHLKMGRFGKYMGCTSEECKNTRKILRSGEVAPPKEDPVPLPELPCEKSDAYFVLRDGAAGVFLAASTFPKSRETRAPLVEELVKFKDRLPEKLCYLAKAPVADPEGHKTVVRFSRKTKQQYVSSEKNGKATGWAAFFVDGAWVVKEK

SEQ ID NO: 8003 - protein, 37 aa, Xenorhabdus bovienii
  Peptide sequence Name=Xb4151_4152.C435.gene79.pep
MITIIIHLLQKYYVLIPYKNKKSQSIRTGFLEKKLCC

SEQ ID NO: 8004 - protein, 37 aa, Xenorhabdus bovienii
  Peptide sequence Name=Xb4151_4152.C435.gene80.pep
MFCSLNMFYIANGYFLITIKNIYLWVYNYYITCCIFI

SEQ ID NO: 8005 - protein, 324 aa, Xenorhabdus bovienii
  Peptide sequence Name=Xb4151_4152.C435.gene81.pep
  Gene classification: Gene name=LysR; Function=Transcriptional regulator; Function class=K Transcription
  Homolog annotation: Query=1..322bp; Hit=1..322bp; Blast score=558; Percent Identity=84.0; E value=1e-159; Homolog= cysB COG0583
MKLQQLRYIVEVVNHNLNVSSTAEGLYTSQPGISKQVRMLEDELGIQIFARSGKHLTHVTPAGEEVVRISREVLSKIESIRSVASEHTYPDRGSLYIATTHTQARYALPPVIKGFIERYPNVSLHMHQGSPTQIAEEVCKGNSDFAIATEALHLYSDLIMLPCYHWNRSVVVTKDHPLAARQNVTIEELAEYPIVTYTFGFTGRSELDVAFDQAGLKPKIVFTATDADVIKTYVRLGLGVGVIASMAVEPVQDSDLVRIDMRDKFSYSTTKIGFRRSSFLRSYMYDFIWRFAPHLTRDVVDKAIALRSNEEIEDMFKDIELPIA

SEQ ID NO: 8006 - protein, 47 aa, Xenorhabdus bovienii
  Peptide sequence Name=Xb4151_4152.C435.gene82.pep
LSDTRIFLKIITYCNNQISNFNCHSNYTLNSPLKKLSEFSIDDFLLL

SEQ ID NO: 8007 - protein, 273 aa, Xenorhabdus bovienii
  Peptide sequence Name=Xb4151_4152.C435.gene83.pep
  Homolog annotation: Query=1..271bp; Hit=1..272bp; Blast score=239; Percent Identity=47.0; E value=3e-62; Homolog= gi|37526328|ref|NP _929672.1| hypothetical protein [Photorhabdus luminescens subsp. laumondii TTO1] gi|36785759|emb|CAE14807.1|
MDIKVDKNRQHYLNHIAQAEQFFSDGIENNFPLSDHQFSDIDGLVQFVITSQINDKSGVIQRLNEIKRTQISLSSIATDYIIKYANTHGQQYRTDVQFWGDIIEKLPLMSVRNIESQTYSHVMKGFSIATNLLQLIMDIVLNTNSSSMKSFSQFLQKQGDTIRLGLKKNNDHYSTLTLASVIEAIGVEDQVIYIPKMKLYKVNFDRSNSEIASNCASNDNINVEFTYSSCVSLFDYQALEDPEIKASFDLFIHNNKKSSIENSDNFFNGEFKV

SEQ ID NO: 8008 - protein, 905 aa, Xenorhabdus bovienii
  Peptide sequence Name=Xb4151_4152.C435.gene84.pep
  Gene classification: Gene name=AcnA; Function=Aconitase A; Function class=C Energy production and conversion
  Homolog annotation: Query=15..905bp; Hit=1..891bp; Blast score=1357; Percent Identity=74.0; E value=0; Homolog= acnA COG1048
MFNGVADHNKKGGVMSFKLKTDCASTLSIGSKIYHYYSLSLLSERLGEIARLPKSMKVLLENLLRNIDGDSVVEEDLKALVEWQKNGHADREIAYRPARVLMQDFTGVPAVVDLAAMREAVLRLGGNVEQVNPLSPVDLVIDHSVMVDKFGTEQAFEENVQIEMERNYERYLFLRWGQKAFNRFRVVPPGTGICHQVNLEYLGKSVWYENQNGKDFAYPDTLVGTDSHTTMINGLGVLGWGVGGIEAEAAMLGQPVSMLIPDVVGFKLTGKLREGITATDLVLTVTQMLRKHGVVGKFVEFYGDGLSDLPLADRATIANMAPEYGATCGFFPVDDITLGYLRLTGRNKDEIALVEAYCKKQGLWRNAGDEPIFTNNLELDMYTVEVSLAGPKRPQDRVALGDVPHAFQAAMELDIHKIQEHRADTPVTLDNQTFALQDGAVVIAAITSCTNTSNPSVLMTAGLLAKKAIEKGLQRQPWVKTSLAPGSKVVTGYLELAGLMPYLEKLGFNLVGYGCTTCIGNSGPLPEPIEVAIKQSDLMVGAVLSGNRNFEGRIHPLVKTNWLASPPLVVAYALSGNMKKDLTREPLGQDQQGHDIYLQDIWPDSQEVAEAVGKVRTEMFHKEYNAVFDGDENWQSLEVESSETYSWQQNSTYIRLPPFFSDMTIEPKPITDIHQANILVILGDSVTTDHISPAGNIKADSPAGRYLQEHGVLPKDFNSYGSRRGNHEVMMRGTFANIRICNEMVPGVEGGYTRHIPSQAQLAIYDAAMLYQEDKTPLAIIAGKEYGSGSSRDWAAKGTRLLGARVVIAESFERIHRSNLIGMGVLPLEFPQGVSRKTLNLTGDERIDIVGLGHIEPGQIIAVKINYANGKETVIDARCRIDTNTELAYFYNDGILHYVIRNMLK

SEQ ID NO: 8009 - protein, 45 aa, Xenorhabdus bovienii
  Peptide sequence Name=Xb4151_4152.C435.gene85.pep
MVKSFSVMGITDSDFPMSSIIGRANLLLTTSAGGGFQLRIKTASV

SEQ ID NO: 8010 - protein, 58 aa, Xenorhabdus bovienii; identical to SEQ ID NO: 7000
  Peptide sequence Name=Xb4151_4152.C435.gene86.pep
  Gene classification: Function=Predicted transposase; Function class=L DNA replication, recombination and repair
  Homolog annotation: Query=20..58bp; Hit=1..39bp; Blast score=58; Percent Identity=61.0; E value=1e-09; Homolog= VCA0493 COG1943
